United States Patent 7,745,391 (HUMAN THROMBOSPONDIN POLYPEPTIDE) - sequence listing, part 223

SEQ ID NO: 576452 - DNA, 388 bp, Homo sapiens
aaggctgaataatattctgttgtgtgtatataccacattttctttatccgttcatccatttatgaacacttagtttcatttccagaccttggctattgttaataatgctgcagtgaacacaggagtgtgaatttgtctttgagatcctgatttcaattcttttggataaatacccagagtaggattgttggatcatatggcgattctatatttaatttagttttggaaacttctgttgtgtttttcttagtgaaacactattttgcattctcaccaacagtgtacaagggttccaatttctccgtatccttaccaagacttgttatctttttttttttttttttttttgattcagaaatatatgaaatctgcatagtcttaatttgta

SEQ ID NO: 576453 - DNA, 341 bp, Homo sapiens
actgctctcgtggtgaacatctgtacttcggagtagtagagcccttactgtctctgtagctgggagacttggtatccattcctgcaatggactgattctgcatttgctgacgtaggagcttttgctgaagtggccaaggtgaccttagcacaggctggcttggtagagattgggcaggctgagcagatggttgttgctgctgctgctgctgctgttgtctgctgttgttgttgctgctgctgctgctgttgttgctgctgctgctgatgttgggctgcccttgagctctgctgctgttgctgtagttgcgctgcacttgaactctgctgttgtctgctggt

SEQ ID NO: 576454 - DNA, 202 bp, Homo sapiens
tctagagcgtaaaaggacgcccagggagacgtaaaaacaaaaaacaggatataggcaggaaacacaaattctgagggagaggaaagggacagttgagtaagacgtctgggggaactgagaagcctgaggtgatgggagctctgccttaggcctcctcttcggcctcctcaccgaaatcctgctactcgtcttgcgggtgctg

SEQ ID NO: 576455 - DNA, 275 bp, Homo sapiens
  misc_feature (20)..(20): n is a, c, g, or t
  misc_feature (37)..(37): n is a, c, g, or t
ccaatccagtttcatcaganatcacattcataccccnaagtggtttttcaaatgaattcatatcccaaatccacatgtcccacatctcggctacgggcagggccgggccaggccgagaggtgcccccgaccctgggtcgggacaaagaggctgccgcagcaagttaaagacaactcgggctgttgcgcgtcgagcaggtcacggggtgggaggagatggaggagccctcacagcggatcggctcccgggccgagcgcggggccgccccaacccgg

SEQ ID NO: 576456 - DNA, 527 bp, Homo sapiens
ccttggggctccatcagtgagtagtaggagcgaaagttgaggtggtcccgcccacagagagggggatgtcagagcgcagttgcttttccacatgctgaaagaagtcatggtcctcaggggacgtgaatggcacaaggatgccatttcctccagagagggtggtatagacaagtgattctgagcctccaggaatcagggtggtcttctgcaaggacagcaccgtctccccgagatggtagtacatgatcacctctgccttcggggaggccccattgagcaagccacggtcccacagggcttggtggccggtaggatcctcatctacttcatcatgggggtggggggggagcctcaccatatttttgtggccaattttgtctgccccagccagagtgtcatagtccaggaggcgggctgtagtgaccgatggggggtaggtatcatcagcaaagatgataagcgggtttacattaggcgtgtagcgaacccagatgaactttgcttggacatcagatacaattaccgta

SEQ ID NO: 576457 - DNA, 613 bp, Homo sapiens
gacacacaacccgttgaggaagctatgcctgtgcccccgccggggcctaaacagcgtcattcctaccccctgtgggcacgttcacactcgtatattacaatagtctgcccgcagggtatgcccctaatttatagtcggcgccagcctggggtgcaaggcaaaaactgacccgtctcaagcatacgcgcatgtgctttcaaggccccttagccccttctgagggggtttctcatcccaccaccgcggatagaggcacccaccaacgatgtgtctaatgtctaaagcgattggtgggcgggggcaaccaccaaagcgggggtcgacccccccccggagccccggcctgggaccaagcccagcacgatgtgatgtcaggagacagcggcgcaatcacagcgcagggcacccaccccgccccaagcttggacaggctcactctctcaggggcaccctcgggcgacgaagtaacacccactctcgggggcgcccgcgcagatgaagaagccacggaagcccgaagggaacagacaggatctgtagagccgcagagacaaagatgtgacgacaggggcgggggtccaaaaaaaacgttatttccccaacaaacatgaca

SEQ ID NO: 576458 - DNA, 431 bp, Homo sapiens
  misc_feature (44)..(44): n is a, c, g, or t
  misc_feature (335)..(335): n is a, c, g, or t
  misc_feature (387)..(387): n is a, c, g, or t
  misc_feature (414)..(414): n is a, c, g, or t
  misc_feature (421)..(421): n is a, c, g, or t
gagatggagtcttgctctgtcgccaggctggagcgcagtggttncgatctcagctcacggcaaccttcgcctcccaggttcaagtgattctcctatcccagcctcctgagtagctgggactacaggctcctgccaccatgcccagctaattttttgtattttagtagaaacggggttttaccatgttaaccaggatggtctcgatttcctaacctcgtgatccgcccacctcagcctcccaaagtgctgggatttcaagcatgagccactgcgcctgggccaggggcaaattcttaaggctaaatttgcttcttgaaaactgggaaagaattttnaccattgtggaaacaacttttcaaagttaaaatcctcagcttcaggggggancccacccccaacatttgtattctaatnttttttnatctggggaa

SEQ ID NO: 576459 - DNA, 112 bp, Homo sapiens
atcccatggcatgtagtgaggacagtcacgagtttaagtgggtctcttttgggtcatgttccggaccttggaggagatatttttgggtgtatgaagttttagcgcgtgttgt

SEQ ID NO: 576460 - DNA, 168 bp, Homo sapiens
acttaaaaaaaaaaggagagtagaaagcctagaggattatgggataccattaagccaaataaatatctccagcaaggtgaagggaaaggtgagaaaaacatatttaatcgaaataataacagaaagacgagagagacatccaagtcgaagaaagctcaaattatatcc

SEQ ID NO: 576461 - DNA, 187 bp, Homo sapiens
  misc_feature (170)..(170): n is a, c, g, or t
gttacccgggtctgggtatgggcaggggggttatagtagaagagcgatggtgagagctaaggtcggggcggatcacctgaggttaggagttcgagaccagcctgcccaaaaaggtgaaaccccgtctctactaaaaatacaaaaaattagctgggcatggtggctgggtngcctatagtcccagcgt

SEQ ID NO: 576462 - DNA, 402 bp, Homo sapiens
  misc_feature (270)..(270): n is a, c, g, or t
  misc_feature (273)..(273): n is a, c, g, or t
cccccccccgggggttttttagggggtttttggggggttttttccccttttttcccgggggggccttttccccttgggcccagggggggggggggggaagagggggttttccccggggggggggccacaaaaaccccctttttttttggttttcccgggcccgggggcccccccccaaaagggggggggtttttttgtggggggccaaaaggggggctttgggggggcccccccccccccgggggtttttgtttccctaaggggttttanaanaagccccctttttttccccccaaaattggggggggggccccccttttttttttttttttttttttttgggggggggtttaaccggggggggggccatgggggggggccttttattttttttttttttta

SEQ ID NO: 576463 - DNA, 809 bp, Homo sapiens
gttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattgacaatagcaaagacttggaaccaacccaaatgcccaacaatgatagactggattaagaaaatgtggcacatatacaccatggaatactatgcagccattaaaaatgatgagttcgtgtcctttgtagggacatggatgaaattggaaatcatcattctcagtaaactatcgcaagaacaaaaaaccaaacaccacatattctcactcataggtgggaattgaacagtgagatcacatggacacaggaaggggaatatcacactctgggggctgttgtggggtggggggaggagggagggatagcattgggagatatacctaatgctagatgacgagttagtgggtgcagcgcaccagcatggcacatgtatacatatgtaactaacctgcacaatgtgcacatgtaccctaaaacttaaagtataatacaaaaatacactaacatacacaaatatatataccaaaaggaacatacctcaacgtaataaaagccatataaacatggtccacagctagtatcataccaaatgggggaaaaactgaaagcctttcctctaagatcttgaacacaacaagaatgcccactgtcaccactgttattcaccatagtactggaaaatcctagatagaagcaatcagattaacctatg

SEQ ID NO: 576464 - DNA, 923 bp, Homo sapiens
gggcgtcatgtgccatttctattttcatcttagaagatttcctcagcaaaccgactgagagatgtggtagcaagcttcagtatttgcctcgcttcccttttcatatttacagaattaaagacaagcctcaagtagctcagtaagctctgcattctcaatagccaaggcacccagcaggccaacatgtgtcagaggcgctagttctaatgctggctattatatggcacgtgagagcatggtttgagaatctatggagtggtgcgcacatgttcccggatgagatacggtggaaaaggcaaaaactatttaccctgcctttgcagagctgtggttatgtgaaccgcaggaaggctgttgacgcctgtttccagcatggtgtgtcatggtcacgctgggcgaaggagcgtggaaggggagatttgtcccctcagtcgtgagacggctgcgggtcgagaatagttcccccgagtgttcctgcgtgttgcgactttgaacctggcagagactaatagtgcagggagactgctggaggtcctgactcgaccatacaccggcttcctcccagccgctggtgtgcggacacactaagatctgcattaggctagaggtgcaagtgggctgattgatacttttgccttcatcatacctggtatgtctggtccttggacctttgatgaccactgggaatcccggtcacagccggctgagaacaggagggggacccgtccgaaggcagaaaatgggctaatgcctggaccggggatgtccaaggggcccgggacacacacacgtctttaccacggcccgggcttttggtgggcgcagggcaaagagggccctctaaaaccggacgggacccccaactccgggacaccttgggcacaaggtttggcggcgcacttctcccaaatatacaaccccgt

SEQ ID NO: 576465 - DNA, 348 bp, Homo sapiens
tctgggctcagaatcgtggataagtaccacttaccccactacccccttatataccacaagggactcagagccagcaggtaaactactcccctaccctacccccaccaaaacctggaaaatcacagacagcctttttacagctcctcttgcacggcccccttacttctggaaggcagtcagagatgtataagctcttctggagctcctccttcttcccagtcactcatacttgtactactcaatcagcctggcgatccgtgtcatctctgatgctgggaagtcctccccttggactaagatcttccccatgatcttcatgtattgatcagcgctaggtaccgagctcga

SEQ ID NO: 576466 - DNA, 660 bp, Homo sapiens
taaggcccattggagtatttggtttccaattagggaaatagtgggtattaggattaggattgtggtgaagtatagtacggatgctactgtgtccaatgatggtaaaagggtagcttacgggtgtgttcctcgcgaatttcagggttaaaagtgaggaggtctggcggctaggaagttcaaataaaggtgatgggactatagggggcgaaatattagtgccttggtgtgttgggactatagtggaggagtggggatatatgggctaggagtgaggaatggatagatacaatagggggaccaaagggacccgccccccccctacgcttggggtgccaagggggacgcgggactcgagaggaagacatcggggggcacgcgcgacacataaggggaaaattactccaatccggggcgcctcgagcattccgctcggcgggcgacacggcgcggcggtcccaaaagaagggcgctgctccggcgcccccaaacgcggggcctacctattccaccatccacgcggcccccgagggggaacggccgccggccccccctcccacgcgcacggcggcccccccggggggtcgacgaacacaaatccgagcggggtcacacaacgggcccccccaaaacgggggagccacactcgcggcccaccacaca

SEQ ID NO: 576467 - DNA, 1408 bp, Homo sapiens
gctgtcggagaggtcagacgcgcgaggggtgcagttttcttttcttcttttttctcttctttttatttttcttattttgttctgtagttttcttctttctcttttttctctttttttttttttctcgtcgcgtgcttggttgtattagcacgtgttgtttcatctttttttgttgttcactcctctctttgtgttctttttatattctctcttgtgtttttcccttcttctttgttttgtttttctgctctgctgtgtttttttttttcttctcgtgtcctctttgtttcttgtttctctcgtatttttttgtgtccctccttttttatcacttcttgtttcttccatctatttctgttttgtttttttttttcgtttttttttttgcttgtgttttttttttcgtcccatcttccttcgtgcgttcttttttttttgcttcttctttttattctttttttgttgttttgttgttctttttgttctttttttttttttttttttattgtttcttttctgctgtgtttctctttttttgttgtgttctcttccgcttgtttgtctttttgttctcttttttttttgtttttttttcttcacactcgtgtttgtctttcttttgtggtgttggtgttgctttgtttttctttcgctctcagttcatgtctttgttttttttgtttgtttttgtcttcgcctctttctcttctttactatatgtgttctctccgtgtgtctgtcgtgtcgttctttagagttgtatttgttttttctccttcctctctcctttgtgtgggtgtctctctcactataataataagtagcttctctctctttttttttttccctctccctcttgcgcccgcctctctcctcttctttttcttctccgctctctctctctttcttttttttttctgctccccccctcctcttttcttccctcccctccccccctctctctctctcttttttgttgttttcgcgcgccctctcttgtcgtcgtgtggtgagaggtgtgtgtgtgagatgtaatattatttttacactgctccgctctctctttccacccccctctctcttctcctcttctgcggcgcgcgcgccccctcccatagagaaagaatatatatatatagatagagagagtatttctctctcctacactacatatataatatagactagagagaagaagttattttttgtgctccctacaacgtgtgtgctgctctctatatatatatattctccgccgcccagccgggcggagaagagagagagagagagaaaaaaaaagaggaggagagagagaaaaagagagagagagaggaggagagagagagagagaggagagagagagagagagaaaaaaacttctctttcttttctctctcccacacacaca

SEQ ID NO: 576468 - DNA, 111 bp, Homo sapiens
ctggtactaagatcctcaactagtcaaggaatgcaatcaatatatgatatactataccagtagatgtatatttaaaatgaaatactgtgtgggcaggtataagaactgaag

SEQ ID NO: 576469 - DNA, 113 bp, Homo sapiens
tgatgagctatgactgtgccactgccctctatcctgggaatagggcgggacctctctcttgagacagagtctcgctctgttgcccaggctggagtgcagtggcacgatcttgg

SEQ ID NO: 576470 - DNA, 99 bp, Homo sapiens
ccgcctactactactactactgctcgaattcaagcttctaacgatgtacggggacatggaaataaagtatatccgctgccctgggcccctgcgaaaaaa

SEQ ID NO: 576471 - DNA, 147 bp, Homo sapiens
ccacgcgtccgggaaaatgtttatttctcaattaaacattccctttaaacacaaggaatgagttctaaatcttcataaagatgaattaaaactcattccttgtgtttaaagggaatgtttaattgagaaataaacatttgtgtacaa

SEQ ID NO: 576472 - DNA, 575 bp, Homo sapiens
  misc_feature (317)..(317): n is a, c, g, or t
  misc_feature (329)..(329): n is a, c, g, or t
  misc_feature (387)..(387): n is a, c, g, or t
  misc_feature (458)..(458): n is a, c, g, or t
  misc_feature (483)..(483): n is a, c, g, or t
  misc_feature (511)..(511): n is a, c, g, or t
  misc_feature (552)..(552): n is a, c, g, or t
tcaagctatgctctacctgaaaggggcacagggtcgccgcttcatctccgaccagagccggagaaaggacctctccgaccggccactgccggaaagacgaagcccaaatccccaactactaactattccggaggcagcaaccatcttactggcgtcccttcagaaatcaccagaagatgaagaaaaaaactttgatcaaaccagattctggaagacagtctgcttaactggtgaaaatatactggattatgtgtaattatggttctattctctgtgaaaacatgaaccatgtgaataaaacctttggacccttttanttcattttgtantcttaagaacacacacagatagtttattctttcagaacaaatatatataggctgctangcgagacatcatctcttcattgctcagtctgttagtgacaaaatgtttcagatcacctggtgctacctggngttctagatattatatatagctgancaaggtcttcttactaagcagactgctntctagtggtttttttcattgacactgcattgtttcccacanatcctccgtcttacaccagatgg

SEQ ID NO: 576473 - DNA, 435 bp, Homo sapiens
ttgcattcgcatttggagatgtcaaaatggagacaatatgcttggagacatcttaagtctcagcttaaatcctttccactaaattttggctgttagtccttctggaagctgctactgtctcaggaactgagtttcctcatctataaaatgaggtactcatacatatctcctacatttgttataggtttataagagataatatatgcaattcacgtagcacagggcatatagaatatgctcaataaaagatgtggtcatgtttgttatattctataagtttttataaaaatagctagctcttattgagtctctgcttcatgctaagtgcttcacataggtgacttcatttacttctcataactctgtgaaataagtattattcctattcccatttattgatgaatttaaatgacttgacaaagttgacatagtaaa

SEQ ID NO: 576474 - DNA, 691 bp, Homo sapiens
tactgggtaaagtatgctaagagtcttgccttgttcagggaggaggataagatattgaaaatttcagactttgaaacatatataattaaatgtgtatggtaaaactttaaggtaattatgaatagaaaagaacatcaatctataggttctaaaccaacaaaggagaaagcagaatatagaaaatctcaccaacctaagagaagacaggaaagacaaaaaaaaaattgaaagaagacaggaaagaagaaaaaaacctaagagaagataagaaagaaagaaacataaattagaaaactaaattaacaatggacagcaagtaagttcaaattattgactggctaactacaataaattgtaagcctgattaaatgtgtctattaacaaattgggagcaatatcagattagcaatttctcaaagtattcagttataagctattttcaaaagacccacttaggccaaaccacacaaattaaagagatgacacaaagacttaccacaaaatgctaaccaaaagaaaggtgggtggtgtcacagtacggcaactggaatctcagggaaatatatgtaatagggatagacgcagatcatctactggatctcacgacaccgactacatattcatgaacctataatgcccctaaaaacataaccttgaaattcaaaaccatgtaaacgcaaacctaggaaag

SEQ ID NO: 576475 - DNA, 1071 bp, Homo sapiens
ggtggaaggagactggcacagagtctagagaggctgagctaagctggtggaaacccagtgctggtatgagggccctgtaagctgtccctttgggacaggtgtgccatggcaggggacccaacacgagcgccaaggtataaacgctggcattgcgggtgcgcggcttaaaggatgcggaggagtgtgacattaggcagagtagcactagtgcttagcggtgtaggccaggctaacgtttcttggctctgcctgcagttaggcactctgagtacctgttcagctatgcccacctaaaaggatcttttactctttcatggcacaggatctcttggcaataaccggggttctcatcattagagctagaatgtctcaaggatgtggagcaatgggacgacggtgacaggactcgctgaaccactctcaggcgtgatacatactagccaatcttcccctttatatatagcgctcagagaatattactccagcgctgaacttgccatgtcaaaagcttgatcgtactaaatgcacttgattataatgtcaggacagcatccacttttcgcccatacccatgcaggcgtcctgcaagaattatcaatccgagagtagaagcactaatcaggacagtgacctggcctggaggcgacccgtaagagaagactatgtctcaatacgaaagtgtcagacgcacgcatgtgtgaatccgcagaggcccataagtgagtggcactgcttgtagccattgggcctcgggtaggcgccattggactgcacataggcaccgaaccaaagggtcgctatttaccacaacaaaaggaacgcaaatcgtaacaaatgcacggaggacgaccgcaacgataaacagcattaatggagaaaggagcgaatagcccaaagaggctatgacgaaaaggcgattaagattagggccactatatggagtatgtgcaaataacaagagcacccgactacttcgagggatttccagagtgatacccaatttgcccgttgcaatacaattaattccatggtgacgcagacttcacaagcagaaacgacacatttaccgca

SEQ ID NO: 576476 - DNA, 187 bp, Homo sapiens
atggcacacacagcacacacactagcacacagcacacacgaacacagcacacacagcacacacacaagcacagcacacacatcacacagcacacgcacacacagcacacacacgcgaacacaacacaacatacccccagcaggcgtgacggctccgtttactgatgctccgtttactgacccgctta

SEQ ID NO: 576477 - DNA, 416 bp, Homo sapiens
  misc_feature (52)..(52): n is a, c, g, or t
  misc_feature (129)..(129): n is a, c, g, or t
  misc_feature (294)..(294): n is a, c, g, or t
  misc_feature (308)..(308): n is a, c, g, or t
cggccgcgcgacacgtctgcgagaagacgacagagggaagccaagaaggggnccaggctcccaccatagagactgtggtgctgtacacggagagacccgtctgacagatcagggcagaggatcattgancgagacagaaagcgacatcctggttcacccagaattgacaccaaagatgttaaaaggataacttcacagtaaatcatttctcctgaaatagaggaagattctttacgttgttgtgcttgtttttaaatcatcagtatagtttaacacattctttctaagcagttntgtgtgggataatntgaagaatatattatgagtaaactccgaaaattttgtttatccaaaggctcaatggattatgtttctattatatacaaggttttaagtaaacataaaatttccagaac

SEQ ID NO: 576478 - DNA, 1561 bp, Homo sapiens
gcagtgtaactgcgtgggttggtttgtgtagagaggccgtgagcgagccctgttgtacggacgtgcacctgcatgcctgttctgtccctcccgggagacccccgacgctgtcgccgtactgagtcgccatggaatgtgcagaaagagtgcacagcgcatcatgacccatgtcaggtgtgtgaagatgtatacactccctgcaatgacagtcgacggtggcctaactggctatgacaaccgaggatgatctatgcaaagctgtacgcatgagtcatagcggacagactgcccaggagaactcatacctactcgagaacaagtgtggagtgcccatcgatgcccgaaggtgtacgtattgccctgtgcactggtcacttcccctcattctttggaacgcccagtcgaccgatgcaagactccagaacactggattgaagagccgtaaggtatcgtacatgtgatcattgaatgaatcataaggtagagaactcctacaggtaagtgtgattgatgacgaactagccatggtatatacgtgggtaagcctaaagtgatggaactaccgattagatgggacagggcgtgcctagaactagagtccatgaacgcgtaaataaacctcattccacgtagtcagtggtctattgattgccaactcaccgagtgtggtacacgccacgtgcggcacaataacgagtgtatcaacgtgacaccctgtcgcaacaatagctgaaaacagcgtacatgctagtgaaccaaagtcgtcctattacagtacggcaacaagtgacagaggtagtagacactgacaatgtgtggcacagttgttagtcatgcacactggaagaatactatagtgaatataatggctgactgaataggtatgataagactagtatagagaggtgacaacgcaatcgaaacgagcaatgagtgaaagtgtggtattaaacaatatactgatatacgagatttaggccacgaaagttagtggcacctttggaacattagcacacactgtccatacatctgagagtatgacacaaatgagagctatgaaatgaggtggtagcgtacacgaagtatagatcgtcataatactgcatttagttggacacatgaactgtatctactactgacaattagaattaggcaagaacagtcacatattcgtaagtagacatgctcatcccattatgtagacattatcgatatcaacaccgctgtgagtaggtagacgcttactcgttgacatcgtggtgtcatgcagagggcagctagcatggtagtacggaacagtgatcggaaacggatgaccagtcggactagaacagtggagcacggtgtggtagtgaagacaatgaacatagtgcatagcgaagacgacgatgagctcgcggtgtagagtaggcgagaatgtagtaggttgtctgtgcgctctttatcaataatggttaacacagcgtagagtcagctgtgtacagtaatagagtaggggagatagagagtaactagagtggaacgtaactgtaagaggagacaagagaaagaccgtagtgtg

SEQ ID NO: 576479 - DNA, 899 bp, Homo sapiens
  misc_feature (1)..(1): n is a, c, g, or t
  misc_feature (4)..(5): n is a, c, g, or t
ntanncctgcagaatggagtgtagcatggtacttagcactagataacaaacgatttgatgaagaatctcatcggtcacaccgtgggcgcatataataaccgccttttcccctgagtgtttgttcgcaaggtatgtgttttgttccaaaacccgggattagaggctcattttgtggggacgcgggatgtaattttcgaaacccgaaatctcttccggtcccaaaaaacggtctttcttcaggttcaaagccttcttctctaatagaaccgtgcctcaccatatattcttttatatgttgtgggcccttttctctgacataattcggtccccgcccgccgggccaaccggtttatagccgccggagcagccacccccccttggttaggacaagcgtcatatcagcccccggcctttccaggcccccgcccacagggggttagaacaaccaagggacgccgtcccaggtcggatatgttcccccggggggggccaaagacacgtgaatctttgcggagttaccccgaaaatcaggacaaaaacgaccgacaggagaggttcacccgtggtatcgtcaaatatcggcgtgtgtgcgccacaaagaagggtgattcaggctttttcgctccacttaacagggatcgcttaggttagtgagtgatctgttacgggagctttctgtggtcgcacaaccacaacaaagggagatttgtcaaccaaccgattggtaccaccatgagcgctgctattctcttgttgggtgagaaacgaggatcagggctttatgaatgtcgaacaccacacggatgggtcaaacaagtgtgtaagacgcacatctctttctttggcctccaatttttgaatgtggtattcattcttcagtacaagaagagtgcggccca

SEQ ID NO: 576480 - DNA, 269 bp, Homo sapiens
tctcatcctcatcatccagttctcgaagccgctcacgatccccatccccccggctttagaagtgacaggaggcggcggtacagttcttatcgttcacatttcctttaccaaaaggcaagagtgctacaaaaggagcgtgccataaaagaaagaagggtggtcttcattggaaagattacctggccgattgactcgatcagagctgaaacagaggttcttcgtttttggagagattgaggagtgccaccatccacttccgtgtccaagga

SEQ ID NO: 576481 - DNA, 236 bp, Homo sapiens
taggctaatgggtcccaaagtgccagtggcacaagctacacatcgcagccccgtatagcctgccggcagtggcacacaatctgatgggaataacatcctggtggcacgaagtagcaaagtgactgatggctcccagggccttcaggacagtgacagtgccggcactggaccccatatggcagccgtgtgtacccgtggaaaccagcaatgcaacttacacagtgctcaccacctgt

SEQ ID NO: 576482 - DNA, 159 bp, Homo sapiens
aaccgggggggtttttagggggttccccccccccccccctcccccggggggcccccccaaattttttttcccctttggggggggggggggccccccccgggggccctttttttttgtgttttttttttaaaaaaaattttttttttttggggcccccca

SEQ ID NO: 576483 - DNA, 1009 bp, Homo sapiens
ggccatattagcagcggttattcggtgagcggctggtggtttattcttccgcggagcttaagggctccgtggacatctcaggtcttcagggctcttccatctggaactatactcaagttcagaaaacatgtctcgaagatatgactccaggaccactatattcttctccagaagggtcgctatataccaagcttgacatatcgccaatggaaagctaatttggaacatgcagggcaacctggtaccggcgaacatttcaagcacacatggatgggtgtatcttgctttgcaagcagcagagaacgccaacatcgcacgaaagacattctttgcactgaaaagtcgtttcattgcctcttggaacacaccaagtttgtatgtacaaccttccaagtggcagggaccagtgggcctttgccagcttggtgggacgagggccacttaaacggtctcgtggaattgccttacaatggcttcctggagcattaaacttggacaccttaaaggggcctctacttgggtctccaaacacgggtacatcccactctaccacgcttattccagcgaaggcccaaattaagcattgctgcacgccaagaatgagggcatttacaaggccgaccttgctgctggaactacttcccaacaccagaagccgtttaatttaccaccaaacttctcggcgcagcgcaaaaaaaccggttcccccatttagcgggcaggttcgccaactttggcctcgcttcaccactttggcgctcggggggcacttaaaggccacccctaattgcgggcgcttcatccaagggccgttccttaatgtccagagcaaggtgggaaccccccttcaggttgcggcacacacatttaaccgcgggcgcgggcactcggcggcgacgagggccccaacaccacaattgcggcaattgggcgcccacaagatccagctaagcgcgggcattggaccagcccaaggcggttcccaaactgggttcgaacaccaccgccc

SEQ ID NO: 576484 - DNA, 405 bp, Homo sapiens
ttagttggcgtgaaggcccaccgagggcgttagctcagcaagtcaggctggagggcaggcccggtgcttgctagcacgccatgtgactctggacgagaccctcccctgtctgggctcggcaccttgtctgtggcctgagatccatgtgaacgtacagcaggaggtgaggcaagggagagtagggtctggaggcagggaatctaaggcccattcacactgacttccctaaaacttaatcccaagggaagaccccaattgttccatggcccaagtaaacaaaaaggaccgggaggctactttccttttgcaaccccctctttttctacacggcaggatgaaaaaacttgcaagaaacctctagattcgtccccctaccacaattgggttgggccctcacgccagggt

SEQ ID NO: 576485 - DNA, 497 bp, Homo sapiens
ccttgcgattacattagactcatcctggttaaccaggacactctcctaatcagctgattagcaaccttaattccatctgcaaccttaaatcccctttacgtgtaacaaaacatgttctgttacacgtaaaggggatttaaggttgcagaacatgttttgttgtcacaagcaagtaaaagaactactctgagccttttttctgttacgtaaacattaggaagcaggatcacaactggagttaaaagacattcagataacacaggcatgatgacctgcatttgcaagggcattgaagaacaactttgggctagaattctttttgcttcttttcttttcttcctcttccccttcttctttgcttcccttcaccctttccttgtttctctctcctccttgtactcttctgttactcttcttcttccacctttttttctcctgctgctccttttaatagcaagcaagatcttgtccaaagggcaagatcactcctagctccc

SEQ ID NO: 576486 - DNA, 1140 bp, Homo sapiens
  misc_feature (266)..(266): n is a, c, g, or t
  misc_feature (521)..(521): n is a, c, g, or t
  misc_feature (873)..(873): n is a, c, g, or t
caagtatcctcgtttgattatgttaagaaaaaagaaagaagagggtgttattgattcatctgacaatagaaatcgttgcgtgaagcagaaatactgggatgtaataagccgatgggccctctgtgttcataactagacatggtctgttttgtaatggacgaagattacgagaacagattaagaaatacgaggcgccaatttccgtactgatgttgtgtacacgagacgagacgagacaacaagcgccaacaggattaccattgctntactatcggttctatggtgcacgactgctgtcgagtaaggccacattgggcagtgcacatgacttcaagccatgtaatactactcgataggattgcacagcattactctatgaaagggaggatcgtacggatagtcacgacactcttatatgaaggaacgaggtcatgcatgcagtactgggtacggcataagatggccctgctgaagaacactatgtgctccgagaaggaaccttggccgaaaggagacttcgntgtcaaagcagtaaccatgttataaacatggtgtgaaggtaggcagaggaaggaatcttctggtggcgaagaagaagatgaagatgagaacattgaggtggtgtattcgaaggctgccagtgtaccgaaagttgagactgtaaagtcagacgaacaaggatgacgacatcgatattggatgccatttaaagggatggatgcgaactagcttaacagtataatggtgcaaattttcctccattatcagccagaagtgccacatgtatgtgcaagggtaaaatgggttaaagtgcatgtttaaatttacactaagaaatctattactgtgaagtggtcctggtgaattaagacncatggagaacatcttagggagtccatacacatcaagtgagcagatggttagttggctaattaaaggcatggtctcttttggaaaatctagtgtggggacacattgggggccacttatacgggttacacatacaggtgacaagggcgaccacaacagttgggctgaagacataagggaaaagggccctaataaagggggcactaaccggagagaactgtggccccacatgggcggagaaaagcccagagaaaagtggtaagcaaaagt

SEQ ID NO: 576487 - DNA, 255 bp, Homo sapiens
ctgacgattagctccgaaagatctcaaatcataccgttggggtcctgcaggctccagctcttcttccctaggtcaaagccactatcatctgatgtgttagggataggttcagaatggcaaaaataaatcagctcccaatgggagcccacggaactaagtagggtcccaagaaaaaaaacgggagctatttcacagagctgagctactgccaaatatcattcctcaaaccctttaatagagggtaaatattagggg

SEQ ID NO: 576488 - DNA, 360 bp, Homo sapiens
tctcttgacgtgttcatttgtcgtcttagtgctatcatgctgggtcaggtcggggcctaagccaccttcttgggaatgttccactggcccttatcactggggctgtaacctgtatcctcacccttctatttctttcccttcaagtgtatgatcgtactcatggcttttggccttgggtttagtgcatatgcctctaaatcctggcgcaaagatattatttggacactgtccagtattctctttgtccagcagatttctaagatcagttccaccataatccctgggttccaagcctcttctgtatttcagcttcttcgagcaaatttctttggaggattactattggttttgccttcctca

SEQ ID NO: 576489 - DNA, 1001 bp, Homo sapiens
ttggtgtcctcccctggcttggactttgtttcgggcgtaattgtgcagatatcatttatgggggtcatcgtatgtgctttggaacacgggaaacatccatttttgcgccgaagcggttgtgtgaactctatttgtgtggaatctctctgacaggtggagccaaatttagacctacagattgaggtgctggtgatttggaaatctgtttgaatatgctgctatggaagatcctacatctccgtattcaggtagtaggttttcctgactatgtaatgataggttctttgtcctcgataatttccggagtttgtccaacagatccgtgttaaggctagatggtgtggctgattcatgagtgacatctgagtaacccttcagaaactatgatgtaactgtctgcagtgatagaagcatatgagggcatgcacattacaatctatttgcaggagtggacaaatggacactcctagattgatctggtatgaaatttacgcaagccaaagcagaggttgtgctttaaatggaagtgggtggatagaaagatccttaggtactacgaaactcttgtagtacgctgacccgaacggggaatacaataattatctacctggttaaccactgctagatggtcaagaataatgccctttaacctgttgctaattggattatagataaatataatatgcgtctttgttcacaatatcctatgatttgtgttgagatctagggctctagtgttcagaattcatgaaattatccatggtacacactagttattaaattacataacttcaaagataacattgttattcttaagccttatacctaatcattgtaacttcgcatgtatccatacctggatttgggatgagaatacttataagatcttctccattggtaataactggaagtgaagtaggttttgttgcttgtacagtggtcagatgatggacaccactatcttttattttgccgattacatcttaactcgcgcgggtgcc

SEQ ID NO: 576490 - DNA, 393 bp, Homo sapiens
cccaaagtgttgggattaccagcgtgagccactgcacccagcctatttatttattttgagacagggtcctattctgttgccaggctggagtgcagtggtgcagtcaacctcctaggttgaagtgatcctcctaccttagctccggagtagttgggactacaggcgcatgccatcatgctcagctaatttttgtattttttgtagagacagggtttcactatgttgcccaagctggtctcaaactctggtgctcaagtgatctgccctcctaggcctcccaacgtgctaggattacaggcataagccaccatgctcggcccatttaaaccatttttaagggtacaatttagtggcattacttaggtccacaatgttatacaactaccatcgcta

SEQ ID NO: 576491 - DNA, 475 bp, Homo sapiens
  misc_feature (68)..(68): n is a, c, g, or t
tcagctttgatctgagttttattagcctatgcctttgttccctctctcctttaggggaacagacgggnttacggctggtctccccatccctctgtcagctgcaggcgggtggcgggcggccgctctgataaggcctggtccctgcccctgtgcctctgtggggtgccggcacagcaagcctgggacctggccgccgcacctccgccaggtcaccgggaggcctggggggcaggtaccctcaggttagggggactctgggatacagacccctgcaagcccgtggcctcctatttctcccatcccacctccctccctctgcctgatgactcccatgggtggggcttctgccttcccaaggccctgtgcctcagtttccttacctaaagaacagggtgctaatggagacaagggagaccaggagacagctcagccaggggccaaaccagcagctattgctatggaggttcactcgtgc

SEQ ID NO: 576492 - DNA, 841 bp, Homo sapiens
  misc_feature (48)..(48): n is a, c, g, or t
  misc_feature (92)..(92): n is a, c, g, or t
  misc_feature (96)..(96): n is a, c, g, or t
  misc_feature (140)..(140): n is a, c, g, or t
  misc_feature (156)..(156): n is a, c, g, or t
  misc_feature (162)..(162): n is a, c, g, or t
  misc_feature (178)..(178): n is a, c, g, or t
  misc_feature (184)..(184): n is a, c, g, or t
  misc_feature (203)..(203): n is a, c, g, or t
  misc_feature (206)..(206): n is a, c, g, or t
  misc_feature (216)..(216): n is a, c, g, or t
  misc_feature (220)..(221): n is a, c, g, or t
  misc_feature (257)..(257): n is a, c, g, or t
  misc_feature (297)..(297): n is a, c, g, or t
  misc_feature (318)..(318): n is a, c, g, or t
  misc_feature (326)..(326): n is a, c, g, or t
  misc_feature (328)..(328): n is a, c, g, or t
  misc_feature (340)..(340): n is a, c, g, or t
  misc_feature (344)..(344): n is a, c, g, or t
  misc_feature (350)..(350): n is a, c, g, or t
  misc_feature (360)..(360): n is a, c, g, or t
  misc_feature (405)..(405): n is a, c, g, or t
  misc_feature (413)..(413): n is a, c, g, or t
  misc_feature (419)..(419): n is a, c, g, or t
  misc_feature (424)..(424): n is a, c, g, or t
  misc_feature (440)..(440): n is a, c, g, or t
  misc_feature (482)..(482): n is a, c, g, or t
  misc_feature (489)..(489): n is a, c, g, or t
  misc_feature (514)..(514): n is a, c, g, or t
  misc_feature (645)..(645): n is a, c, g, or t
  misc_feature (648)..(648): n is a, c, g, or t
  misc_feature (655)..(655): n is a, c, g, or t
  misc_feature (657)..(658): n is a, c, g, or t
  misc_feature (660)..(660): n is a, c, g, or t
  misc_feature (669)..(669): n is a, c, g, or t
  misc_feature (680)..(681): n is a, c, g, or t
  misc_feature (684)..(684): n is a, c, g, or t
  misc_feature (686)..(686): n is a, c, g, or t
  misc_feature (688)..(690): n is a, c, g, or t
  misc_feature (692)..(693): n is a, c, g, or t
  misc_feature (696)..(696): n is a, c, g, or t
  misc_feature (705)..(705): n is a, c, g, or t
  misc_feature (707)..(708): n is a, c, g, or t
  misc_feature (710)..(710): n is a, c, g, or t
  misc_feature (712)..(712): n is a, c, g, or t
  misc_feature (714)..(714): n is a, c, g, or t
  misc_feature (720)..(720): n is a, c, g, or t
  misc_feature (724)..(724): n is a, c, g, or t
  misc_feature (727)..(727): n is a, c, g, or t
  misc_feature (731)..(731): n is a, c, g, or t
  misc_feature (742)..(742): n is a, c, g, or t
  misc_feature (747)..(748): n is a, c, g, or t
  misc_feature (751)..(753): n is a, c, g, or t
  misc_feature (774)..(774): n is a, c, g, or t
  misc_feature (778)..(778): n is a, c, g, or t
  misc_feature (790)..(790): n is a, c, g, or t
actgcacagctctcttctctcgccgccgcccgagcgcacccttcagcncgcgcgccggccgtgagtcctcggtgctcgcccgccggccaganaaanagcccgcccgaccccgtcccgaccctggccgccccgagcggacntggagcaaaatgatgnttcaanacccaggccaggtctntgcctnggaagtgagtgcttctgcnatngtcccctgantgtnncctcctgggtaactggtgtttgaggattttgctaanctgacgccctttgtcaaggaagagctgaggtttgccatcnagaacaagcacctctgccacnggatgtcntntgagctggaatnagtnactgtnagcgaaaganccctcggggtgtccatcaaaaaagccgaggtagcccctgaagaanatgaaagnaaaaanaggcnacgagaaagaaataanattgcagatgcaaagtgccgaaaaaagaagaaggagaagacngagtgcntgcagaaagtgagtgccttctagcnttacccttcctctcgctcacgccatgttttcaccagcttcatgtggctataagaagaagagttagaaaactccctacttggttatagtttcccaagaagggccttgtagctggtagcagaaatgccacttncanaatcacnanntnccaaaccanttaaaacaatnnatntnannntnnatntataaaaananntntntnaattcntctnatncctnactcccaccancctcnnccnnntcatacatgtccatcagcttncagnctgcaggacatnccaccccacttaaacacccttcacttcactcttttcctcacaaaaccaacc

SEQ ID NO: 576493 - DNA, 153 bp, Homo sapiens
aagagatctgtttagggacacaggaggccaaggacacaaaaaagcaaaagaactagcatgctttttcaatggatgtctatttttacagggctggctctcagattattgttatagctttaaataaaaggcccgttttgtcatttcggaaaaaaa

SEQ ID NO: 576494 - DNA, 187 bp, Homo sapiens
ggccagggaccaagtatgtttctctgcctagggcctgcataaaccagggctctcaagggtcactgagggggccgagggtggtctctcctggaaaaggcgaatagtctctggggggaagcatccccaagttggacctcagagatgtccccgataccagctggcaattaaacaaccaaacgttccggga

SEQ ID NO: 576495 - DNA, 406 bp, Homo sapiens
tccattagagcttcatccagctgactaggagcactgtgttgatattttttctgcctgggttgctctctactccagctcatcacatagtgggattctctggccaaaacgaagaaggggagattgaatttgggctcacgttagcagtctcttccatacatgcctgctcagaggattaaaggctacagaagggcttgagtcaccttgctctgagaaggatacagaatgcttgaggtttatggcactgtgccttgccttgagtgtctcttacatgctgcgcccaagagtccctattctgagttgcaggtgtctcgtaagactcctctgctaattcgcacacatttactttagggcccttattccatggctgtctccttttaaatgcccttaaaggactctggtttgaggc

SEQ ID NO: 576496 - DNA, 545 bp, Homo sapiens
  misc_feature (228)..(228): n is a, c, g, or t
  misc_feature (388)..(388): n is a, c, g, or t
atcaacatggctcttaaatcccttctcatcactcctttatctcttttctcttgcagtttatttttgaagaagctgggtcacttgactgtggagtctgtccaagtctgaagttttattttttttgcatccccaagtggtgtttaacagactcattgggtttacaatttgggagttgaatccggaggctttacttctagttggcttttgccaagactactttttaggaantgctatgttcttcctttggaaagcacataaggtctggctgtctctttttttagtgatgttgctgtttggtcaataagttaaggtggaatcagcctgatttgttcttcgcttttaaaacaaaacaaaacaaaaaacaataacaacaacaaaaaacaccctntctcctttgtcactaataaggaatatgcagagtgagacttgagattctgtgaatagcctccctgataacatcttgctcaacagtttcagcgtccattgacaattcttttttttatattttttattttaataaagacagggtctatgttaaaaaaaaa

SEQ ID NO: 576497 - DNA, 478 bp, Homo sapiens
  misc_feature (20)..(20): n is a, c, g, or t
  misc_feature (38)..(38): n is a, c, g, or t
  misc_feature (41)..(41): n is a, c, g, or t
  misc_feature (43)..(44): n is a, c, g, or t
  misc_feature (47)..(51): n is a, c, g, or t
  misc_feature (56)..(56): n is a, c, g, or t
  misc_feature (59)..(59): n is a, c, g, or t
  misc_feature (62)..(62): n is a, c, g, or t
  misc_feature (87)..(87): n is a, c, g, or t
  misc_feature (103)..(103): n is a, c, g, or t
  misc_feature (110)..(110): n is a, c, g, or t
  misc_feature (116)..(117): n is a, c, g, or t
  misc_feature (172)..(172): n is a, c, g, or t
  misc_feature (223)..(223): n is a, c, g, or t
  misc_feature (281)..(281): n is a, c, g, or t
  misc_feature (288)..(288): n is a, c, g, or t
  misc_feature (387)..(387): n is a, c, g, or t
  misc_feature (389)..(389): n is a, c, g, or t
  misc_feature (401)..(401): n is a, c, g, or t
  misc_feature (417)..(417): n is a, c, g, or t
  misc_feature (442)..(442): n is a, c, g, or t
tctcttttcacactgtattntgattaatggataaatgnatnanntannnnnctggnggnctncctgcacactctggggagccagggncccagcaccctccagnacagganatctgnnatgcctggctgctggagtacatgtgttcacaagggttactcctcaaaacccccanttctcactcatgtccccaactcaaggctataaaacaacaaaatggaaaaanaatgttctgctgcgtccccaccgtaacctccctggcctcccctctctcagggagcagntcacagntcaccatggggaattctagcccccactggtgggatgttactaacaccattctggttattttggcgtctttatttttggtgggatgtgttttttcacgtntntgtttgtgtgtntgtgtgtgtgtgtttnttttctgtgacctcctgtccccatngtacgtcccaccccctccccaaatcccctatccctc

SEQ ID NO: 576498 - DNA, 210 bp, Homo sapiens
aagaagattgcggatattgaaaggagggttgtcactaaaatgcagaatggggatgtgacctggaaattagagggcctaccttttctgccacttgtcccagaacacacagggccactgggcttatcacatgccaaagtcctgataataaatcagcctcttgccacgatactcccctcaatctagggggtctcggatcctgctaattgggta

SEQ ID NO: 576499 - DNA, 671 bp, Homo sapiens
gctctgtcgagagatgtgggcagctggtcaggatggccattcgggctcagcacagcaacggggcgcagactcagactggggaagcaaacgaggggctggacaggccaggagagcctgtcggacagtgatcctgagatgtgggagttgctgcgagaggtgagaaggacagtgcatgtgtctgtggccgtgtgagcgtcattgcctcaagagaacttcgtgcagccgagctgcgcttggaggcccgtggggtcctgtcttgaaggataagtactcggaggggttatccttggcaagagatacgtatgggggatgcagaggtggctggcatgacatttgagctgggttgtgcctatgcgcctggtgccttgggaagccttttgaggctggatcctgcccaggtgggggagtccaatgtccagccccttagtccggggtcccgcagccatactggccgtctagactaggcctttcttgcaggacttagcgaaccgggatcatggggctggaccttgcccggatggggggccagtctcacccgaggggtacattgttcttgacgtcaagagcggatatcaggcacggtcccatcttcttccgagtctattggccctataagctcaatcgccaaaaattgggctcatttgactacaaccaggtttgggcctgaatgg

SEQ ID NO: 576500 - DNA, 944 bp, Homo sapiens
gagcgcgcccgttgcaagatggcggcggccatgctgggccccggggctgtgtgtgcgcagcgggcggcggcgcggcccggaaggctggcgcggcgacggcgttagcccggccctcggcccctctttgcggccgctccctccgcctattccctccttgctcgagatggatctgcccgtgggccccggcgcggcggggcccagcaacgtcccggccttcctgaccaagctgtggaccctcgtgagcgacccggacaccgacgcgctcatctgctggagcccgagcgggaacagcttccacgtgttcgaccagggccagtttgccaaggaggtgctgcccagtacttcaagcacaacaagcatggccaggcttcgtgcggcaggctcaacattgtatggcttccggaaagtggtccacatcgagcaggggcggcctggtcaagccagaggagagacgacacggagtctcccagcaagccatgctttcctgcgtggccaaggagcaagctcctttgagaaccattcaagaggaacagtgaccaggtgtgtccacccttgaaggagtgacagacggtaacacgatccgccaggaacagcgtcaaccaacgctgcctgaccggaccgttgcaggctgatgacaggggacagcaggagttgcaattgggacttcccaatgcgtccttgtgccaactgagaagccatgtaacgcaaatttgcgagggcattacataggtgcgagccggggcgacgagatggggccaaggcccatattcggcgcgcggaacgatccacatttgcccccagcggcaactagaacagggttccgtcgagccacagcgctcgcattccgaagttcccctggagttgtcgcaacttgggttgcaacgtgtcccaaaaaccgggaattacccttgcgggggttacagatcaagaagacggattccacg

SEQ ID NO: 576501 - DNA, 398 bp, Homo sapiens
aggtatactacagtccatcgtatctcgtaagttcgacacagaaatgttccaggtatcgtgattaaacccataattaaaagtaactccgaagagatcaggaccagggtcacgccatggttcatcttctacagaatccaaatctacctctaaaagtggaactccatgaatgcttccaggtgcatcaaggtctactcctttgagtattgtccgtgtagtcccataaactcttgcccctgtcttgatgttcagatttacaggtgatgtagcataactcccatactgtggtgctcccgttataatgtctcctatagtgagatgaacatcatcttcatcatcatcgctgtcactatcactatcatcttcggtctcagtcactttcggtatcggtacaccattta

SEQ ID NO: 576502 - DNA, 509 bp, Homo sapiens
  misc_feature (434)..(434): n is a, c, g, or t
  misc_feature (498)..(498): n is a, c, g, or t
gtcgtttaaacctaggagtctgagaatcctggcaacgtaccgagaactcatctctaggaaaaataagaaaattaggccgggcgcggtggcgcgtgcctgtagtcccagctactcgggaggctgaggctgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgggcaacatagcgagaccccgtctctataaaaaacttaaaaattagctgggtgtagtagtgaacgcctgtagtcccagctacttnggaggctgaggcaggaggatcacttgatcccggggaggttgaggctaacatgagccgagatcanaccaccgcatt

SEQ ID NO: 576503 - DNA, 565 bp, Homo sapiens
  misc_feature (285)..(285): n is a, c, g, or t
  misc_feature (303)..(303): n is a, c, g, or t
  misc_feature (305)..(306): n is a, c, g, or t
  misc_feature (312)..(312): n is a, c, g, or t
  misc_feature (314)..(314): n is a, c, g, or t
  misc_feature (342)..(342): n is a, c, g, or t
  misc_feature (373)..(373): n is a, c, g, or t
  misc_feature (513)..(513): n is a, c, g, or t
gagcgcgcccgttgcaagatggcggcggccatgctgggccccggggctgtgtgtgcgcagcgggcggcggcgcggcccggaaggctggcgcggcgacggcgttagcccggccctcggcccctctttgcggccgctccctccgcctattccctccttgctcgagatggatctgcccgtgggccccggcgcggcggggcccagcaacgtcccggccttcctgaccaagctgtggaccctcgtgagcgacccggacaccgacgcgctcatctgctggagcccggtgangagcgcgcgggcgggccngnngggacngngaggagcagggccgcggcggacgggggnagggctgcggggaggggcctgcgcacttcancttacgcgcggtgagcctgccctgcccccgccagagaagggcgcgggtcccgagcctgctcagacccagagccttaagttgggaaagcggctacgagacccacactcggttcaacccctgccccagcgaagtttccctgngatggggagaatggggcgtctcttgtattgggcttctgctaactgttgggcg

SEQ ID NO: 576504 - DNA, 482 bp, Homo sapiens
ccttgatgtcctgcgaccagtctgggcaacactgtgagaccctacaaaaaataaaataattctctacttaataaaaaattagccaggcgtggtggtgcatgcctgtaattccagttactcaggaggctgaggcacaagaattgcttgaacctgtaggcagaggttgtggtgagccaagattgcaccactgcactccagcctgggtgacagagtgagactctgtctcagaaaaaaaaaataaataaataaatacaaataataaattagctgagctctggtgtgtcatgctagccaggtttatacccctgtggctgaagagctacatcatcttatattaacatgtaatactcatttattggtacaaaccttcaagccatatagccatatttagttccaaagctggcctgagtctttatcccttctatggcatttttggggcagttttgaattcctagcctagacagctccccaaggtctgcaag

SEQ ID NO: 576505 - DNA, 572 bp, Homo sapiens
  misc_feature (501)..(501): n is a, c, g, or t
tgtttatcgatcccacacgtgatgaaaattgaagcacaattcattcaccctccaaagtatctcaagctagaaatatcttcctccgcagatccccgtaccctgatatggaaagatctttagatgtactaagtgaaagatgccaagttagtgacatatatttatagcatgttccctaccctgtcaatgaaattccgtctaccctgagagcctctgtggaaaccttaaccccagctctctctctttgtgaaaggaatatatgaaatcagatatgtgggtctcccctttcagaaccggaccagccttaatttaagaagaactgtgggccgggcgcggtggcgcgtgcctgtagtcccagctactcgggaggctgaggctgggaggatcgcttgagcccaggagttctgggctgtagtgcgctatgccgatcgggtgtccgcactaagttcggcatcaatatggtgacctcccgggagcgggggaccaccaggttgcctaaggagnggtgaaccgacccagtcggaaacgacagtcaactccgtgctgatcatagtgaaccctgtgatacatcatcg

SEQ ID NO: 576506 - DNA, 399 bp, Homo sapiens
  misc_feature (105)..(105): n is a, c, g, or t
  misc_feature (135)..(135): n is a, c, g, or t
gcacacgggtgggcagatcgcttgagtacaggagttccagaccagcctgggtaaaatggtgaaaccgcgtctctgcaaaagattagctgggcatggcggcatgcnctgtagttcagctgctcaggaggctgaggngggaggattgcctgagtctggagaagtcgaggctgccctgattgccactgcactcaaaaaaaaaaaaaacaacaacaaccaaaaaaactggccaggcgtggtggctcatgcctgtagtcccaaagtgctgggattacaggcgtgagccaccgtgcccggcctgggtgacccatttaaatcacttttgatgatcctggggtatgtgacattttaaaataatatgtatatatggaaggaaataaaaaactataaaaaaggaaaaaa

SEQ ID NO: 576507 - DNA, 83 bp, Homo sapiens
tctagcaggatgcccactcctccactccacctcttcctgcagctgtttttgtaccaaaaatattatattactgtcttcatctt

SEQ ID NO: 576508 - DNA, 194 bp, Homo sapiens
taaaaattgtgaataggctgggtgtggcggctcacgcctgtaatcccagcactgtgggaggctgaggtgggagatctcttgagccctggaattcaagaccagtctagtctgggaaacacagcaagacccgccttgctgggcgcggtggctcacgcctgtaatcccagcacttggggaggctgggcgtgcagtgg

SEQ ID NO: 576509 - DNA, 161 bp, Homo sapiens
caatggaatttttggacggggcaagctacgtacatttatggcagaaaaaaagtgcaactgacatactacaaagagattttttaagtttaaacacaagtttggactctttgtggatttcttatttttttttattgtgtcctttttgtgtgcttaaaattagc

SEQ ID NO: 576510 - DNA, 507 bp, Homo sapiens
  misc_feature (203)..(203): n is a, c, g, or t
  misc_feature (210)..(210): n is a, c, g, or t
cgcacgatggcgcgtccttggtcactgtaacctccacctcccgggttcaagtgattcttctgcctcagcctcccgagtagctgggaccacaggcatgcgccaccatgcccggataattttgtatttttagtagagacagggtttctccatgttggtcaggctgttctcaaactcccaatctcaggtgatctacctgcctcggnctcccanagtgctaggattacaggtgcgaaccaccacgcccagcccgaaacacattttttgtttgttcattgttttgttttcgagacagggtctcgctcttttgcccatgctggaatgcagtgcgctatgccgatcgggtgtccgcactaagttcggcatcaatatggtgacctcccgggagcgggggaccaccaggttgcctaaggtatggctgcaccaggtcacacgtatcgggcatcgtaacagtccaattccctcgctgtcaacatcgtgactgcgattgcggatacatttacatcagga

SEQ ID NO: 576511 - DNA, 447 bp, Homo sapiens
  misc_feature (184)..(184): n is a, c, g, or t
  misc_feature (219)..(219): n is a, c, g, or t
  misc_feature (234)..(234): n is a, c, g, or t
  misc_feature (242)..(242): n is a, c, g, or t
  misc_feature (245)..(245): n is a, c, g, or t
  misc_feature (254)..(254): n is a, c, g, or t
  misc_feature (265)..(265): n is a, c, g, or t
  misc_feature (279)..(279): n is a, c, g, or t
  misc_feature (288)..(288): n is a, c, g, or t
ttctaagcatgttaattttacctgggatagacaggactttattttttatttttattttgtttgagacggagtctcgctgtgttgcccagcctggagtgcagtggcgcgatctcggctcactgcaacctgcgcctcccgggctcaggcgattctccttcctcagcctccagagtagctgggagtncaggtgcccgctgccacgcccggctgatttttgtntttttggtagagacngggtttcnccntgttggtcnggctggtctcnaactcctaagctcnggtgatccncccgccttggcctcccaaagtgctgggattacaggcgtgagccaccgtgcccggcctgggtgacccatttaaatcacttttgatgatcctggggtatgtgacattttaaaataatatgtatatatggaaggaaataaaaaactataaaaaaggaaaaaa

SEQ ID NO: 576512 - DNA, 310 bp, Homo sapiens
  misc_feature (235)..(235): n is a, c, g, or t
  misc_feature (299)..(299): n is a, c, g, or t
agaggagtccccaacatgcgaacggactgatcgaccaccaggttgcctaaggaggggtgaaccggcccaggtcggaaacggagcaggtcaaaactcccgtgctgatcagtagtgggatcgcgcctgtgaatagccactgcactccagcctgggcaacatagcgagaccccgtctctataaaaaacttaaaaattagctgggtgtagtagtgaacgcctgtagtcccagctacttnggaggctgaggcaggaggatcacttgatcccggggaggttgaggctaacatgagccgagatcanaccaccgcatt

SEQ ID NO: 576513 - DNA, 593 bp, Homo sapiens
  misc_feature (323)..(323): n is a, c, g, or t
ccattgtaaacatgtatttgattttacataaaatatttactttaaaatgagttaatatttatagtctaaaaatgtgaaaatacatatatggtcatagtctgaaagacatatatacacagtaagctttatacctaaataagaacatgggaagtaagaaagataactagcacaaaaatccaaactggctgttttactccattgaaagttgcatttaattttgagttgactgagaaaggaataagatgggatatactataattcttattatgaaatgaggtaactgtactagttattaagaaggaatattaaggctgggtgcggtngtcacgcctgtaatctcagcactttgggaggccgaggtgggcagatcacttgaggtcaggagtttgaaaccagcctgaccaacatggtggaatcccgtctctactaaaagtgcaaaaattagccaggcgtggtggtgggcacctgtaatcccagccactctgtaggctgaggcgggagaatcacttgaatctgggaggcggaggttgcagtgagccaacgttgtgccactgcactccagtctgggtgacagagtgagactccattaaaga

SEQ ID NO: 576514 - DNA, 496 bp, Homo sapiens
  misc_feature (318)..(318): n is a, c, g, or t
  misc_feature (320)..(320): n is a, c, g, or t
  misc_feature (324)..(325): n is a, c, g, or t
  misc_feature (328)..(328): n is a, c, g, or t
  misc_feature (331)..(332): n is a, c, g, or t
  misc_feature (336)..(336): n is a, c, g, or t
  misc_feature (350)..(350): n is a, c, g, or t
  misc_feature (352)..(352): n is a, c, g, or t
  misc_feature (360)..(360): n is a, c, g, or t
  misc_feature (378)..(378): n is a, c, g, or t
  misc_feature (381)..(383): n is a, c, g, or t
gtcgtttaaacctaggagtctgagaatcctggcaacgtaccgagaactcatctctaggaaaaataagaaaattaggccgggcgcggtggcgcgtgcctgtagtcccagctactcgggaggctgaggctgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtggctantncagnngcngannatantcactgcagcctcnanctcctagnctcaagtgatcctcctgnctnnnctcccaagtaggattacaagcatgcgccgacgatgcccagaattcagaaccttgtctatcactctccccttcaacctagatgtgaaaacaggattaaactcaacccggaaaac

SEQ ID NO: 576515 - DNA, 571 bp, Homo sapiens
  misc_feature (323)..(323): n is a, c, g, or t
ccattgtaaacatgtatttgattttacataaaatatttactttaaaatgagttaatatttatagtctaaaaatgtgaaaatacatatatggtcatagtctgaaagacatatatacacagtaagctttatacctaaataagaacatgggaagtaagaaagataactagcacaaaaatccaaactggctgttttactccattgaaagttgcatttaattttgagttgactgagaaaggaataagatgggatatactataattcttattatgaaatgaggtaactgtactagttattaagaaggaatattaaggctgggtgcggtngtcacgcctgtaatctcagcactttgggaggccgaggtgggcagatcacttgaggtcaggagtttgaaaccagcctgaccaacatggtggaatcccgtctctactaaaagtgcaaaaattagccagactggagtgcagtggcacaacgttggctcactgcaacctccgcctcccagattcaagtgattctcctgcctcagcctacagagtggctgggattacaggtgcccaccaccagcgtcgatcgg

SEQ ID NO: 576516 - DNA, 551 bp, Homo sapiens
  misc_feature (184)..(184): n is a, c, g, or t
  misc_feature (475)..(475): n is a, c, g, or t
  misc_feature (543)..(543): n is a, c, g, or t
cgacagtatagaatcgagctggtacccgagctgctcatggtgctgagcgatcatgggtgccacctagattacggctgggtctacctttcccagcccactgactcaaatgttgaatctcctgtggcaagaccctcgacagacacacccaggaacaatacttggcatccttcaatccaatcaagtngacactcagtattaaccatcacagtggtagactccctgcagagcactgtctctgtaattccagtgccttgggaggccaaggtgggaagatggttcaagccctggagtttgagaacagcttgggcaacgtgtcgagactccatctctccaaaaaaatacaaaaattagccagtggtgatggtgtatgcctgtgatcccagctacttgggaagctgaggtggtatgggtcacctgagcctgggaggtcgagcctgcaagtgaattgagtcggtgccactgcactccagcctgngtgacacagtgggacccttttgcattaatctccctgggagctgtagactggagctgctcctattcggncatttggc

SEQ ID NO: 576517 - DNA, 595 bp, Homo sapiens
  misc_feature (179)..(179): n is a, c, g, or t
  misc_feature (520)..(520): n is a, c, g, or t
  misc_feature (584)..(584): n is a, c, g, or t
tcagaatgatgtgcagttaaacttacggccaggcttggtggctcacacctgcaatcccagcactttggaggccgaggtggggggatcacctgaggtcaggagtttaagatcagcctgaccaacatggtgaaaccctgtctctactaaaaatacaaaaattagccgggcgtggtggcacntgcctgtagtcccagctactcgggaggctgaggctgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgggcaacatagcgagaccccgtctctataaaaaacttaaaaattagctgggtgtagtagtgaacgcctgtagtcccagctacttnggaggctgaggcaggaggatcacttgatcccggggaggttgaggctaacatgagccgagatcanaccaccgcatt

SEQ ID NO: 576518 - DNA, 180 bp, Homo sapiens
gcgtcgacatggaggagaaaaaagaggaatagagagtgaaaaggaaagaagggcagaaagaaaagagaaggaggagagaagaggaagagaaagatagaggaaaagaagaagataagagaaagaggaggaggaggaagaagttggagaagatggaggaggaagaagagggagaaaatgaga

SEQ ID NO: 576519 - DNA, 614 bp, Homo sapiens
  misc_feature (198)..(198): n is a, c, g, or t
  misc_feature (539)..(539): n is a, c, g, or t
  misc_feature (603)..(603): n is a, c, g, or t
gtggcttagaattttatttttggtttacatctcaactatcacagcagccgggcgcggtggctcacacctgcaatcccagcactttggaggccgaggtggggggatcacctgaggtcaggagtttaagatcagcctgaccaacatggtgaaaccctgtctctactaaaaatacaaaaattagccgggcgtggtggcacntgcctgtagtcccagctactcgggaggctgaggctgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgggcaacatagcgagaccccgtctctataaaaaacttaaaaattagctgggtgtagtagtgaacgcctgtagtcccagctacttnggaggctgaggcaggaggatcacttgatcccggggaggttgaggctaacatgagccgagatcanaccaccgcatt

SEQ ID NO: 576520 - DNA, 1999 bp, Homo sapiens
  misc_feature (819)..(819): n is a, c, g, or t
  misc_feature (890)..(890): n is a, c, g, or t
  misc_feature (1800)..(1800): n is a, c, g, or t
agcgagcgcagagcggtttggtcgttcgttgggcggtgttggtttttcgctcgctcgacctgcgcgctcttcctcgcggcagcgcgaacgcggccgcggcggctccggagcaaagctggccctaacaaccttcggccgcttggcgctgacaacgaaacaactgcgcccgcacacccaaagccacgaacctgccctcgcctacagctaccacccgcgctgcgcgcaaaaagcccccacccgaccaacaacacgcatgggcgagcaacgaaacacgcccgacccagcgcaaacacacgcggcctcccccatccataacccgagaccgcgcggcctgcacacgcaaaagacacatccactcgaccgttaacacgggtcacccgggtgaaacacaggatggggcagaccttttcagcacgcaaggcactctccggttcagccttttacttcaagcaacaggctccgcaaccccggacgccatagggcatccaattccccggggcaacacgaccatggacccccttttcccaagcaaaggggaatttaggggtctggaacggggggaacggaaacttcagaccagatccaaacggggaaccttttttccaacacaacaacccccggaacccccgtgggaacgcggcttataattccaacgcaaaggaccggtccaaggacccccaaatattcccggaggacatatggacccggtccctggggcccaacgggagcaaacgcgggacgcttaaacgaaccgggaaaacacggccccgaggattaagccccccattgggcgggacgtgagcgagagggcacttcccnttgagcgcttacttccagggcaaaacaagccggccaaactttaataccgtcccaaagaaaggacgcgcgcnttgtggaacttgagcattggggccgcccgcaaaagagttatcgagccagaatagccaaggaaacccactgttaaagaaacagggggaaacaggaggcaaaacagaggtcttttgcacgaaaacagcagccacgaaatacatatgccaaaaagattgtgggagccacgcgccctagaggagaagcaaccagggcagcatgcccgaaagagattttgcagccccagagagggcaccatttagttgggcgcacgccgacccccacttatccgcgaggaccccaccccggtgcgcggcaaaaccattttataaacccgcaggagggaacgcagcgagcccacaaaagcaccaacaacgagcaaaacgcggcaaaagggcacccccctgatactataacaacaaccgcggccagctttgcgccgaaacaacacgagcaggggggagcaccaaaaagcggcaccactacataccatcaccatgcactaaacccttctggggcgggagcccccgagaggcaactttaacacgacccatcagacgagggtgctcttaaacacgaggcctcttgcaacacaagccacaacgcttgtttctaccaccattgtggggggctttcacacgaaccaacacacaaaacggatttaaagacccgccttttatcatcaccagcggagacggagcatcatactattctgctcaacaacaaaccgatctcattctccgacgacggggcagctttggcgggacacaaacccacccagatctgcaactgatacatgcacatcaatccacgactaccagacgacgagcgcgcttatatcacacacacggcggccgaaaaaacagaagaacagaacgctttctgaggaggcagctatggacgtcaactctgaaagcactgttttaacacagnacgcttttgtacacaaccttctgtgggaggctctgtctcctggggagccccgcacgacacactgttctgttctgacggcggcagctcttaacagacccgcctgtattatattattaaacacaacaggggcgactcttttacccgcaacaattattattcttccccacgcaagagtagtgtagccccgcattcgagttaa

SEQ ID NO: 576521 - DNA, 259 bp, Homo sapiens
ggtctgccccagcactccactgaacctgctaaagatgccagtgttgctaaattcagtgggctcttcattcttcatcttatttgacaactcagtagcactgaacacagctgaccactctttctcataacagtctttactggactttggtaaatcaagatctgttggtttttctcttacctctttggtaactccagtcttagttaagccaccttcctcttcccgctttttggacccttttcctactctcctatactctcaa

SEQ ID NO: 576522 - DNA, 181 bp, Homo sapiens
catccgggggggggttttttttccctttccccccttaaaaaaataggtttttgggttttgggggggggggtggaaccccccccttttgcctttgtgggggttaaacttttcccctccgcttttttccctttttttttttaaaaaaaaaaaagggtttgctgggtttccgcttttttcttta

SEQ ID NO: 576523 - DNA, 353 bp, Homo sapiens
cacagatacgggttgagcctctctcctaacacacgacatcgctcacctcagtagccaacttggagtagcttgtaatgggatagcgataggacccctgtgctctgaccttatgagaaacctatgatcattttcttcagctatttgaatagagacttcatggagtactgcatggaatggactgagctcctgggctgaacatggaccacactgtgacacggaggccatgggaatagggagcacaaggcggtactgcttttggattgtatcacatgtgaatcctaggttttatcgatgcgcacgcagtgagtgcttttgagtatggaagccagtgaggggggtgatcgccttttggg

SEQ ID NO: 576524 - DNA, 622 bp, Homo sapiens
  misc_feature (206)..(206): n is a, c, g, or t
  misc_feature (547)..(547): n is a, c, g, or t
  misc_feature (611)..(611): n is a, c, g, or t
ttgctctgaggtctcctcctgggtcaagcgattctcatgccccagactccctagctgtaatcacagcggtgcaccaccacgcctggataatttttagtattttggggtagagaccatgtaagtcacgcttgtctcgaactcctgaccaacatggtgaaaccctgtctctactaaaaatacaaaaattagccgggcgtggtggcacntgcctgtagtcccagctactcgggaggctgaggctgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgggcaacatagcgagaccccgtctctataaaaaacttaaaaattagctgggtgtagtagtgaacgcctgtagtcccagctacttnggaggctgaggcaggaggatcacttgatcccggggaggttgaggctaacatgagccgagatcanaccaccgcatt

SEQ ID NO: 576525 - DNA, 126 bp, Homo sapiens
cattatagtagggtaaaatcactgttcacgcaggtctaacccagctccagtacctcattcagtgggtgcaacaatcccaaccgcttggtgaattctagcttcacaagtgcataggcaagcagccga

SEQ ID NO: 576526 - DNA, 265 bp, Homo sapiens
ttatttgtgccactgcactccagcgtgggggacagagcaagaccctggtcgtcagaaaaagtaagaacgtcaacaaaggatagtagaactggaaaaggggccgggtgcggtggctcatgcctgtaatcccagcacattgggaggccaaggtgggcggatcacgaggtcaagagatcgagaccatcttggccaacatggtgaaaccccatctgtactaaaaatacaaaaattacctgggcctggtgacacatgcctgtaatcccag

SEQ ID NO: 576527 - DNA, 454 bp, Homo sapiens
  misc_feature (33)..(33): n is a, c, g, or t
  misc_feature (35)..(35): n is a, c, g, or t
  misc_feature (38)..(38): n is a, c, g, or t
  misc_feature (379)..(379): n is a, c, g, or t
  misc_feature (443)..(443): n is a, c, g, or t
accttctctggtggtatcctccgccgggcgcgntngcntgcctgtagtcccagctactcgggaggctgaggctgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgggcaacatagcgagaccccgtctctataaaaaacttaaaaattagctgggtgtagtagtgaacgcctgtagtcccagctacttnggaggctgaggcaggaggatcacttgatcccggggaggttgaggctaacatgagccgagatcanaccaccgcatt

SEQ ID NO: 576528 - DNA, 545 bp, Homo sapiens
  misc_feature (129)..(130): n is a, c, g, or t
  misc_feature (266)..(266): n is a, c, g, or t
  misc_feature (342)..(342): n is a, c, g, or t
atgcaagaactgcaagagaccatttactaagatactcaatttactggagagaaagctgctcacatggagatgattagtgtcttctggtgttttaagtagatattcacaatatttgagatcactgcattnncaacaggaagtgaatacaaaactataagagtagtaccataggtaccacagttaattctatgcaggtatgatttaatactgcatctttctgtttgtttacatttctgtaaactgcaaaaggcaccatgtatggactntgtaggcacaccttttgattaattttcattaccgatttgggttttttgggtaaaaattataaaagactaattttcnccctgtattttatgctttcatgacataacccttttcttaattggagcaagggtggcaagcttcctgggtcaccctggagaggtgtttaaattggtggcacattttgcaaaaacctttcaaattattttttgaaaaaaaaccctttggttaaatgggatttcgcagggtaaaaaaacctgcctgtttaaaaagcaaacctttat

SEQ ID NO: 576529 - DNA, 492 bp, Homo sapiens
  misc_feature (417)..(417): n is a, c, g, or t
  misc_feature (481)..(481): n is a, c, g, or t
cccgggtacactagagggatagccgtcaataataaaaaaaaaaaaaaaaaaaggataaactgggtatgctagcacatgcctgtagtcccagctactcgggaggctgaggctgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgggcaacatagcgagaccccgtctctataaaaaacttaaaaattagctgggtgtagtagtgaacgcctgtagtcccagctacttnggaggctgaggcaggaggatcacttgatcccggggaggttgaggctaacatgagccgagatcanaccaccgcatt

SEQ ID NO: 576530 - DNA, 841 bp, Homo sapiens
ggaaaaaggacacaaatggaaaaacatttcatgctcatggataggaagaatcaatatcgtgaaaataaccacactgcccaaagtaatttatagattcaatgctatttccatcaagctaccactgactttcttcgcagaattagaaaaaactactttaaatttcatatggagccaaaaaacccatatagccaacacagttgtaagcaaaaagaacaaagctggaagtgtcacagtagacttcaaactatactaaaaggctatagaagccaaaatagcatgatactgataccaaaacagacatatagaccaatggaacagaacagagacctcagaaataactacacatctacagccatcatcatgatctttgacaaacctgataaaaacaagcaacgggaacaaggattccctatttattcaaatggtgctgggaaaactggctagccgtatgcataaaatgaaattggaccccttccttacacttatacaaaaattaacttaagatggattacacgacttaaatgtaaaacccaaaacataaaaacctaaaagaaaaactaggcaataccattcaggacctaggcatggggcaaagacttcatgattaaaacgccaaagcaatgcaaaaaaaacctgaatgacaaaggggatcccttaaactaaagagcttctgcccgcacaaaaagaaaaacaaacaacacaaaaattgggcgcccggccccaaaattaaaccgctgggcgcggccagataaaacggacgggtcacagaaccgccaaacggggtcaccaaaaccgggcgggctcaaacacgatcgcgtggaaaacgcaagcacgcgcaacc

SEQ ID NO: 576531 - DNA, 372 bp, Homo sapiens
cacgaggccgcagcgtgttccgcctgatgctggagttgaacgagcggctggggaccagctacgtgatcgccacccacgacccggagatcgcggccggcgcccagcgcgttctccggctggaggaaggggtgctggtaccggcgaaggccgcttattgagcctacggtaaatggttgacgaaccatttaccgctgttctgttcccttctcctcggccgggtcctcgatcttcagcacgccggcctgcaccgcctcggtgtaccaggcttcatcctggagggcctgggtgaccacgaaattgggtgccgagcgcttgatgaggcgcggtccgacgaagcccgccaggaagaccaggatcccgagccacagttgg

SEQ ID NO: 576532 - DNA, 116 bp, Homo sapiens
cgggtgatggtcccacccctgactccgtcatcacacaccgacccgttcgttgtctcagccccgcgctgataatatggacggggtgatgctcccagtccgctgagtccggtcattca

SEQ ID NO: 576533 - DNA, 830 bp, Homo sapiens
aagcagtgctatcaacgcagagtgcccattacggccgggcgtggtaacaaaaattagctgggcatggtggcacatgcctgtaatcccagctactcaggaggctgaggcaggagaatcacatgaagccgggaggccagaggtttcagtgagccgagtgcaccgttgggagactctgtctcaaataaaataaaatcttggccttctagtaagatactttctgaaacccaaaaatatctgggacaaatggtctgaacacaagtcttgagtgccatggggagcacagaagggatatcttatgcacactgatgatgcactagacgaaacctgagactccacatgtgtgatactcacacggtcagacttccacaagagctgcagggcacgagccagggttaccacagacacttcgctctacacgtgacagcaatgtctggatacaacagcagtcacaacaaagcacatgaattacttgcaaccttagggggtaaacataagttggtgttttcttgggaactggtaagaattcttgcgggattcacacgcgcgtccggcataagggacacagggatggccgggcaattggggttcgtgcactacaattacatggtgaaaccattgacgagtggaggcactcctggaacgggtgggtaatacgctcaaaagaaggatttttgctgccaagatcaatgcttccgtaaacagccaaggtggcaaggtgacaggtaatgacataggacaatctggtgctggtggcaacaccacacacccaatcacaaactaagacattataacaggtatgagctcaagtacaagtgttatgtgggctacat

SEQ ID NO: 576534 - DNA, 275 bp, Homo sapiens
tgtagggcaatagtaggaagtaaaagtggggccacagatttttctttgtttaggattaaaaaaaaaaaaaggcttatttatatggggatagaaaaagcccagtaaagaaaagagaattggcgggaggtatgtgccccggaatgaaacccattcacaggtggaggggcgggcctttgggctaaggaggggaattggcccacaaccacaggtctatcacacatgggaagagagggagtctatgggccaaaggtgtacagggctcatggggagacccc

SEQ ID NO: 576535 - DNA, 1319 bp, Homo sapiens
ctaggcggctggcggcggcggcggctcctcagatgtcctggctcagtgctccgtgctgctggctccagcccgctgatgccccaattcctgatgaccacttgcgctggtgccgttctgcgcctgtgtggctatcctgcaactgtgtgtgtgctgtgcctgtggacttcatgctgcagcccctcaccatcatcacgtggtccatgcttggcatgcaatggcatgcattggctgccactgtgcccaggagacctgatccaggccatcaattggtgatgatgcacatgatgctcatgacacacctgtgaggcacaagaacctgcatcaatggtgctgccacgatcacctcacactgtctgtgagcagtgcctgagtgtgcaggatgctggcccagttgccccatgatgacagcaatggctcaggcaacacagtgatccacatacgatcctgagatccaaggacggcatgcccaacaaccatgcatgtgcggccctcagtgcaccgggactggtgcccagaagatgcgcatgaccaaagcctgggatctccatatggacaaacccacatcgctttccagtacccctcacaatggcagcagcgaggccacccttgcagcccagattgagcaccctgcaatagatgacatccaaaccacacagacggctgaaccaagccagagggactccccgcgagacccgggactgcagaagtccgaacctggggcatccgaagggtgaacaggatgctgcgggacgccaagacaagaagaccgtggacagagagaagcacaaaagcaggatccaaggcatcactacccagatacatatgcaagggaacattgtaacaaaggccagagccaagcgacagcgagaatagcagcccggcagccatcagcagacacccagggacacctacaaagcccacgggcaaagccagtacaaggcagagcacacacgaacgagcaagacatgaacacgagcatagcccacaaaagacagccgcacgtagcaaccaacgtcgaattgatgatggaccccaattgctatcagtggccagagagacaacggtcataccaacatacccagacagaaatcactgagtcacaggtacatggtgccattaaaccactaacaatcttagaactcaactaactaacaaataggtaaatcttagtataagcaccgaacaagagctataacaacatcacttcaataacatttatcgctatactcatacaacaagacactatatagatatatcactctcaaatacatcaagcctaatatgaatctcacatgcccttcgtcacaacagcaaacgaa

SEQ ID NO: 576536 - DNA, 385 bp, Homo sapiens
cacgtcaaccgtgcttgacaaaatcaatggaaagaggaagaccgccaaagcacatctgaggcaaactaagacatgacagacacgtgagcacgagagcaaaggagaggcaggtgtcagaggcagaggaaaatgggacattggatatgacagacatacacacctacatggaaatgtatcaacgtgcgcaagcgtagcggcggcgggcagaggactactacagatgcaaaatcaccccttctgcaagaaagcctctttagcaaccggtgcacttacaatctggtattacctgggagtgaaaagaactattacagccatgcctaactgacttcttgaggtcagaatggcggcagtggagcatcgtcattcttcaggattgccctactgg

SEQ ID NO: 576537 - DNA, 518 bp, Homo sapiens
  misc_feature (364)..(364): n is a, c, g, or t
gccagagagtaaatattttaggcttcaaggcaatatgaccatttttgcccactaagatttatgtcacatttgggaggaagatagaaataatgagcaatttgggactttgttgtacaaatgtagaattaagtaagttggttaaaatactaagaatggcagaatgtggtggctcacatctgtaatctcagcactgtgggaggaagcaggaagatagcttgagctcaggagtttgagaccaacctgggcaacatagtgagaccatggctctaccaaaactttttaaaaaattagctcgaaaaaaaaaaaagaagaggggtgtttttttttttaaaaagggttttttggggggccccccaattttggnatttaaagaggtgtagccccagcttctcaggaggctgaggaaggaggattgcttgagcccaggaggtcaaagctacagtgagccgtgatcacaccactgcactccagcctgggcaacagagcaagatgctgtctcatttttttgggacaaaaaa

SEQ ID NO: 576538 - DNA, 149 bp, Homo sapiens
ctaggaaaaacccttgtagagagagtaaaaaatttaccccccatagtgggcctaaaagcagcccccaattaagaaagggttcaagctcaaccccccctacctaaaaaatcccaaacatataaatgaactcctcccccccaattgggcca

SEQ ID NO: 576539 - DNA, 362 bp, Homo sapiens
attatcagtatctattacaatgtaataataatagaaataaagtgcaggataaatctaatgtgcttgaaacatcccaaaatcatcctgcccccaatcccatcccggtctgtggaaaaactgtcttccgcaaaattggttcctggcaccaaaaagttaggggacctctgctataagagcacttcaacttgtggccagtgcggtgactcatgcctgtaaatcccggcacttagggaggctgaggcaggtggatcacgagatcaggagttcaagaccagcctgatcagcttgacaaaaccctgtgtctactaaaaatacaaacatcagccaggcatggtggcaccaaccagtagtaccagctacta

SEQ ID NO: 576540 - DNA, 499 bp, Homo sapiens
  misc_feature (279)..(281): n is a, c, g, or t
  misc_feature (288)..(289): n is a, c, g, or t
  misc_feature (291)..(291): n is a, c, g, or t
  misc_feature (296)..(299): n is a, c, g, or t
  misc_feature (301)..(301): n is a, c, g, or t
  misc_feature (390)..(390): n is a, c, g, or t
ccagttttaacaaaggattttattttgttccctaaaaagtaaaatctagaaaatagcaacccactgcaagaagagttctatactaaaacattttcaatcattctctcttcttttcacatggtgtactctttcatgtacacatcatcggaaaacagactgataaatgcaaaccctgtgtgaaaggcacatggcactaatattgctcacacctgctacacctccttgggagccaagggaagccttttctgcaatctccccattttgatagaaaacactttnnnattttgnnanaaacnnnnanaaatttttttatagcaaaatatttaaaggtctctttccctgctcttcacttatctactaggaaggtacagaattaaaaagctttttttnccccagctgtgatcaagatgtattaaaagaatatgaaagagcatctgggttattctagaagttctgtgatcaaaacatattaaaaaaaattaaagcgcatctgggttat

SEQ ID NO: 576541 - DNA, 318 bp, Homo sapiens
tgtcacccaggctggagtgagcccaggatctcggctcactacaagctccacctcccgggttcacgccattctcctacctcagcctcccgagtagctgggactacaggtgcacgccaccacgcctggctaattattttgtattcttcagtagagatggggtttcaccatgttagccgggatggtctcgaccttctgacctggtgatccacccaccttggcctcccaaagtgctgggattacaggcgtaagccaccgcgcccagccaaaattcttaattcttggtgacactagacacatttttaagtgctcaacagctac

SEQ ID NO: 576542 - DNA, 292 bp, Homo sapiens
atcacttataaaacatgatgccatgaaaaattccacagatcagctttagttgtatcgttgtcaacgttatatgtgctctcaatgaagaaatatttgtagcatgtacacggttatttctgtttcttcaacagtcattgtacagtgggctattaaacttggattttactttttatcaatgccagtcatgttctttttattcaagtatgcaactagttgcagaaactatcagtcatatgcatttttaagcagctttcatgttctcacttcaacaatgtgaacttgtactatcgtt

SEQ ID NO: 576543 - DNA, 278 bp, Homo sapiens
ccggccatagttcgagagaaatagaaatcttcaccaatgtcagtgactgcatggtaccaaaaatcacatatgctattacctcacagtaggaaggcttctttcccattgtaggctcagagacacacttttacagaaatcaaacctatttacaggggtggcacccctatttctgtaggcatctagatcatgtcatactcccaatgctcctgcaagttcttatatccagtgttgtatcttatgctgagctgacaactagatttctctcggtgccaatggga

SEQ ID NO: 576544 - DNA, 536 bp, Homo sapiens
  misc_feature (103)..(103): n is a, c, g, or t
  misc_feature (140)..(140): n is a, c, g, or t
  misc_feature (315)..(315): n is a, c, g, or t
  misc_feature (327)..(327): n is a, c, g, or t
  misc_feature (335)..(335): n is a, c, g, or t
  misc_feature (342)..(342): n is a, c, g, or t
  misc_feature (348)..(348): n is a, c, g, or t
  misc_feature (350)..(350): n is a, c, g, or t
  misc_feature (360)..(360): n is a, c, g, or t
  misc_feature (375)..(375): n is a, c, g, or t
  misc_feature (381)..(381): n is a, c, g, or t
  misc_feature (392)..(392): n is a, c, g, or t
  misc_feature (400)..(400): n is a, c, g, or t
  misc_feature (403)..(403): n is a, c, g, or t
  misc_feature (406)..(406): n is a, c, g, or t
  misc_feature (408)..(408): n is a, c, g, or t
  misc_feature (410)..(411): n is a, c, g, or t
  misc_feature (420)..(420): n is a, c, g, or t
  misc_feature (430)..(430): n is a, c, g, or t
  misc_feature (432)..(432): n is a, c, g, or t
  misc_feature (437)..(437): n is a, c, g, or t
  misc_feature (440)..(440): n is a, c, g, or t
  misc_feature (444)..(444): n is a, c, g, or t
  misc_feature (446)..(446): n is a, c, g, or t
  misc_feature (450)..(450): n is a, c, g, or t
  misc_feature (462)..(462): n is a, c, g, or t
  misc_feature (492)..(492): n is a, c, g, or t
  misc_feature (499)..(499): n is a, c, g, or t
  misc_feature (505)..(505): n is a, c, g, or t
  misc_feature (520)..(521): n is a, c, g, or t
  misc_feature (528)..(528): n is a, c, g, or t
  misc_feature (530)..(530): n is a, c, g, or t
tgcaataacatgactgaagaaacagtattcaattaaaatacagaaattgtcaactgaaaaatagtgcatgacagaatatccaacactgtattgaatattttcngattattaaaccaaattacttaaaccttatacttganaactaatgcacattggtttttaaaatgacctactgaaaccaccataaaatgtatcttttatacaggttaattatagtaacaaatcatattgctttacattgttaaaataatattttcttcaatcatatgacctacaaaattatacccttattttccactgattctcatatttaanaccagaattttnagattttnctaaatnaatttncntcagttttgncttcgcttgcgactnagggtngaatctataangggctggntanaantngnntactatgtnacagatattngnctgangcnacangnttangatttgataggnatataaactatttctataagtgatattgtncttcagnggcctntatttttccaaatgnnggggtgngncttctg

SEQ ID NO: 576545 - DNA, 308 bp, Homo sapiens
ttctgtggtcttgatgaactttggtatcgaacgccttcatcgggcgttctgagtacatctcagcagcgcctagttcttgcgttactcacaagtggcccacctaggtactcgtatttccacgcccgtctccacgcacagcgatcctggcttcttacccttttaaagtttgagaataggttgagatcgtttcggccccaagacctctaatcattcgctttaccggataaaactgcgtggcgggggtgcgtcgggtctgcgagagcgccagctatcctgagggaaacttcggagggaaccagctactagat

SEQ ID NO: 576546 - DNA, 164 bp, Homo sapiens
  misc_feature (152)..(152): n is a, c, g, or t
  misc_feature (160)..(160): n is a, c, g, or t
tgcgtccggaaaaacgtgctttgaggagagaagagtgagcggtggatcgctacaatgattgcctgagcaggggttgcttccctatccttcttattatcgtgtttccactatcctgaagacatttaagtcttacaagagatgatgaaacacantttcaagnagag

SEQ ID NO: 576547 - DNA, 394 bp, Homo sapiens
gacgctctctgtggggcagagtaaattggagactgctgaatcaatagagagacaaatggccttatcgcccctcagtgagagatgctgactgcactcacgctcctaggacatgaaagacaaagtttcagtccctattccaggtagcaggatatggcctagagtctatcagtgagtattcaatagacacacttatgaaccccggcaagagaaagaaatggtgctgggtcatctccagaaacaaaagagcaaaatagtgcattgtctacgtcaagccaagatgaagagtttatgtacgtggtagagaagtctgcagaacccgcaggccaaatcctgtctcatttgtcttcagaacttaaagaaatgtccacaagtaactttgaatcatcccctgaag

SEQ ID NO: 576548 - DNA, 566 bp, Homo sapiens
ttccccatctagcaagctgccatcatctgcttcagaaatacgtgaacgccacaagatactcctgagaaggcaactccagacacataatgtcagattcaccaaagttgaaatgaaggaaaaaatgttaaggcagccagagagaaaggtcagttacccacaaaggaagcccatcagactaacagcagatctcttcgcagaaactctacaagccagaagagagtgggggccaatattcaacattcttaaagaaaagatggggaaaaaacagagcagaaaaactggaaactgtaaaaagcagagcgcctctcctcctccaaaggaatgcagctcctcaccagcaatggaacaaagctggatgtggaatgactttgacgagctgagagaagaaggcttcagacgatcaaactactctgagctccaggaggaaattcaaacaaatggcaaagaagttaaaaactctgcaaaaaaattagatgaatgcatcactagaataaccaacacacagcagctcctacaaggaaaacactagacagctgaacagcaagagacatcacagagcgggcgcc

SEQ ID NO: 576549 - DNA, 1009 bp, Homo sapiens
tttcagtggaaagtgtacctcatctatattttgtatcctattcttcaattgcagtgcatagggagctttcaccccgttatagactgagtcttatctttatgttttttttagcagattgcctatgtctcctcttggattgccgactgcttttaattcatgtcttctgctgtcaatcgcggataggataacggtaggtatgaactcaatgttgtaggtctttacaccaaaaggttgtggccctaatgggcacgcagtcattcttattgtctgttaagtcaatgattctgtttcaagttatgcatagatggttcatatctaagtttttggtgacccagaattaaggccttttggaaagggttaaaccctcacaaatctatcatcttttatggtgaattacttgaaccatatgtttagtccccctaggctattgaacatgtggagatatgtgatcttacatctggctgttctggtcttgtgtttcctagagatttctgcccttgaaaaatacaagggcttgtttggtgagagcagaacttagatggtgatgatagttgggcctctggtctacaacagattgtgcattaactcctttggaaagcttcgtgtataatcattcttaactttctttggtgaagcgtaagaaatttagagtagttgaaatcttataggaagggaacttctgagggcccagataaatagtgtctcgacgggcacaattcttaaactgacttaactagctgtaactatagtttcttgtggatttattgcactgatgttgtaccttgtggtatatctgtccctattataataagtcgttgttttctcctctttaatattgctgtgaacagtggtgcccattgtagcatatgtttgattgtttgtttaattatttcataagaaactacgttaatttcaccttactttcaattgtaaattagcctgtcttcctatctggatttttttgtgtgcatacatattctactggacttaactacgtttgcagtattta

SEQ ID NO: 576550 - DNA, 239 bp, Homo sapiens
cgagctgaggcaggagctggcgtgttgtgagaggtggagatgcagtagcagagatcgcgctactgcactccagccatgttcaaacagcaagactctgtctccaaaaaaaaaaaaaaaaaatttaattaccctggtttgaaacaagcctggtcaacttggggaaacctcgtctctactaaaaatacaaaaagttttgctgggtgtggtggcaggaccctgcctgtagtcccagcttctgg

SEQ ID NO: 576551 - DNA, 85 bp, Homo sapiens
ctcaggatactcactattagagttggattacagtgacttttgctataagccaatgtatattcaatggcctgaaggatctttattt

SEQ ID NO: 576552 - DNA, 1382 bp, Homo sapiens
  misc_feature (422)..(422): n is a, c, g, or t
  misc_feature (494)..(495): n is a, c, g, or t
  misc_feature (505)..(505): n is a, c, g, or t
  misc_feature (530)..(530): n is a, c, g, or t
  misc_feature (546)..(546): n is a, c, g, or t
  misc_feature (571)..(571): n is a, c, g, or t
  misc_feature (597)..(598): n is a, c, g, or t
  misc_feature (833)..(833): n is a, c, g, or t
  misc_feature (917)..(917): n is a, c, g, or t
  misc_feature (920)..(920): n is a, c, g, or t
  misc_feature (992)..(992): n is a, c, g, or t
  misc_feature (1039)..(1039): n is a, c, g, or t
  misc_feature (1045)..(1045): n is a, c, g, or t
  misc_feature (1077)..(1077): n is a, c, g, or t
ttttttttgtagagatggagtctcactttgttgtccaggcttgtcttgaactcctgggctcatgtgattcttctgccttggcctcccactctgctgggactataggtgtgagccattctgcccagccatattgtcaaataatatttaaatgatatttaaataagatgacaaaacactcctggtacaatgaatagatttatgtatatgtatgtcaagagtgagagagacataaagactgtctgatatttactaaatttttaaatttatatttactaaattattaatagtaattttactggtagtggttttatagtaattttccttttaaaatctattttctttctttcataggtgaggaaaataaactacctgaaggtttccctttaaaaaaatctgtatttggggggcttcccactttgggngttagagctcactgggcccagggattcttatccaggggaggggatctatggggtacccaggtgggctcaatnnatggacactntgaccctcctgaaatgacacctgtnatgtttagtgcaagtntcttcaggggagactgttcacagcnctatcagattctcaaagctgctcccnnttctccattacagggaagggaggctgggtggtctgttcagggtaacacagcaggtgaatagcagagctgggatgtggctcactcccactctgtagtgctcagcaggggctgctggaagctgtttaaaggcagctcttacttgctgaaactccctggaatgtctctgaccaaaaagccagggaactaaacacctctggtccctagccagagcttgggaatgccagactgcccccanggggagcttgcagcctcacaagtgccggtgcagggctgggcagcccaggggtatttgggggagggaagagagcataggggccanacnatggacatgccatggccgacgggatgctctgggctgcaacatttatacatgggtgatggcagagagcgattnggctcagtagtgacagaatgaaattacatgttttctccaaacttaanggctgnccaaggacaacccttcttaatctctcagtctntacagcccacattcataacaggaagataataaacctcacttgcctcactgcattgacgtggggataaaatgatgtaagctatcttgtcaaacactgagctggaactcgctctccctctagttctccagggtaaaaaacatggtgagcatttcagatcataaatctatgtgcactttggaataataagtggttctggtgcagtaagaggcttacaaaagcagcagtacttcaataaagtactaacagactacgtttattcacattatacacaatttcccctctccctggttttattttttcacttt

SEQ ID NO: 576553 - DNA, 889 bp, Homo sapiens
tccccaaaaaggaaggattgtggttgtggctttaaaaaccctgtgcgattccctttggccctctaaattttcccctttccaaagtgggcatcagcttttggctttagaactttagtcccgttggtggagcaactacctaccttggctaggctctgagatgcaaagagcaccacctttctgctttcaagtgggcaattatctatgcaatttccaggtgtccctataataccgccagcatttcccacttgtctaagacactgttttggctaagggaccccatgatgctatacacacacagataaactcctcaatttattaaccacaggggatgtgggttgttccacttcctgggaaaaccccatcttaggtagaaaattatcctaggtggaagcattattttatgacttaataccctgggcactatcatagtttaacttaccttactttaaattgctcagaacacctatttagcctacagttgcgcaaaacaaagcttttttacaatgaagtgttagtacctcatgtatctcttgaactgtctggaagttgaaaattagaccgggccagtcaacgggggcttacacctgtaatccagtgcttgggagccaggtaggacacttgctgggccccgtgtatcacccatggtcgcactatggggcccttttccaaattctaagtaggcatgttgttggcgcctgtgccagccgagaatgggcggcgacctgacccgagttctggtggaagccactgccgtccccgggggcgactttaattgagggctgccgagggggcgcgcgcgcctcgagtccccctgtgagggggcctttgtttttgttctctcttctttcttgtgcttactgttctctcgttctcttcgccgcggcggcag

SEQ ID NO: 576554 - DNA, 897 bp, Homo sapiens
  misc_feature (225)..(225): n is a, c, g, or t
  misc_feature (277)..(277): n is a, c, g, or t
  misc_feature (336)..(336): n is a, c, g, or t
  misc_feature (396)..(396): n is a, c, g, or t
  misc_feature (429)..(430): n is a, c, g, or t
  misc_feature (433)..(433): n is a, c, g, or t
  misc_feature (457)..(457): n is a, c, g, or t
gctcattccttcggaaacggaattggtctgaatgctccgggatgaagtaacccaggctggagatccagagggcccctgagcgccccaccggccaacggggctgtgggcccagcatttagcccgcattgggcacccaacattttcccggagtgctgggtcctgtggttctggaggcagaagaccgtttttctctctgccttccattctctgtttcttgctcctttngcccctcggtccatccttccctctgttcttccttccctcccccggttttttnctccctttctccctccctccctctttctctcccttccggggtccctccttccacccatnctttcctagctccatccttccatctcactctatctccgttcctgtctcatctctgcctgncttccctcttgcctggaaagggcagcacctcgnnttngcatgaggtctcgggcctacattnagttgcaaggcgctccatggtgctggcaaggaggctggcgggacacgggttagcaagtgatggtgagcgaagaggcagaggagtcgagctgcagacaaggagaactggcctggcttctgccccgagccagttgtatcgcggactgaggtctccgacaacccgcctgaagaacgcggggaaaaagggatgagagctccgcctgggctagtcagagaacccaggctgctgcctggaaacccggccatgcgcagtagagagccacttccgggtacctggaccggcctgggatcccgggatgctcaggaatcctttcttgtcattcttgacagcctcctctgtgtggagtctctcgctggacctgggaatcagggaatcttaggcaggtcagctgaagggagacacgccttccataccagcttgaggtcaccggaagaaagcgc

SEQ ID NO: 576555 - DNA, 282 bp, Homo sapiens
gaaactttaagcccccatttaatattcagattccattaggaccttaaacagattaacaggcaaaaaaaacaggcttacttccccagaagcctcaaggcttcttggaatttctgttaaaaattcagatgtactgatgataaatttctaaataccacaatttcagccaattttgttaccaaatgggaaaaaaaaaggaaggtttttttgaccacagaacctgttttaaaaattgggggggaaatggcagttacactggcgaatctgtgaaaaccagagttcgga

SEQ ID NO: 576556 - DNA, 332 bp, Homo sapiens
cgacggctgccgtcttgactgatgggggggtgacacgaaaggaacgggctaccgttcgtgactattccgtagtcgtgtgcagaacatgactcacgggtgttacactgggcttccgctaccagatgaagtctgtgtatgctcacttccccatcaacgttgttatccaggagaatggttctctatgttggagatccgccatttcttgaggtggcaaatacatccgcacggttcggatgagaccaggtgtcgcttgttcagtatctcaagcccagacagatgaattactccttgaaggaaatgacattgtgcttgtttcaaattcagcggcttag

SEQ ID NO: 576557 - DNA, 234 bp, Homo sapiens
gaatctgtttttctaactgcataacttcgatatctactcaagttctttaaagagactgtaacttgtatctactaatcactagcggttgtgaagctttaataagaaaatacttgtaaagcacttgtatcatacatgttcaacacgggttggtattgttggatataggccatataaactggctgagacttacactgtgtttgccttgtgctgttagttgacactttagttcttctg

SEQ ID NO: 576558 - DNA, 281 bp, Homo sapiens
ttaatgttcaattcccacctaccagtgagattatgcgggttggttatgttctgcgatagttactgagaatgatgatttccaatttcatccatgtccctacaaaggacatgaactcatcattttttatggctgcatagtattccatggtgtatatgtgccacattttcttaatccagtctatcatcgctcggacattcgggctcggtcccaagctcattcgcctatcgtgcaatactgccgcaataaaacatacgctgtgcatgcgctctccactacgcagc

SEQ ID NO: 576559 - DNA, 207 bp, Homo sapiens
taatatcctctttctgtggaatataagcaagctttgagacaatgagtggtaatcctaaaccaatcagaaatctggtccccccacttgggcccatcagggccatataaagcctagaaatacacaaacattgtgaaatgttcagtgttttttattactttttattatataccttagttcccgacaaacgagatgttttagttttccagt

SEQ ID NO: 576560 - DNA, 262 bp, Homo sapiens
tcgtgtgaagtggctgggatgacgccgtttctctgacgtaccccatagatcttggtcatggagccaaacccagtgctacccggaggtacaggtgtcgcgctgtggaaacagctcgcgtgttgaaccagttctcatacgtagggagcaagctctttgtgctatggccagcttgatggtattcacccattttttggactttcagctttcccggagtatttgaggaagggtgccagagctctgacgaaatacctgctggttcacg

SEQ ID NO: 576561 - DNA, 118 bp, Homo sapiens
  misc_feature (13)..(13): n is a, c, g, or t
  misc_feature (28)..(28): n is a, c, g, or t
  misc_feature (36)..(36): n is a, c, g, or t
  misc_feature (55)..(55): n is a, c, g, or t
  misc_feature (117)..(117): n is a, c, g, or t
ttcacccgaaagntcccttttattaaangaaattgnctaactccaaatatatggntcagaattagatgtcaagaataaagcagttgtccgagtctaagtttctatattattaataant

SEQ ID NO: 576562 - DNA, 469 bp, Homo sapiens
  misc_feature (218)..(218): n is a, c, g, or t
  misc_feature (228)..(228): n is a, c, g, or t
  misc_feature (258)..(258): n is a, c, g, or t
  misc_feature (263)..(263): n is a, c, g, or t
  misc_feature (271)..(271): n is a, c, g, or t
  misc_feature (318)..(318): n is a, c, g, or t
  misc_feature (322)..(322): n is a, c, g, or t
  misc_feature (345)..(345): n is a, c, g, or t
  misc_feature (385)..(385): n is a, c, g, or t
  misc_feature (469)..(469): n is a, c, g, or t
tactgtgagcagtggccaagcttggcatttcttgtagcccagatgtcatggaggaattcatacttgctacctacagataaagaaacagaaagtcaatgacttacccgaggcatttagccactcctacaacttaattaaaaaaaaagaccaaaacccaaaaacaaaaaagaagacaaacaaaaaacaacaaaacaatgggcaaaaggtttgagcaaccntttataaagntacacagtgaccaataagcacacacaaatnttgcntaacatcntagttgagcattaatgactgctcaattaatatatgcaattaattgcntgtntaaatgcaattaacatgcaatanatataccatgagatactattacacaccggtagatggctanatttaagactgaccatatgagcatggtgggtgtccagccactgggactctccaccttactggtggggtatagggggcccaccan

SEQ ID NO: 576563 - DNA, 446 bp, Homo sapiens
  misc_feature (7)..(7): n is a, c, g, or t
  misc_feature (21)..(21): n is a, c, g, or t
  misc_feature (91)..(91): n is a, c, g, or t
  misc_feature (175)..(175): n is a, c, g, or t
  misc_feature (442)..(442): n is a, c, g, or t
  misc_feature (445)..(446): n is a, c, g, or t
ctgtccncctatgatcaaaanttccctccccttttaaggcctgaaataatactcccactgtatgccatagaaccccatttcatttaccccncagacacataggttgccttcccaccttttgtcctactgtcaataatgcctccctgtgaacacagttaacaagttcaggccgcgngtgtcacgccctgtaatcccaacactttgagaggccaaggcgggtagatcgcctgaggtcaggagttcaagaccagctgaccaacatggtgaaaccctgtctctactgaaaatacaaaattagctgggcgtggtggcaggcacctgtaatctcagctacttgggaggctgaggcagaagaaatgcttgaacccgggaggcggaggttgcagtgagccaagatcacaccattgcactccagccagggcaacaagagtgggactccaantann

SEQ ID NO: 576564 - DNA, 303 bp, Homo sapiens
cccatgtcacaggatgatttctgaggatcaactcaggaggatgtctgttggcatctgtggggagaagccagatctgttcagctgtgtgtgtgtgtgtgtgtgtgtgtgtgtgtgtgactgtgtatgagagtgtgtgactacgcatgtgtgattgtgttcgtgactgattgtgtgtgtgtgactgcgtgtgtgactgggtgtgtggctgtgactgcgtgtgtgattgtgtttatgactgagactgtgtgtgactgattctgtgactgtgagtgtgactgtgtgagactgtgactgggtgtgtgg

SEQ ID NO: 576565 - DNA, 814 bp, Homo sapiens
catcctgatccagtcagagaagagtgatcgtcgtcttaacttcgtgtcatgctatgacgtactagaaagtcttctgaagtacatgctggatattatcgaggattgaatggctgtacaagcgtgtcaggataaatggactcagagatgtctctacagcgaataaataacatacataatataccaagcatagcgtctagactatgggtctagcacatgtgaccgatcaatggtccccgggagtaaggtgtacttccaatcaggcaggggaccactgctcggtgtgaaagaggtatcatttgtacccctggatgcttggtgtgagacctcaaaactgtttattccctatgatacactcgtctgagctctgggaacccctttagaagacgaggtgcgtcaaatggaggcacacgaagtagaattagctctatgcataggaatatggcagagatagaggatgagagtgtgtaaatagtaactccactgaactgactaaggtgatacaatcttggggttaacgaccgggtccttatctagatattttatacaatattctaggataatatgctttggtgtgctgaatcgtgaagaaatgtgttgatcaaattagacctttcgatagatattatatacgaaagtgactggaaatatgccaagtagtggtacgccaagttccgtatgggtgaatgtgaaaaggactcctggttggtattcgatattaagtagttaaaagtatgaaagccaacagattaatgggggtcaaagggtcaatgtcggctagactgtggcattacattttgagtacaagtggctattg

SEQ ID NO: 576566 - DNA, 833 bp, Homo sapiens
gggggcctacggggcggcaaggcgggcggtccttcgacctgcggcgcttcctgatgcagccgcaggtgttggcgcgcgcgtgtgcttggtcttcgccttgatcgtgtctcctgcatctatgtgtgaggtgctacagcattgcccacgagtctaaggcgagatgtactgcgtgttcaacccgcgacgagtgtatgcctgccgcgtatggcagtgccatcggggggtgcttggccttccttggcctcggcctttcttcttggtggtcgacggcgtatttccccccaggatcagcgaacgcctacttgaacccgcaagttcctggtcattggtgaccttgctcttctcagctctctggaccttcctgtggtttgtgggtttctgcttcctcagccaaaccatgttggggcagtcaccaagcccgaagggacggtgctggctgggggccgactcttgtgagggcaagccatcaccttcagcttcttttccatcttctcctggggtgtgctggcctcccttggcctacccagcgctacaaggctgccgtggacgattcatccaggaattacgttgaccccactcgtgggagccctaacagtgagtaggcctcctacccagggtgcatcctcgtggacaagtaccaacagccatcccttcagccagaacgcgggggaccaccgagggctaccagcctgccctgtggtcttggcggcgggttgccgtgggaggggggccgcgagggcctccccttttgccctgggatttcccatgagcgctcttgtgaatgcggccccctctttaccggtccatcctgttgcgggtgcccacaggtttgg

SEQ ID NO: 576567 - DNA, 134 bp, Homo sapiens
tacttttcacaggtgctcggacggattcttggaaaagtgaacagcgccggctacaggttagcattataatcagtctagttggcacagtggcatgcgttcggttcatcaattttagtgggagggcttccagcctc

SEQ ID NO: 576568 - DNA, 539 bp, Homo sapiens
  misc_feature (105)..(105): n is a, c, g, or t
  misc_feature (128)..(128): n is a, c, g, or t
ctagaggacccagcgtaatatgtaacactacacccatagtacatttaaaaggtgatgctaatactttaaaatgtttaagatatagatttaaaaagcattgtacantgtatactgcagtgtcgtctacnatggcattgggacaggacataatgtaaaacataaaagtgcaattgttacacttacatatgatagtgaatggcacgtgacaattttgtctcaagttaaaataccaaaaactattacaggtctactggatttatgtctatatgacaaatcttgatactgcatccacaacattactggcgtgcttttgcttgcttttgtgtgcttttgtgtgtctgcctattaatacgtccgctgcttttgtctgtgtctacatacacatcattaataatattggtattactattgtggataacagcagcctctgcgtttaggtgttttattgtatatattatatttgtttatataccattatttttaatacatacacatgcacgctttttaattacataatgtatatgtacataatgttattt

SEQ ID NO: 576569 - DNA, 111 bp, Homo sapiens
tcccgactgtgatctgtggcttcttcctccttgtctcttgtatggttcatgttctactttacccttttacatgtgcacagatcacccttcgtgcacagatcacccttcgtg

SEQ ID NO: 576570 - DNA, 345 bp, Homo sapiens
tttggtctttgctcaaatatttctggatttcttaaatgtacctttataattaatttctactttaattacattgtggttcaagaacatacttagtgtttttcagtacctttaaatttattgagatttgtgttagggcctagcgtatggtcttatcatggagagtgttgcttgtatattctgctctgttgggtggagtattagatatcagttaggttggttgatagtattgttcaactctttcatattctcactgattttctctatttgttctaccccttatttagagtgaagtgttgaactctccagctattactgttgaattatctagtctgggcaacagagcga

SEQ ID NO: 576571 - DNA, 345 bp, Homo sapiens
atagttctctattatgctgacatcaaacccagctgtttgcagacccagctctagtcccacacctgcctcagaccactttccccagggctccagcctgcagtgtcctttcctagtcttacaacacttctctgacaatggaatactattcaaccagaaaaagagagagaaatcctgtcttttgcagcaacagggatatacccgaaggacattatgctaaatgaaataatccaggcacagaaaggcaactaccgtacaatctcacatgcagaggctaaaaagttgctatcataggagataacagaacagtggttaccaggggtggggaggagagagggggatggagca

SEQ ID NO: 576572 - DNA, 239 bp, Homo sapiens
caggtacatacattacacccctataactacaaaacttcaccatcgggtgcatttgatttatgttatatatacagtagggatctacttcaggaaaatgtgatagtagtactggataaactatttcatccgctgtatcctcacccaaaacacacacacagagcaaactcccttacataaaagccctcatatccactggcagaccccgttcgcatcatgaactccctgtgaaacttcgccat

SEQ ID NO: 576573 - DNA, 536 bp, Homo sapiens
cacgagtgtgctaaaattttttttttgaggggggcacgagggctactgtgtcaaaactgtgcatttacttgtgttatttgactttcaaaatactattaccttaatgggcaaataatcagaacatatcacactataggatggatataaggatatgaggaatttacatttaaatggtatataccgatctagaagtgaagtgagaatcctctttttagaaagtgaaccatggatctgtgaccaaggtctaactgtgaaaaggggacattttacacttttttctttggataggatcaggtcttaagaacaggcccggtaactggaggaatgggaaccgctttgatgagaaaaatgggctggagagaaggagaaggagtttggaaaaacacagaaagcgattaggaacccatactagatgatttaaaacagacccaaaaaggctttgtttcccttgggaaaaaggcccaaagaaggtttgggaacttttttgttgcaatgaaagatctgtgaggggttccgggcctgttttgtggtctgtt

SEQ ID NO: 576574 - DNA, 326 bp, Homo sapiens
gtgccatatgcatcataagtcctgcctgttactggtgtagtagccgcctatgtaccttctagtaatatttcatacttattgcgtattatagccagttctcttagatccagcttttagtagatttcatgtgtatagtgtaaagttagggtccaactatcgtacttttgcatataaatatctcatttttccaaaatcatttgttgaagaggctgtcctttccccattaagtggtcttggaaccctcaccaaagatcatttgactatatatgtgacgatttatttccaagatttatattctattctataattctatatctttgggcaat

SEQ ID NO: 576575 - DNA, 414 bp, Homo sapiens
ctagttcctagtcattgctctgaattgtagcacttccttcatacttcagtcttgagtggacatgaaacctgaaaattatgtgtttctatgaaaatcacttattgatctgcacaagaccgagaggatattactaagttgatttatgtttatgcaataatgtagatcaaattattttgaaatgttttgagtctagactgaataagtgagttttcctttgaataattggtattgtgtagataaggcctttattcctctcattcaatctagaccaatttgaacctcagttcgtcttgtgtctggtaacgtcaggagccatcaggatccagaataaagaatgaatcttatctctcctctgctctcctcttctccgcccttcttcctacttcaactccttttttttcctctcctttttct

SEQ ID NO: 576576 - DNA, 575 bp, Homo sapiens
atggccccttggtcccgcagttcctaggcactggcacctgaattttgctccgagagggagtcctagcggacggacgccccgatgccagaaagaccacgagggtgacttacccccttagaaagagacgactgaatgaaaatgggcccccagatactgcaagcccataaaaaagggattatgacaagagaggggaacagcatacaggaacatcaagcacaaaagaagcatgcacagcaaacgacgaaaacggcgcagagacacaacaacagacacgaagccacaaccccaagcaataagcgaaccgaacgcctgacaacggaaggacgcacaccatgcgtctcaacacagacaggaaccccgcacaaagcacagaagtagcacaaagcggcccgcgagccgaagatacacagacgccaaaggacaacacacaccaccgagacccaacagaatgctccacgacccaagagaaaggccggcaaacgcgctcaaacaaagcccatcgggacaaaacgtaaacgagcgacacaccgacacaacaacactcaaggcaacaacaccaagaacgacggctcccg

SEQ ID NO: 576577 - DNA, 204 bp, Homo sapiens
ctgcagccgtgccgccgccgctctggagagaggagcggagagagccacgtcgctgtaccaatatctcagccgcgcagtccgaagagtgtaagatgttcgcctgcgccaagtcgcctgcgaccccctctctgatccgagctggatccagagttggcatacagaccaatttcatgcatcagtagttatctcggaccagacgcttag

SEQ ID NO: 576578 - DNA, 607 bp, Homo sapiens
atatacatggcatgcaccaaaacgaggacagttctgcattttccagtgggtgagcacggagagtaatcgctatagtctcgatcatatttctgcacggttcacttctcaggtaggtggatccatccttggcatatcacataagtacaagaaaaagaagtatggactaactcggttatggtataaggggatggtagtcttagaagggaattatttcatgatatagggaacaaaatttcatttagacttaaccaaattcgggtggtaccaggtttggtttccatacatttacctctcctacggatgaaaaagtaagtcaccgtgaactactactttctttcttatttaatccctttttttcccacatttcctccaaggagacacggatggacttggccttaacttccagggatatcggggcccggtggcatgatgctgagaaccaaacagtagtgaaatacatcaagttggaacggtaggggtcacttagtgctgtcatcctacctcaccccaagcaatgtcatgctaagaagaggagaggacgggcgccgagtctcatggctgtaatcctaaagtgggagagggcgggcaggcaatcactaagccagga

SEQ ID NO: 576579 - DNA, 132 bp, Homo sapiens
  misc_feature (27)..(27): n is a, c, g, or t
  misc_feature (64)..(64): n is a, c, g, or t
  misc_feature (68)..(68): n is a, c, g, or t
  misc_feature (78)..(78): n is a, c, g, or t
  misc_feature (89)..(89): n is a, c, g, or t
  misc_feature (97)..(97): n is a, c, g, or t
  misc_feature (126)..(126): n is a, c, g, or t
atagatttttaccttcttccttatttncttagcatgctttgtttctttgcatttagtatttctnaatntcaaacattntttcggttttntttggccnaattttttttccttttttccagacattcncatttc

SEQ ID NO: 576580 - DNA, 377 bp, Homo sapiens
atccgacttcttgtgtaacaccttagagtcagcttgcaagatatgctcagatcctacagaggatgaaatagtgttcttagttccagatccaatgcaaaaaccttgcttagagaattattgcggatctatacattacttcacgaatctaaagtccttcatattattcaatctcacgtcgactatatttggaggctcttcatattctactaattcttccagccgcctactgtcttagttgttgttacataactccagtccttaaagtagctaagagatgtgatttttatccaagtatcccttctagctacaagtattcttctaaatcggttctggtctacgtaaacaccctcatcttctcaagctttaccttctaactt

SEQ ID NO: 576581 - DNA, 398 bp, Homo sapiens
  misc_feature (5)..(5): n is a, c, g, or t
  misc_feature (61)..(61): n is a, c, g, or t
  misc_feature (117)..(117): n is a, c, g, or t
  misc_feature (133)..(133): n is a, c, g, or t
  misc_feature (139)..(139): n is a, c, g, or t
  misc_feature (141)..(141): n is a, c, g, or t
  misc_feature (143)..(143): n is a, c, g, or t
  misc_feature (148)..(148): n is a, c, g, or t
  misc_feature (172)..(173): n is a, c, g, or t
  misc_feature (176)..(176): n is a, c, g, or t
  misc_feature (205)..(205): n is a, c, g, or t
  misc_feature (215)..(215): n is a, c, g, or t
  misc_feature (231)..(231): n is a, c, g, or t
  misc_feature (235)..(236): n is a, c, g, or t
  misc_feature (238)..(239): n is a, c, g, or t
  misc_feature (242)..(242): n is a, c, g, or t
  misc_feature (260)..(260): n is a, c, g, or t
  misc_feature (263)..(263): n is a, c, g, or t
  misc_feature (266)..(266): n is a, c, g, or t
  misc_feature (269)..(269): n is a, c, g, or t
  misc_feature (278)..(279): n is a, c, g, or t
  misc_feature (282)..(282): n is a, c, g, or t
  misc_feature (316)..(316): n is a, c, g, or t
  misc_feature (327)..(327): n is a, c, g, or t
  misc_feature (332)..(333): n is a, c, g, or t
  misc_feature (359)..(359): n is a, c, g, or t
tacanaaaaacaatataatttatctttacaaaaattacagccaagcaataggaaagggggntgttaatgatgaagatagcaacacatatgtttagtacatatatcttacacattganatgctacatcttatancctganangncatgngtagagggggaaggggggtaaatnnggnctcattactggggttaagacttatttggnaggaatttanttcttatatgtgacanattnngnnaanactttctatataggggtnggnagnggntgacggtgnntcncattatagatctgggaagttgggtcttctttgtnggcagtataanatttnngaccagtatcaaaattgtggtaaaanacaaattgaagggattttctagtgtatgcgaacattacg

SEQ ID NO: 576582 - DNA, 422 bp, Homo sapiens
gctaggaacaatttcagtagctttgccctgaaccaaacgagaaaacaaaagggaactcccgtatgacccacgtcacgtggggcactcagagtgtgtgcggcatgatcctcggttgctcctcctctcactttagtagaggacgcggtggacagctgatttccttcagttgtttacccacttccgtcattgtcctccgctagaataacagagtagttggtaatcatggccagaaggggggtgggggcagtgtgaggacttggggtttttgtgctgtgtgacacaagaaaaaaaaggacaatctggaatccccaactccccctatccgaaaaaaaagagggtttaaggggggcaaaatttgaagttttaaaaaaggaccaagttcctgaaattcaataaaatatttttattaattttaatggaaa

SEQ ID NO: 576583 - DNA, 484 bp, Homo sapiens
cccatgtggtatagctgagtgtgaacgcgccctgacactgccatgctcagccccgagctgcttctgctctgccagcagccatgaaaggattctttgagctccgggtgtaattgtcgttctttctgccaacttcccggggctcaggcttgcgtaactgcactgtcgggggcttccctgcctgcctctgggacgtggtttgggtccgtgtcctggaagcgtgtttgtgagcatgttcctcgtatgaatgtgtttgtgagcagcttctcggatgggggactgcttgggaagcagctgcactggcacgggttcccaccctcaggccctcacccgttcccctgacctctggccctgcaggagctgagcccaggtgaccaccctgagaaagggcagaacacacctggcctaaagccatcaagacacgtggagagggggcagctaagcagaaagaggggggcttcctggaggacccctctggcagtgcagg

SEQ ID NO: 576584 - DNA, 522 bp, Homo sapiens
taagggctgtgggtttagaaattaatctcctatccaactagatgcagaatgagttcccagtttccacagtatggtaggacgtgcattggagaagttcttctcttgaaatgagaggatcgatatgtaagtagattccaggtgatactatgctaattgtaaacagttgttgttttttacagttgctccgtaaagactgggtgagtatcctgtaggccagatgcctggcctacaatgctgtgtgccttggtaactcgaaagcatatgctgtgccttcctccagagaccactgtgttccctcccagggtggtgtgagcatcctctccaggagtttttattagcagttttcttatgagggagggtcagcatcaggagcttggcattttctgtgaattgttcatatttgttgcccatttgcttttgggatgttgacctcttttagattgatttgtaccttttttataagttagccctttgggtaagagttccaagtatttcttctggtttgtcagtttctccaccaaa

SEQ ID NO: 576585 - DNA, 394 bp, Homo sapiens
tcgatcacagtaactcgactcctgtaatgcacataacatattcaacccagatgaacacactaaaataatttagaaacaggctaaaataattcctatgctgagagctctgtaaacatctggaccaatcttattctatcatatcacaatgtactttaataactaagtctattctaggcacatggccacgactacttgcataggtaacagatgatgattctcaatataagatgtatgttgctatggcatcaacaaagcagtgatctgtatgaatcaattctcgttatttaccaggatcattatgaaggaaaataaaaaattactgggttctcgtagttacatgtttacatttatgataaagtgtaaagtttagcacgtaagtatgggtaccgagctc

SEQ ID NO: 576586 - DNA, 196 bp, Homo sapiens
ccctgatccagatatctctcagtgtcagttgcctgcgctatcgaattgaagaggaggaagaggcatttacttctctgctgaaaagcaatgggaagtgcagacacatgcttcagaatgtgactccttaaaattctatccacttggaacggaaacagtctcctcctttaagcctcgagatataccaaacattatctcc

SEQ ID NO: 576587 - DNA, 424 bp, Homo sapiens
aacacagtagcaggaggtgcaagttgaggcggatggagtcacgtacttggtgtagttaggatgtgtccccttacattcttgcattggaaacttaattcctgccctcgtgagtggattactgttgctgtcacgggagtgggctccttatcacgtgagtggctatctaatcaaagtgagctctctttggctctctggctcttgcgcctgtcagcatgtgatgccctctgcgggctttgacataccaagaaggccctcaccagatgctggcaccttgatcttggacttcccagcctccagaactgtgagcgcaatatccttctgttgcttataatttacccagcctgtgatattctgttacagcagcagaaaacataccaagacatggatgtgtgtgtgtgttggtgggcggtgaggaggttattgg

SEQ ID NO: 576588 - DNA, 364 bp, Homo sapiens
gtttttttgggttgcccacttatttagccactggcatttaaatgggaatttttccaacttttaaacctttatttttgaaggtaattttgttttttgggtgggccttccgtgaagtttttgggctttttttccgacaactgactgggttttttttgggatggatttggcttttgggtttaatcctttaaggtcctttttttggccggcccttgttacttaaactggaaactaagtaagtttttttttgggggattttttttaaaattttttttggaagtcccttaaacttaatttggaggaaaaatcctggtgcttttaccataaatttggataaattttttttaagggaactcccctttttgga

SEQ ID NO: 576589 - DNA, 158 bp, Homo sapiens
  misc_feature (53)..(53): n is a, c, g, or t
  misc_feature (130)..(130): n is a, c, g, or t
accgtaggagcaggcatgacttgcccacgcctgagtcgcctatcaaaagcagnttaaacaggtagtcatatgcggggttcatggcggcggtggtgggccgctcggtcgctcccagtcgattctgctccgnctcccgttccggataacacgttcgcgag

SEQ ID NO: 576590 - DNA, 1321 bp, Homo sapiens
  misc_feature (269)..(269): n is a, c, g, or t
  misc_feature (427)..(427): n is a, c, g, or t
ggtcctgcgcatcttctttagcgtcgccagccgagccgacatcgctgaggacacctagtggtggaacgtgtgaaagcgtccgagatggtccaacagaggagtatctgggtcagtagttggcgctgcctggtctagcgcatgggactcgcgtctctgtgaacctgctaggtaatccgtggatatagtggccatcaatgaccccttcattgacctcaactgacgatggtttgactatgttccaatatggattcctacccgatgggtcgaanacttccgatgtgcgaccagctcaaaggcatagagtaaccggcgcaagcctggtcgatctcaatgcgtagaatcccaatccaccgagtcgttccgaggagccgacgatccactcgcaaacatcgaacgctggcggcgatgccttggcgcttgacgtacngtcgctggaagtccacttggcggtacttccaccgaccgagtggaagcagaggctgggggcttcattgtagcaagggggggacgccaatacagggtcatttcatcctactggaacgccctctggctgatagcccaccgagtggttacagtgcatcggcgtgtagaaccatggagatagtatagacaagcatggctcagaggatcatcaggcacatgcctcgctagcgtcaacaagtaggtgtagacacgctctaggccataggttcatccgattgacaactttgggtatacgtcggaaggactcatcgagcacgagtccatgccatcgactgggcatctcaagggagatcatggtggcatgagcccactccggggaaaacttgtgggacagttagattagggctggcgaggaggcatctccaataaacattcattctctcgggcctccttgctaggtcgccttggccaaaggcctgtgggcaaagggtcatccccttggagtgaacggggaaagctccacttggccatggggccatcccggtgtcccccaagtgggccaccgtgtccagtgggttggaacttgacccctgggcgggtacttaaaaagaaacaacctttgccccaaattaaattgacatggaaccgttccaagggacggggtgggctggaaaacccgagggcgtttccgaggaggagccgccccacaaagaggaggagacatcactggagcgagtaaacacagtgtgaggacccccaggggggtcgttccgcccgtgatgttttaacaaacgagagaaaacgcaaacactcctcaacactattgtagtgcacgaggacgtgctgcatgtacccctcacagcgagacaccatatgttgagacaaccataaccgtgga

SEQ ID NO: 576591 - DNA, 172 bp, Homo sapiens
cgataaatgggtacgatgaggagtaggaggttggccatgggtatgttgttaagaagaggaattgaacctctgactgtaaaagttttacagttttatagcgattacctgggctctgctattcttaaacaaaccctgttctttgggtagggtgtcgggtataataactaaggtt

SEQ ID NO: 576592 - DNA, 598 bp, Homo sapiens
  misc_feature (595)..(595): n is a, c, g, or t
ggacggcgctgctcggtcgagtacatcccttatgaggctggcacctacagcctcaacgtcagctatggtggccatcaagagccaggcagtccctttcaaggctccctgtgcattgatgtgacaagatgcgtccaagagtcaatgtgctctgcggcccggccttgagcccagtgcatgtgttcgtgccaacctcctctcagtccttccaggtggacacaagcaaggctggtgtggccccattgcaggtcaaagtgcaagggcccaaaggcctggtggagccagtggacgtggtagacaacgctgatggcacccagaccgtcaattatgtgcccagccgagaagggccctacagcatctcagtactgtatggagatgaagaggtaccccggagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctgggtgtccagatcacggatcccgaaggcagccgaagaagaccacattcagaaaccatgacggncgt

SEQ ID NO: 576593 - DNA, 893 bp, Homo sapiens
tccgccctccccccgcgcctaaaaatctcgtgggtttggatttccacatcccacgcatctcccctctagtatatactccggcgcgctctattaatgtttctcccccgccgctgcacggtgtacgtgatgagggaaatcgcctcgccgtggccctccgttgcaacataatcagctcacttcgggctgacgtctcgcgcgacacttttcgctgccccacgcccacatattgctgctggtgtggtgatatcacgccctgccggattccagctcgtcatcatcatctctctgcgcactctattttctctcgcatctcgtcgcgcgcggcgatcactcgcgcacccactcaatatcgctcccgcgcgcgaggggttttgctcccgccccccactctctcgcgtctcggcggcgcgctcctctcgtcgattttttgtcctaacctccgaggggatcggtccgtatcgtctccccacaggcgcccaccactggtcctgctcccccccccccgcgggggcgaactccccctccccaccgcttgtcttctctgggtgggcgtccccgatcgggggggttctgtcgccccgcgccgctcgtattgccctctcggcgcgcatctatgtcgctcgcctctctcctctctgtcctcgggcagctcttgcctgcaatcaccccccctgttctgcatttgggtggatactccccgtgagttcaccccgcggccctcttttctccacaaggtccgcgcattgacctccctcttctattttctctcgggtcgtctaggctggcggggactactctggccacccctgttggcgtctgccggacttagcagggcatgcgcctacttgtcccccgcccgtcactcccccctgtgggccccaccccgcccccaa

SEQ ID NO: 576594 - DNA, 103 bp, Homo sapiens
ggtatcccggtctggaaagatgtccagctgcccgaagttctttcggcggcactgacagacagccaaggcaatgaggaagacaatggccagcgcaaccacgaca

SEQ ID NO: 576595 - DNA, 227 bp, Homo sapiens
  misc_feature (47)..(47): n is a, c, g, or t
gcggtgattgaggatccccccgcgtacagttgcgccagatggaagtntaaccttcactccagacaagcagtttgtaggcaaaccagatccagtcaccgtaaaacgcgtggataagaacggtactccagtcactgcgacttacagtccagagtttactaaggtgactccaactggaacaggcgcaactagcacaggtcctcaaggacttccgcaactggtacggcggg

SEQ ID NO: 576596 - DNA, 104 bp, Homo sapiens
taaattagcaaccgctcgactacggtaacaaagatataatcacctaggactacaaatatttttaggactcacgttaactcacatttatacagcagtcgacgcgg

SEQ ID NO: 576597 - DNA, 382 bp, Homo sapiens
aacagcaactaggggggttagcacttgtgctaacaatttatgagcaaaaggcttagaatttgatgatgtcctcctttacaacttttttactgattcgtgaggcttataaggaatggaagatcatttcctcattcacacctacctcaactgactccagagaggaaaaccggccattggttgaagtacccctggacaaaccaggctcttctcagggtcgatctctcatggtgaatccagaaatgtacaagctcctcaacggagagctgaagcagctgtacaccgccatcacacgggctcgggtcaacctctggatctttgatgaaaaccgagagaaacgggctcccgcattcaaatacacattagaagagacttttgaaatatc

SEQ ID NO: 576598 - DNA, 1205 bp, Homo sapiens
aaattgcctaaaatgagattatctaaatacatgaatactggtcgtccaatgcagcaacttgaccatattgctttctggtgtaactgtttgatggcccattatcccacactttaggttatgtagtcctgtctcacctcgtgccagtggaggctatccgtatgttgaaatattgctcttaatgacccgcacatgatattggtatcattgtttggcgcaccatggttgctattagttatctccgccacagtatctctcagacgaggactatccacatcgatggggcatctcggagtaactactttgcttctcgtgtcatgagtagtagtgccgatcttccaatcagcctactaatgccagatgacaattagaactaaaagatttcgattgggtggggaccccgggtaatccaggattcagctgctactagtccgagttcgcttgttacctcatccaccatggtcctgttcggaattaatcaagtgttacgcgaccttggggagataactccttgtgcagcttatcccagccttattaattctaccttttgccacgttgtagtgaccgactaataacgtcacgttaggacgttaactacccgacggaatggcacctggaactgattgtgccgttaacctcctagagagtctgtctctggccctggaataggccgtaattgtgcaaagttggtaaaggcggcaagagatcaatgggtcgataatggcaccgctaatgaattcttggtacaatcttcgacttcagttaatggtaccccagtgtagtgttccactaacctgtgcacagacgctctcgtccattacagtcacggcacgtaatttgtccagaacaacatacgcggcgtgcaatgagtgggaccccacactatggataggccgcatgttcccgttactccacgcacccgtgtagccccacgcggtcgcgaggggtaaacagatcctcgtgacttgggcggaagtgccccttaagttaacccaattacttaatgaaatatattgggtgctcccggtgtcggttaatcagctcggtatctctaagagtagccccggatattaattatactaggtcacccgcaacactatgaaatgattagcaaccgaatcgatactgccagcgtatcgtctccctttctaacccgtactatgcatgttagttgtaggaatagaccgttatatcaacttctccgacat

SEQ ID NO: 576599 - DNA, 414 bp, Homo sapiens
ggtggagtggaagcggagacaacagagcgcctgtatggtggggccggccagtgcttgcgtggatcaagcgtgctcgcaactgggtacagctactcggtggtgcggacgtagatcatgcagtggagtgtcggcagctggtcttagatgaagctcggaggcagtcggaaccggaaagtacacctacgtatgcattgacccgtatcacatagaagacaaatcagagtgctatactgggaccgcacgctttcacgctcttttccacgtcagcgtcacttcgaagacggctcgattatgctggtggacatacagagatgcttcctgccagtgacaaagcggcacccgtcacgatggccgcgtgagatcgtgtgaccgacaacggggtgttccccacgattcctagctgcttggaagggt

SEQ ID NO: 576600 - DNA, 961 bp, Homo sapiens
ttgcaagtgcacagaaacaacctgcggggaaagtccagatagtctccaaaaaaagtgagctacagccatattcagtccaagatgtggttccaaggacaatattaagcatgtccctggaggtggtcatgttcagactcagaacaaagaacagtggacactctcataaggtctcctccaacgtgtgtgcgatctaacgagctaaccactcaaagacacaagcctggatggacggacgatgtcaagatacgcaaacgctcagaagtatgaaccttcacaggacgaacgagacacacggacacaacaggatgagacgactccacatcgaacataaaaatgatgcgagaagccaccacataaacaatgacaagagaacagatgacaagaatagaacagaaccatgaagagacgacagagacgaggaaacacagcagagaacacacaccagaagctacacaggagcacacgcaaacaatgaacacaggaacgaaacggaaagacacagagacacaaatcatcaatagagcgaaacgacagaaccaaagaaaagacaagagacaaacaaaaacaagacaaactaaagaaaccaagacaggagacaccgtctagaatgagacacaaagacgcagcaaacacataggaaaaaaagaacaggaataggaagaaaaacaaaaaaggaaaaacgaaacacaaggcacaaaaaggaggaagagaaaccagagaaaccaacgagaagacaacaaaaggaaaaaacagagcaaaggaacagaagcagaaaaccagagacacagaagaagaaaaacaagagaaaaacagacagaggaagataacgaagacgaaaaaacgacatagcaaaagaagaagcaagacaagcaacacgaaaaagaagaaaagagacagtagacaacaagaacagcacaccagaaagaagaacgaaagcaagacaaaatacaaaaagccacac

SEQ ID NO: 576601 - DNA, 317 bp, Homo sapiens
caaaaaaaaaaaaaattataataataaaaacatggtataaaagtttcaacaaagacttagtagcactggtgtcacatctggctggaactaaagattttccaaccattggggtgcatggcttggcatttccagttaagatattcatttaatctatgtcccggctagtttactctgggcaagactggaagatgaggtactttggtgggtgggggtgatccaggcggtaaatctgaatttggcatgatggcctttccctggccatgatcctcctggggtgaggctaaatgattggtttggttgtggggcctcacgccaag

SEQ ID NO: 576602 - DNA, 351 bp, Homo sapiens
  misc_feature (181)..(181): n is a, c, g, or t
cctaacaggtgaaggggtggcatatgaatgtgcttcaaggcacctaaaccgtggggaactgaccgcttagccaaaggcttttatttcctagcttacctgatattactgggggagggtgcaaaggggactctcacccatccacagaagacaaaatggcaccagccagtcttccacgtggganccgggtgcaggtctctctaggttccccagcttgggggtgctcagcttctgtgtcgggggctggctcgttagagcagtgggtcccacacgaggcagctgtactatggacacttggctgtccactcagtttcaccacctgccagggaaagatgatggctgtgaaaagaggca

SEQ ID NO: 576603 - DNA, 308 bp, Homo sapiens
gagatgtagactcactctgtgacccacactgaggtgcacagggctgatctcggctcacatgtaagctctcgcctctctggggtcaagcgaatcttctggcttagactcccgagtagctgggaatacaggcacccggcataaagcccggctaaattttggattttggtagagacagggtttcaccatggtggtcaagctgtgcttgaactggtgaccttaagtgatacggccgccttggcctcccaaagtgctgggaatgcaagtgtgagtcacttcgcctggccagacctaaaatctttaagtggcga

SEQ ID NO: 576604 - DNA, 1041 bp, Homo sapiens
gccgcgtccgccccggagcacagagcctcgcctttgccgatccgccgcccgtccacacccgccgcctagctcaccatggatgatgatatcgccgcgctcggtcgtcgacaacggctccggcgatgtgcaaggccggcttcgcgggcgacgatgccccccgggccggtcttcctcctccatcgtggggcgcccctaggtcaccatgggcgtgatggtgtggtcagtgggtcagagaggattcctagtgtgggcgacgaggcccagagcaagagaggcatcctcagcctgaagtaccccatcgagcacggcatctgtcaccaagctgggacgacatgtgagaaacatctggcatccacactcttctacagatgagctgctgtgtggctcccagagtgagcagcccctgtgctgctgaccgagtgcccccctgaagccccaaggcgcaaccgctgatgaagatgacccagatcatgttcgagaccttctaacatgcccaggcatgtacgttgctatccaggtctgtgctatccctgtgacgccatctgggcgtacctagctggcagtcgtgatggactccggtgacggggtcatccatactgtgcccagtctacgaggggtatgccctcccccatgccagtccgtgcgtctggacgctggctggacgggactctgactgactagctcatgaagatcctcaccgagcgcggctacaagttcagcaccacgtgcgagcgggaaatcgttgcgtgacattaaggagaagctgtgctacgtcgccctggacttcgagcaaggatgggcacggtggttccagtcctccctggagaacagcttaaagtgctgacggcacgtcgttccccattgggcactgagcggggccggtgcctgagggactcttttccggccttccttcctggggctgggggtccgtggggtccccgagataccttcatccctcatgaatgttgctttgcacatccggagaacttgttccccacattggtgtttgggggccccaggttcccgggattcgcaggagcg

SEQ ID NO: 576605 - DNA, 195 bp, Homo sapiens
tcttgccacgactcgcaacataacaatgacgagactccatcatgtagcttgtgacacttttattttatcagtcaccggggaacttttcagtgatgaacatacacagggtaataaaccttcacatggcttcaaaaggaaaccaagcaactcttctctaatctactcttactataacttcctaagcgcacaccaaac

SEQ ID NO: 576606 - DNA, 295 bp, Homo sapiens
gtcaccatattcctccatctaacagttacttttaaaaaaattaaactttggaggccatgacggcaggagtgagaggccaggagtttgagaccaatctgggcaacatagcaaaactctgtccctacaaaacaataatagtaattataaattagctgggcatggtggtacatgcctatagtcccagcaactcaagaggctaatgcaggaggactcgcttgagctcaagaggttgatgcaataacctatgatcatgccactgcactctagcctgggcaacagagcaataccctgacat

SEQ ID NO: 576607 - DNA, 403 bp, Homo sapiens
acagagctttcctgtgagtatacccgctctcgtatagcggtaaaagtgttgtgttatacacgccgggattgcgcctgtgtttaaacgcaatgtgtgggcacatctcaagagccaacctcttgtgatggtaatttatacgaattgggctctcaatcgggaggtccacccattgtgtcacggccaagaattcacagttcgctgggtccaagaatatattggggaaggtatgtagaatttaaagtttagtccccggaagccgtggtcctggaagttcaggtcccttggtggcccatttgttttatggttaaggaaggatcgtttaccttgtttggtatgttaaggattggtaaggattggaagcccattaggcctaggattatggcgggcaggtatagttcagacg

SEQ ID NO: 576608 - DNA, 835 bp, Homo sapiens
ggggaggcctgggagggggtgttaggtgttttagggccaccgagctcaaacacaaggacccctccccggcaccaggagtaatggggatctgggattgatcaagcggtatcgtttgacagtatgtaccaacaacaacagaagaggagggagggtggagacgaggggaacagcgaacaacaccggaacatcacacaagacccggaccagaaatacactgcgaccacacgcagtgtgtgtgtatatccacgcgcgcccacacaaattccacccacgcggagacacacaggacaaaaagaaagcaaccttgtgatacaaacaccacccacgcaaacaattatagccaacaagagatgtggtctctccagcaaaagccaccacaaccaccactggtgaacagcggggtgggcctccactcaatagaaaacaacagaaacacaaaaagacgagagaaaacaaaagaaagaagaaacacagaaaaaaagaacacaaagcaagcaacaaacaaacaaagaaaagcaaaaaaacaaaacaaagaagacagagaaaatagtaaaaacgtaaaaaaaagaaaaagcaagacaacaacaacacacaacacaagaacaagaacacgaagaatcacaaaacagaacaaaagtaaaaaacaaaaaacaaacaatgaaagaaacaaaaaacaaaaagaaacaaataagaaaaaaacacaacaacaaaagacagaaagaacaatacaagaaaacaaaaaaaacacaacgataaaaacaacaggaacaaaaccaaaaagaaaaaaaaaagaattcaaaaaaagagaaaaaagtaacgcaaacacaacgacacg

SEQ ID NO: 576609 - DNA, 121 bp, Homo sapiens
agatatatgccgtggatcacttaagatcctgctctcctgctgaggtggagactgcagtgagctgagatcgcaccattgcactccagccgtgggcaacgagtgcaaaactcagtctccagat

SEQ ID NO: 576610 - DNA, 108 bp, Homo sapiens
agttatacttgtttcattgtggaccttctcaactattttcccaattaggataaaggattattgttttcattatacgactctacagaataggacacttgaactcagtta

SEQ ID NO: 576611 - DNA, 497 bp, Homo sapiens
tggtctaaccaatccagcgtggcattcacccatcgcaaggtgttcaagagaaaagtgtcgaacaatcccaaccagcggcagctatacagagaccagtgcgtgggtcctgccattcccatctctttgtgtcttactctaaaaagactcagagtaacaacgcagaaaataggcgcgcctgaggcaggaccgggagtcagggcggaaaagtctagcagagcagccaaggtgcctgcagccccctgcccggtctggagaggaagaagactagccaaaacccctccaggaacagagtcctctccactagcacaaaatcgaagcaggaattccccactttgggagcgtgccagcctcggccaggcctccatccagaatggcaaagacagcctaaccatgccagggtcccgggcctccacggcttctgcttctgccgcagtctctgcggaccggccccgccagcaccagagatccatgtcggcctcagtgcaccccaacattga

SEQ ID NO: 576612 - DNA, 147 bp, Homo sapiens
tagctgttctagaggatcccgaagacaatgtgtactggattcgatgttaccaattaaagaggccaggcatgcatgcctgtaatctcagcactttacggggctgagacaggactgcttgagcccaaaagtttgagacaaagggaaaca

SEQ ID NO: 576613 - DNA, 671 bp, Homo sapiens
tggggcttattattcaaagttaactggacctccccagccaggggggcaaacccttccgagcaggggaaaggtccatctagctgccctctgtggggttgcagcctatgccatggaaaggtgtactgggaacgcaggagggacgcctctgggcaagggcaggccttaaaacgcaaggggaagtctggagcaaggaagatctggcacactcaaccccatttggatattcttactcctctctcagtctatgggccacgcgttgtggtgtagcactagacacgccggtgtgcccacaaatgagctcgcgggtgggccattctgcccggggtgtgaaaagcggcggggcccttttcttctaaagaatcctatgtgggtagtgggcgcgcacaagaagacaatatatgaggtctgtgcaaaccttacagggtccctcccaccgggcactagtgggaagagacctctctatttaacactatggtgggaggcgggccgacaaggggaaaataaaaactgcgccaaaaaaacgaaggggcccccaaggtggtggtccccacaagaggtctccgagggggcgagaacacacatttgtaacgagggcgcatgtgatacagtgtgggggacccaaacaaaaagaggaggggggtccctttggagtggaggagcggggacaacaa

SEQ ID NO: 576614 - DNA, 345 bp, Homo sapiens
tgaagtttaaaagggagagtggcttaaccacactaacagcaagagtatggatgagaatgacacagtccaacatttaaaccaattaaggcaaatattcagtgagtgagttcaattattattattttttgagacaagggctcactctgttacccaagctagagtgcagtggtgtgatcttggctcactgtagcctcaacttcttcagactcaagcaatcctcccacctcagcctcctgagtagctgggactataagcgtgtgccaccatgcctggctaattattttattttattattctatgagatggagtttcattcttgttgcccacgctggagcgcagaggtgc

SEQ ID NO: 576615 - DNA, 128 bp, Homo sapiens
cgttactggcatttgtgaaatgatggtgaaagtaagtggtagcttttcccgttctttttcttctttttttgtgagtgtcccaagcttgtaaaaattataatgttatggctactcatgttagcctccat

SEQ ID NO: 576616 - DNA, 585 bp, Homo sapiens
  misc_feature (27)..(27): n is a, c, g, or t
  misc_feature (171)..(171): n is a, c, g, or t
  misc_feature (316)..(316): n is a, c, g, or t
  misc_feature (543)..(543): n is a, c, g, or t
  misc_feature (545)..(546): n is a, c, g, or t
  misc_feature (555)..(555): n is a, c, g, or t
agatctctatgttcgatcgatatcatngttggcttctacatactggtagcaagatgacttctgattgtcatcttaggtaaattatagataaatgaaacaggccagtaatcatacactaagattaataaacagcacttcaaaattaaccgcataagggctgtgcttgcagcnaggtttcacaagacaaggcacccagattttttcttcccacgtctagcttgcagacgcagctctcgtagccatttcaaaaacctctctcactccatctttggtctttgctgaacactccatgtacccaaaagcgccaatcctgttngccatatctctgccttcttcaggtttcaccggctcctgcttcatcttggctagctcccgccttgtgtgctcatcattccgaagatccttcttattcccaagcaggatgatgggcacgtggggacagaaatgcttgacttctggggtccacttttctgggatgtttctaaactatcagggctgtcgatggaaacacacatcagtataacatcggtatctgggtaggcnannggctcaggngatcataatctacctgcccagttgtgtcca

SEQ ID NO: 576617 - DNA, 860 bp, Homo sapiens
  misc_feature (95)..(95): n is a, c, g, or t
cctggattagccgggttgtatttgcaaaccgcggagtgagtattcccgtggctgtgtaggggctaacaatggaccacccagaaggacgttcaacncttccagaagcagcaacccaatgatatatactctgtgggagcagttgtcacacagaaaatttgaaattaaaattctaggggatccaaatcagatgcagaagaatgtggtctaccgaaataagttgtaccaaagaaaatggacctaaaaagaatgtggtcgttttgatagctcgactgaaatgctgggaatccaagaggaatgtcttcaccttataacttgggattgtgctctctttcccatttctgatgtgtgggtatagctttacgatttttgtgcttacagtagtttccccactttatctttcgggagattacattttccagaggcccccagtgaaactcttgaaaaccctcaaaacatgttacccaaaccttttatagcactgttttttcccatatatattattaccctattgatacaacgtataactgtatacaaattaacgcatagccaagagatttatactaagttgtaatagaaacatttgataacatactataatacaacgttatgtgaattgttggtgggtcctcttgctttcacaattttctttttgtacagtactcacctatttagaatgtggttggctacgggtaaccaaaccacggagggcactttggttagggggcctactgtctttggattcagttttactttggttatttacgccctttttggggtccaccacatttgttccgcttgcctccggcttgtgtgtttttttcaccactggtgggcccccttttaactaattggttgacgct

SEQ ID NO: 576618 - DNA, 518 bp, Homo sapiens
  misc_feature (1)..(1): n is a, c, g, or t
  misc_feature (17)..(17): n is a, c, g, or t
  misc_feature (28)..(28): n is a, c, g, or t
  misc_feature (61)..(61): n is a, c, g, or t
  misc_feature (98)..(98): n is a, c, g, or t
  misc_feature (245)..(245): n is a, c, g, or t
  misc_feature (437)..(437): n is a, c, g, or t
  misc_feature (487)..(487): n is a, c, g, or t
  misc_feature (516)..(516): n is a, c, g, or t
naaaattgacagtatgnagaaatattgntcgttaataattatgtactgtcttaatgtgggncacttcatttgttagtataatactagataatagcagncctagttctttaggtatttgacgattcaaattttttttttgttttttgtttttgtttttttttgagacagagtcttgactctgttgacccagggctggcgtgcagtggtgtgatctcggctcacttcagcctccgccacctcaaggncagttcaagcaattctcctgcctcagcctcccgagtagctaggactacaggcgtgtgccacctctcccggctaatttttttgtatttttagtagagacggggtttcaccgtgttagccagggtgatctcgatctcctgacctcgtgattcgcccgcctcggcctcccaaagtgctggaattactggcgtgcncccaatgcccagcctcaaatatgttttaaaaaatatcattgtcctctctnttaagattttttaagtattttctcaaggnct

SEQ ID NO: 576619 - DNA, 357 bp, Homo sapiens
  misc_feature (280)..(280): n is a, c, g, or t
  misc_feature (292)..(292): n is a, c, g, or t
agcatcgtagcttcgagctggcggataacggcatcatctttacgccgcaatctgacctggtgatcctgaactacatcgccaactatatcattcaaaacaatgcgataaatcaggacttcttcagcaagcacgttaacctgcgcaaaggggcgacggacatcggctacggtttacgtccgacccatccgctggaaaaagcagcgaagaatccgggttctgacgcctccgaaccgatgagctttgaagattacaaagccttcgttgccgagtatacgctggnaaaaactgccgnaatgaccggcgtgccgaaagaccagttagaacaactggcggagtgtatgccgatccgacaagaag

SEQ ID NO: 576620 - DNA, 394 bp, Homo sapiens
cgaggatcacatgccaataacctccaatgtaggaggtggtcagcaggcaatctcctgggctataaggatgcggactcatcctcagcagcgcccatgtttgtgatacagcggtgtttgtaggatgggtttaaaaataactagaaaaactcagggccctccattttctcagatctccttgaaaattgagggcttttcgatagtttcgggtcaggtaacgatgggctccctggcgtaagcttttcaagggattttttggaggcttattggtaacttgtgataggaactttgggaccttgatacttacgtatcatgtggagaagagcccatttaacaaactaggaagatgaaaagggcaattgtggccaaaactttgggaaaaggaggttattggcat

SEQ ID NO: 576621 - DNA, 173 bp, Homo sapiens
agtaatgcaggaaggccgacaaaatcctccccctaacctcccccctggggccctggtgatgctttatgaacctaaatggggtcaaggggtccccggccacttaaagattatttaagacttgaacttggaggagatactgatttatgtagcgaataaaagccgtttttttttta

SEQ ID NO: 576622 - DNA, 1038 bp, Homo sapiens
  misc_feature (2)..(2): n is a, c, g, or t
  misc_feature (13)..(14): n is a, c, g, or t
  misc_feature (171)..(171): n is a, c, g, or t
  misc_feature (354)..(354): n is a, c, g, or t
  misc_feature (523)..(523): n is a, c, g, or t
  misc_feature (660)..(660): n is a, c, g, or t
  misc_feature (665)..(665): n is a, c, g, or t
  misc_feature (1005)..(1005): n is a, c, g, or t
cntgggggagctnngcgagctgcgtcatttgggtcgggtggtcccgctcgtatttgggaccaatcaccctctttttttcgcccacaactccctacgggggcgagcgaagccagcccggacacagaacgattgtaagataaacggagcattacagaataacagctataaatnaacaatattgaatatgataacaatcgaacttatcgaaaaaaagaagataactttaaagtatgcataagtagtataagtattgaactatataaaagtataacaaatatgaaatacattcacaacctactaacaacaccacacacaacctacacccacgccacacacacacgtagttagtttatngatcaactagtatcatggattatataatataataattttgagtccagaccattaaattgtcattacagaaacttgaaaaatagcaccaaacaacgccacgagaaataacaaaaaaacaaaaagaaaaaaaacgaaaacagacaagatcaattacaatatgcaaagaagnacccctcaacataacaaaagaatcgaataataacctaacagaatttcatctacgctagtataattatctcttattttagattacaatgtctttgtgttgtgtttgagtagtgcgcgacctgccacctccatatatancctcntgactactttacactactgacggacactcccagcagtgagatgtcaccgtcatgctcgtcgtgtgtaaatcatcgatcgttacttatatagtactaggccggttatgacgtatgggttgagacagcttcattcttaccgacagtagctatacattgcctatagacatacctcctcgactgcagcaaccgtacgaagctaaagaggtcatagatgacgcagaagagggagctgtatacatcatattgattatgtatagatgagtgtagtatgcaggttaaggtgtgagattatacagtactacgatacttatatttcacatatatagaaatatgaaaacancaatccacctcacacatgactctcgaaactcga

SEQ ID NO: 576623 - DNA, 2284 bp, Homo sapiens
ctgggtcatcggttccctggaaggagaaaaagctgccaattgaacggggcctcccggtcccaggaatgtcgcgacgcggggacgacgcatctcacgacgtcagcctgaaacacgcgggcctttcatcacccgagactcctccagcccaggagggccccgctctttcgcctgcctcctgggggagagcctctggacgacgcacgcgacagcgttttctccaaaaaaggcagagaagagaagcgtagcagtggccgcaagggcgacgggcggcgaagggtactacgcacgcccgcgtcggccacgcggagagatacgcccgactcgagtcccgcggcgcacgcccctagacgcccgaggtgcgcgggccacgcccctcgcccggccaagagcacgccccttccgtcgcccctcccgggggcgtttaccgttcctccccgccccggaagcgcgttcttacctccttcctcgcgagagttccgtgcaccggcacccagatcgcgcgagacagcggaaggagcaagagtgggaggcgcgcgcggaggccgcgacggacgcaagatggcgacggcgaccatagctctccaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaaaaaaaaaaaaatccttggcggcggttacaacgtcgtgcttgggaaacccttgcgtacccaattaattgcttgaagacatcccctttgccaggtgcggg

SEQ ID NO: 576624 - DNA, 2483 bp, Homo sapiens
ctgggtcatcggttccctggaaggagaaaaagctgccaattgaacggggcctcccggtcccaggaatgtcgcgacgcggggacgacgcatctcacgacgtcagcctgaaacacgcgggcctttcatcacccgagactcctccagcccaggagggccccgctctttcgcctgcctcctgggggagagcctctggacgacgcacgcgacagcgttttctccaaaaaaggcagagaagagaagcgtagcagtggccgcaagggcgacgggcggcgaagggtactacgcacgcccgcgtcggccacgcggagagatacgcccgactcgagtcccgcggcgcacgcccctagacgcccgaggtgcgcgggccacgcccctcgcccggccaagagcacgccccttccgtcgcccctcccgggggcgtttaccgttcctccccgccccggaagcgcgttcttacctccttcctcgcgagagttccgtgcaccggcacccagatcgcgcgagacagcggaaggagcaagagtgggaggcgcgcgcggaggccgcgacggacgcaagatggcgacggcgaccatagctctccaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactctgggaagcacacaggctacgggtccatgctgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaaaaaaaaaaaaatccttggcggcggttacaacgtcgtgcttgggaaacccttgcgtacccaattaattgcttgaagacatcccctttgccaggtgcggg

SEQ ID NO: 576625 - DNA, 2452 bp, Homo sapiens
ctgggtcatcggttccctggaaggagaaaaagctgccaattgaacggggcctcccggtcccaggaatgtcgcgacgcggggacgacgcatctcacgacgtcagcctgaaacacgcgggcctttcatcacccgagactcctccagcccaggagggccccgctctttcgcctgcctcctgggggagagcctctggacgacgcacgcgacagcgttttctccaaaaaaggcagagaagagaagcgtagcagtggccgcaagggcgacgggcggcgaagggtactacgcacgcccgcgtcggccacgcggagagatacgcccgactcgagtcccgcggcgcacgcccctagacgcccgaggtgcgcgggccacgcccctcgcccggccaagagcacgccccttccgtcgcccctcccgggggcgtttaccgttcctccccgccccggaagcgcgttcttacctccttcctcgcgagagttccgtgcaccggcacccagatcgcgcgagacagcggaaggagcaagagtgggaggcgcgcgcggaggccgcgacggacgcaagatggcgacggcgaccatagctctccaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaaaaaaaaaaaaatccttggcggcggttacaacgtcgtgcttgggaaacccttgcgtacccaattaattgcttgaagacatcccctttgccaggtgcggg

SEQ ID NO: 576626 - DNA, 2438 bp, Homo sapiens
ctgggtcatcggttccctggaaggagaaaaagctgccaattgaacggggcctcccggtcccaggaatgtcgcgacgcggggacgacgcatctcacgacgtcagcctgaaacacgcgggcctttcatcacccgagactcctccagcccaggagggccccgctctttcgcctgcctcctgggggagagcctctggacgacgcacgcgacagcgttttctccaaaaaaggcagagaagagaagcgtagcagtggccgcaagggcgacgggcggcgaagggtactacgcacgcccgcgtcggccacgcggagagatacgcccgactcgagtcccgcggcgcacgcccctagacgcccgaggtgcgcgggccacgcccctcgcccggccaagagcacgccccttccgtcgcccctcccgggggcgtttaccgttcctccccgccccggaagcgcgttcttacctccttcctcgcgagagttccgtgcaccggcacccagatcgcgcgagacagcggaaggagcaagagtgggaggcgcgcgcggaggccgcgacggacgcaagatggcgacggcgaccatagctctccaggtcaatggccagcaaggagggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaaaaaaaaaaaaatccttggcggcggttacaacgtcgtgcttgggaaacccttgcgtacccaattaattgcttgaagacatcccctttgccaggtgcggg

SEQ ID NO: 576627 - DNA, 546 bp, Homo sapiens
aaaaatcctacctattccattcaaaagggatgaagaggctggtatgcagtggctcacacattatcccagcactttgggaggccaagatgggaggatcacttgaggccaggagttcgaaaccagcctggccaacacggtaaaacccggtctctactaaaaacacaaaaattagctgggcatggtggtggttgcctgtaactccacctactctggaggcctacaggcaggagaatagcttgaacccggcgagacagaggttgcagtgagcccaaatcacacctatgtactccagcctgagtgacagagtgagtgagaaatctgtctcaaaaaaaataaaagaaagtgttaagtccccctatgggaatctcctcttctcctgccctctctggaacctcacttgtcagttcttcctcccactttcctgtatctttaacctatcccccacttttagctccttcccatcatcatttaaattactcaaacttcttctgtttgaaaaacctctccctaaactcagtgagaggtctcctgcacacccattgagcc

SEQ ID NO: 576628 - DNA, 346 bp, Homo sapiens
  misc_feature (344)..(344): n is a, c, g, or t
aagagggaaaagcagataacccaacaggaggtggtggggtctgacgtgtccaagtgctggcagacaccctggtcacccaggacagagcggaaaaaaaaaaaagaggtcagggttttaacgagctatgcaatctttttccaaaacccaaggttggctgcttcccacccctgcctgttccccttctccggcctcctcacaatgtgaagctgtggtgcagtggccaaggctcttgctcctgtctctcctcgggtcatgataccaccctcctcctcccaacccgggatcctcactgttgctgtccacagatttgtgaactcctggtagtaaaacacttttgcatcccnaa

SEQ ID NO: 576629 - DNA, 2341 bp, Homo sapiens
ctgggtcatcggttccctggaaggagaaaaagctgccaattgaacggggcctcccggtcccaggaatgtcgcgacgcggggacgacgcatctcacgacgtcagcctgaaacacgcgggcctttcatcacccgagactcctccagcccaggagggccccgctctttcgcctgcctcctgggggagagcctctggacgacgcacgcgacagcgttttctccaaaaaaggcagagaagagaagcgtagcagtggccgcaagggcgacgggcggcgaagggtactacgcacgcccgcgtcggccacgcggagagatacgcccgactcgagtcccgcggcgcacgcccctagacgcccgaggtgcgcgggccacgcccctcgcccggccaagagcacgccccttccgtcgcccctcccgggggcgtttaccgttcctccccgccccggaagcgcgttcttacctccttcctcgcgagagttccgtgcaccggcacccagatcgcgcgagacagcggaaggagcaagagtgggaggcgcgcgcggaggccgcgacggacgcaagatggcgacggcgaccatagctctcggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaaaaaaaaaaaaatccttggcggcggttacaacgtcgtgcttgggaaacccttgcgtacccaattaattgcttgaagacatcccctttgccaggtgcggg

SEQ ID NO: 576630 - DNA, 2516 bp, Homo sapiens
  misc_feature (415)..(415): n is a, c, g, or t
tgcagtattacgagacgaggccatggatggtgaaggcacgtgaacttgtgtggccaacctttgtgtgccacccacagccagctttgaccttcagggactggttggggctctggttgcctggggaggggtctccaggcttcctgccctttgagcctgggccagcatcccagcacttggcaggcaggagggggttcttggggcttgggccagcctgtcccttcctgcctcctgtgtccctctgtccttgctcatcacttctgtgctggggacccttctctcttctctgctgtccctcaaggctgtgtctggaagtctcggagggcccggtggtgggccagtgatcttgtgcttgctgagctggaggacaggcgcaggcatgctgtttgcccatcccacactctgatgggcctgctanccatgcctccctgctcacacagctgcgttcttccctctgcaaaaagcttagagatggattttgacaggagggacgtaaacataatcctggttggcatcagcttgggtctgcagtggctgtgactgcccaagggcctcttggtccccaggcccacctggctagggtgccagtggggtctgctcctggcttctcccagtgggccaggcaaagcccatgcaagagtgtgtggaagtgagctggagccctcttcagggctcgtgtggcccgagagaggcctgtgttctctgggagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaaaaaaaaaaaaatccttggcggcggttacaacgtcgtgcttgggaaacccttgcgtacccaattaattgcttgaagacatcccctttgccaggtgcggg

SEQ ID NO: 576631 - DNA, 165 bp, Homo sapiens
  misc_feature (84)..(84): n is a, c, g, or t
tctaacgatcccttactcgaaaaggggctgctaaaacaggcagattaaagagctgaagaaagctcagaggcagtgggagctgantgggctgctgctctgggggcgtggaggggagcaccctgtagatgcaccgcgcaggccctacccccttttcccagagccctt

SEQ ID NO: 576632 - DNA, 202 bp, Homo sapiens
cgcataatgcctggtgacagactgtgtgtgtgtgtgtgtgtctacgcgcgagggtacattgctcacgtcctctctccattcccacgagtgtattcacccagaagtatacaacttcacgcttcagttaccagcatcctcctcattacttctctggtctacactctcttccagtgtagtctgttctcttagaccaaatcttata

SEQ ID NO: 576633 - DNA, 2147 bp, Homo sapiens
  misc_feature (2085)..(2085): n is a, c, g, or t
  misc_feature (2087)..(2088): n is a, c, g, or t
  misc_feature (2095)..(2095): n is a, c, g, or t
  misc_feature (2097)..(2097): n is a, c, g, or t
  misc_feature (2117)..(2117): n is a, c, g, or t
  misc_feature (2120)..(2120): n is a, c, g, or t
ctgggtcatcggttccctggaaggagaaaaagctgccaattgaacggggcctcccggtcccaggaatgtcgcgacgcggggacgacgcatctcacgacgtcagcctgaaacacgcgggcctttcatcacccgagactcctccagcccaggagggccccgctctttcgcctgcctcctgggggagagcctctggacgacgcacgcgacagcgttttctccaaaaaaggcagagaagagaagcgtagcagtggccgcaagggcgacgggcggcgaagggtactacgcacgcccgcgtcggccacgcggagagatacgcccgactcgagtcccgcggcgcacgcccctagacgcccgaggtgcgcgggccacgcccctcgcccggccaagagcacgccccttccgtcgcccctcccgggggcgtttaccgttcctccccgccccggaagcgcgttcttacctccttcctcgcgagagttccgtgcaccggcacccagatcgcgcgagacagcggaaggagcaagagtgggaggcgcgcgcggaggccgcgacggacgcaagatggcgacggcgaccatagctctccaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacagggaggaggaggtggcaancnntgtcaantntggggggttccatagccccnganaacctaagggtcaggctaatgggcggg

SEQ ID NO: 576634 - DNA, 2248 bp, Homo sapiens
ctgggtcatcggttccctggaaggagaaaaagctgccaattgaacggggcctcccggtcccaggaatgtcgcgacgcggggacgacgcatctcacgacgtcagcctgaaacacgcgggcctttcatcacccgagactcctccagcccaggagggccccgctctttcgcctgcctcctgggggagagcctctggacgacgcacgcgacagcgttttctccaaaaaaggcagagaagagaagcgtagcagtggccgcaagggcgacgggcggcgaagggtactacgcacgcccgcgtcggccacgcggagagatacgcccgactcgagtcccgcggcgcacgcccctagacgcccgaggtgcgcgggccacgcccctcgcccggccaagagcacgccccttccgtcgcccctcccgggggcgtttaccgttcctccccgccccggaagcgcgttcttacctccttcctcgcgagagttccgtgcaccggcacccagatcgcgcgagacagcggaaggagcaagagtgggaggcgcgcgcggaggccgcgacggacgcaagatggcgacggcgaccatagctctccaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtcaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctg

SEQ ID NO: 576635 - DNA, 255 bp, Homo sapiens
cacgagtggtaggatgagaaggaagagtggcctgctcagagtgggtggtccagaggcctctcgggggaggtgactcctttttattttattttttttgagatggagatctagctctgtcgcccagcctgaagtgcagtcgtgtgtttcatgcgcgtccgtgtgaagagaccaccaaacaggctttgtgtgagcaacatggctgtttatttcacctgggtgcaggcgggctgagtccgaaaagagagtcagcaaagg

SEQ ID NO: 576636 - DNA, 669 bp, Homo sapiens
aaacataataatgggacgtgactaccatccaaatcttccacgtatttggctcactacctggcaccacactgagtaaagagaggccagtatgggatgacttaagtttgtaagccttattattagtaattatattatcatatcaaaacacatagaaatgtccctatcctttttgctttttatttagtctacagcccttaagtcattctgcctaaaattcatcaagctcctcttcttattaggtccaatatcccatataaaataaaattgccttgcatgtagtgcatgctcaatacaaacttattttactggaagtatcacttcctgtgagagcaggctgttataaagtgaagttgcttagcaatatttgaatgccgactttccccttccaattctccaacatgttctccaaatatatgtaagtatcagagacttatatatatctttttagttcctagttatacttcccaggaaattacctttccacacagtctgagagtctggaagtcaagttggatgcgggagcatcgtgcccccctatagcatacagcagtccattccaggtcgtcactcctacgccacctctcctttttgacatctgtgcacacagagtccaattataagtatagaggatcaaaacatactactgatttgagacaagaacttccatca

SEQ ID NO: 576637 - DNA, 1971 bp, Homo sapiens
agcggggcttgcggcctcagcttccggcctgcggaccccagcttccggcggggcggggcgggggcctgggcgcggcgtgtggcccttgcgggcgagcctggcggggttgcgttcctgtccgctagcaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaaaaaaaaaaaaatccttggcggcggttacaacgtcgtgcttgggaaacccttgcgtacccaattaattgcttgaagacatcccctttgccaggtgcggg

SEQ ID NO: 576638 - DNA, 1111 bp, Homo sapiens
gatgaatcatgtgacggtggcttgatggagtgaacctgtctttaaatgctgtccctgaatgtgacatgctggaggagaaccatgtgcagcccagaaaacccaggcgtggacgattgatcctgcagagcagaaggggggttccatcaatgggcgggatgaccctaaaaagcgatacttgtaattcaacaatgttacccaaggtgtatgcaaggggcttccaattgcccatatgtggtgtcagaaatacgcagcatggagttacccgtgataaattcaacacgttgggcaacatgaccaagtggctccaggagcaatgctatgtgagcgacctgagttacatatatcccaacattttggcccctttgacaaaacaagtaccccacagggcacaggcgacaaccttttggggacactatttcccagaacacactcaaacaggtattcagtcgtgttaacctaatagagcagtcttaaacaaaggattgattacccaacattaacaaatgcgataaacaccttagtgggtgagctaggcgatataccaaatacgccacaaggcaagacgaatgatggccaataatacccgactggggaacagtcaaatgtgggccaagcccatcaggcacaacaaggggacaacctttgggcataccaaattggttagatgaagaggaacagcgttgtgaggcacccaagtgattagtggtgaggaccactgttttctcttttaacgatccatgtgggaccagagatgtggagcatataacatccggagggtgggatacacgccgctttaagactccctatgacaattgtgaaattaaaaccagaaacaccagatagaacgaacatcccacgagtccccaatggcaaaaatcacattttaccagacaacattaaaccaaaaataaacacattaaacttttatcatacgatcgccccacctcgattgacccacccaaaaataaaaaaaacggaagcgaccacactgtatttaatccccaaaaactttattacattcactataaaatgacgcaagctcatacgtacagttaaattcatgcacgtttgagtcaccaataaaactattatagacaattttaagtttacg

SEQ ID NO: 576639 - DNA, 2059 bp, Homo sapiens
ataggctaggtacgaggctgggtgtttaatcggccgaggatggcgacggcgacatagctctctctcatgggaggttgaatggagcagctgaacttggctgacagtggcctggtggggaaggaagccagaagatgcagaagggcctcccctcccatgggcatgccttctgcctggtggctgcagaatgaggccggctgcctctttgcagcaaggcaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaaaaaaaaaaaaatccttggcggcggttacaacgtcgtgcttgggaaacccttgcgtacccaattaattgcttgaagacatcccctttgccaggtgcggg

SEQ ID NO: 576640 - DNA, 240 bp, Homo sapiens
  misc_feature (152)..(152): n is a, c, g, or t
cgatcctttcggggtgctgtcgggaatcgggtgttgctatgctgatgcccacgctgtgtcactcacctcaggagaaacgtgagaggcaaaaaaatcttcctcctgtggtggaggggacaaaggtggaacgcacacaactatcaatgccacangattcagtgccagtgcttccgctgttgcttgagcaggcgagcgcatttgattttctcccatatagagtctgagcagcaccatcgaatt

SEQ ID NO: 576641 - DNA, 195 bp, Homo sapiens
ctgctagccgcggcgccggtgttggggtgctcgggagcggcttgcctccttgttgcgactgtctttccgccagacgcgagctcgcggcccttgtgttgtcgacccactaccacgtttcttgcggtacacttgtccttcccagacacctggctccctgcttccccagggtgccgcccgctctcctcccggtctccg

SEQ ID NO: 576642 - DNA, 198 bp, Homo sapiens
cccgtgaatcgaacggaggaagcaggaaaaattgtgtcctcgcatttcaagaagaaaacactggctagagcagagagtcactccacaccgtgacatcgagcaggtagagtcaccccacaccgtgtcatcgagcagggagagtcaccccacaccgagcgctcgctcgggagcttagagcgattcccgtgaggtactgca

SEQ ID NO: 576643 - DNA, 830 bp, Homo sapiens
ttccattcctctaattagggaaagattcatcttgtcatacagaacaagatatcaataagcacttctctgtgcttgccaactgattttatccacttgtgtagacccctaagaggtgcagcttccaccttggaaaccttggattcgatgtaaggaagctattgcatgacatctgcgtatagaaaagaaagaaagacaactctgaaagggacagtttcagatgtgtatatctgctgtctttgatggactgtgttcatgattgtggtgtggctgtattctctccttgttaactgttcattcctattagttaatggtcttggggaggtctctgtaaaatatatggacaccacgaacagtggggctgctcacctcccaggtaaccaacacatgttggtgtttggagtctgctcatttcctaatactggatgatgtatgtaatccatgttatgtctcttagtgcaaaacagaaacatcatttccttagggctggctcactctgtcaggcctaatctaacaggcttagatagtaaggtcactgtgactgctgctatcacataaataattcaatattacatattcggaaaaaatctaaagactaagggacgggggaggccaaaacgatatcctgcccgaagggagcccaagataatcgcagtacccaagtctcttgtgtgatcgcaagagggcccctactatctgagtgggcttctacatgctagagaccttgcccttccttgttagaagggactcggatggcgcactcttctgtcccctggcacgctgggacgacgatatccgagggagaggactgggccgatttcctagccgtgcca

SEQ ID NO: 576644 - DNA, 287 bp, Homo sapiens
  misc_feature (270)..(270): n is a, c, g, or t
ccgccgccagctccagcctttgctcccctcccaaagtccctccccggagcggagcgcacctagggtacctcttccgtgcccccagaccaggctacccgttcagaccagtcagcctcggggaggcacgccgcccagaccagactgcacatccgctctcacgacttcatgcctcatgcacatgggcttcctccgagagccaatgatatgctctaaccagaattccgtggtgaagacgctcatcctcagccgtccctctgccagtcgattctntggcttactgcgtcacg

SEQ ID NO: 576645 - DNA, 419 bp, Homo sapiens
ctcgtccgtacatcatcaggacagcttccctcactgtgtatcagaaccgcaagaacgggaatagagtggtcagaacgtgttgtctcactctgaacaacgcaggagatgtacgatgatgaaagagacaatgtagtactgttggtccaaaagcatttaatctcaataaatctgggattatgtgtccttacgtagctggtcgtctttcttcacataaatcgatccatgttaccacatagtagttttagtttaggattcagtaacagtgaagtgtttactatgtgcaagggtattgaagttcttatgaccacagatcatcagtactgttgtctcatgtaatgctaaaactgaaatggtccgtgtaagcattgttaaaaatgatgtgtgaaatagaatgagtgctatggtgttgaaaactgcag

SEQ ID NO: 576646 - DNA, 282 bp, Homo sapiens
aaaatgaacggtgtcaaggtgaccagagaggggtgtctggccttagtgacacagctacctctctggggcaccctatctgcattgtctctgtccaggaagtgttacggctgactgggtgactcagcaaggcagatgtcagagctgggacttgggcgtaggcctttgtcctcatccccagcactggcctccctgtggaagatgaacatatcccagccacctgtgtacaggggctcactttgtgtgctccttgttgcctgagaagaaaccttgggcgtacgggga

SEQ ID NO: 576647 - DNA, 623 bp, Homo sapiens
  misc_feature (18)..(18): n is a, c, g, or t
  misc_feature (20)..(20): n is a, c, g, or t
  misc_feature (24)..(24): n is a, c, g, or t
  misc_feature (31)..(31): n is a, c, g, or t
  misc_feature (37)..(37): n is a, c, g, or t
  misc_feature (44)..(44): n is a, c, g, or t
  misc_feature (51)..(51): n is a, c, g, or t
  misc_feature (58)..(58): n is a, c, g, or t
  misc_feature (68)..(68): n is a, c, g, or t
  misc_feature (73)..(73): n is a, c, g, or t
  misc_feature (75)..(75): n is a, c, g, or t
  misc_feature (95)..(95): n is a, c, g, or t
  misc_feature (109)..(109): n is a, c, g, or t
  misc_feature (111)..(111): n is a, c, g, or t
  misc_feature (139)..(139): n is a, c, g, or t
  misc_feature (154)..(154): n is a, c, g, or t
  misc_feature (156)..(156): n is a, c, g, or t
  misc_feature (185)..(185): n is a, c, g, or t
  misc_feature (532)..(532): n is a, c, g, or t
  misc_feature (593)..(593): n is a, c, g, or t
gagtagacttcccttaanangtanctcctgncagtgntaaattnggggttncaaaatncaaagctcancaaananaacttttcttccattttgcncatttctaatattnangaaatttaaaatttgcttatttctaatnttaaggaagttctcngnatctctctctgtttagaatagttaaatancaattatgtttttaaatgagggaaagttgttctctgaaacatttttaggtactacagtgtccaaagttttctagaactaggaatcaggagagaaatgatatatttagctatttgtttccccacattggatatgcaggcgagttctcactttaatgtataaggaatacactgggcagtagagaagggtgtgcttcttttgttgtaatacttcttctacttcttacaattttctgctttcatcctttgacttctctcttctttcagctaaaaataggtcctcaagaatcaaagtttaaagctatcagaattctcaaagtaacagtccagtagaaccttgataataaacnccattccttcacaagcagatggctgtcattatcttatgtgtttttatgtattatgtcttgnggaatttaaaattaaaaggaaaatgtttta

SEQ ID NO: 576648 - DNA, 985 bp, Homo sapiens
  misc_feature (718)..(718): n is a, c, g, or t
gatcgtgaaaaagctttcaaaggtgtaaaggtactacacatctgcctctgttgatgacatggtttctctcaagtgactactgcagcagaatgaaggagaaccagaaagatatctaccttgatatctacgaggatgagcaccagagggaatcgaggttagctgactcacccgttggtggaacgttctctcggaacacatggtgcgttgaaaaagtgagtctactatgattgagtcccatagatgagtgcctgtgtccagagcagctgaccggaatttgcacggggtaacgtaactttaggtgtcagatcacccaaagtaaggcctggcacaccttccagaggagtgtaagtaagaagaaacttgagaatcgggccgatggaaatgcacgactgttgtgaggaacctctgcgacctgtcaaaaacataataaataataaataaatgtgtcgggggtgctaggtgcctcgtaaagatgatgtttaaagtatcactgggggatgcgggaactacatatgataggtgaaccttatggccacgggtgactttcccaacgagaacttttggatctcattcttgtctttgctgttctcccaataaaaggcccgtgacggtcaggtgtttttgaccaagcaccttactgtggtactgcgtaacttacatgctcctgaacactgtaagaccgagaagatctggtacaaatacggaggggcggagaganagcattgcgaagatggctggtcacactgtgctcccattgcttacagacccaacggccttgaaggactcattaataaggacctggcctgttaaactactggagtccgatttaattcgaaccgggactggcgtttttcgtacgcgaaaattttttcggacccaacacaggacatctagggacattataggaacctaaccggcgagcaatcttgtggacacagagcatcggcgcgacctctgacccaattgtgcgagaagtacaccaagg

SEQ ID NO: 576649 - DNA, 125 bp, Homo sapiens
tattatatatatacacacatattgttatatctatacacacacacatatatttatatatacatacacatatattttatatatatacacacacatatatatattatatatatacacatacgacggca

SEQ ID NO: 576650 - DNA, 82 bp, Homo sapiens
  misc_feature (81)..(81): n is a, c, g, or t
gaacccgtatcaccgagttgtatgaccatcaccacaataaatcttagaacattatcacctctaaataaaacttttagctant

SEQ ID NO: 576651 - DNA, 291 bp, Homo sapiens
  misc_feature (27)..(27): n is a, c, g, or t
  misc_feature (38)..(38): n is a, c, g, or t
gggtagcaggactagtctaagccactntgactggacantccaggtgcgaaggaggctctgcttctttctttacgcatctgcagtatgtgactgtcactcacccctctagaattgatcggaagccagcctgatgggatggcaattatttacctgtgtgtggcctctccgtggcaaaagctctttgctctgaatttcgaagaccacaaagactcacttgggtgtgtgcatcagtctaggccacagagggctcactgggtgttgatggcctagtttcacctacccacaaccctg

SEQ ID NO: 576652 - DNA, 705 bp, Homo sapiens
aaaatgtgtccagtcatggccttagccagcgtctaaggacaagcctcatagggtcatgtacagagtattaaccagtgcacacttgaggccgttcagcacattgagctatgtgagagcgccttgtgattatatgcagccagccttcatagcagcacattatcagttctagctgaattctgtcataagcatccatgctgccataaagttaagaagcgctggagcctattcgtaccaacgagatcagttgtgtcaaagactgggtctttgtgtgtgtcagcttccgccacgttagggcctactccatatgcatgctaatgacctgctcttatgaaatgaacaaagacaagtgctaaagcatgctagagtgatcatcagtcagaggctcatacacccacgcacgttgcatctgtttccatatggactcagtcgtatagattactaacaccaacgctcatgagtagctataacgttcacatgaagtgaatagattgtgtagcagactaacaccatatgctttgtttcgtagtgaagaatctcttgaccagctctttgatgatggtggtgtttatatccttcttctcgacaggcaagtccagcgtaagcatggtattcagcagttgctgctcaagcctgggtgtgctggtggtcctgcatctcacccaggatctgcaggactggctgtgcagtagggatgtcctgggaata

SEQ ID NO: 576653 - DNA, 425 bp, Homo sapiens
tccagggagttcccttcccggccctaccagcgccgtttggttgagccccttcccacaccagggtgtttttccgggcctttcctttgaaacttgccctgcttaagggccccttttcccagattgggcccaattgggtttttcccccctacctgtttagttttccgggcccgtttaggtttaggccctttaaggccttaggtttagtttgaaggatttattggggacaaaaccccccttttttgagccttcagggtggtttttggatttagccatttccaggggcttttttttgcttggaggttgggtttggatttggggttggtgccacctttttttttcagtttactttttttttttttccctttgggggtttagagccccagtttactttgaaattcagttttttgccttcggctttcccttca

SEQ ID NO: 576654 - DNA, 195 bp, Homo sapiens
  misc_feature (173)..(173): n is a, c, g, or t
cgacattacgataaaagtcacaaggcagatttggctaatacactctagagacatacattaggatagcaatagcctgattcactgaagtctaaactaagctgacttggcagaaaagttgcttgctctgcttgtcttcttgtttctcgacatccgtgaacatatgcctcattganaataccattttcagtgacatct

SEQ ID NO: 576655 - DNA, 472 bp, Homo sapiens
ttcaatgtattcaaaatgtgaaccaaaatattttatgtatattaacaatacataaaattattgttcaagagaaaatcaggccgggtccagtggctcacgtctgtaatcccaccactttgggaagcctaggcgggtggatcacgaggtcagaagtgccaagccagcctgacaaaggtggtgaaacaccgtccgtactaaaaatacaaaaagtagccgggcacagtggcgggcgcctgtaatcccagctactcaggagactgagacagagaattgcttcaacccgggaggtagaggttgcagtgggcccagatcatgccactgcactccagcctgggcaacagagcaatacttcatctcaaaaataaataaatatatacatacaaaaagaagctggggggcaagcgcatggctcatgcctgtaataccgcactttcggagctgaggcagcagatcactgaggtcggagttcaga

SEQ ID NO: 576656 - DNA, 916 bp, Homo sapiens
caaacgaaggagacgctcttagctacttggaatggaagaaatgggcttcacggattaaaactggggcaccaagcagataatctgaatataaataaagaatactggtatattctaaccaccagacttacggtggagccctgggttaaaagattccattttgtaataaggcctgtgttgcttgtggtgaatcctgtagttctattactagaataagacaaagacatgatctcatggagtgaaatttgagttctaatactgctgattatctgaagagaaataagactaattgaggagcgagaagaagataaatagactctgaaacattttatttcagaatggcgtgtcgcctaatgtatgtaacaattactgtaattatactagtaatttttcgtgaaatctaggcaggaaaaaagtagaacacttgcgagttccagtgtgctcaacgggaaactgtgtaagagtgtcagaattgtggaaaaatctttgtaacctaagattaattttcacatttaaactaaaaactctagttggctggtatggaagctcaagtcatggtacaacttacttcgagtggtgtattggggaagcaggagaccttcagcgtcagggagatgcactcatgtgtgcattcctatccgatgtcacgtaaagacttgacatgattcttttcaaccccataggaacatcacggcacaagagtaaggtgtcaccagtctactattaagatcttctactagagcttctaaagagcaactaagttctggtctaattggacgttcatctcttgcgttactttcctagcttgaagctctgattggaaggtgttgaatgaggccttactttaggataattggcggagaggcaagacaacagtcacaaacgggctcctggccaattccacatgtggccttgggac

SEQ ID NO: 576657 - DNA, 849 bp, Homo sapiens
gggaattactccgagtggagagagcgagctgaatggttgtgtggtcgtgtctcggaagagccggtagcgcttgcatgggatggtcttgaacaattgactgaataggacatgattgcaagtacattcaacaggagagtgtttgtactagtaatttgtgcgaaagtagtgggtgatggaatcataatacaacaacagagaaggagaatggtcgaacatgttaaatgacgaatcatcataggggacgaagaagttcctagagagaaggcagaggttcagaggggaaattgagttgtaaatggaagtggagttgatgtatggataaaggctacgattgactaagccgggaagttgtcttgaggaattgatgggtgagaaagagttgacagacaaagatctgtgatagaagagattcagagaaaacattcctgtggtgtattagattatacggtaatgggacgagaagggggtcatgatgtaggtgcgtggcatgaatcttgcgtcgctaggtgagtgacaataccctgggaagatggaagttccacagatgacagaagttgatgagatgatcagggatcgcagatattgaatggtgatgtgtcaagtaatatgatgaatgaggttgtagatactgatgaacgggaacagtgaaagactttgttgtgaatgtgttagatttgcttggttgtagacttgtgatatgggggctggtgtgggtgcggagcttattcgtgaagggtttttcctactggttaagaaaggtttgatgtataggcagttaggaactattcctcctatggtttcttccttttttttgggcttgtctcacactttttaaaaaagtggtcataa

SEQ ID NO: 576658 - DNA, 858 bp, Homo sapiens
  misc_feature (297)..(297): n is a, c, g, or t
gattgtacatgagtgatagacatcataatcggaggcttaaggaacctgtctagggtaaggaccagatctacagacgattatcgtcacagcccatgctttggtaataatgttctacatagtagatacccatcataatcggaggctctaggcaactgagtacgattccccgtagtaatctggtagccctcgcgatatggcgtctgccgccagaccgaatgtaacaagatcgtaagtttcggggtactcttgacactcatctactgctctctgagtccttgtctcgcgtctgtgcttatnagttgggaggcctggagccaggaacgaggttgaaccagtctgaccctcccttgaactagggaactgaaaagtaggaaacaacacaaaaaagaacaaggagaatataaaacagagatactcagataaacaaatataaaagaaggatggtgtgcgtggttttggggttagggggataggagctccgacttaccttggctagctccatgacagggactctgcaagctatgcgtttttatgaagtcgtgaaagtctggtatagcacatatgctgggagaggagaatacttatctctgggcacatcactatattaggttggctctgcaggactgaatacactgcctgacaattggccgggctcctatggaaagctcgcataaggttcgaatacaaacccaatcaggtgatgcaacactttgagggatgcaatcccaccactgttaacgaagaaggcgtaaagcatcccacaaaggggagaccctcggaaggacagaagcaaacagaagaaccgcgcgtggaagaagcgaacacggccactggatacagccacagaaatcaaacgaa

SEQ ID NO: 576659 - DNA, 747 bp, Homo sapiens
agcggaggaggacctgagcatctagtatccagaagaaagatcttggggaagtcattgtcagggtaataatctagtcatattcagaagtaatctggggagagaataatagttgtacaataagggtaggagtatgcatgactaccagaggatcatctcctgcccttcagctcctagtctcaactagacagctatactatattacactaacaccatcgcttgcatatagacaaaaatagatgaaaacgatattacttagccaactatcacggatggtttgcaaacaaaactagcactcgaacatacactgaccattgctgagaattcgtacttccaagactacatatcacatacaacgtaaagcaactgattcgcatataaggaacaacggcagtatcatagaacaataggaacaaccaagggaatttacttcgcaggaactattactaacacggggaacactaatacaactctagacataaaaacgggcacgacaagagaatacaaagcgcgacgatccacgatacaatttaaaccacttggtaaccccacaaaaacgacacactgaacagacaagccatataccttggccttagctcggcctccaataggagaaccaccttagaggcaaacggtacctacaaagacggactaagaacacgggagatgcgattaacgacagtcataagaacaggtacccacaagaggcagcgcaacaagacaaacatgcaaacactacagtcataggta

SEQ ID NO: 576660 - DNA, 2431 bp, Homo sapiens
ctgggtcatcggttccctggaaggagaaaaagctgccaattgaacggggcctcccggtcccaggaatgtcgcgacgcggggacgacgcatctcacgacgtcagcctgaaacacgcgggcctttcatcacccgagactcctccagcccaggagggccccgctctttcgcctgcctcctgggggagagcctctggacgacgcacgcgacagcgttttctccaaaaaaggcagagaagagaagcgtagcagtggccgcaagggcgacgggcggcgaagggtactacgcacgcccgcgtcggccacgcggagagatacgcccgactcgagtcccgcggcgcacgcccctagacgcccgaggtgcgcgggccacgcccctcgcccggccaagagcacgccccttccgtcgcccctcccgggggcgtttaccgttcctccccgccccggaagcgcgttcttacctccttcctcgcgagagttccgtgcaccggcacccagatcgcgcgagacagcggaaggagcaagagtgggaggcgcgcgcggaggccgcgacggacgcaagatggcgacggcgaccatagctctccaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaaaaaaaaaaaaatccttggcggcggttacaacgtcgtgcttgggaaacccttgcgtacccaattaattgcttgaagacatcccctttgccaggtgcggg

SEQ ID NO: 576661 - DNA, 1738 bp, Homo sapiens
ctgcgaccccacactatgactgcaggatggagcccgcacctccctgtcatgtggggagccctccccacagcagggctgggtgggtgggccaggaggggagtgggctgcccagcctcctgccgcccctgacgagccagcggttctctcccctctgtcctgctgcagatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaaaaaaaaaaaaatccttggcggcggttacaacgtcgtgcttgggaaacccttgcgtacccaattaattgcttgaagacatcccctttgccaggtgcggg

SEQ ID NO: 576662 - DNA, 1652 bp, Homo sapiens
cctgagctcctcccctggggtctcttctgggcagtggctgccctgtcttctgacctcctctcttctggccaccaaaccaatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaaaaaaaaaaaaatccttggcggcggttacaacgtcgtgcttgggaaacccttgcgtacccaattaattgcttgaagacatcccctttgccaggtgcggg

SEQ ID NO: 576663 - DNA, 1833 bp, Homo sapiens
ctgggtcatcggttccctggaaggagaaaaagctgccaattgaacggggcctcccggtcccaggaatgtcgcgacgcggggacgacgcatctcacgacgtcagcctgaaacacgcgggcctttcatcacccgagactcctccagcccaggagggccccgctctttcgcctgcctcctgggggagagcctctggacgacgcacgcgacagcgttttctccaaaaaaggcagagaagagaagcgtagcagtggccgcaagggcgacgggcggcgaagggtactacgcacgcccgcgtcggccacgcggagagatacgcccgactcgagtcccgcggcgcacgcccctagacgcccgaggtgcgcgggccacgcccctcgcccggccaagagcacgccccttccgtcgcccctcccgggggcgtttaccgttcctccccgccccggaagcgcgttcttacctccttcctcgcgagagttccgtgcaccggcacccagatcgcgcgagacagcggaaggagcaagagtgggaggcgcgcgcggaggccgcgacggacgcaagatggcgacggcgaccatagctctccaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagaacttccagcgtagggtcgtatggctgcccagttggtggaggtagtaggatatttgtc

SEQ ID NO: 576664 - DNA, 2430 bp, Homo sapiens
ctgggtcatcggttccctggaaggagaaaaagctgccaattgaacggggcctcccggtcccaggaatgtcgcgacgcggggacgacgcatctcacgacgtcagcctgaaacacgcgggcctttcatcacccgagactcctccagcccaggagggccccgctctttcgcctgcctcctgggggagagcctctggacgacgcacgcgacagcgttttctccaaaaaaggcagagaagagaagcgtagcagtggccgcaagggcgacgggcggcgaagggtactacgcacgcccgcgtcggccacgcggagagatacgcccgactcgagtcccgcggcgcacgcccctagacgcccgaggtgcgcgggccacgcccctcgcccggccaagagcacgccccttccgtcgcccctcccgggggcgtttaccgttcctccccgccccggaagcgcgttcttacctccttcctcgcgagagttccgtgcaccggcacccagatcgcgcgagacagcggaaggagcaagagtgggaggcgcgcgcggaggccgcgacggacgcaagatggcgacggcgaccatagctctccaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaacacaatgggaggcacaagggtacgggttattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaaaaaaaaaaaaatccttggcggcggttacaacgtcgtgcttgggaaacccttgcgtacccaattaattgcttgaagacatcccctttgccaggtgcggg

SEQ ID NO: 576665 - DNA, 162 bp, Homo sapiens
  misc_feature (36)..(36): n is a, c, g, or t
  misc_feature (108)..(108): n is a, c, g, or t
gccataagctgggcatgcgtctgtgcagttgaaagnccttgcagctgacaaaaggactgaacattgttgtaggctgtggatatggttacatgtgcagcagacacgtgngcccatctgactgcgaggtgtctcagcaatgcctggcatcgtgtccatgtctat

SEQ ID NO: 576666 - DNA, 553 bp, Homo sapiens
gcacgaggagaaaaaatgtggaggaagaaaatggcagtgacgagtctgaaattgacattagtagcaccgattcagaaaatgaagaagagcaaaatggagaagaagagatcgtaaatattgacttcgattttttcggtggtaacccagaagttgattttcatgctttaaagaatttactgcgtcagttatttggtcctcaagaaagtaccaggattcaactaagcagcttggcagatttgatcctaggttccccaaccaccacaattaaaactgacggcaaagaatctgatccatactgttttctttcattcgttgatttcaaagctaatcatctaagtgattatgtcaaatatttacaaaaagtggacatgagactttccactttcttcaaaactatgattgatagtggtaataaaaattgtgctttggttctcagtgaaaggctgattaatatgccaccggaagtcgttccacctttatacaagattacgttggaggatgttgccacggcacttggcgatgacaaacattatgacttctatatcatcgtcac

SEQ ID NO: 576667 - DNA, 408 bp, Homo sapiens
cggcacgaggacaagttttcatttctctgggataaatgcctgtgagtgcaactgctgggtcatatggcaattgcatgtttagttttacaagaaactgccaaactgctttccagagtggctgtcccattttaaattccctccagcaattataagaggtgcagtttctcggcattctttccaaaatttgatggtgttgccattttttatcttagccattttggcaggtgtgtagtaatatcttattgtgggttttacgttgcatttccctaattttaatgttgttaaatattttctcatgtgcttatccgctatctgtgtatcctcttcgtgaaattgttcttcatgtattttgttcatttcctgattgtgttttaattgttaaatttttaaagttctttagatattcta

SEQ ID NO: 576668 - DNA, 2547 bp, Homo sapiens
ctgggtcatcggttccctggaaggagaaaaagctgccaattgaacggggcctcccggtcccaggaatgtcgcgacgcggggacgacgcatctcacgacgtcagcctgaaacacgcgggcctttcatcacccgagactcctccagcccaggagggccccgctctttcgcctgcctcctgggggagagcctctggacgacgcacgcgacagcgttttctccaaaaaaggcagagaagagaagcgtagcagtggccgcaagggcgacgggcggcgaagggtactacgcacgcccgcgtcggccacgcggagagatacgcccgactcgagtcccgcggcgcacgcccctagacgcccgaggtgcgcgggccacgcccctcgcccggccaagagcacgccccttccgtcgcccctcccgggggcgtttaccgttcctccccgccccggaagcgcgttcttacctccttcctcgcgagagttccgtgcaccggcacccagatcgcgcgagacagcggaaggagcaagagtgggaggcgcgcgcggaggccgcgacggacgcaagatggcgacggcgaccatagctctccaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgaggcaagggagccaaggcctcgatccgcatgcgttgcaggcttgccatccacggaagcctttttgtggccgtgcctgcgttgaccggtctttccatctcaccggcatcttccccaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaaaaaaaaaaaaatccttggcggcggttacaacgtcgtgcttgggaaacccttgcgtacccaattaattgcttgaagacatcccctttgccaggtgcggg

SEQ ID NO: 576669 - DNA, 1549 bp, Homo sapiens
ctgggtcatcggttccctggaaggagaaaaagctgccaattgaacggggcctcccggtcccaggaatgtcgcgacgcggggacgacgcatctcacgacgtcagcctgaaacacgcgggcctttcatcacccgagactcctccagcccaggagggccccgctctttcgcctgcctcctgggggagagcctctggacgacgcacgcgacagcgttttctccaaaaaaggcagagaagagaagcgtagcagtggccgcaagggcgacgggcggcgaagggtactacgcacgcccgcgtcggccacgcggagagatacgcccgactcgagtcccgcggcgcacgcccctagacgcccgaggtgcgcgggccacgcccctcgcccggccaagagcacgccccttccgtcgcccctcccgggggcgtttaccgttcctccccgccccggaagcgcgttcttacctccttcctcgcgagagttccgtgcaccggcacccagatcgcgcgagacagcggaaggagcaagagtgggaggcgcgcgcggaggccgcgacggacgcaagatggcgacggcgaccatagctctccaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggccgcccagcctacagtgcggataaaggtgcggatgctgctg

SEQ ID NO: 576670 - DNA, 1967 bp, Homo sapiens
ctgggtcatcggttccctggaaggagaaaaagctgccaattgaacggggcctcccggtcccaggaatgtcgcgacgcggggacgacgcatctcacgacgtcagcctgaaacacgcgggcctttcatcacccgagactcctccagcccaggagggccccgctctttcgcctgcctcctgggggagagcctctggacgacgcacgcgacagcgttttctccaaaaaaggcagagaagagaagcgtagcagtggccgcaagggcgacgggcggcgaagggtactacgcacgcccgcgtcggccacgcggagagatacgcccgactcgagtcccgcggcgcacgcccctagacgcccgaggtgcgcgggccacgcccctcgcccggccaagagcacgccccttccgtcgcccctcccgggggcgtttaccgttcctccccgccccggaagcgcgttcttacctccttcctcgcgagagttccgtgcaccggcacccagatcgcgcgagacagcggaaggagcaagagtgggaggcgcgcgcggaggccgcgacggacgcaagatggcgacggcgaccatagctctccaggtcaatggccagcaaggaggggggtccgagccggcggcggcggcggcagtggtggcagcgggaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaaaaaaaaaaaaatccttggcggcggttacaacgtcgtgcttgggaaacccttgcgtacccaattaattgcttgaagacatcccctttgccaggtgcggg

SEQ ID NO: 576671 - DNA, 435 bp, Homo sapiens
agcggcgggggcctcgcgcggcggccagcagtcctgcccggaccaaccatccttccagccccttccgactccggatcctaccagaaacttcctcggccctttctttccaccatgcttgttaacatgcccgtgatgggcgcgcaatcgcgtaaggtgattgtaggcctcgattctgagcccgtgagaagaaagctagaccctcgtccccggcagcaattcatttttcagttagtatgtgttgagtagctgttatatacgcgctgtgtaacaagacacgagaagaagtcccttctctcaaggacagcgcattcttgtgggggcggtggggaggacgtgagtcttaatgcgagtcagtagagtagaacgagacctgtgggataatcagggttaggaagaagacagatagggtgatgtgatagagttgactggagtggg

SEQ ID NO: 576672 - DNA, 1613 bp, Homo sapiens
  misc_feature (1422)..(1422): n is a, c, g, or t
  misc_feature (1424)..(1424): n is a, c, g, or t
  misc_feature (1435)..(1435): n is a, c, g, or t
  misc_feature (1437)..(1437): n is a, c, g, or t
  misc_feature (1440)..(1441): n is a, c, g, or t
ctgggtcatcggttccctggaaggagaaaaagctgccaattgaacggggcctcccggtcccaggaatgtcgcgacgcggggacgacgcatctcacgacgtcagcctgaaacacgcgggcctttcatcacccgagactcctccagcccaggagggccccgctctttcgcctgcctcctgggggagagcctctggacgacgcacgcgacagcgttttctccaaaaaaggcagagaagagaagcgtagcagtggccgcaagggcgacgggcggcgaagggtactacgcacgcccgcgtcggccacgcggagagatacgcccgactcgagtcccgcggcgcacgcccctagacgcccgaggtgcgcgggccacgcccctcgcccggccaagagcacgccccttccgtcgcccctcccgggggcgtttaccgttcctccccgccccggaagcgcgttcttacctccttcctcgcgagagttccgtgcaccggcacccagatcgcgcgagacagcggaaggagcaagagtgggaggcgcgcgcggaggccgcgacggacgcaagatggcgacggcgaccatagctctccaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgggtctcatgaactntngactggtggcngnctnncggtggagtgcaacggctgctatacgcaagctgggcccccgcccgtgggggggctgcctgcaaacagtgaaggcggacggggtcggcagagggcagaagggcggctacgagaggacggggagaggcgcatacgtagccagaggctaaagacacaccggtagaactaatagta

SEQ ID NO: 576673 - DNA, 209 bp, Homo sapiens
cggctggtggaccctctgatccgaaagcatcaggaaggccatgtagagcaacagggcacccaccacggacaggtagatgacaatgatgaccttgatggtggtggtgctgcgtcctcgtacctgcactcgcacagcaggcagtaggctccacgtcatggccaggcactgatgggctccaccacgtcaggcagttgcagtccttcttggcg

SEQ ID NO: 576674 - DNA, 1538 bp, Homo sapiens
  misc_feature (1439)..(1439): n is a, c, g, or t
  misc_feature (1442)..(1442): n is a, c, g, or t
  misc_feature (1446)..(1446): n is a, c, g, or t
ctgggtcatcggttccctggaaggagaaaaagctgccaattgaacggggcctcccggtcccaggaatgtcgcgacgcggggacgacgcatctcacgacgtcagcctgaaacacgcgggcctttcatcacccgagactcctccagcccaggagggccccgctctttcgcctgcctcctgggggagagcctctggacgacgcacgcgacagcgttttctccaaaaaaggcagagaagagaagcgtagcagtggccgcaagggcgacgggcggcgaagggtactacgcacgcccgcgtcggccacgcggagagatacgcccgactcgagtcccgcggcgcacgcccctagacgcccgaggtgcgcgggccacgcccctcgcccggccaagagcacgccccttccgtcgcccctcccgggggcgtttaccgttcctccccgccccggaagcgcgttcttacctccttcctcgcgagagttccgtgcaccggcacccagatcgcgcgagacagcggaaggagcaagagtgggaggcgcgcgcggaggccgcgacggacgcaagatggcgacggcgaccatagctctccaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcanccnagcngccggaggctccccctgcagtctgggccactcagaaccactgcagaaaccgtcagaaacaggcggagcaggtgagacctgagcactgcatgt

SEQ ID NO: 576675 - DNA, 449 bp, Homo sapiens
  misc_feature (39)..(39): n is a, c, g, or t
gggtcctttatgaatggagaagatgtatggtgtctgcangctatgaagaaatactgagacaggtaatttataaagaaagatgttaattggtctgcagcggtacagaaagcataacacagatgtctgttctgaggaggcctcaggaaggttacaatcatggcagaaggaaagggggaggaggggtctcgcatggtgggagcaggagcaaaagagaaagagccaggcgccacacttttaaataggcagatctcctgagaagtcaatcactgtcgtgaggacagcactaagaggatggcgctaaaccattcatgagaaatccgcttccatgatcccatcaccttccaccaggccccacctccaatactggggattacagttcaacaggagatttgtgcagcgacacagatccaaactatgttacatagctactttcatcagcatatatataa

SEQ ID NO: 576676 - DNA, 1371 bp, Homo sapiens
taaagggctgatctccctcttaaaaattttttactacggttcacagcaccaacgggcggaaagggcggccccaaactctctttgtgccccgcgaggtaaactctgtgggggttttgccaccctttcgggggctttcctttatacccccgcctttcagccaaagtgccgcctctcaggttcttttcctcaacctttgactcgtgtttgcgttcttcgaggccgttccctctctcgtggaaccttctcctctccggagaggaacacgcgcgcgttctttctttccacacagcttctccggacactgtggtgggtggtctcactcttctccgccgcggggaggatatcatctcacagccaccgtgtctttgtgcccacgtgacacatgtgtggagaggcggccatctctccggcgaacccccctttcgactctccccgcttggctctctgggccctcctttttccccccttatatctgggcctgtgtgcggggggccacacgtgtgtcgtcaggactatgtgcgaggcgtgtgcgacccccccacaatctcccctttgtgcggtctcccccggtttctctccccacgttcttgtgcgccgagcgacaaaccccatgcgggcgccccggttgtaaacccccagctctctctccccgaggcgcgcccttgacgctgcccacattttttctccctgtgtggggacccccaccgcactatctctcctcttccagggctctcccccagggctgtgggcggcccccccctttttgtcagacgggtcgctgacagcgcgcgcccctgccctcttacccctgtgtgggccccgggccccggtggcacctcgttttgcgcttctgtcaaaaggcggggcgcccaccgctaaaaacccccccggtgttctatgcccccacagaacatctcccccaaaaacacatcaccgacgccccacactggtcatctatcactctggcacacctctctcatccacaacgttacttccctcctcccaaagagggcgaccccccaacacgttttacactcgccccctattacccccacgcccacctttttctcttcgctgttcccaccctgcgttgtgttccccccctaattgggctggcgcctccccgtctttttatctaccgccctcttctggccccctcctgtgcgccgtcgtcgcccttattaccccaccgcgtcccgtccgtgcctccgttgtggcccaaccacatctggctccttatctcgttggggcccactcctctcgtcggcgaccagcgaccgcccttatcatcctccgcgtccgcgccgcgtgtccccctcaatcattctggtacgcccctgcttcctcccttttcggcagcactatctcccc

SEQ ID NO: 576677 - DNA, 419 bp, Homo sapiens
  misc_feature (33)..(33): n is a, c, g, or t
  misc_feature (115)..(115): n is a, c, g, or t
  misc_feature (159)..(160): n is a, c, g, or t
  misc_feature (164)..(164): n is a, c, g, or t
  misc_feature (197)..(197): n is a, c, g, or t
  misc_feature (306)..(306): n is a, c, g, or t
  misc_feature (314)..(314): n is a, c, g, or t
  misc_feature (395)..(395): n is a, c, g, or t
agagaccacaggttgcttaaacacttagaggtntggaaatagtgaagaggagagtgatttggatgggggaaattttaaataagatggagatgggagagggaatagaaagtttggnaagttaaatttggtagataattgtgttgagtggatatggaaagnnaggntgtgtgggatgagttggtgggtgttggtggggntttagtatggtttgtagttattttgatggtgaggaggtggttgggtgttgtggtagtttgtagtaggttgaggtggaggttgaggaggaggtgggttgggtgggttggntgggttgnggtttggagggggggtagagggataatgctgctgctgatagaattttttgggctgggccaacttgatataaaaattgcttncactgaaagtatggaaattttttt

SEQ ID NO: 576678 - DNA, 381 bp, Homo sapiens
  misc_feature (6)..(6): n is a, c, g, or t
aaaccnatttttaacctgtgtggccccccctagctgtttgccagcaaatttaatatttatgagactttatttaaaaaaaatatatcatttagaggtggtttgctgtgcctgatttatttatgtatttatttaatcagatggagtctcgctctgtcacccaggctggagtgcagtggtgcaatctcagctcactgcaacctccgcctcccgggttcaagcagttcgcctgccttagcctccctggtagctgggattacagacatccaccaccatgcccagcaaatttttgtatttttagtagagacagggtttcaccatgttggccatgatggtctcgatctcttgaccttgcaatctgcctgcctcggcctcccaaagtgc

SEQ ID NO: 576679 - DNA, 543 bp, Homo sapiens
caacgatggtcctcagctgaagatgtcaccttttcatctactttctcccttgcttcctccatctaaacaaagacgcagagttcgaactctaaacaaaaactcacagagagttcaggggttctctgctgcgacttccactctctggcttagtgtgcatccgtttccacgggctattttacctcttgatttttggccctgtggtctctgaatgctggatgtcatgcgctgaagcctggagacgtccagatccggggtcaggaaactgcagcggggggcagccgcctgcttttgtgaacgcagcgtattgaaacacacacatgcccatttgttcacagatgctctgtggctgagtgtgccctacagcagcacggttcagtaggcaggggccaacttctactacccggctaaggaaaagatgggcagagcctgctctggatgacgctgtgttccagccggcggagagggtccccatttctcggttaaggagggtgactcctcgctccaatcagggactgagctgagctgaggaccatctgggggtac

SEQ ID NO: 576680 - DNA, 247 bp, Homo sapiens
aacccgatagccgacagctctggatcttactgaagcgtgggctcggagctccccttactctcgtgtctcctctcggccccctttatttccttcttgctttgggtctttaacacctctcgagcctgtcctccccccgccactggaagtcttcccgtctctaaatggaattagtggagcccggagcctctggtgtaacgcacagacatgatccatgggcgcagcgtgcttcacattgtagcgggtttaa

SEQ ID NO: 576681 - DNA, 125 bp, Homo sapiens
tctagaggatcccggaggtgcagtgacggaagtgtgaaagagcttgtgtgtctcacagtggtcattgctcaataaatggcagctactgtttttactcgtaagggtgatgatttggatgcacagaa

SEQ ID NO: 576682 - DNA, 181 bp, Homo sapiens
agacgtgtcaacagatgcattcatttacatatgtacacacgtgcctcggctctgaccgtccacacagggcccgtgtcaacagcagcgactcaaggggcgtgtgtacatatgtaaatgagaatggagacgtgtcacagatgcattcatttctcttggctgtgtattgtcttcttttgcgacc

SEQ ID NO: 576683 - DNA, 628 bp, Homo sapiens
gagagatagagagagagagagagagagagagagagagagagagagagagagagagagagagagagagagagagagagagagagagagagagagagagagagagagagagagagagagagagagagagagaactagtctcgcgccttcacactcttttcaccctccttagccaagtgcaatccctttgacatccactgcatcgccgtccccaacacaccagaccactcccctctctgccaatccctgaaacaggccccattgttcacctgacccatcaatccccggccacatgctttgcggggagccaacccgccagccactcacccctaccaagactttcacccttcccggccaaggtcgcagtcaccgcccgcgcttcggtaacgcccacttctcaccgtcccaccccccacctcccactccgaccctctcccgcagcctggaccccattcgtacaccctgtcgccccacgaacgcctcactccatcatcatcggcccactgctcgccaccctccactcctcttcttccacctctccgcgaccatccccttcttctacgctctccgctatcccttccccgcatccgtctccctcccctcacccccaccttccctcctccacttccct

SEQ ID NO: 576684 - DNA, 885 bp, Homo sapiens
  misc_feature (885)..(885): n is a, c, g, or t
agtcggtattttcctcattggtgacatccaaatagtaacgtgaatattccatgtatggctggcaagaacaaatgtacgattattgatgactaactactggcatctctccataacagtccatctgctgacaggctgcctgcttcttgatccgtcgactctttaggtttctccccatgtattccagcctgatcttcaacaaccccatttctatctgccaaagcgtcttactgagctagtaggcggatgcacgatgtatgacatgccacctatcacaagggcctaaccgagccctggctgcggatcttcattgtagttcacattatttccattcttacaccctacttcatgttgtacactattttcttacatttgctgtctcttctaaacattctttgctgcaatccactttttctctattgtgctctaggtgctgcagaggctaatgctgggtttcctttcattcctccttgcagctcagcacctcccttctcaattcctttgccatgtctccactttaaatcttaacctactccagatagtcttttccttcacactattggcatctgtgcttgggttgctttcagtctattctctgatctatgatttcttgcatgatcaaagaaggtgccatgaaaggatcccttaagaaagcctgtcattttagccagaacgaactagcttcatgatagcaccaggaagactgatatctcccaggaaaacaaccactcaggggggtgctccttttgccttcctatggagtgtttggctgctgtttttgaaacccaagggtttctggttaggctgcgccagatggagtggctaaaagctgggatgggacactaaacacatgtccaggtcccctgtggatttttaaccatgacggcn

SEQ ID NO: 576685 - DNA, 414 bp, Homo sapiens
  misc_feature (406)..(406): n is a, c, g, or t
atttgatttaaaagtgaaagatgtgtgacctccttcccttttgccttaaaccaccttaccaagcccattgtagggttaatagttggccctaatttcaatgtaaatgtgtcctcagggaatatggaggccccacagagagggagagagatgagagaagggcagagcagtcagaacacacaacatttttcgattaagttgaccttcttttctgggtgtggtttgtggtaccccaaaacaattataataaaaccatgaaagatcactcatcacagatcaccgtaacagatacaataataatggaaaggtctgaaatattccaagaattaccaaaatgtgacccagagacaaagtgagcacatgcaattggaaaaatggctcgaattaatgcagggttgccaggaaactncaatatgt

SEQ ID NO: 576686 - DNA, 253 bp, Homo sapiens
cgtgaggaaaagacgattaaccgagattccgtatattagtggcgatgcgaactgcggaccatagccagtgcgttctaattcaagctagcagaaccatctggaaagatgggccatagctggtgcccgtgctgtatgcgaaagtgatgttagaagactcgagtagggcgggacacgtgtaatcctgtctgaacatggggggaccaccctccaagcctaaatactcgtatgcgaccgatagcgaactagtaccgta

SEQ ID NO: 576687 - DNA, 341 bp, Homo sapiens
aaaagtgggagctaaacagtgggtattcacagaacataaaaatggcaacgattggccgggcgcggtggctcacacctgtaatcccagcactctgggaggccgaggtaggtggatcacgagtcaggagatcaagaccatcatggctaacacggtgaaaccctgtctctactaaaaatacaaaaaattagccgggtgtggtggcaggtgcctgtagtcccagctactcgggaggctgaggcaggagaatggcgtgaacccaggaggcagagcttgcagtgagccaagatcacgccactgcactccagcctggctgacagagcaagactccgtctcaaaaaaaa

SEQ ID NO: 576688 - DNA, 357 bp, Homo sapiens
gtctacaaaggatagaaatggtctgtatctgtcattttgttcaagtcctctttatatttggttccattgaggaaaaccaccctctctaatcaggagatcacgttctttctgttatcctagctcattttgtagacgtgtgttctaggcccatggcgctgtgtcaatatatacttagataaaactgataggcctgcaatggagcattcacagtttctctagctgcaatcctactaattttacacgattttaaaacaaccaaggacccacgagaaggtaacaccatatttcaacgaacacgacagcacagcctgtgcaaaggctacatatcctatactgcacatatcaaagagagaggca

SEQ ID NO: 576689 - DNA, 195 bp, Homo sapiens
cacgagtggtaacgagggagaatgtattagcaggggagagtttgagagagagggacagatcccaacagagcacagccgagcgagggtgcaccgcaggataccccaagaagagccaacgacagggctacaatccacatcatgccaaaggctacacaagggcacaaaggtctcccaaggcctgccatgaacgctgct

SEQ ID NO: 576690 - DNA, 162 bp, Homo sapiens
  misc_feature (162)..(162): n is a, c, g, or t
gagcttaggctgcctgggttttggtgatttttgtctgattgcaatgtctggacgtgggaagcaaggaggcaaagttcgggccaaagcgcaaatcccgctcttctcgcggctggtctccagttccccgctggccccgttccaccccttcctcccctaaaggcn

SEQ ID NO: 576691 - DNA, 1043 bp, Homo sapiens
  misc_feature (1043)..(1043): n is a, c, g, or t
agcggaggtgcatcgaggaggacggaatgcattgatctgcggcccagtccccatgtgagagcgatgcacgagtgcggctcttcatcatcctgccaaccccatacagctagagcattcccggagaacctgagacaaccttaatgaacaggctatggcagtattcgatagacggtggagagggtcttatgcagagctggatgcactcgatttggactcctgttctgaaatgatcaggcactctcttggtagccaaggcccagctgacgcttccaccgtagaagaagtcggactgtgaactggtcaggatcccggtactttgcatgggtcgtagggattgattgatcccaaagtccagcggattcttgggcgctctggacgtttccgctcgttccgcacgcgaatacttctccgagctccgttgttaatgcttgcactaccactagtagaaaagacacacatgagatgtccattgcgtatcttttctagttagcggctcttgggacgagaccgactatacattcataggttccgagaaatcatgggatttaataaaacggcaagttgcggagctagatgggccacctatgattcggccacgataagtcttccaattcctagtcaaaccaaaggggagctggtagacgcgtcaacaatggcaaaagatgtgccaagaagacctaggaacactttattccacgcgatttgccttgaaacggtgcaaaccagtccatcgcaatcgctattcgacaaccgtttcttgctaagtagattccttagtgacctcgaggtggaatctcatcatgggtaggataagggctacgtggggatggaatctggtgtattacaccaacatatacggccacgaagaatacgccccatgaggactgtgtgctaatggctaaggacgttgtacctttctccattactctcaatggccctctatggggtcgtttggggccttctcataaagacctctaatttttcccccttgtgccaggcattgtaagctccttgacttggtatcgacctgtttacaccaacan

SEQ ID NO: 576692 - DNA, 789 bp, Homo sapiens
ctttctcccctacttatacagaaaaaaaaaaaaagaataattactaatctcggggcttggtatcttggtgtccctttggcatagactggtctttcttatccccaacccggcctatgggttaccatgaaatgggaattaaatcctcaacaatgagtgaatattagccaggcctaggtggggaaaggggaaggatattagaggtaaagggaccagcaatgtgtacaaatgtgcaggtgagcaggagtcagacttttataagcaggagtgaaagggcttggtggtgcctttctaaggatggtggggtttaatcctacaagtaatagcacatcactgaataattttaacaggagagtgggcttcaggttgggcatttcagaaagatggtctgggctataatgggggaaaagggatgggaatgagggctaaatcttttcaagatgcaaaagggggcaagaaaacaggttagaaagctaagtggaataacctaagggaggcgtgagaatgatacgttatggatagtgggttctacctggtggtcacaacattggacaatacactttctacaacagatactggttaacatggggagaatggagtcggggtactatgagctaaacaccaaaactgggactggacttggtatttagaccttatctcttgaattactcctggccttggaacaaacaccaaattctgcgattctacctctaagggtctctgagataataacctcctttccatctggctgccatgggcttatcaggcctgggttatcgtaacgtcttctcc

SEQ ID NO: 576693 - DNA, 305 bp, Homo sapiens
gtcgacccgggttcaagtgattcttgtgcacagctcctgagtagttgggattacaggcacacaccaccatgcttggctagtttttgtattttttgtagaaacagggtttcaccatgttggccaggctggtctcgaactcctgacctcaggtgatccacctgcctcagcctctcaaagcattgggactacaggcatgagcactgcaccgggccctatttgttttttttgttgttgttgttttttaattgagacagagtcctcgctttgttgcctagactggagtgcagcagcgctagtcgacgcgg

SEQ ID NO: 576694 - DNA, 311 bp, Homo sapiens
ttttttaaaaaagggggcccccccggggggggaaaaattggggttttttttttgggggggggttccccccccccggggcccccccattccccggggggggtttgggggaaatctttggtggggttttaaaacttttttttttgcccggggaaggggccccccttttttcccccgggtttttttttttttaaaaaaggggctttttttttcgggggtttttaaaaccccgggggtcccccccgggggggttggggtttttttccccccgggggccccccccgaaaaaaaaaggttttttttttcccccccca

SEQ ID NO: 576695 - DNA, 1467 bp, Homo sapiens
  misc_feature (1011)..(1011): n is a, c, g, or t
  misc_feature (1019)..(1019): n is a, c, g, or t
cttatgcgtggtcttctggttgactccttgtgtttgtctgctctctcattctcatacgtctctgcatggtgctatgtgtgtctttgatgcgttgattccttctcgtgtgacgcttcgcctagtctactcccgcgcatgagagtcgtcctagctggttctgcaacccccccctttttgtgcctagccgctcaccccgtgggtgcccccccacgtcttgttttttggtaacttgcgcgccccaaacattttgggggccggttgcccaccccctctttctcggggagggggcaaccttgtggataaggtccacaagagaccgtggtgggcacaccctcttcttggtgaagagcacccttttttctctctctttgggggaaaaaggatccccgtcccctcccagcccgtgggtgtgaagtttgcctttccttgaagccacccttgcgcgccagggtttccgcgaagatataaaatctgtctaagcctgggttattgtctctgaacacagggaccttttattctggagcctcgtgcccccgctgggagggggtgaaaaccgcgcacagaatctgtggtgcacaagagacaacacccagggcccccctttccgggggacgcaagggtttcccgcccgcttcgctgagagccacgtgaccatcctcgggagaataggaggagcccgcttctctttcccagtgaccaggagctttctcgtggtcactgcgcacacaacattgtgtgtccaagtgcctcttccccccccatgagaccacagggcgctctccgaggtcgaagaaaaaggctcacagagagcccacgcggtgtaacccacacgagatggagaacaacatgagaagggcgcggacacacacgagaggccgcgtgagaccacccctcgtagaggcacacacgccactcaccaacgcgggagagacaccgctttataggcccctctctcggagttatacttcgcgcgggcaacagcgtttctgaagctcgaagatgttcacgcgncccctccncaccacaagagaggttggaaaggagagccacagagagtttttccttctatagaactctcccccgcggcggagaaaagggagagacactcccctgttccccccgttttgctataagtattgccgggtggttgttctcccttcaccacgagttttctcgcgtatcccgctatggcccattggtgcccgcctgggccacaccgggcgcgttttcccacagaatgctggcgcgtcacccgctaagagcccaggaggccctctctggtggggccctcgtccacggcactaaccacgaaggcgtcgcacacttcttgttctttctggtgcaccaccctccacctatgtgcccctccacgctcctattcttctgtatggcctcggtgttttcctagattatgattgtagagcgaggattgttataatattggaataaagagttattgctcaccca

SEQ ID NO: 576696 - DNA, 125 bp, Homo sapiens
acgagctgcccctttcaggcggagtaggaggtgctgcggagaagccggtgcccgtgcggctgggagtgcggttgtgggtgtggcgtgcggatatttggtgcgagatgcgggcgcagtgtgtgagg

SEQ ID NO: 576697 - DNA, 485 bp, Homo sapiens
tcataggtcgcaggcagggaaaaatacacagtctcttgcatagcaaaagtgacctttactccagttcccaacaatctgcccatctccatctgagaccacttggccggaattaatgtccatatcacaatcagcatttcggtcaaagccattcaacaagtctgtaggaagtctgaaactttccaacattttcctgtcttcttctgagacctccaaactgttccaacctctgcctgttacccagttccaaagctgcttccatatttttgggtatctttacagcagtgccccactctctttggcaccaatttactgtattagtttgttctcacattgctataaagaacttcccaaaactgggtaatgtataaaggaaagaggtttagttgactcacagtttcggagagctggggaggcctcaagaaacttacaattatggcagaaggggaaagcaattatgtccttcttcacatcctgcgaacctatga

SEQ ID NO: 576698 - DNA, 613 bp, Homo sapiens
aagacattggaacactatacctattattcggcgcatgagctggagtcctaggcgcagctctaagcctccttattcgagccgagcgtgggccagacaggcaaccttctaggtaacgaccacatctagcaagcgttggatcgtcgacagcccatgcaatttgtaagtagatcttcttgcatagtaatacccgatcataatcggaggcttgggcgaagctgactagttccgctaataatcggtgcccccgatatggcgtttccccgcagtaaacgaagcataagcttgctgatcgtcttagcgctccctctctcctactcctgctcgcatctgctatagtggaggccggagctaggaacaggtcgacacagtgctaccctcccttaggcagggaactactcgcgcacgcgctggagcctccgtaggaacgtaagccgatactatctccttacacctagcaggtgtctgcgctctatcttaggggccagtcaattggtcatcgaccaaaccattatcaactatgaaaccccctggccataagcctaataccaaacgcccgctcttcgtcgtgatccgacgtaatcacagtagtggcatacgttctccgtatgtctcc

SEQ ID NO: 576699 - DNA, 937 bp, Homo sapiens
tgctagcgtacagtgtagcgccttgtctggtagtggttcgcccgaactagagtgtgtccacatgggtgaagccctatcttcgggggcccctttatacgcggcaagctatgttgcgccgtggaccccgccgtgtgggggggatcccgccatgctctgccagtgctgccacccaactggggggaaccatcactaaaatcttaagcgcttgttcaccatttgccgccaacccttttgtaacgctcgtgcaacaccggtaatgtaacaatgtttgttgcaagaactcacgaaaacctttccccgttaattgctgaccaccgctgtaaattcttctttttcccctcaatatatgcgccccccggtgtgtttccaaacccaatctttgctgtgaaaagacaccttctcgctttagggtcttcaacacaattataacaccccgcgtattttgtttcccggaataaatcctatcttaaaccagtgttggcggcttctccccatgcaaccccaccgaactgcgccttgatatgtcagatacatagcatacactgctcttctaggaaaccacgtgaaattatatttgactgtattaaaataaccactgccaacttcttaataaaggtataatacaaaatatacccatcttactggttcaatttggctgatcgcccgcgatacctcgcttcaaacataacaatagtgtccccccctcgaccctctgttgatatctacgggacttccccatagtccgtcgctcacctcacctagcactttccccccctggcacccccacaatacgttccccctccttctcacacaaaaagaagtgaaaccataaaaatatgaacaaaacaaatccccatatttttcaagactggcaggaatagacaaaatttttaaaaaccccattgggttttaaagggttcccggcccaacaaaaaca

SEQ ID NO: 576700 - DNA, 650 bp, Homo sapiens
tggaaatggagtcttgctctgtaacccaggtctgcactgcaggggggtgatctcggctcactgaaacctctgcctccccagttcaagcaattctcatgcctcagcctcccaggtggctggtaaccggcgggttgtgttgccaccacgccccaagctaattttggtatttttatagtagaagacgagggttttcaccaatgttgggccaggcgtggtctcaaactccccaactctcagatgatcgcggccacctgtggcctcccagagggtgcgtggcataacgaggcgttgagccaaccaacagcccgggttatacagtgcattttttatattcaccagcaaacggtgaacactcgtgatacccacgtgaaaagagagcctccagaatctccgacccttacacccgcagaaccgctgtggttaacccacatatttctacagctttctctttctcgtagaatttctcgcctttcattatgtgagtgtggcgactcaacacacagcagttgtgctcctttgtgggtgtttaaggcatttcttactttagcagagccatcaccgtggctcgaacagttcacgtggggccaacatatttttcgccccaggtgtcctccagaaaagaaagattctggagggtcaggccactcttt

SEQ ID NO: 576701 - DNA, 543 bp, Homo sapiens
aactgacaatgacagctaacatatcaataagataaacaacatactacgataatattgaagctgctactcatatcacaaatcaatgccagatcgaccagaacactgctataaagtcaagtgttctattctgaagggttgacttggcctgtattgcaccacaatcaagttatacttttagtatagtactgaactggtctgggttcagtttcctcgaagaaaataccacctagctagtttatgtaagaaaggacagcaaattattaaaatgattgcagaattgttgagagcacttgaataatgatcctcaaactttagcatgaagtcagtatcagtttggaggcccttgataacagattgtaggccccaccctcaagatttatagactataaggggtgcaccaccaacaaccggccaatttttgtaattttaggagagatagggttacgctattttggccatgctggtcttgaacttatgacctcaggtgattagcatgcctcacccttccaaagtgctgggattgcaggcgtgagcctccacatg

SEQ ID NO: 576702 - DNA, 253 bp, Homo sapiens
tgcagggcaccacgatgcccgtcctgccgaagcacacggtcactttcattcctgtgccccgaccacgccgggccgggccgaacaggtgtctgaccccgcgcgcagcccccactctcggaggacgccggggcgggtgggcccagagtaccggggcgccgctctcccggaacagccctgcaggcccggagtgcttcgcgcagcgccccttccacctggcaggcggcaggtggcgggaatcggggaggggcggccc

SEQ ID NO: 576703 - DNA, 895 bp, Homo sapiens
gagagccggaaccgggcgggcagaggggcgctcgtacggttggcggacgcctgtggcttggctgcagcggccggcaagaccctggaagagaccgtggcgtatggaagacggccaaggctgtcttggaatgtcctgagcagccctccgagtcggagcctctgccacccgacgtttcttgagtgacgctgggttggatataggatttgaccgttgtgtgaagtctactcgggacgacgggcgatcctgtatctcgttgtgggcgcgccacgccacttggataacgggttcattggctagtttcccaggggggccatggggcggaaggcgccttgtccctgtccttgtagagccccaagtgaggagcgctctctatttggtattagtctggggtgagggttccaggccctgttccaaggagcccaggataaggggggctaagccccagtcctggagagtttaggatgagggggcctggcactttcccaaagagctcagtgtatggggaatgtgatcctgcctcttggactccaggattggaggtgggggtgttatggcccttgtagaggaacggggtgtatggggtacagccctttcccagactgcggcaggcatggaccttgtcacgagatgctaaggacaaggggacatgatcctgtaactgggaagtctggaacggggagcatggccaaatcctggctggcgatacggggattgtggacagtgacttgggggaaacattgcttaaaacttaactgaagagtaaccaggaaatggagcacgagaatcacaagacaagaaaggaaagaggatgggacactacgggaagcaggtctggaaaacgcccaaagcctccccatgcccagatactccggaaaccctgagaacagggcaccat

SEQ ID NO: 576704 - DNA, 919 bp, Homo sapiens
  misc_feature (1)..(1): n is a, c, g, or t
  misc_feature (74)..(74): n is a, c, g, or t
  misc_feature (91)..(91): n is a, c, g, or t
  misc_feature (98)..(98): n is a, c, g, or t
  misc_feature (101)..(101): n is a, c, g, or t
  misc_feature (107)..(107): n is a, c, g, or t
  misc_feature (136)..(136): n is a, c, g, or t
  misc_feature (152)..(152): n is a, c, g, or t
  misc_feature (172)..(173): n is a, c, g, or t
  misc_feature (190)..(190): n is a, c, g, or t
  misc_feature (197)..(197): n is a, c, g, or t
  misc_feature (200)..(200): n is a, c, g, or t
  misc_feature (203)..(203): n is a, c, g, or t
  misc_feature (205)..(205): n is a, c, g, or t
  misc_feature (213)..(213): n is a, c, g, or t
  misc_feature (215)..(215): n is a, c, g, or t
  misc_feature (218)..(218): n is a, c, g, or t
  misc_feature (221)..(221): n is a, c, g, or t
  misc_feature (224)..(224): n is a, c, g, or t
  misc_feature (226)..(226): n is a, c, g, or t
  misc_feature (232)..(232): n is a, c, g, or t
  misc_feature (237)..(237): n is a, c, g, or t
  misc_feature (240)..(240): n is a, c, g, or t
  misc_feature (263)..(263): n is a, c, g, or t
  misc_feature (265)..(267): n is a, c, g, or t
  misc_feature (273)..(273): n is a, c, g, or t
  misc_feature (281)..(281): n is a, c, g, or t
  misc_feature (288)..(288): n is a, c, g, or t
  misc_feature (293)..(293): n is a, c, g, or t
  misc_feature (308)..(308): n is a, c, g, or t
  misc_feature (315)..(315): n is a, c, g, or t
  misc_feature (327)..(327): n is a, c, g, or t
  misc_feature (329)..(329): n is a, c, g, or t
  misc_feature (346)..(346): n is a, c, g, or t
  misc_feature (365)..(365): n is a, c, g, or t
  misc_feature (371)..(371): n is a, c, g, or t
  misc_feature (374)..(374): n is a, c, g, or t
  misc_feature (377)..(377): n is a, c, g, or t
  misc_feature (381)..(381): n is a, c, g, or t
  misc_feature (383)..(384): n is a, c, g, or t
  misc_feature (392)..(392): n is a, c, g, or t
  misc_feature (410)..(410): n is a, c, g, or t
  misc_feature (430)..(430): n is a, c, g, or t
  misc_feature (452)..(452): n is a, c, g, or t
  misc_feature (455)..(456): n is a, c, g, or t
  misc_feature (500)..(500): n is a, c, g, or t
ngccaacatcccccttcccaaaaataacattgaaacgggtaaccgtacctgtcaaatcccccggctggcaactntcaaaatccggcctccncccaacnccncaaatntgacaaagtcatttttgtttgtgtaagtnataccggttatccacntccagtacatgtaccattannccagaagcccataaatnatattancanttncnatgtagananccngangtncnaaaggncaatnccncccagccgacacccccccccggncnnncctgtngccaaggntcccccnatttnaatcgtttggcaatngcctttngccccattttcncnttttcagactgtctgcnttgtcccagagtatatgangtaacnacnatnaacncnncggttacnatggattccctggtttcngatttgtcggtatccgaatnaatttcaggcacagaatgaccntcnnggagggcatttgcctcctccagtgccttttccaccccgaaaganggctcctgaataccgctccgtgtcaaccaggggtgctttagacattcttcagcagtggctcgatcttcaggtttcttaactaaaagtgtcctgatgaaatcaacagccgactcagacaaaacatcaaattcttcctcagaataacttaaattcatctgtgagatgtttaagaatgtttcttgtttatcattgcctaagaaaggtgatattcctgtaagcatgacatatgttaacactccaatgctccacatatctgttgccatgcttataggatcataactaagaatttcaggagccacatattcaggggtaccataatttctcggagctcttcactgttcttcaatattcttgagaggccaaatcaacaatcttaatgtcacccaatggagattcacttgtcaacagaatattctgag

SEQ ID NO: 576705 - DNA, 200 bp, Homo sapiens
gccagttaccatacaccatgatgaagttcgcctgctttgaccgtactgttgaggcactgtccacgttgtggttcctaagccccgcagtgagtgttcaaggccagagcaggctggtttgtaacatttgtaggcagggttacataggctgggggtcttttgtgccaattgttttctcaccctgcctgattctgtgggatctg

SEQ ID NO: 576706 - DNA, 208 bp, Homo sapiens
cccccccccccgccggtaacttttatattttcagtacagacagggtttccctatgttggccaggctggtcttgaactccttacctcaggtgatcccctcccctcagcttccccaagagctgggattataggcatgagcccctgcccctggccctgtgctgaaaggcttttgacttatcctagtgttcttgccatattagccccatttt

SEQ ID NO: 576707 - DNA, 918 bp, Homo sapiens
  misc_feature (918)..(918): n is a, c, g, or t
aaagcctgaggcggcggcagcggcggagttggcggcttgtgagagctcgggagagttccctggaaccagaactatggaccttctacgcttctgtcctaccgtattagtctacctacctcgtgcgggagccctcgcgacgcgcccgagcccaaatcccccaagccaacacgcagtccagcatggatatgtggagtgtggtcctgcagtgatagaagagatgataagattgtctatgaatgagtaaaacagtaccgtggtgagagtttcttaggatgtacagaggacaagagcaacatgttcagatggaaccaggtagaatagaactagataatatagctggtcaagtcgatgtggactccagagatgtcgcatgctataattatgactgcataatgcagttgtcaaacgctccggtagacgagtgacgtgattaaggtctaattgccattggcaagtatcttcccagcagcagtagaggcagaagagcagctgtcgatttctcctctagaatctcagagaggcccaattacttactaccttatgaagtctccttgtctagtctttttgtgatgtgtcgtgagcaaggcatattgcgttagtcagagttaggaaagttatggaagtagctctaatgccgcccccaagttgcagagaacaagaatggccgctaatttgatggatttgagtggcttgtctggaaagatattatgagtggtgacacagcgttggagggcccacgtcgcctcaaaaggtaggacccgagattatttgggtggtcaagacagattcctaattgttaatggcggaccaacgtagtggagcccagctgataattacaaagccgagataaggtccgatcgcgggatccaaaacagcaagggcccgaggaggatccaactggtcgcattcttggcgggn

SEQ ID NO: 576708 - DNA, 1214 bp, Homo sapiens
ctgggtcatcggttccctggaaggagaaaaagctgccaattgaacggggcctcccggtcccaggaatgtcgcgacgcggggacgacgcatctcacgacgtcagcctgaaacacgcgggcctttcatcacccgagactcctccagcccaggagggccccgctctttcgcctgcctcctgggggagagcctctggacgacgcacgcgacagcgttttctccaaaaaaggcagagaagagaagcgtagcagtggccgcaagggcgacgggcggcgaagggtactacgcacgcccgcgtcggccacgcggagagatacgcccgactcgagtcccgcggcgcacgcccctagacgcccgaggtgcgcgggccacgcccctcgcccggccaagagcacgccccttccgtcgcccctcccgggggcgtttaccgttcctccccgccccggaagcgcgttcttacctccttcctcgcgagagttccgtgcaccggcacccagatcgcgcgagacagcggaaggagcaagagtgggaggcgcgcgcggaggccgcgacggacgcaagatggcgacggcgaccatagctctccaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaagggtggggcaggaccccagccaaccaataggggccaaggccccacccccattta

SEQ ID NO: 576709 - DNA, 351 bp, Homo sapiens
  misc_feature (29)..(29): n is a, c, g, or t
atttcaagcacagagtcagacggcaaggnacatagcgagacccacttctaccaaaaaatacatatccatatctatagatgtatagatattaaaaattagtaaattccttgcttcccacagttcctgtactaagccagtcagaataagggctgcatgtcactcctacatttcacagccttaggagtaatctatatatttgactggctcagtgctgtgttaaataaacacagattaattgactaggctgaggatgaaataataatctgaggtagctgtgaaattacatagttatttacttatgtagttatttattatcattattccttcatacttatttacttttttccccta

SEQ ID NO: 576710 - DNA, 1290 bp, Homo sapiens
ctgggtcatcggttccctggaaggagaaaaagctgccaattgaacggggcctcccggtcccaggaatgtcgcgacgcggggacgacgcatctcacgacgtcagcctgaaacacgcgggcctttcatcacccgagactcctccagcccaggagggccccgctctttcgcctgcctcctgggggagagcctctggacgacgcacgcgacagcgttttctccaaaaaaggcagagaagagaagcgtagcagtggccgcaagggcgacgggcggcgaagggtactacgcacgcccgcgtcggccacgcggagagatacgcccgactcgagtcccgcggcgcacgcccctagacgcccgaggtgcgcgggccacgcccctcgcccggccaagagcacgccccttccgtcgcccctcccgggggcgtttaccgttcctccccgccccggaagcgcgttcttacctccttcctcgcgagagttccgtgcaccggcacccagatcgcgcgagacagcggaaggagcaagagtgggaggcgcgcgcggaggccgcgacggacgcaagatggcgacggcgaccatagctctccaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaaaaaaaaaaaaatccttggcggcggttacaacgtcgtgcttgggaaacccttgcgtacccaattaattgcttgaagacatcccctttgccaggtgcggg

SEQ ID NO: 576711 - DNA, 1511 bp, Homo sapiens
gtatggcgcccgagtgcactgaagatggcggctgctgtagcgacgtgtatgctccgagcgtcggtttgccctgacatgtgagtgccattccttgggggcatattctgccactgcaagccctcagtgcctgctgcaatgtggcaagaaacgagctttgaccaactttcactttgtagtatctgggtttccaggtgcaaggcacaaacttatctcacgacacccatgtaaccttcattgccaattgaaccctggttggtcacacccagacattgcaacccctactttccacaggggtcacagccgggtaggtcccacatggggcagcaaggttccacaaagccacttcaaggccattcggaatggcaactctccccaaggggcgggccacacatccattttggggtgggctatattccattatcataaattccctttgtgcggcatttcccgacccatatatgtctggttgttcccttacaccacaggacaaccatcatgggtgtgggccgtctgtacaggttggcaacccaacaggtcttcatagcggcaaattctacaaagcggtacgttgcttgcacaccctttgtgttgacaacaggttcgtgtcacgaacaaagggtacatccgacaggctggggcaatttatccccgaccgcttttgcacggcgcacactccattatgacccgtggttggacttacacacattaaacccaacgcccaacatggaagcacagcgaaacgcttggagcatgtggcgctatcgtggtagtgccccacccaacatttgtaacctaccaacattccgtgagcacacgcgatccgtttggtgatctcgaaccggccacgcattcatcaaacgttaacacggatccacagcacagtcttctagccgccggtgcagcgtaccattaaccgtgtgctgtgattgacattggttacaagacacaaggacgactaccgatgggggctacgaatcgtgcacgaccaatcaacacggaagggggatccgatcatatttacaaatatacactttgtgacaacgccgccaaaacatcgggtgaacgtctcaatcacgaagaggcggagtacatgggacacagccgacttaacacagcgacaagtcactcccaccaacgatcttggtgggccgtggcacaagggctgtgaaactgaaaaaagccgccatcacggacattgggagtggcacgagggcgcgcataccacgggcgacggtgtacggcaagacacacacagtatgtgcgcggacacacggcaccagtggaccgcccaggaggacacaccgttgtaacaccacccggagagaactgacgtacaacatacggaacgacaggacgcaacgctaccacacggacgagcgcatccaccaacgacaagtacaccttaccgaggcaggaggcgacaaaacaccagaggagagactcaccccacggtggggtgactaccagcagcacaccgacgccactcaacagtaggtgaaacgaaagacaca

SEQ ID NO: 576712 - DNA, 1043 bp, Homo sapiens
ctgggtcatcggttccctggaaggagaaaaagctgccaattgaacggggcctcccggtcccaggaatgtcgcgacgcggggacgacgcatctcacgacgtcagcctgaaacacgcgggcctttcatcacccgagactcctccagcccaggagggccccgctctttcgcctgcctcctgggggagagcctctggacgacgcacgcgacagcgttttctccaaaaaaggcagagaagagaagcgtagcagtggccgcaagggcgacgggcggcgaagggtactacgcacgcccgcgtcggccacgcggagagatacgcccgactcgagtcccgcggcgcacgcccctagacgcccgaggtgcgcgggccacgcccctcgcccggccaagagcacgccccttccgtcgcccctcccgggggcgtttaccgttcctccccgccccggaagcgcgttcttacctccttcctcgcgagagttccgtgcaccggcacccagatcgcgcgagacagcggaaggagcaagagtgggaggcgcgcgcggaggccgcgacggacgcaagatggcgacggcgaccatagctctccaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatggcggctcagcggcagcgggcgctggccatcatgtgccgcgtctacgtgggctctatctactatgagctgggggaggacaccatccgccaggcctttgcccccttgcccttatagagggtaccgagctcggttcg

SEQ ID NO: 576713 - DNA, 807 bp, Homo sapiens
acctgcctgaggaaaacctgtgtactattagccatgtgtcaaccccacctgtgttcttctgacatttgcctgtcagactggatgagcccttgaggcctgacgtctcctttgcagctgtactgccatgcaccaatggtccccaaagcaccagccagcacacacattttctgttgcatctcgcagccaacttggcagcagcacacagtgcattctcgcgttcatacacggtgtttccatagcgttatcccacgaagcacattcatatcccaggtggctttccatcgtgtcacacgggctgcgttgaacttcaaccactgcccatcacatggccacttggtcgcggcaagatccatactcattggcgcgcgcacacattctgaccgcacgcaggcaactctccatccctcacaagctatcactgtggcagtcacagtggcagtcatatgctcacacatggtcataaaattgcatcgtgaacccgcacacatcaaaacttgtgtaccacgagtcaataatacatccttgcctccttgaccacaggcactcggacgctcgcgtatcgcacatcgcggcacgacaatggtcgagctggtcccggagcccaaacaacggtcgccgaccgccgcaacgcggccatcgcacctccatcaaggtcgagcacaggccccaatcgcgcaccccggccaaacggaggggtccccagaggaacattgggacaaggaccacaaaccaacacgaccaagacatcccacacaaacctggcctgcacccggtacagacaacactccgagactcacagctccgacc

SEQ ID NO: 576714 - DNA, 232 bp, Homo sapiens
  misc_feature (30)..(30): n is a, c, g, or t
  misc_feature (47)..(47): n is a, c, g, or t
  misc_feature (61)..(61): n is a, c, g, or t
  misc_feature (67)..(67): n is a, c, g, or t
ggagctcgcggggaggccaggctcgtgccnttttgcagacgccaccnccgagggaaaaccngtggtnctattagctgttcttggacattcccgtcgacgggagcccttggccgggtctcctttgaggtaaggggcctggataccaagaagtgacttctcatctaatccataaagctatgttaacagattgggggtagtggcattttcattacaggtaactaaaagaacacct

SEQ ID NO: 576715 - DNA, 1071 bp, Homo sapiens
ctgggtcatcggttccctggaaggagaaaaagctgccaattgaacggggcctcccggtcccaggaatgtcgcgacgcggggacgacgcatctcacgacgtcagcctgaaacacgcgggcctttcatcacccgagactcctccagcccaggagggccccgctctttcgcctgcctcctgggggagagcctctggacgacgcacgcgacagcgttttctccaaaaaaggcagagaagagaagcgtagcagtggccgcaagggcgacgggcggcgaagggtactacgcacgcccgcgtcggccacgcggagagatacgcccgactcgagtcccgcggcgcacgcccctagacgcccgaggtgcgcgggccacgcccctcgcccggccaagagcacgccccttccgtcgcccctcccgggggcgtttaccgttcctccccgccccggaagcgcgttcttacctccttcctcgcgagagttccgtgcaccggcacccagatcgcgcgagacagcggaaggagcaagagtgggaggcgcgcgcggaggccgcgacggacgcaagatggcgacggcgaccatagctctccaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcagcagtgacaatgggctttggagatcctctctcacctttgcaatcgatcaatagaaatgctcacttcttccggggctcatgtccttagtcagggctagaggggggcagtgcagcccacgtgctggggaccttgctcccctggccggtcctgcccgccagctctggacgagcgcagcagagcgccaggcgtggtggggccggtggtgtgggc

SEQ ID NO: 576716 - DNA, 149 bp, Homo sapiens
caagatcctgaagcaatgatagagtgtgaaactgagaccagatgggggatggagatgtagttgctgacatccatggatcgaatccaggccctgttagcttcatttgccagacccaccattagagagtgaagatgaagagagaggctgca

SEQ ID NO: 576717 - DNA, 281 bp, Homo sapiens
  misc_feature (42)..(43): n is a, c, g, or t
  misc_feature (75)..(75): n is a, c, g, or t
cccgggttttaaagggggcccccccccccctttttttttttnnccgggggggtttttttttggccccggggcccnccccccccccattattttttaaaaagggggggtttgggggggggcggtttccccaacacccccatttttttttttttacccgggggggcgggttttattgttttgccccccgggttttttgggggggggtaaaaaccccggttttttttttttggggggtttttacccccccccccccgggtaaaatggttttttttcccccccca

SEQ ID NO: 576718 - DNA, 245 bp, Homo sapiens
gtaacaggcacagtaatttgttttgattctaactggggatatcaagatacattttttaccaaaaaaaaaaaaaaagggccttccggtgcccttcaatttaccattcctccgttaaaaccatccacgggtttaccaaaacgggctcctttgttctacactttatcgggaataatcggcatacctcgggccccttcatttccattcacgttccattacccccaccgcgctcttttgtactttttcaa

SEQ ID NO: 576719 - DNA, 126 bp, Homo sapiens
ttatgttctgacccacatcacctcccactggccagccaggttgtgtcagtgcaggaatatcatttcgtgtacatcattttgtatcccccttttatctccctctctcttctccatagacttgttgct

SEQ ID NO: 576720 - DNA, 262 bp, Homo sapiens
gaccgcccccacctacagcaggcgcacttccacaggggcagttgttgccgcgagctgcggggcccgtgcgtcgccgggcacagtataatctcgaatcaaatgcctgtcgataggagcaccgggagagcgaggcttacaccacccggccggagccccgccattgtgatcgtcactttctccaaaccagagggagcgcccgggggcagacaggccaatatgtgcgagaggggggagaagcagagaccactttctacagcggccg

SEQ ID NO: 576721 - DNA, 185 bp, Homo sapiens
catcatcatctcgtcacatattgctctctgactcattaatatttgcttgagtgtgagagatacactcatcagctcagggaatggtgcatcgtgtgtaatctataaatatcttcgacgtccttctagtctgagatccagccctggttggcttcactgaagtagcccaattggctggtcgagcgagc

SEQ ID NO: 576722 - DNA, 1066 bp, Homo sapiens
gaactcggttgttcccaattggcaatgatgtaatctacagaggagatgaaagccatagatggcctaaacagaaatgtgcgatatttgacccttgatatgtaagtgattttggagatggatgtcctaatttattttcagaggaggaatgtaagatgggtgttgagagtgaccttcacgccaggggcacagaggccaatgtgagacagaggtgagacaggagctttctggaagtctcctcctggattcactccagagctctgttctctggcagggagagtggccctgggtcagcatgggtcaacctgtgcctctgctctcgtgactccaaggaactttccagagcagccaagatcattgctgaatctgcaccttccatgtaggcctgctgtttgtgctactgtctagtgtacacactgtggatattgcccatgtggtcgcattagatgtttccaaatctgtgcttctatcttgttcttcccaacctgctcaatgtcttaccagatcaaaggcagttccgtcaatcttgtgggccaggttccaattcccacctctttcacatggaattgcttgctggatcctgtcgatttagcatttttaatcatttcaaacctttttcgtgcctgtctttgcatgtttgcccatgagccaaacactgcatttgcctccagaaagtctgtcttagtggagcgaataggagcacttggccttggtgttctgcaatatggagatctcagtgcagagaatgaagaaatgttaaaatcaaatgcagagtgtagatgcaaaagcaccattgttggagataatttataaccaataacagaagtttactattcctctgtgttctaaggttctaggattcatagaaggtcattcatataatgagggaaaaaagaagttatgtaactgctggcagtagggatttcaacaagtaatagagatgatgagataatgtgtgaaaaaaacaagcacaatggtacatcataagtacccaaaatttggtggatattattagtagtattttattcatttagaggaaaatacaaaatgaaaacggagatgataaaag

SEQ ID NO: 576723 - DNA, 181 bp, Homo sapiens
gtgacagccggtacggccccgggttagggcaacctcgattacgggcggctccagtcccgccagtagcgccccggcaatgcaacaagtgtcaagagagtgtaaagacggacgtagtatatggatcatataggaatagtaagaagtggtaggtagtggtgcgagatactcgttgcggcgggcg

SEQ ID NO: 576724 - DNA, 1076 bp, Homo sapiens
ggcggatcctcccagaggtggcacaatggagcgatctccaggagagggccccagccccagccccatggaccagccctctgctccctccgaccccactgagcagccccccgctgctcacgcaaagccagacccaggttctgggggccaacctgctggccctggctgcggcgggtgaggccctggctggtgctagacttcattcgggaggcggttgctggtgctgatacctgtgtatttggccgggggcagtggagactcagcgtgggtaacgtgctcttcggcctcgccctctacctgggactggcgccgggtccgcgacgagaacgaaccggaagccttcgagcagcgaggcagctactggacgacgaggagcagatcacatgcggaaaacctctctatatgagtcactcgagcagctaccatgcctgggtcagcttcacaagacgtggaaaaggctgacatggctcactacgatagtggaccaggtctggaaccttacctgggccagatactatggagaagcatactgacctgaaactgtggctccggctgttaggggatctaaaccaccagtcatgcaaacatatacatttaccacgacgtggaactggagtgacaagcaatcggcgcattcactggagtcgagggttcacccaggtcagcagaaacagagcacgatcctgcaggcactggacacatcaagccactgcacggtgcaaggctgcagactgaatgctggaaacgagaacgaaacgaaaagcaaggcaacacacccgaaccacgggcgcccgccacccaccgaccagaactgcacacgagagcttccgtccctgaccagccaccataaggagagatacacctgtctgggccaacctggcacagcagtacgacacaccggactcactaccacagacaagagaacgacaccgtgccacgtaaagaaagcaggagacaccaggactccagtgacagccaacagtgaccgggcagaggagcggcaacccccccatgcgcttgtggccccaattccacgaaagctgacagtgatgtcgggcacgaaccaaaatcctcactcc

SEQ ID NO: 576725 - DNA, 649 bp, Homo sapiens
  misc_feature (84)..(84): n is a, c, g, or t
  misc_feature (138)..(138): n is a, c, g, or t
  misc_feature (497)..(497): n is a, c, g, or t
  misc_feature (517)..(517): n is a, c, g, or t
tggaaatgacaggcttttaatttctcaggaacagccgaaatgacctccagaaggtttccagcgaagctgtaacaatccacccgntgcagctctatgacagggaggagggcgaatcaaatccatcatcttacgccaganttcagcccgtggcgggagcgtgcgtgcctccaaagaaagcggggaccggggcggacggcgtctctcccccggtgtggagaacgtgacagatgtgaaggtggggctgacagacacacggcctgcagcagcccagccagtcccccacagcatcgagccaagtcatttaaaagggatttaggccactgcctttttctgagggaggagcggccagcattgtgccccggcggctcacggggcctgtctaatcacacagcaggtggcaaagggagtatctgccagacgcttcctatcactctattctggtctcctcatccacctgaagttcaccccgtttccccaatgacttagaagggcttggngctaagtttaaatggtagtntgggctatccggtgaattaacaattcaaacaaaataagaaagccatgttgttaaccagtagagggagccagggactcggtctccattctctcatcacacacaagtcatgctctctaccaaaaaaagaaaaac

SEQ ID NO: 576726 - DNA, 399 bp, Homo sapiens
agagcccagaatcccttctcatgccagtgtgaatctaagagcttgaccacaggcttcctcacaggtgaaattgaaaaccagcccaagctgctcagccaagtctcttgggcacttgtcactgttaaaggttggccagaatctggaaggtgtaaaagatccagttaaaaggtgcacccattaggaattaaggctcaaggtggggtctccttggcttgggccaaagtgcttccccacttgccttgtgggaaaggagaaagtgaaatggccggtgtacagagcctctaacgcctctgtaggcatcactgtgaaaaactctgccaacacatgtgttgtggtcacaacagtgccgagcatgtagtacagccacagacagctctcccacagacgagtctggtctcc

SEQ ID NO: 576727 - DNA, 661 bp, Homo sapiens
  misc_feature (84)..(84): n is a, c, g, or t
  misc_feature (138)..(138): n is a, c, g, or t
tggaaatgacaggcttttaatttctcaggaacagccgaaatgacctccagaaggtttccagcgaagctgtaacaatccacccgntgcagctctatgacagggaggagggcgaatcaaatccatcatcttacgccaganttcagcccgtggcgggagcgtgcgtgcctccaaagaaagcggggaccggggcggacggcgtctctcccccggtgtggagaacgtgacagatgtgaaggtggggctgtgaacaaaaacacacgcggcctgtgcacgacatgccacagcacagttccccacaacagacatctctgagcacaagctaatttaacaaacagggattttagggccactgtgccttttatctcgtgaggggagagacgcggccagcatgtgtgtgtcccgcggcgggctatcagtgtggggccgtgttatatatatctcaacaacgagcaagtgtgtgcacaaagagggacgaatattctgtgccaagaaaggccttttccattatttcaactctctatatatatcagtggtctccctttcaatctccaacccttgagaagttttacaccccgcgtgattaccccccaaaagtgaactttaaaaaggtggcttggggtgcataaagttttaaaatttgggtagtttgggggacaaaatg

SEQ ID NO: 576728 - DNA, 153 bp, Homo sapiens
tctctactgagctccaggagcactgccaccccaccatcacagaatgtctgagctgtcttgagcacactgctggactcaatgagtgcagattctcaatggacaggcgtgaggctggctcagctgtcccctgccgcagcacatggccaggcacgt

SEQ ID NO: 576729 - DNA, 368 bp, Homo sapiens
  misc_feature (108)..(108): n is a, c, g, or t
gtggaaaccaaagagcaatttcaagaagcagttccaggaagaagcttagcccaggaaaaacaaagaccagttggacccagagatgcctgagttggagatgaactttgnccaactttcctcatcaccatacttaaaatcctgtccaaggaggagcttattcaccattttctatacatgtgacatatgtagcagcataaccgacaactgggactgcgctgccttgactccacctctacatacaatgactcagctaaccagactaataaaagccatgtttgcaccattgctcagcgaggcattgctttggggaattattcccagtgtcctccttacttatcgcaagtaataaaatccccctgggaaatcca

SEQ ID NO: 576730 - DNA, 105 bp, Homo sapiens
tacttgcgctggatattaggggcccgggtcagaatcttgccaaatgaagagaagggccctgtgtctgtgtccctcagtacgaagactaaagtgctggttagtgtg

SEQ ID NO: 576731 - DNA, 444 bp, Homo sapiens
  misc_feature (6)..(6): n is a, c, g, or t
  misc_feature (40)..(40): n is a, c, g, or t
  misc_feature (97)..(97): n is a, c, g, or t
gaagangtttcttcagggtaattatttaatgataggattngagcccagtcatatattaaaatgagttcttattatatttaaaaaactatatggcaantcatttcaattaattggggaagttaaggatatattaatacatggtgttagcctttaacattaacttaacattacagtccggcacggtggctcgcgcctgtaatcccagcaccttgggaggctgaggtggggggatcatgaggtcaagagatcgagaccatcctagccaacatgttgaaaccccgtctctactaaaaatacaaaaattagctgggtgttgtggcgcgcctgtagtcccagctactccggaggctgaggcaggagaatgacttgaacctgggaggtggaggtgcagtgagctgagattgtgccactgcactccagcctggcgacagatcaagatccgtc

SEQ ID NO: 576732 - DNA, 853 bp, Homo sapiens
cctggcaagagttaatatctcacaagggtcccttttttttaagggtacagtgatcgctaggtaaccctggtaggcacattgactcgctgctgatacctccatagtccatagaggcccgtccccccaggccagaaaaggttttggccttttgggttcacatctcttgctggggaataatatggggaaatgcgctcgttttctgctaaaattttagcttaatatcttagtcccagggagagctcagcacattaggaaccagactggaagactgtgaattttaacacccaaacaccactggcttaacattaattttatttgggactaccacgaaaaatattataatttctggagccaataaggtcactataccccgttttcacgtcctcgacactttaacggatttcttgagtcccccatcaccagttaacctgctggtgtttaactctgttacatttattattggtgtccaaagcacacttgactgggtgtaaccccgtgagcatctttttgagtgtttcataaagcaattttcccacttggaaaccataattgagaaaatagccctattgtatattttatgccctgagctagaaagtgccctttttactgatgctattacgactgataattttctctgaagtgagaatttaacccttttttctctttagtattatagtttatatatagcccatatttttagaaagccattcccagatcaggcatggtggcttacacctgtaatccccagcactttggaaggctgaggtgtggggattgcgtgaaacccccagatttgagacccgcctggttagcaaggccagatcccccactctaccaaaagaaaaaaaaaact

SEQ ID NO: 576733 - DNA, 923 bp, Homo sapiens
  misc_feature (233)..(233): n is a, c, g, or t
  misc_feature (242)..(242): n is a, c, g, or t
  misc_feature (247)..(247): n is a, c, g, or t
  misc_feature (251)..(251): n is a, c, g, or t
  misc_feature (268)..(268): n is a, c, g, or t
cacgaggttttctaattcattcaggtaaatatgatttatccctggggtagtggcacacacacagtatccattagttaaactcttcttaaggaagatcaggaacatcccatctgtgcttaaccagaatccagcatgtcagcacacaagtgattttattgttattttgttgtttttacttgcatttgttgtggttactttcatctgcagcatttggagtttaaaaataatgtaangggttctantaganatantgtcctaaggccaattncctaccatactaacaatcagcagataaaattctggacgtgagattccttatgatctaattatacctgaggttgagcaagaaatgtcttcctttagaaaatctcatgcaagtcaggttcttctctacagttcatacaattgagaatggatttaattaactagcgattctaggccagctattgctctgcccgtgtgaaggaaaaaggaatcgttctcaacctgataatctgtgtaagaacacaatcccatatgaacaatctggtcattaacatacatatgatacggagtctctttgtcagtcgaccaagtgaacatatcttgctcatggtgggttggacgaaagtaactacatgttacgagggtcacgaagcttctggtgttcgtgcgtgtatgctttaaatacgccttggggtgcttgtgatagaacggccttacaaggggagcatcagcgttaggaaagtgtgactctgtaggagtgtagaaggccggggtgtatgatcttagcctcgtgcctgatgcctgaatccagccagctgtggctctgatccagagcaatagagcaagttagccatcaccagtcattgtgtacagaggcagggaatactggtttgagtccatgggtagcatggagtgtatgaggagattcaagacataga

SEQ ID NO: 576734 - DNA, 175 bp, Homo sapiens
aatggaggtttgagcattaagttcctgagggcctttgtcattgtggttagtgacccatctggatgcttaggctgtcacattaatacctggcctgttgattagcgtggcaagaaggttcatgccggttgtggtggcttgcgcctctaatcccactgccttaggcaggtcgaggcag

SEQ ID NO: 576735 - DNA, 134 bp, Homo sapiens
ggcttgagagctgaatagcataatttctcctgcctcatcagtcacagggactggaagtccatcttgtaccctgatccttcacagacctgagcaagccaggcgaaaccccatcgctacagacctgagcaagccag

SEQ ID NO: 576736 - DNA, 414 bp, Homo sapiens
  misc_feature (414)..(414): n is a, c, g, or t
atggccggtgaagagattcgaggcaagccgactgacggcagggcgacgtagcagagaaagacagaagaggagggacgtctggacaccgagagatgtttggctcggggcagtcagagcggagtccagcccctgggcggcccaactccaggggaagatcaccttcccacttcatccatccccacccttccagctccccatccatcctgctgaaagccatttccaccactcaataaaacctcgcattcatccttcaagtccgtgtgtgacccgatttttcctggattctggaaaagagctcggaatacagaaagctgtcccctggtcctttgcccttgtgaaaaagcagaaggtccattgagctggttaacactccagctgtctgtggtggccaagctgaaagagctttgtaacacn

SEQ ID NO: 576737 - DNA, 442 bp, Homo sapiens
gctcaagttgatcctcaataccaggtttatgaaactcaaaaacaggcagaacgaaacaccaggcttttcagcaggcagacatggtggataaaacttttaaaaaaggccaccggatgaccctttccctttttatggaaccggacacaccggtccctaacccaggacccaacaatctgtggcctacaagaaacagacatcatctataaggaaaaacacagacggaaaataaagcaaagaaaaaagatattccagggctgggcatggtagctcatgcctgtaatctcagcacttggggagaccgaggcgggtggatggcttgaggtcaggagtttgggaccagcctgaccaacgtggtgaaaccctgtctctactaaaaatacaaaaatcagcggggcatcggggcaggcacctgtaatcccagctactcaggaggctgtggcag

SEQ ID NO: 576738 - DNA, 545 bp, Homo sapiens
gcacgtgatgcgtgcagagctgattctagaggatcccaattgtcaggcaagagtgtcgcatcctagcaccagaggctgcgctttgtctcccaggcacagttccattttgactccactgtcaatgaattgatagcagagttcagtatccaaatgcttgtaaaaacaggttttacatttgatttcccatttctcatatttaggtaaaacattgtcctataaattggggttgccacctgatagctctttttatgtggccaggtgcctccataaaattagatgcttgagatatcagatataccagctgtcctggagagagaaaagtttcctatcttgtgcgcatttttccataaaggagttcttcttatctgaagagaagtaatggctcttgtattaatgactatatagtgtttcccttcagtgtattccacaacagaaaaacgacagtggactgtggagtctttgtgctccagtactgcaagtgtcctcgccttagagcagcctttccagttttcacaagaagacatgcccccgagtgcggaaaagga

SEQ ID NO: 576739 - DNA, 2382 bp, Homo sapiens
agtaccgctgcggccgggggattgggccggggtctccaccgccgaccgaggggagcggcgtccgctcggccctgctttttgcgacctgccgtcagccccacgtcgccggcctggaggggcgaagaggacgaggggcgcaaggcttcctccggggacattggctccctggattatcaagcagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtatttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacaagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttcaatgtgtacctgtcttatggaagaaatatgcaggtatataagaccacgattttctaagctgccatataagaatttttgtttttgtaaatggttaaatacatttcctgggtaacttaggaaattaagctttttcataaggcaacagatggtaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagcagggtcggaattacgggtttgtatatatgtatatactcgtttgtatatatgtatatactgggacattttatcttctggcccaaagtcagaactttataaaaatcttgagtttgttcacttaatgtgaaataagctatgtgtccagggtattgctcccctgagtgtatatgagtgctgagtagtattgcagagaatgtgatgagttatcactgtcacaactttttctatagaaaacaggggctgcttttaaactctcactatgggacactttaccaaaatacttccatatcaattatttgaacccggtagtttgtttgacctagttagattgtggtgtttattcaagtttgaaatcatgtttgacaatactgtaaattaggttaattttgaagtcttagcatcatcatattgtgctgttttggataacacgtttgttcaagaacatttaaactgtttctttggtgtcctttacattgaaataaattgtgtttgtgcctcc

SEQ ID NO: 576740 - DNA, 433 bp, Homo sapiens
atgtctatcctacctgaccagacatcaccctttggtaatgtctgttctacttcctgtctctgaattggcgttattctaggtacctcataaaagtgaaattataacatatatgcccttccgtgtctggcttatttcactaagcataaagttttttttaatttttctctgagacggagtttcgctcttgtcacccaggctggagtgcaatggcgtgggcttggttcactgcaacctctgcctcccgggttcgtgcgattctcctgcctcggcctcctgagtggctgggactacgggcatgtgccagtatgtccggctaatttttgtgtttttggtggagataggatttcaccatgttgaccaggatggtctcgatctcctgaccttgttatctgcccacctcggcctcccagggtggtgggattgtaggcgtgag

SEQ ID NO: 576741 - DNA, 800 bp, Homo sapiens
cggccgcacgccgcggagcagtgcgctcgcgaggtccgggtattacgtgtgctcgagcacgctggtggcgaaaagacccgtgacttgaactgtgttgtgcggcgccatgcaggtctccagcctcaatgaggtgaagatttacagcctcagctgcggcaaggtcccttcctgagtggcttctctgactaggaccgcaacgagagcgcatacagagacggaaagatgtagagtgtccgtaggaggaattgaactatattcagggacttgtgcaaagtgccatactgtgatgtacccactattaaggtgtcacaagatggactaggtacattttagcaagctggaacattataaaccgtcgggttcgatgtgatgaccacctatcaattatccttgcaagtttgcaaaggtgtgcaagattcaggaagttgtcacgctttgtaaatactgtctgcatggacttactcaaaggtagtgtgatatacggcactaggccttggtactgactaggagccgacagaaactgagtgagtggacatgaatattatagtgaattaagctaagatagataataacgtatatgacaattggtagaaaagcgttaaaattgcgctggcgtaaggatagcataatacaggtcagaacccaaacacacactggagcataagaagtacgtggttgtagttagttgatagaacgatacatgcaataaaaagaaaatagtatccaaagcatctagagagacgacgtagaaagcacaacacacgtcccctcaggtcccgttatcaaaccccctacatcga

SEQ ID NO: 576742 - DNA, 131 bp, Homo sapiens
atctacttgttaacctccccctcgagataagaacactaaagggtatcgggcagatatcaaatatgaaggctcatcctccactcgcatacagactccgacagggaactaaccatggtgttagagatggcagt

SEQ ID NO: 576743 - DNA, 304 bp, Homo sapiens
tttactggaattttttttttggggttttgtgaaccaaactcctttccaaccatcaggagattcagactttttcaacttaaagaattcctgaatttttacacccaaaagacttccccaggacttccccatcctttttcaagaccaaacaaccagattcccccccattctgattcttcaaaacccagggttcagaccacattaaaaacttcagatttccacttcgcctttcaaattttttccaaagactttccttattcaccgccaaattttcgattcgttcgacctcggaactttcattcccaag

SEQ ID NO: 576744 - DNA, 439 bp, Homo sapiens
agccaaattcgcacaggcgctggttagagtgtgggtcgcaggttaagcaatcaaggtagggtcaacgaaaggtcgaatcgaaaaactgtccgacccacccccagggttggggtcggtggagtccagcaggatatcaaggttgtttcacgaccgttggggaaaaggtccgcgttaaatgcaaccggatatacctcggggccttaagaagtgattcagcccaaatggtacccgtggaacaagattgtcctaagaagtggtacacgatttttaaggaccacgtgtctctgggggactataaacccgatgggataacctggagctttattacaataaatagaatcctcatcttcctgccccgctttcctctcccatcctcatcccccacatgggatagagcttgtttgtaaaaactccccttaataaagattaaatgtgccca

SEQ ID NO: 576745 - DNA, 199 bp, Homo sapiens
ctaaagtatagcagagttacgctcacgcacccgtcttgattcctacttctgtttattcttgacttctcaaatctctttggatgccagtgtgtccttttgctacagcttctccattccttaattctttattttgatttatctctttatctgtgtggtttctttgtctgttatcctccttgagaagaatttgtggagttac

SEQ ID NO: 576746 - DNA, 102 bp, Homo sapiens
caacaatcagctagatacaaagcagtaggtgattgcagtgaaattggaatggcaccacagatgtgagacaaaatatgaaggaagcagaactgtaagaactta

SEQ ID NO: 576747 - DNA, 1501 bp, Homo sapiens
cgcggtggctcacacctgtaatcccagcactttgggaggccgaggcaggcagacaacaaggtcaggagtttgagaccagcctggccaacatggtgaaaccctgtctctattaaagataaaaaaaaatcagccaggtgtggtggtgcacgcctgtaattccagctactcaggaggctgaggcaggagaatcgcttgaacccaggaggtggaggttgcagtgagccgagatcgtgccattgcactccagcctgggtgaaagggcgagactccgtctcaaaaaaaaaaaaaaggtttccattggcccttttttccagggggcttttggcaattttcctggaagatccctagtgggactgaaaattctaacggtgacccgggggctggacgtggaaacccatggggtagtcacttgggtccattatcctctggtcgccagtatttatgggctacaaaatacttttataacaattttctcccaaagaaagagcttacggcgcaatctagacctcagaaaataccaaaccacatttaaagggtacacctatagtaatgtgaccatgaacgaagcgtccagagaactgacactgagggcaggatccaggacttttcctatgacaaattagtttgacactacacagtggttctccccgtgggctcttcacctttatctgcaggaaggccccacgaaaaatgacaacctgcgtaataaaccactatgccactgagtatcgaccagcaagatcagccctcgcacacattcatacggtcccgaacggcggctgcagttttctttattcagccacgatagagatagaaacaagaagcgagccaacacacacacacacagagggtcatagaaacacgcacacgtaaccctatcacaccgccacaccgcaaccaacacaacaaccacacaagcggggggacacgagaacacgccgcggcgacgaggccccacgcgccggcacaaccaagccgaccacacacgcaccgacgaccgcgacaacacagaccgacggaggagaagaccagaaggaacgaacgagcgggaagagcgaagctgcgcgagccgacgcgcggagaagagggacagcgagcggaagggggaaagagaacagagaggaggcaagagagcgaaggcggccggagagcggacgagggaagagaagcccggggcagagacccagcagagacggacagagggcgaggccgacacgccgggcgcagggcaggcccgcggggagcgcacacgagcagcgggcgagcaacacggcaagaagaggcgccggcgggaggaacgaacgacaacgcgccgcaacacacgcacccagacgcagggaaaaagaacgacgagagagcagcaaaccaaaaggaggagggacacacaagagaacagggggagaagagacagagaacccggcggaccaacaaagcggaaccgaacagcgaacgcaagcaacacaccagcagaccgagcaagacccgcagcagacaacaccac

SEQ ID NO: 576748 - DNA, 918 bp, Homo sapiens
tgtctctctcgcgttgtgtgctgatttttgttcagcccgtgttacctcccttgtggtgtcgtgaccacctgctcgcgtgggggtttcgttggtggcgtactgttggtgtcgccaactggtccggtgaggaacaagctgttctgtgcacaatatagcggttgcgctcctcgcttcccactattaaggagtacttcccagcactctcatgtaaagtcaatgggggccgctgccggtgggcgcccgtcatgtacaaggtcacgtccaagcaccttggaccacacgtatgttgacagaaacggtggaacctaccaggggcagcgcacatctctgcgttggaacacccccgccctcggttactccctgggtatttgcgagggcccgtgggcaagggcgcacaggtcacccgcctgcggggcggtcctaatggtgtcttcaaacaacattgcccctcaaaacatatgtcaccggtaacccgcgggttgttactgcacccaagatgttgtgtgccgacgccacttcgcgaagtgcagtcgcgcgggcccacgttcgtcgtggacgccttattgccgcaacacacgtatctacttgcgttacagtgagtgggatccctccctccctgacttatcgctcgggcaccccagaagggctattccctcgatccccgaaatcaccgacaggggcccacccccccagaggactgccgcggcccaagttcccccggaggaacaagaagagatgcccagagtccctccctctacagtgcggcggtataccggatctcccccacacatcttccgtacaagagactcccccgcacgcgtgccaacagggaggattaaacatacccggggatgccacggcagggcgggtaaaaaaacaggccctcccagtgaccccccaaaaacaacaaacaaaaca

SEQ ID NO: 576749 - DNA, 932 bp, Homo sapiens
  misc_feature (308)..(308): n is a, c, g, or t
  misc_feature (313)..(313): n is a, c, g, or t
  misc_feature (873)..(873): n is a, c, g, or t
agtttattaaaatggctccaattctccaaaattatatggtatatatttgtaagttatttaaaaaaacttccatggcccttccattcccctctcctctcaaaatagggtattggtccaggttggatccaagtggccacaaaggtctaaccatggcacccacgaaagcacgacgaagaacagggacgggtccacgagggaaccagggtatggcctgggggtcacctaactcggcaactggacgacggtccaacggcgcaggttaaactcactgggctgggggggcaaacgaactggagaacgagactaantacancaggaccaacagccaaacaggaacagcaaatagcggcgagagctaggaaccagaagaacagtgttacaaatattcattacaccaacatttaccaacattatattcaggggggaggccccaaccaacatcccggaggagcaaccaggaaccaaaacttaacccaccatggaaggggaaggaactctaggccggggggcgtccgtcttctccctacaaaacctccgtttctaagcaaataatttagggaagccccaaacgagggttccacaggttcccggcgttccccggggtgcgtggtccatattttgcgcggccttatggccatctcaccaaggggcaaaatggccagccagcagggcctttttggggggtggccaaggcccactggtgacaaggtgtggaagaatctacacttggtaactttccaataattttggcgccctgtgttcccattttcaggcaatggtccttcaacatggattcttcgaatagttagagcgcgggaatttcccccatcatgggttgaaactgagggttcttacggggcaatccaggctggngcccggagacaattaaattcttcacattccaggtgagcgcatttggcttctggggggag

SEQ ID NO: 576750 - DNA, 301 bp, Homo sapiens
atatctatcggggaggtaatatgtgtatcgccgtgagcaatatattgagtcggactgggtgtcagaggacgcgtgtcagagttgccttgtagaaataatcccaggaacctgggataactggatacacccggtatccaggcactaccagagcgtgaactttaggctggccaaggcctggagccagagtgtgtgcagcgctcccacggccgcctgcccgggactgccccccgacacatgcttagtggaattctcccggtggcagcccaagagtctccggaacgaaggtcaccaacagccaaag

SEQ ID NO: 576751 - DNA, 512 bp, Homo sapiens
cgcggtggctcacgcctgtaatcccagctctcagggaggctaagaggcgggaggatagcttgagcccaggagttcgagacctgcctgggcaatatagcgagaccccggttctccagaaaaaggaaaaaaaaaaaaaaaaaacaaaaaaaaaaaaaaaaaaaaaaaaaaaaaattgtgtgtggggcgcgcgcgccggggccccggaaaaggttttaaaacccatcgcgggggggcgcgcgggggcccccactggagcgacagggacacatgtgggccaaagcgcggtggccacaagagagagaccccggggcactatgagaacaggggcgggggtttccacacaattaaaaaaagaggggggggggaaccacggaggggttttgggagcaaaacttccaagaagggggggctacagaggaggccacaaaaggggggggcttctttaaaagggggggcccaccgcggcgacgccggagttctacaatttacccccgagggggggggggggaggg

SEQ ID NO: 576752 - DNA, 285 bp, Homo sapiens
catcacgtctggtgtatgagcagtacattgaagtcaattggtgtgatatccgaattaaggtgaaaaatatctaaattggaagactcgaaaagaataacttcgagtatttcaaagaaaacgaactcttgatctcccctacttatgctctttgtttaactcatcatgatccttttttcttctctcattgtttaaatttctacctcccatacattaatctgattggccctcctcatttcggatctagccttctattggccattgagaatgtactttttaggagtgagg

SEQ ID NO: 576753 - DNA, 144 bp, Homo sapiens
tagagattgatgactatcgaggtatgtgtcaccatggcaaaaattcaataggtctattctaattagtccaggacgaactgtatagttttcaagtggcctgggaccctggtcttcttgtccttactgacttttgtgcatttttgg

SEQ ID NO: 576754 - DNA, 321 bp, Homo sapiens
cccacttatgtgtatatagtcaaaggatgtgaaatcagtatgttgaagagatagctgcactccaatgttaagtgaagttttcttcacaatagtttagttatcaattcaacctaagtatccatcaataaattaataaagaaaatatcgtatatataggcaagaccttggagataccatgggttcgatttcagaccaccacaataaagcaaatattgcaataaaatgagtaacacaattttttgtttcccagtgcatatacaagctatggttacatcatactgtggtctattaactgtgcaatagcgttatgtctaaaatgag

SEQ ID NO: 576755 - DNA, 945 bp, Homo sapiens
tccaaaaattttccccttttttttaaaaaaaaacccctttaaaaatggcttattaaaaataaaggggggtttccccaacccattttttgggtttttttttcacctgaaaaataacccaatttattcccaagaggttagacctcaacactctcttccttttgtgttccccctcgtttttcaagagtgggtgtttttcccccaagttcgtgagagagtttcccccccaagatattttttcttaaagttgggcccaataattttaataaatccgcccatgaaatttaaatttcctctttattttacagtggaagttccctcttctcgtgaccccacttatattagggccatcaaaaggaacggtttaataattctcggctcaaaaaaaacccgtccagtgtggaggcgtgtgtttcatctctctcctcgatagagtcactcacacaatttctcttttaaacaagacagcggggccgcgctttagtggaccccaccccatctgcaaaagcggcttccgcgtgtaccctctttcttgtaccctcggtggcgccctcttttatagtctctctccttatttcttgaagaggacccctcgatattttctttatcccccctccctgtttttttgtgccctcgttcctttaaactctcgcgtctttaccgaccatccccgtttttttttctccaaacaccaaaccactttttcaccagaacaccaaacattcttcttcattggcatgttcaaggaggaccgtttaccttacaacacctacatatcatcgagatacataatcatcaagtgtccgatagaatacgacaccgaacacagaatacgtacgagctaataagaaatcctctgatacatccctacacacttatgaaccgggctgtcctcaacatgatcgtcatcatcctgtcctcatatgctacgcactcttgactaggcag

SEQ ID NO: 576756 - DNA, 804 bp, Homo sapiens
cccgtgacacggcaagaggagagagcaaagacagaagcgagcagaaagagagagcgacagcacggaagcccaacgagagagacgagcagcagaagagacgacaagcagccagaagagacaggaccacgaccgccagagcgcacacaagccaagcacccagcgcacaccaggagcaagacagcgaacgagagcggcagagcaaagcagagggaaacagccgacacggcccagcacaaccagaagaggaccaacgacgcaacacagacacagaagaagagagggaaggagagaacaagaagacaagcaagacaaaggacgggacagagagaggcagacgaaggaaaggaagagacgacaagaagatagacaaggcaaaggacgccacaacaagaccagcaagcagggggcagacacggaggacagaagaagccagagaagagcgagaggaaagaagcagccggagcccggagagcgagaagcagcaggacacgtaggcgcagagactagagcccacgagagaacaggagcaagagaagaaggaggaaaacaggagacagacgagcagagagaacgaggagaagaacagcagaagcgaaaaggaaagaaggcagacacgcgagagcccagaaggcgtcagaagaagcagcgagagacacgacacacagcagagcataagcaagaagcacaatgacagcaggcgcgacgacggagaggcacacaaagagagcggagacagtaggagaacagagcgagcgaaggagaagcgcacaagagacagaagagcggcgaggagcagaggcgagt

SEQ ID NO: 576757 - DNA, 411 bp, Homo sapiens
agatcaatgaaaaggaaaagttgttttcttgaacaggattaaacaaaggtcaactaaccctttaatctgactgaaaaaaggagagtgactcaaaataaaacaagagacaaaaagggagacattacaactgataccacagaaattcagatgatcattagagactgttatgagaaactgtatgacaatacattagaagtcctagaagaaatggataaattcctagacacctataacctatcaagatagaaccatgaagaaatccaaaagccgaatagaccagcaacaaataatgagacaaaagcagtaataaaagtctttcatcaaagaaaagtctaggacctgatggctttactgctgaattctaccaaacacttaaagaagaactaataccaattctactcaaattgttac

SEQ ID NO: 576758 - DNA, 158 bp, Homo sapiens
gaggagcctactagggtgtagaataggaagtatgtccctcgttcaggcgttctggctggttgcctcatcggtgatgatagccaaggtggggataagtgtggtttcgagagatataaaatatgattagtctgtggctgtgattttatattaaggagatt

SEQ ID NO: 576759 - DNA, 162 bp, Homo sapiens
tccaagcggaaggaggaggaggaggaggaggatgatgatgatgattcaaaggagcctaaatcatctgctcagctcctggaagactggggcatcggtagacattgaccacggttctcagaggaggattatcgaccctcaccaactacaaggccttcagcagtt

SEQ ID NO: 576760 - DNA, 1194 bp, Homo sapiens
ggtcggggtttcctgtcttgcaacaggtgcttggacgtgaacccgtgcgctcgttcccgcaccccggccgggcgcccatagccagccctccggtacacctcttcaccgcacccatcgagtactgccgccaagggccccgcggccgccgctccagcgccgcgcagccaccgctcgccgaccggcgcctctccattaggtcgccgaacatgactgaccgcgtccacctcgcaggatgcgccagaagctaccaccatgagactcacgaggccagacatcaaccggccagatcaacctggagctctacgcctcctacgtttacctgtaccatggtgagcgcgggcgggcctaagcggtggcgggggccgtggcgcggtgtcccggggcgcgcgctgggtgcgggcctgggggtgtggccactccgcgggctcatcccgcactctcctggcgcccttctggacacacatgtgcggctgctcgaggttgccgaggactatctctggacgcagaagagtcggggcagctggatacttctcggctgtaccctgagaatgctccctcgctaggccaggggcggctctgcagcacccttctgtatgaagagagaccttggtgtcctgaaatcctggggtagcagactgacagactgtgtgatcaatcctgcggcttaggacaggtggagttcaggcattaccatctgtagctctgcctccgcatttggacctagatgggacagcgtgaaaaggctgcaggtactcccagctacccgggccgacctggtggtgtgaccggacgctgccgggaacaccgaggcgaaatagcaaaccttggggggctggcaggcacgatgggtcacacagaggggaagaacacatcgaggagacgcagagatccacacaatgcggcaccggacaacgcacaaggccccactggattggaacgccactctcaaggaaacgacccctctgtcgcgcacacgcaaaggatccctgcaccgtgcccctgggcgcccacataccatagcgggcccacagacacacgccggggacatggaccaaaaagaacccacatatgcaaaagacccaccagcgggcacaacaagcgtacgaggacaaacacccagcgcgacgcgacagagccacccgaaggcgagaccaacaacagagtggaggcaacaacaacacacacagagctccc

SEQ ID NO: 576761 - DNA, 598 bp, Homo sapiens
  misc_feature (532)..(532): n is a, c, g, or t
ttttttttttgtacagagcccctgactggagctaaaagtttaacagcgttgctacgagctatcaactgcgccttggcaaggagcgcttttgttcggaagcctgtccatccaggagttatcggatagccagatgcatgaactaatctctacaggattacacttctttatattaacgcatcccccattactacaagcatgacaatgccttcttagacacccatgattggtatgcttctagaatccaaaggcggataatgccaagcaagaacaacagaggcactgccggatcacttcaccagacaattcttcagataaacatggtacaactctggatactgcaaggagctgccacagggaggagcgcctgcctttgtgttctcagacggactaggaagcactctgactacagaggccgataatgcctacgccactgacgtcagtctgaagacgatgcccaagcaccggaatgagtaacgctccatggacacgttagtggaccgttcgtattcttggtccggagacatactctgcncacccatgcacagatactttgaggctgaactcgatgtgtgccctcgcttgttttcaaaaagggcaa

SEQ ID NO: 576762 - DNA, 1352 bp, Homo sapiens
gttttcttactgacgacaactcctcgtccagtcatctgtggaaccacttgaacactagatgatgaagatggtcttcctgaaaaacttgcccagcaagaatccacatgtatcaaaaggcagcagagaaacccctcctcgtctttgcgccagccatggccacgtttgcagttacgcaatcattctacagcgcatggacacgtcttctggactgaaactgggacacaaacacggcaccacgcggacccaacgcttgcacacacacaaacactgcacacgcatgcaacacagcaccaaacctcgcgcacacacgctgcacaactgcgcacagactgcccctactccactgaaccactcaagcgcacacacttctcttctgccgcccaagcactctcgactcgacgcaccgaccacgcggcacacgcacactctacaggcaccggccactgcggacacgcaaacctttcaccacacatccgcacacgccacacagtggcccacgccaaacaccggctaaaacacgacacaacacttgccccacacctccgcaccgggccaaacgccacgcgcacgcgcacaccgcaccagctcaaccacacgcccgcagcgcacacgcagccaactgcacatgcacctacccgccccacaccaggcctgccacgcaactctgcgcaacacgcacaaccaccacaccaccatgtacagggaccggacccccaccccacagcacccccacgcgcgccaccaccgcctcacacacccacacgaccccgcaacaacctcgagcgcaccccacaccgcaccctgctcgccccatcccccacaagccgccgcaccacacacggcaacgaaccccaccacgccccccacacacatgcgaccgcctgggcccccacgccagagagacacgcccacccctgggaagaacgccacctcgccgccgcacagcaaactcccaccccctcacaatgcccggcataaccaccaccagggcaccgccagccccaccacagcagccgcccaccacacccacccacccccgcccacccacccccatcaaccaccgcccccacgcaccgcacgcgccaccgagcccctcagacagaccccaacctcacaacgcccgcctctttaaaccatggatcaacaacccgcacccaatcgacgcatctacccaccccacagggcgaccccccattcataccccgaacacccccagcggccgccaacacgcccactcccacctaagcaccgtccttagtcggcgctgtctccaccacaaagcaacaaaccatgcggaccgcagcaccaaacaagtggaacacaccaaccatgcgcccagccacgatacaaac

SEQ ID NO: 576763 - DNA, 559 bp, Homo sapiens
  misc_feature (377)..(377): n is a, c, g, or t
ctcctgggactggtgcccccggaggtattggggacagaggagggctgcagcacagtggggagggcagaggggtctctagtgaaggtgacctagggggtgacatctgtgactctggggcaaggccagtggtctagacgtgtcagtagcgaggtgggttccagcacccatgaggccagtgttgctggagggatggcagggccaggtgccctgggtaggggtgttggggaccctggctagagtgtgggcagcagatggggtgggggaagagcctccttgccaggttcctgtgggccagtcactggtgccacaggggtctccctggtgggcctctgcctttcttctttttgagacaggtgtcattccgtcacccatcctgnagtgcagtggcacgatctcccggctcactgtagctgtggcctcctgggcctaagccaccctcccacctcagtcctgagtagctgggactacaggcgtgcactgtcacacctggataatttttgtattttttttgtagagatggggttttggcatgttgcccaggggtggtctcaaactcctg

SEQ ID NO: 576764 - DNA, 932 bp, Homo sapiens
gggctatggcaaaggtcaccaccgggtcgattaaatcttcgcaattgagataaccgttcatcagcagttcccaacaggtttcttcaatacgcttgcggctccagcgcggataatccgggttcggttcgctgcacgcgcgagagaagacaatttggcgttattgaaatgcgcttcgcgtccgaggttaaaaccttcggcaaacggcttggcaaacgcgacataggagatggtgccgccataagccagaccgcggagcgccgattgcagcgcgtcggcgtagccgctggtttcgataatcacatcggcaccctgcttgccggtcagcgtttaggatctctttacctacatcagtgccgatggggttaaggcagaaatccgcgccgtggcgacgggcaatatcacagcgatgggcgataggatcagacgccaatcaccacagaagaccgccagcgcgtaagccagtcggatggcaatagaccgatgcgccaagccctaccaccaccacaaaaatcccctacgcgcacgtggcatcgcgcacgccgtcatggcaaactgcgccgggtcgtagcagacgggtttccacggagctgccactgcaggatattggcgccagctgaaagtaatgcactgcgtcaatgatgaaccgccacggagagcggccgagacgcatacgctggtagccaccggagtccgaacgacgcagcggcccgaaaatggcgcacaacagtgccagtggaattgcaagacaagacggcgagacgccgaagcgaagaacacagcacgcgaaagaccacaatacggggcggggaatcaccacgccaggaaaaataaactacagggaccaccaagaaccagcaagaaccgaaaagggggcgaaaggcaacgcgaacccgcaagaggagcaacagaccaggagcgcaacagagaacaca

SEQ ID NO: 576765 - DNA, 187 bp, Homo sapiens
atagatgggttaagcacgcgcagcgaccttgagcagaatgaacacagcggatcgataaacatgtagagcactggcgcctcgggggcagcgtggttggcctcaatccacatcagataggtgtcagcctggctgcgcaattgtttgagggttgcgaaggttggaatggcagcgccattgtctggtgggt

SEQ ID NO: 576766 - DNA, 842 bp, Homo sapiens
taaaaaaattaacccttttttcccgttgttttggcaaataaaagcgggctaagtgggtggcttttgggggtttatccaaaaaaaccacatccccttttcctctccttcccgatctcctccgacatcttcttcctctgtgtggattttcaccctcttgaggtcgtggggcgtctgcagccagccaggaggagcacagctgtgtgtgtggtggccagcagccacaccgaggggtcagccagcccacaaagaggccagctgtgagtttcagcccaagagagagcgaccttttggcactctttttctcgagacagagtgtgggaagaggtgtgttacactcgcgtctctctccagcgagaacagaggccgcgagagaactctcgtcatgtgtgtttcccccgtgttggggtgtgaattagacagagtgggggtctcaccgtgtgttgtgcccccacgtggtttggggggttcccacacactttctgtgtcggagacacggagacacgctgcgggtggccacacctttgtgtggggcgagacaccccctctctgcggagggaaggagagcgcggagaataatttgtgccggagaaagatctcccccctctcctggtgggggagaaatctcatcaagacgcagcatctctctcagaggggcggggtgtgagtacaaaacgtggcctcgtcgcccctgtgtgtgttcttaaaacccccctcctgtggctgtgggtattttgcacccagcgccccccaaaaggggggagacagcagcgggcgggggaacaaatgtgtgtgagacgccatttttctcccaagcagagcggggtgtggtctcctcccgacgg

SEQ ID NO: 576767 - DNA, 287 bp, Homo sapiens
atgtgtgtgtatgtgtgtgtgtatgtgtgtgtatgtgtgtgtatgtgtgtttgtgtgtgtatgtgtgtgtatgtgtgtgtatgtgtgtgtgtatgtgtatatgtgtgtgtgtatgtgtgtgtataggtgtgtgtttgtgtgtgtgtatgtgtgtgtatgtgtgtgtatgtgtgtgtgtatgtgtgtttgtgtgtgtgtatgtgtgtatgtgtgtgtatatgtgtgagcatgtgtatgtgagagcatgggtatgtgtatgagagagagcatatgtgtgtggtcgacgc

SEQ ID NO: 576768 - DNA, 914 bp, Homo sapiens
cggcgagcggacggctgcatttacggggtctcccggagggccagagtcgtgggttacacgaagagacgaaatgtggtctgagggacgactagtgaatatgaaacgaattccgagagaacggagcacctcctcgaagtcatcccaggtgatggctagcaactaggactcagttgaagtatttgtgccaataagggaaatcgcacgcacgtggctagactagaccttgggtagaacggagaggcatacgaagtgagagtagtttacaagtctatgatagattgaccgatgagtatgacgagggccgcagtggttctcatgatcggagaagtggtccacctcacagaggaggatgcaatctggttattagatgtggacgaagagtacgatcattctgcaagcaggcaagcctgagatacagggtaccatgacgagatcggcgttgtaggaatgaacaaagtttctactctatcccattatgctgacgagagcggtctccattataagagagggagcatatactgtgtgtaatgcagagacatcacctagttgggccgaaaaggagttgctccagagcagacagatactggtgtccaggtgtcagtaggcagatagctactctcgccagacaaggagcgaaaatcatactcatttccatcagggctcgaacattagaagagtccgtgcgtcctggtgccatcctacaaacggcagagatgaaggaaaatcctgaagagagcataacagagagggctgtccaggtcttttgagaaacatcaagagattacttcaacgctcaaggtggttcagcagtattcttgcatcaaaggtgttagaacaagaccagtaggctaacgtgacaaaggaacttgcctgaggctgcaagcaggtgggcttgctgaaaaagctaggagaaa

SEQ ID NO: 576769 - DNA, 383 bp, Homo sapiens
  misc_feature (103)..(103): n is a, c, g, or t
  misc_feature (106)..(106): n is a, c, g, or t
  misc_feature (109)..(109): n is a, c, g, or t
aagaccgccgcccagcagagcggagctcgcggcccatcgtcgggtcactcatgttggctactaacccttttcgtgcgccgggcattctagccgccggccgtgngcnggntcagataggcggcggcgatgccctgcttggtgttggcgggttgtggggacgagtactcggccagataccgcccgacgggaacgacgcagtgggccacgccatgggtgggcgtgtccctagcggtgtagcacttgctgttggggatgtccgcgacagtccaggtggatccgcccggaatctccagagcctttgcggtgatgagccggtctgccagcaaactggcgccggcagcatcccgggcgcggtaggtggtgcttgcgcccagaccaataac

SEQ ID NO: 576770 - DNA, 1136 bp, Homo sapiens
ttgggtaactgtatggggcgtttcttgtggtcctgggaacaaacagcgggatagtgccggtaatgtgcggtaaaccccatgggggttcaccccttggtcttcacggggtttgtctgggagtccatcttggggcgcctttcccgtgggccctttttggaacgtggtctttcccaagggtcacatggaatcggcgctttagttgcaatttcccgtagtggtcgtccaaggccagggcctgaggccattggccaaggcgctgaggcttcaatgcgttggttcgtgggtcaaggcttcttgggttctgcgctacgaggtacctttgggcaaccgtaggtcagatggcaaggcgaccgcatcaggactacagtggaggtcccttcatgggcaatgcgactgaaggggaccggtcttgaggtctgtagcacaaggccaagtcctgcaacgcgcagctccttgggctctgtctggtcgagagatccccattcctgtactgggtgcaagactgcagcctccggatgcagttctcgatgtccatcattcgcacggagagagacggtctcgggtaccagggagtaggagggaggcagcccctgccgtgcaggtcctggccgatggcgcctctaccgctgctgccctggggctttatggccatgaagcaaattccttgagtggggggtactggggcctagcacgctatcgctggtacctagtccactgcccacccgccgtcgtgctggctgccctcacttctggctgacagtagggacgccgaccagtctgacaccattgtcgaccgcacgctgctgcccccacaccacgttgcaagaggtcacaccatgtgcagcagccttgcgactgacccgcagccggccccgcaggcctcagagttgcatggatgctatccggtgcggctgccaacaggcatcagtcgttcccttccgcaggtggaggggcgcgctgtcccgcaggcatctgagctctgtgccggggccgtggccatgggaagatgttgccacgctgcctcctcacatcgagttttacctcaggatacactcttgaatgtctgagtgagggtcgtgcttagctctattggcctgtgagatgctattgcaaaatcttgcaggtgtttttaagat

SEQ ID NO: 576771 - DNA, 201 bp, Homo sapiens
gtgtcagactctgtcgatgttcggatcagcagatttacgtccagcgctatctagggtctctggattgagaaagtgtctgttctcactatggagtaaagttttccactacgcgtttccgtgaatgttgtcccaggatatcgttgaagtgtggatctaggtctatgtgatacttcttcatatacccatacagttcttcatgta

SEQ ID NO: 576772 - DNA, 238 bp, Homo sapiens
tatacaatcagctcctaccgttcgctcggacacacacaagcggtgatcatacgtcagggcctctgaagagagaagggatgttggcctccaccgtgtcccagtccaacgtgttcattgcgcctgctgccatcgccaggcagtcaggggtgacctgtctcccatgtcactgcaggctcctggggtcccggagttccacagcagcatcctggtgacagatctcggccatggtccgagcgga

SEQ ID NO: 576773 - DNA, 162 bp, Homo sapiens
gacagtagagacgaaaatgaaccaattcaggagcgattcttcagacctcacttcttgcaggctcctggagatctgactgttcaagagggaaaactctccagattgggcttccaagtcaagtgggttaccaccccccagatcttaagctggcaacctaggtgg

SEQ ID NO: 576774 - DNA, 152 bp, Homo sapiens
  misc_feature (69)..(69): n is a, c, g, or t
aaccttacctcccttaacctcttatcatagctgccgtctcgcaggcgcccacccgtttgaggcgctccnactcgtgcagcacgcgaaccgcccatgtgcttgcgcccccaggaaacgctagtacctatgaccggcaggaatgcccggtaagt

SEQ ID NO: 576775 - DNA, 351 bp, Homo sapiens
  misc_feature (1)..(1): n is a, c, g, or t
ntgtggctctggacactcccctataaaatatatgcctctgttgacaagtgtaaggatcaaaaggatcacatgtggcttccatgaaaagaaaggtatcttaaaattgttgtcaatcaggtatctatttcaatgcaacttaccaatatgaccatcgttcaatataataaacacagctatcaggtttcctcccaagctgtcatcgagcgctacagacggtcatagattcccatgttgcaacaccagtatagccaccctccatcctgcttctaccaggacggctgtataaaggcatcagtgtaacatactgatatatggtcacgcattttaaatgcactgtgctctaggttagcc

SEQ ID NO: 576776 - DNA, 316 bp, Homo sapiens
tctctccacactggacacagtaggtagtgtcagccagagattcggggcagtagataatgttcattttactgatgcactttagtttttgggtccgttactggttttccagaaaattgggggctttttaggcggggagttagggcgacccaaaccagtgaagagcccccaatccccttgcagtttttgtgggctatccagtggtggggtgggaccaggtcctaaattgggggatcttccacgcttcctttccttgaaggggcttggcaccaggacaggcttaacccccaagaaggggtccaatggttggggaaggtgg

SEQ ID NO: 576777 - DNA, 1045 bp, Homo sapiens
  misc_feature (1045)..(1045): n is a, c, g, or t
agcggacttccgcgtcacctcgccgctccgcggcgtcccctacctgattggaatgctgctaaggtcccgggtaacacctgacgccgaacggcagtgcaagagtacggtgccagcgcagcctgcacggcgtagaatctacacctgccgcgtggcacggagtcgactggtccacgatcacactcctggtacttgtaggtactcgtaccgcggcgtaacactgggaagtcgtgttgctagcacctgaccatgcggacatgaacaccagaaacgaacagcgaggctagcgcgattacgccaacggcagcgacgggcagtataagctgagtgctacggagatgcatcttctcttatccgtctcggttctgtcagcaagatgttacctcgccgtagagattgaaggactgggcgttcctggtccttccaaaactagcgcgattgaccaaagcatccaattagcatacgtaggacgacacgcactgaggatcgaaaggttggtcgatgatagtacgtgaacgttagggctgtagggaactcgattcgggaggattgtgcatgaacctgaaatcgtgagagtgccgctgtcatgtgtgagctgtgtggtgtaatgaattctcggtgatgtccgatagggaccaaaagtttgtgacaataagtgaagtctctttatctgctcccgactgggagctcactattgatttcgcgtcatcttgcacctatcgttgctaccgtccccgggactggacttggaagcaatcgctagacttcgaaggtctcagggacgatatgtgcaatagtctcgacttgggggtggccactttttccccaggaagacctttcgtgggccagaccgctaacaacgggagaggcccacttacggccttaggggataagggcgcgatatgccacacagctctgagaggtgttagaataggccagcgcttcacattaagtagaggcgtttaaacgccacacatttgcggaccttcgagccaagaaagcccggaaccctcacgcaggcaagaaaggcgcgaaaagaccgatgatn

SEQ ID NO: 576778 - DNA, 640 bp, Homo sapiens
aagcccgccgccggtggaaggtttgttcttaggtccacaccgctttcgggaggcccaatggccgtccccaaagggccacaccgtcgccaaatcttgtcccaggtcttttctggaccgcctaagaaagaccagcggaccaagctttggccgccactgccaaacagcgcgccaatggtcttccatcaagagtgaaccgggcggccccctggaaatgattgtacccgccgccaccgctcaccagtcaccaagacttcttggacgcccaattcttgcgtttctcggcaaaggaggcgatttgtctggtgtaagaacaatcccgtgtccgctggtaaaagggtggtggtacaacgtgggcccacagagtttaatgctatccgctcacagtccacttctcccaaggccctcggtggcctattaccacgaaaaaatgtggaatgaggcttcccagaaaggagatcacaagacactcctcactccacgtatgaccggagaccctgctggtagctgagccctcgtcgctgcgaggtcccaaaagtttggagggtcctggtgcccgcgctcgctacccagaaatcctaccgataagcccctcgtgactccaaactcaccttgtataataaaccgtttttgagggatttta

SEQ ID NO: 576779 - DNA, 344 bp, Homo sapiens
  misc_feature (7)..(7): n is a, c, g, or t
  misc_feature (28)..(28): n is a, c, g, or t
caccctncaagtgttggtccaacttttncccacttgttcttctagaaattttcctgtttcagcagggcccggtggctcacgcctgtaatcccagcactttgggaagcccaggctggcggatcacgaggtcaggagatcgagaccatcctggctaacacagtgaaaccccgtctctctaaaaatgcaaaaaatgagccgggcatggtggcggacgcctgtagtccctcccagctactcgggaggctgaggcaggagaatggcgtggactcgggaggcggagcttgcagtgagtcaagatcttgccactgcactccagcctgggcgacagagcaagactccatctc

SEQ ID NO: 576780 - DNA, 399 bp, Homo sapiens
  misc_feature (64)..(65): n is a, c, g, or t
tggtagtctaggctttaaaaatgcttatctgacattatacaaatttcctgaccagtactctcannagtgtgaaggtcatggaaaacaagaaaagactgagccactgatacagattagagaagactcaggagacatgacagctaaatacaacatggtatcttatatttaatcctagaataggaaaacagcattagtgaaaaaacataaaacccagattaagtcgatagtgtagttcataatgctgtgccatgttaatttcttagtctttataaatgtactgtggttatgtaagatgttaacattagaggaagaccaggtgtgggggctcaccccagcactttagcttgagcccaggagtttgagaccagcttgggcaacatggtaaaaccccatctctac

SEQ ID NO: 576781 - DNA, 547 bp, Homo sapiens
  misc_feature (193)..(193): n is a, c, g, or t
  misc_feature (201)..(201): n is a, c, g, or t
  misc_feature (209)..(209): n is a, c, g, or t
  misc_feature (212)..(212): n is a, c, g, or t
  misc_feature (224)..(224): n is a, c, g, or t
  misc_feature (226)..(226): n is a, c, g, or t
  misc_feature (239)..(239): n is a, c, g, or t
  misc_feature (250)..(250): n is a, c, g, or t
  misc_feature (489)..(489): n is a, c, g, or t
ggatcaccatggcacaaggcgtgcttgagtacaaggacacctacggcgatgaccccgtctccaaccagaacatccagtacttcctggaccgcttctacctcagccgcatctccatccgcatgctcatcaaccagcacaccctcatctttgatggcagcaccaacccagcccatcccaagacacatcggcagcntcgacccnaactgcancgnctctgaggtggncnaagatgcctacanatggctaagcncctgtgtgacaagtattacatggcccgtccacccgtggaagcccgtggcaaggatcccaaggcaggaaatcccaagtgccccaggcgccaaagcgttcccaaagagccaagccccggaagtttcacaaatgggtctacgtcccctcccacctctaccacatgctctttgagctcttcaagaatgccatgagggcgactgtggaaagccatgagtccagcctcattctcccacccatcanggtcatggtggccatgggtgaggaagatctgtccatcaagattagtgaccaaggtggg

SEQ ID NO: 576782 - DNA, 500 bp, Homo sapiens
  misc_feature (193)..(193): n is a, c, g, or t
  misc_feature (201)..(201): n is a, c, g, or t
  misc_feature (209)..(209): n is a, c, g, or t
  misc_feature (212)..(212): n is a, c, g, or t
  misc_feature (224)..(224): n is a, c, g, or t
  misc_feature (226)..(226): n is a, c, g, or t
  misc_feature (239)..(239): n is a, c, g, or t
  misc_feature (250)..(250): n is a, c, g, or t
  misc_feature (442)..(442): n is a, c, g, or t
ggatcaccatggcacaaggcgtgcttgagtacaaggacacctacggcgatgaccccgtctccaaccagaacatccagtacttcctggaccgcttctacctcagccgcatctccatccgcatgctcatcaaccagcacaccctcatctttgatggcagcaccaacccagcccatcccaagacacatcggcagcntcgacccnaactgcancgnctctgaggtggncnaagatgcctacanatggctaagcncctgtgtgacaagtattacatggcctcacctgacctgtagatccaggaaatcgatgcagccgaatccaaacagtcgattcacatggtctacgtcccctcccacctctaccacatgctctttgagctcttcaagaatgccatgagggcgactgtggaaagccatgagtccagcctcattctcccacccatcanggtcatggtggccatgggtgaggaagatctgtccatcaagattagtgaccaaggtggg

SEQ ID NO: 576783 - DNA, 321 bp, Homo sapiens
tcataaaggtggcgcctccggagtgtcgttcctcccgtctggagttgttcctccctcctggtgggttcctagtctcgctggctttaggagtgaagcttcagaccttcgtggtgagtgttacagctctcaaaggcggcacggacccaaagagtcaacagcagcaacatttagcaggaagaacaaaggaactaagcttccacagcatgaaaagttgctgttgctggctgaggtggcctgcttttattcctttatctggccccaaccacatcctgctgattggtccattttacagagagctgattggtccaatttgagagaatg

SEQ ID NO: 576784 - DNA, 804 bp, Homo sapiens
cgtcggtgcgtgcgcgcccagacgttctgccgggtggcagtcccagcggagtttgcgggtgcgggcgggaccggatttcgtccgtgggcccgggggcggcgggggccggggagtgaggggccggctgagcccacctcgctgggccctccctggcgccccgccttgggcggcggcgagctgctgcgggcctgccatgtctgtagcagtgctcccgcaccttgcacaactggctgggcagtgtgtgaccgagtgccatccgtctcgtgagggaggacctgcgtaggtccgatcgatccgcttcgtgccacagacctgggaatccatactgtgcagtgaacgctggcacgaggtccttgtacatgcatcgccgacgaaggtggtggtcataagacatcggcgtgcgtcttcagaatccatgctgcctggcagcctcgacggctaggcatggctggcagatgtgcagggccctttgtcgtcatcacatccgagtcacatgctcagcaagatgctcattagctaggaaacagattttatgctgttactcgtacagtgttaaggcgtctttgcccagatttgctcattttccagactcctttatgtccaaatttcttggtgattacagaatgcaatcactggtatcactaagtggacaacacaatagtggaccacacacttaaggacagttgaaatgggctcactttggggtaatgtaatatgggtcttttaaaatagtctgatgttggtattggccaataaatttggatagctttattaataaacttttaatgcgaatattataatata

SEQ ID NO: 576785 - DNA, 81 bp, Homo sapiens
tggaaatgtttaaaagggctttattggcgggggagcaggaatttaaccaaaaaggccaaatcccatgtcatcatctggact

SEQ ID NO: 576786 - DNA, 405 bp, Homo sapiens
tctagaggatcccggtgtgtccttggtcttcaaactcagtaaatccacaattttaaaaaacaaaaacctttcaccgggcctactcacatttttactaaaatccctacacagagccatacattctgcttttcatttgacttctccaagctgctgccttcaccaaatagactccacgagcctcccaagtggtatccaccaatatatgtgatactcaaggaaaagtaggtattaaagagtaattaattcaattgatacgaaatcttttcttttaaaattttaccttaactttaaaaagcccttttctggatggaggtgaaacagcataaatccttagaggaaacggttatcctttacgtggactctccatcagccccataaggtgagtggcataaagaggcatttttc

SEQ ID NO: 576787 - DNA, 481 bp, Homo sapiens
gggtcgatctagcgatccctgagtttccttgtctaccaaatcttatagaacggccacccctatctccctttgctgactctcttttcagactcagccagcctgcccccaggtgaaatagacagccatgtgctcacacaaagcctggttggtgtctcttcacacggactcgagtgaactttgatgccgtggctcggatcgggggacctcccttaggagatcaatcccccgtcctcctgctctttgctccatgagaaagatccacctacgagcttaggtcctcagaccaaccagcccaagaaacatctcaccaattttaaatccagtaagccgcctctttttactctcttctccaacctccctcactatccctcaacctctttctcctttcaatcttggcgccacacttcaatctctcccttctcttagtttcaattcctttcattttctggtagagacaaagggaaacaccgggtaccgagct

SEQ ID NO: 576788 - DNA, 767 bp, Homo sapiens
gcagcacccatgtggcgctgcagccgaatcatgcacatgcagcgagagctccaacccacccttctgtcttccctggaaggcatcgtctatcagatggtctggttcagagaaaattggcatgaagaggttctcaggcagttccaacagggtcctggcgaaatgttactccgtggcgttagagaactacgtggagcggtgtccgatgctaaagatcacctccctacactctcaccattttgtgaagaagttgtgtgagcacgtttggggtgggcctggagacactgtgtccaatcgtctctgaccatgttcgtccagacgcatgcctctgagtctctggcccgtgcgtgagtcgctaggccatatgcgacaaaagacctgtccttgtcatgatagactcgaacaagtgccagttcacgacggatgttgacttccgtcgttatccaggtaatccatgacgacttctactaattcttatgtctaagtcgaaagcatgtggattcacaacatcgttggaggccaagatcaagccaactccccaaacgttcttcctcataccgaggcaacaatgtgccggtctctttgagcaatttctcggcacagacagttgaagtggaacttcctggtggagtttctgatgccatagtcgaactgcattattacatcaagattggacggttcatgccccgtggtagacgcttcgtgcagaagacttaacaccgtagtccggcggattgtcatccgggggactcacatggcaagatctacca

SEQ ID NO: 576789 - DNA, 1214 bp, Homo sapiens
agaatgtagtttgctctgcagcgtgtgcgtttgccctcctcccccgccctcagtgtccacaggtcaccatggcgtattatgggcatcagtgcctgcggcagcattggcctttgcagcggcggaagcagctccatgctctgcatccgagcaaacccccacgacggtcttatgaccattggctgcttctcacggcattctagcacgcagctggtatgactagtagaccgacaacagactaccgctttcgaatttaatgcggcattctctcagattccggactagagcaaccgtgatatgaccgagactgagactacctgaggcaagaccgaccgttcgctttgagttgggtggtactttcgactgtactcccacgttaccgtagccctggtctggcggtattggagtggccttgacaagaagagtcactaacggtactcataaaggatgatgtatccttgagaggtagggacaaagcatctttcaaaagcactcataggggttcgtccagacgtacggatgacttaagtgtccggagtccatacgttatgtgctggctcgattggcttgggcttggtccagtccgcttccaaccaacaagcaagggagggaatgcgcttcctcccggtgacacggatagtgactgttgggacgataaactgggattatggaacgtagttccacgttgtgattgcccctggatggggatagtttcactgaccctcttaacacccactgtccaggttgtagcttctgtacccaactttgagcatgagacttggtcccactctctttggccgctaactagctgctaggacagacgtatttacggcggtgcaccctcgaacgggcgaaccccgaattgtggcctctcccggaacaattttcacacaagatccgacctgggttgccgccttaaactattttaaaacggctttcccactatcaccgagggtccggcccggcattaccgaccggtcctttgtttagacgcgggtcgtgtgacattgatgttcctgggagagtacggaggccgaaccgcgccgcgagtgtgcccagatgcctgcgtgcatcagggggggaaaggcccgtcggaaaatgaggaggcatgggtgagccggaggcagacggggggcagaggccgagccgttgcgggggggcgcggaaggggccgagcggggtccgtggagtgaggggcggacgaggagcgggagacg

SEQ ID NO: 576790 - DNA, 145 bp, Homo sapiens
taaaaaaaatggctcggctgggttgggagacacagcaataactacggtggccagggaggggttaccagcgtagcagcgggtttatcagcccgcttggacatacagctaagggaaatatatgctggggggccagtgggaggggtac

SEQ ID NO: 576791 - DNA, 518 bp, Homo sapiens
acactgggttcgagttcgagaccagcctgaccaacatggagaaacctcatctctactaaaaatacaaaattagccaggcgtagtggtgcatgcctgtaatcccagctactcggaggctcaggcaggagaatcacttgaacctgggaagcagaagtttgcagtgagccaagatcacgccattgcattgcagcctgggcaacaagagcgaaactccatctcaaaaaaaataataataataaggaatcaataatgggccaggtgcagtgacttatgcctgtaatctcagcactttgggaggctaaagtgggaggactgcttgaggccaagagttcaagaccagcctgggcaacatagcaagacccaatcactacaaaaaattagctgagtatgtagctaaaaactagctaggcctgtagtcctagctactcagggagggtgaggcaggaaatagcttgagcccaggagttcaaggttgcagtgagctgtgattgcatcactgcactccagcctgggtgaga

SEQ ID NO: 576792 - DNA, 245 bp, Homo sapiens
tcctgatacaaaatgacatcacgctactacgttgattatgacagcaaagtacctacattcctggaggagcaatgactctgatagacaaaggatgtggagctttcctcgccagtggcagagttacgagcagagcacgcatagagcccattatgccttggcgtaatctgagggataaagagcttatgtcctgatagctgaaacttcccattaattgcccacgaatactagtgctgatagattcgaga

SEQ ID NO: 576793 - DNA, 623 bp, Homo sapiens
gctggcgagtgtaccctttctgcagaaagtaaaatatgcccttgcctgaggaaattaaatttatgttcaagtaagtttctttatggcactgggaaacaagcatttctaacaatttggtggaaatccgtgaacatggatacgtggctcttctgggggcggtcgtccagtcgctttctcatgagggagcaacactcctctgacctcattgcagtggcctcagggatatggaattaagatccacctggtgtgatgaagtaaacccagactctcagcaacgcaggacaaataaaacaataaatctggccggcgatttgaaaagtaaaaggatcctcacattccagcgttgaacccaggaaacctctgtgcccaatatcgacgaaaaatagatacactgggagagccgaattaaaaagtctttaagcacgggtaccagccctagaatttccagtacaccagcagcagcctgggaaaccagatcctcattcaaaagacagaaagaaacaaaactcgagcagcctgagaaggaccctattttatgctgttaaccactgagactgtgccatcctcacagttgagaaaggttggacccaaccatactcaatgtcagaaaaacattttcctcg

SEQ ID NO: 576794 - DNA, 401 bp, Homo sapiens
  misc_feature (48)..(48): n is a, c, g, or t
  misc_feature (52)..(52): n is a, c, g, or t
  misc_feature (62)..(62): n is a, c, g, or t
  misc_feature (77)..(77): n is a, c, g, or t
  misc_feature (100)..(100): n is a, c, g, or t
  misc_feature (161)..(161): n is a, c, g, or t
  misc_feature (165)..(165): n is a, c, g, or t
aagtgtgcaggccaccacggcctgggctcaatttttgtattttacagntagnagcatggggncttcatcatgttggnccaggtggttcctgaactcctgnacctcaagtaatctgcctgccttggcctttccaaaatgcttgggattacagggcgtgacanctgngacctgggtccctattttctttttacaacagaccttgggaaatattttcttcccccaagaggttgaggcccatggaatgcattaggggcaggtggggtggtggtgctctgtagcctttaggacttctagaatcaggcttctgggccaccttcttagcaggtgtatacctctttgttccagacttactttctgtctcacaatatcttcactatttccacagttgcagccaagacagg

SEQ ID NO: 576795 - DNA, 396 bp, Homo sapiens
agggaactaagtttattagaaaggaaaacaaaaacacaaacaaaaaaaattcccatttctttaaaaacaatactttaacattttcacaggttggtcaaagggtaacatttgaaacctgaatgtaaaattccagtttagtaagggacaggctgaccacatgcctggaaaatttcagcaaggcatgaacacttcttgatacctagctgcaaagagacagtatttagagatccctgagcaaagacttaaactttctaggactggtctgactcccccttaataattgaggacaaggcacagggtagcctaagctagcatcattgacctttaacagaactaaaatggctaacaagcttaacagcctaccgtacctgtatggaaggactgcataaggcagtc

SEQ ID NO: 576796 - DNA, 893 bp, Homo sapiens
  misc_feature (563)..(563): n is a, c, g, or t
cctctaagacatctttctaacacagccgtttgtcttccctccataacttttttcccttacccccctcacctggtccccactccccgccttgtccctcaccaacgcgtaatttccaggtcccacaaccttaactccccgttatctcaataacaccccggccccaatccacctaggagtttgtgcggctcccccaccttttcttcagggagatgtagctccactctatactcttacaagcgctattttacccaccaaggcgcccccaacactttgtaacttcataaccccgatattttatgaactggcgtcacattactaactcacgtcaaatcttgttatggacaggagcttccaatcaaaattcttcctaaagatatgaccagtattgattagtacaaagtattccgagtattccaccacgcctctggtccccgcttctcccccagaatgtattttgaccccccttagtgcaaaaaaatttttacaggaggccacaaaaattttaaaaattctacttgtatgtgcataacacccgaacactttatgactaccccccctttaantaccctaggcgtaacggtctcccaccaaagaactatgtggtaaaattgacatagtgtgattatgttctaataaccacgaagcatcatggcctcacatgtaacgatcagaggataagcatggcacgaacttaacgatcctccagctagaacatggtggcgcgcctgggtttctaactcaatttactcgctctctgtcatctatgtgggggcgcaataccccgcgggagagatgaacgtaacttcgcgggggcaccgaggaggtccctagaatacgggacagcggcccatggcccccccacctgcaacgaggaaatcttcccccacaaaaca

SEQ ID NO: 576797 - DNA, 519 bp, Homo sapiens
  misc_feature (307)..(307): n is a, c, g, or t
tgtacatggaacgtgagctggggctgcagcgtgggcttggtagatccttggccttggcttggcttggcctttgcgcggcacagctgagcccttggatacgggcacgagcacgcttcccaagcttggggtgggcaatgtaggcaagtcgatcgagcttgcggctgacaccctttggaatcttgggcttaacctccttgggctatacgagggccttgatggcctcggcacgtgcactcatggccttggcatggttggcctgcatcttctttaggcccttttggttgtgcttcttggcaaagcgcatgtncctcaggaacttggggtccaccccgcttaagagactcgtatctttgtgatcgggggttcttgataccatttctgtgccatttccgggactggttgtgtgtggagtggttcttggacttggcattgtctgcccataagccggggctccccggggggctggcttgattacatcctgtttgtagatgcggacaacctgatcctcaaccctgacac

SEQ ID NO: 576798 - DNA, 330 bp, Homo sapiens
  misc_feature (153)..(153): n is a, c, g, or t
ggtaaaatcgagtccttacagccataccacaaggtacgtccatttggactacaagaagagcttcctttaaagttcctatttcagcataaagaggctgtcctttttttttaggaatatgtttggaacttgtgccttcctgtggaagggctgagngactgcaagaaggagagctagcaagatatgcctgttccacccctctcgtggtactgtgtggctgtgcaatgtatgttttatatgatatatctcggcgcatgtgttgtgcaattgttgttatatataatagaggtttgtgttttatatgtgtttcctctttttcacaatgtaaagggc

SEQ ID NO: 576799 - DNA, 850 bp, Homo sapiens
cccagcccctcccgtccgtgcgcgcgctgcaccgccgcaccgctgggggttggttgagtgcggacggtggggtccgggccggagtacgtgttcccgctgcgctaggggaacgcgggcagtcagaaaaatgggtaagaagagtcgagtaactaactcagaaatctggcactggtgctacaggcaactgtgtcaccaaaggaaatcttgaaccttgaccagtgagctgctgcagaaatgcaggcaagtcccggctgcctggcccaggaaaacagacgtgggaagagtatgtgcagatcctggactctgggttgaagacacatacggcaccacaagcgaagagaggtctgtccgttacactttttgagtggcaccacacgacgcacgatttacttttccattgatctaatggaacactggggcctctgcaaacatggggcttctgtcgagggtctagaaagtgggttacacctttcaaccgacagaaggggcttctgggtctatgagaacgcgaaacaaggagaatactcacggcagtacagcaaatatgtttagactggggttcccactgaacaagatttgcgtacagtgactgttggaacatcttgctacagaggcatttcagcttggttggggacgcttatacttcctcacgaagcctgaaatcctttcaaagccatgagaaaacatcggcactggggcttttcatttgcagtgtggagcggagccagcactaagctcacttctgtggagaccgtatattccaaaacggtccgcgaagggaataatgaaaggtcctcatactaatttgcaagaaggcaggagcgttggggaatcgtcaagtcacccaaaa

SEQ ID NO: 576800 - DNA, 166 bp, Homo sapiens
tctacaaccttcctgtacaaaaatatataaaattagttgagtgtgtttgtgtggggtgcatagtattccatggtgtatatgtaccacgattttctttattcaatctgtcattgatgggcatttacgttgatcccatgtctttgctatggtgaatagtgctgcaatg

SEQ ID NO: 576801 - DNA, 492 bp, Homo sapiens
  misc_feature (391)..(391): n is a, c, g, or t
caactgcaagcgcgctccaacattggttgctagagctgctgttttaatttttgcaccatcagatttttcagtgggctcttttatttgtttgtcagtaatcatttttttcatagccttcttttttcagccacacacaagttagagaagaaaaatagtctccctttcattaggattttgtctacacaaataatatccgtgaatatttctaactgcaaagtagcctctctagttgactaattctcctgttgaaactctttgcaacaattgctgccataatgaagcaccaccgatttggaacccttcattctgttttgccacaaaggacatgttgctaagccacatttctcagtgttttcagactcacttactccacataaaaagccaatgtatnttttttggaactctgagagtaagaattttgtcttcaaactatcacttcattgggcagaccagtcttacagattgtttcgttattacatttgttttacatgg

SEQ ID NO: 576802 - DNA, 366 bp, Homo sapiens
cgaagacacacacacacacacacacacacacacacacacgtgtgtgtatacgcgctattatggcgcaatgtgtcactcaagaggcctgagagacgagaggcaagatatatctggtgtgtgctctgctcatgtcacctcagttattcttctcattttatagtacagaagtgtttataggcattatgtgccttagagctcctatggggttgtatgtgcaagagggatatatacacacaggtgtgtgtgctgtgagcgctcctgttgccaccagaacgtctttgaagcgcgggctggagctggcccttgagggttgtatagaattgattggagagaagggcgccccagcagagagtgtgtgcagtgtgt

SEQ ID NO: 576803 - DNA, 410 bp, Homo sapiens
  misc_feature (181)..(181): n is a, c, g, or t
  misc_feature (245)..(245): n is a, c, g, or t
  misc_feature (318)..(318): n is a, c, g, or t
  misc_feature (384)..(384): n is a, c, g, or t
cccatcaatggataaattgtgttacatacacacaatggaattttattcacccattaaaaaaagaagtactgatttatgctatgtagaggcaccccgaaaacatgctaaacgaaagaagctagacacaaaagtcttattattgcatgattccatttagatgaaatattcagaatatataaanccatagagacagaagggagatggtggttgccagggcctggggaaggagggattagagagtgacnccttaacgagtttggggttttcctttggggtgatgggaatgttttggaacgagatagaggtggtggttgtgcnacattgtgaatattatgtcactgaattgttcactttaaaatggctgtttatgttatgtgaatttcncctcaataaaaaaaatttttagaagg

SEQ ID NO: 576804 - DNA, 887 bp, Homo sapiens
caccaatattatggcttgtggatagagtgcaaattcacacaaatctgggggccaacaaagtgagcccggagaccccacctcggggtgattcctggtgggtttatgatgccccccctgcggacgacaaaatttatggcttctcgcgcatggatattacttactcagggcgaccaacaagaggcagtatttcttccctaggagagcgcccgctcgtgtttagtttaacacgcacagatcctgcccgttcctgacacagattgtgtgtgaggtaggcgatgcccacctttcgttgcgcgcagcttgcttcactctcctgtgtgggtaggcgcacacaatatttgctttacggtcagctaggttcttcctcgagcgggcgactcattctcgtgcgcgtacacaacccctgttggtatattccccccgcccgcttctttgctcattccaccgcgcgctctctgttactcacgcgcagcggacgctctgttcatccccacccgctctctgtattcatccaccggctggttgtgggcgcaccccatacagtgtcgctcgctcacactccccggtttttctcccctgctcatactgctctcaccgccgtcggggagatgtgcccacgcaggtgtggctgcaacccttgtgtggtgtcagagtgcccggcgtatttcgccgccaagcagggcagttgtgttgtctcctgtggaggcgccagtccagtcctcgcctgtttggtggttcccgtgcgttcgctatgtgggtgctgggtcatcaccccataggggttgtgcttcctcgccgcatgtcgacacctccccttcactcccgggcggggagtatttctaccgtccagaaaagttgcagaaaaaagcccttgtcccaacaaaaca

SEQ ID NO: 576805 - DNA, 588 bp, Homo sapiens
aaggcgggcacggtggctcatgtttgtaatcccagcacgtttgggaggccaaggtgggtcgatcactgaggtcaggagttcgagactagcttggccaacatggtgaaacctcatctctactaaaaatacaaaaaaaagtagctgggcgtggtggttggcgcctgtaatcccagctactcgggaggctgaggcaggagaatcgcttgaacccgagagacggaggttgcagtgagctgatattgtgccactgcactccagcctgggcgacagagcaagactctgtctcaaaaaacaaaaaaaagagagaacctaaatttaaaatttacgttttcatcccaagatggtcttttctggcatttcgtttggccttatttacaagcatggataaaaatcttaaagggtttaacttaaaaatgatcaatatactgggtgaatctttggagaaatctcttaacggcatgggctatttttctctcgtgctgaaagatgactatgataatcgggtacaactgggtcttcatgtcaccaatttggctgcaagcatgggggaacggctttaaattctgtaacataggtcttaacatctgt

SEQ ID NO: 576806 - DNA, 895 bp, Homo sapiens
ctcaagaggtctagataccggagttatgaagagagagggagaaggctctcagtgtctgagtttaaaatgaaatcctggaagaaattgagattgccattcaaggagtactcctgagtgagtaatggtggcacgtcaagctaggcattcatcagacgcatgaatactggaatgttgggacagacagggagatgtgaaagaagcagcgtttatttctgtgcttatagaagtgaaaatggtaaacagagggagcaggaaaagaagagcatgcatacacataatgaaataagaatagctaaagaaatggcagtctctcagaatgggaagaatgagagaagtcatatgccccggagaacatatttgactacagtcattccttatgagaaaaaaaaacggaccaccgtcgggtgaagatcttcaaatattaacaaaaattctttgtgccatgaaggaggacccgtgaaatcagttccgagcttgttaactgattatattctgaaagttctgtgtcctacatagagcagcaacgtttatctgcggtgggctccaggctagatttccgacagcattattctgagagctggtaccattacccttcttgtatggaaactcagcacatttgaacttgggtttggatccagtattaacagatctgaatacactaatcgttatattatagaacccagagattggctattgatctagagatggttggctaacttatattaaagggtctgtaatgaaaagagaattcatgggagggggggttttcataagggaggcactggtaaaggattaaggcgagaaaaacgggggaaaaaaacaggggaaccggttggaagggtccaacgggagggaaaaggggcacaattgcttataaaggtgtccaaatatgtgt

SEQ ID NO: 576807 - DNA, 302 bp, Homo sapiens
tgggtgatctgcaggatcctttagaatgagaggtgggatggggtgccttcatcctgcgctgtggaaggcctgaacgagcgcagtgcgaggtgaggctgcagttccatggatgtgggcggggacatctttcaccagcagtgcaagcgcaacgagctggtgatcccgcgtgcagcccaaacgagggccgtgtacaccaaggattgatgaccaagaagccgggcattgttcttcaacccccgaggagtcggagctggaccttgactacggcaacagatacaagaacgtgaagctcgtcataacgg

SEQ ID NO: 576808 - DNA, 360 bp, Homo sapiens
tgatctagagtatccctgctgcggactatttgtcggaagcagcactggaacttgagcgagctcacatggtattgttaactgaattagctatctatactctaaatttaagcctcagaaaatgagggagcacctgaagctgtactggtctagagtgaatattcccaaggtgctaagagctgcagaacaagctctatctttgggcagaactggtgtttgcgtatgacacgtatgaagaatatgatattgccataattaccatgatgaatcatccaattgatgcctggaacgaagggcaatccaaagatatcattaccaaggttgccaatggtggaactctcacgacacgagcaataacagtcc

SEQ ID NO: 576809 - DNA, 108 bp, Homo sapiens
atggcaacatactccttccccggcgatggttttctgtgactgcaagaatgtggggatcccaatgcactgggaatgctggaaactgagggccggcccctgaaaggctga

SEQ ID NO: 576810 - DNA, 970 bp, Homo sapiens
ggccccggaggatgagcccaggtctccacggtccctagctagaccccacgcgattcctcacctgagaccccgtcccacacgagccccagctggggcaaacagggcccctccccatcttccgcatctgtaatttgcagggacgatcgacgacgtgatcagcgcagacctgcagtctctccaggtggggactgttcctggaggggcggtagtggtggcggggatcttggtcagtcgctaatacttccgcgcgatgcggcaggggccctacctgccccgggggagctggggtgggagcgggctgttgcaggcagctggttggatagccattggcccataacctccagccccagagtacgatcgggctcaggacctgtgagcagctgctgcgtgttttcgggcatgggtcaagagcctgggcttacaccagttccagcagctctggggctacctcctggacgttggcaggccaatattcgacaagttcgatgaggacacctcttggagaccatgagctgtcctaggagctgaggctggcactgaatgcagagaggtttccacatgagacaaccagtgacccagaacctcaccagcgtaccgggatagccggctgcggtgtggacttcgagccggaccgtgtcctgtgtggcccacttcacctggattttctgggccttgcagcagcccctggatgggtgagggggtcaatctggcctgaaccacggaccgggttggaggggccccctttctaaggatctcggatgggggcctggtgccacaggcaggtggtgagagacacctcctaaggtcggcgggatggtgcccatcttcggtaccccgctgggtatccgggccaaggacgcacgggacctggcggatctctctgaaaaaaaaggcgcctagaagaaaatacaaagaaacgcccggtcaaggggagggaaagtgagcctaaagaggcccggcacaacattgg

SEQ ID NO: 576811 - DNA, 757 bp, Homo sapiens
atatttcactcactttcacatctccagctgaatgactgaggaaggtgctacagtagagcccccttcactgtgcttctgacttgttacggacctttggcttcgcttcaggaatggcttgatcatgatcgatcgtggcgatggaattgtaagaatccgagcatctgtatgcagttgctaactccatggcgtttcgagctccatggaagtcttgtgcttctagattcaagacagaggacacatcgaacacgcgacttagagagcacgatttacttgactccactcatgccatcacagtccaaatgattgagatgaagccacaatgttcccttcttggtaagtatgactcgtgctgaatagtcgtgttgcagatcttgctataactagatattgaactagacccagtctggagggaatacgagcgagcaagctacatcgaagcagtgagcttgtagcgagaaggcaagacttcactacttgcttcagtatggctctaaaggttgtgaaagcgattgttgagcacaatatatcccagttccagcacatacattctgtacacagtcagggtcttttacatacacctagggatgctgaatccatggaatgagtagtatctttgcatactgtggaatatgattaatagcatggaaaaggagagatagtcgataaatgacgagagaattcctttatagtttctgaaacgtcagctgtagtgagaaattaatcctcagaagaccatacatatttctagtaagagatc

SEQ ID NO: 576812 - DNA, 1822 bp, Homo sapiens
  misc_feature (1078)..(1078): n is a, c, g, or t
ccacagtgtccggagacggtgtggggagagcctcaatgccgttgcagggtcacatgtgaagtaggggggcggagcgcttagcttgtagtcgtcctccacgtttaagcacttcgcgctcttgcgagtatccgttggaagatcccttgtgtgcatgcgttagcataggagtgtgcgccacggagtgtcttagggaatcccgcagacctcgtggtgtaccgaggggttcctgtgtccgagttttccgcctcttcgcctagcgcattgtcagagcttcgagttgtcaagacagatacgctcaagcccgggcactcgaattcgtggcagcaaatagtcgcaccgggacgacactagatgggcctgtaaagacgccaagcgagggtgcgcgccgaagtgctgccctgatacttgaaacgcaaagggactctcgcgttggcgcgcgttagtcgctcggggacgtcgccgtgtgttcagggctcgagtggccaccagttgagataggcccccgcgattccacggtggtctcacagggtggcgcataccctttacataccttggggcggctccctactgtgaattcgccactgtacgatcgagggccatctgttgcccatcggggccacggccttggtgggcccccgtaatgcgtgcaacaaaccgccagatcccagacgcgtcagcggtggatccagcgcgttgccatctgtgatcccctgcccacgtgttccgttggcggcgccaaggggactggcgagcgctgggtacgtcatcccgggggttccggagggggtacctcccctttgggtttgtggcgttggaaggccgcaccggggcgccagggccttttgtcggcgccgtggcgcgccttatagggattcccacctttggtctggccacccgttgtgaggggcccttccccacatttcggcattttggccaccccttatcggggcgcccgttggcacccccgccgtctggggggcgtggggcgaacttcccttgtgggaggcttataccggttccgtgactctacggtttagcgagcccccgtttatgggcagagagggcccctcttgggggngtcctggttgttcgcagttggccaccttttatgggaccacatgtggggaggggcttccggacgtgggacattaaccccaagggatgccgcgaccaaagtggtgaagacctaaaggtgaccagccccactggctctagaaacacagcggcgtgcagccacagaggtgtaaacaatggcgacgaggggtaccttctagctgcagagaactgtaaggcaactttcgccaacattgaccaacacgtgccataacatgaaggatgtgcggaagcggcccttaataagttctccaccaaatagagggcagagtgaacatcgtgagaaccaaggaaacagaacgagagacaacttggggataaagataggggagccccacacgtggtagttccagaagagaggaccagaagagacagcgagagcccgtaatacaccgtacccgaccatctgacggggggcaccccaacctcatccaaataggggcccacacaaaaggagctcgtggcccccctaaccagcagagcccccacagagagagacctcaggggtgtatggagcccagaagaagagttaccagtcagcaaacgccaaacagtgcaacgtcgagaagaaaacacaagacacgaaagagaatcccctaggtgtgcaacaaatcaagcgacacaaaattcacgcagcacacacacacgcgcggcacaagcacgtcacaccaaaccgcaggcagtaataggcaactgcaaacaaactcgg

SEQ ID NO: 576813 - DNA, 414 bp, Homo sapiens
accgtcctatatacctaccctactgtctttgcaccctaccccaagtttttctctccgggtctgggtgaacatcctgaagagcccccagtttggctttgacatcgacacgacagaccacatcgacgcctgcctttcagtcatcgcgcagccattcatcgacgcctgctccatctctgacctgcagctggtcaagtattcgccaaccaacaagctcctctacgccaagtagattcctgagcaccggaagatcgtgccgcgctgctacaagcagattcaggacatgacgccgctcagcgagcacgacatgaatgcccatctggccgagcagtcgaggaaataccagaatgagttcaccaccaatctggccatggcagagagttataagcacgccaagaggaatccgccgcagatcat

SEQ ID NO: 576814 - DNA, 271 bp, Homo sapiens
agatgctcttcgttgacgtgtctatatcactgcacaaaatttggtatattatcagttaaaacacaacatcacaaaggcagcaatttttataataagattttgctatattttgttttgtttgaggtaagtgagctgttgctaggctgtgggagctagttcgtttatacagagtttttgttttaataatattttacagtagaacatgacttttatggctctgccctgtcttctgagttattcttctagatctcttccttgtgtcttatatctc

SEQ ID NO: 576815 - DNA, 181 bp, Homo sapiens
atgcccaaactccgcacgacgactctggttctaatgctgtccagtctcttcaaacgcattttctgccttttaagtatgcttgtaattttctgttgataggtagacctgatacactgggtaaaaggaattgcagtaaacagggctttcatcctgttttcaggtgttggggataacatcaggc

SEQ ID NO: 576816 - DNA, 226 bp, Homo sapiens
cccagagcttcgccactttcctttccaggctagcccccaagggtatacacttatcctcggctttcacagcattatattcattttgcctctttttgattttattctccaaacgtcaattatatatcatataattgagccatatactctttagcatctgtcttctgtcattcacattatgtatgtgagagtcatccatatgttgcatatagttgtagataattcattt

SEQ ID NO: 576817 - DNA, 322 bp, Homo sapiens
acgagtcacctcaatgtccagacgagtcacctcaatgtcctgacgagtcacgtgaatgccccgacgagtcacctcactgccccgacgaggcacctcaatgccccgacgagtcacctcaatgccccgacgagtcacctcaatgtcccgacgagtcacctcaatgtcccgacgagtcacctcaatgtccggacgagtcacctcaatgccccgacgagtcacctcaatgccccgacgagtcacctcaatgccccgacgagtcacctcaatgccccgacgagtcacctcaatgccccgacgagtcacctcaatgccccgtcgacgc

SEQ ID NO: 576818 - DNA, 111 bp, Homo sapiens
tttcaccgggtgaccaaagctttatttttcaaaagcaggtacaccaaagtactatgtgtaccatatcgtgcaaaatgtaatatggaatttccaaacatcaatgaagggatc

SEQ ID NO: 576819 - DNA, 1571 bp, Homo sapiens
  misc_feature (334)..(334): n is a, c, g, or t
  misc_feature (368)..(368): n is a, c, g, or t
  misc_feature (446)..(446): n is a, c, g, or t
  misc_feature (505)..(505): n is a, c, g, or t
gcaatgccgtggacagccccctcctcaatgtacacgcgcctaaatactcagttgcttacaagtggcggcgcccattcctgtgcacgtgtcctgtgagtctggattcgactgccttccgagacgtccgaaggcgtgggcatgtccacacaaagctaatgaggtatgccttgctatacccaagctctcttcgtcgtgcaattactcgcgagggaaatgtcgagaggtgtgagtaaagacacacaagttcgcgtagtagggccctagcgaggaagccatgagatcgatgtgacaggcatgcacgatccgatagctccgcgatgacagcgcaattacngacatcactattcgtcgcacgggctctgagaacnacgtggcgctcacgctagcacaaatgcgtgcgtggagctagtctagatcgaagagacctatcccgaaggtggcggatngtaagtgagcgatcctggacgtcctgagatgacccccaaccgccagatcctcacctagnttgccccctgatcgtcttcgcttgttgcgcacatctatgactccatgagaagtacgcgttgtgcgtggcggtatcactattgctagtcacgaaagctttaccttcccatttattcctcattcatggcgtgaaggttcgccgtggcgggggaccaacagattgggccagtgtttgcgccaccacgtggggcgttgtcatggcacttgtctaggggtgggcggcccataacgtgctcgcgagagtcgtggactgagggctggcacccagatcagcctcgtgcttggtctacatcgacttaatgaatcgcggcatttgacgcaacgccgcatggatcacaaatctaatttcttgagagcccacccacgataattggtagccgctgtctcattcccacaaagagaaaccattggctgggtagccaggaaaatcctgctgggatttagcaggaagcctaatttcggctatagcgggcattggcgtgacccaaggcgtactatgcggcgcgaccacgaagatattgggctcgcccagtaattcttcccgtagaatagcaaggcgtttgagttcatttgattggcctgtggtgtttcgtcctgtatcttttgaccccagatttttagtccccccgtcaaaggccataggctgtctctcaatggccaccttgtgtaggccccattggagaaccttggcgaggtcactggagctgggggggcactgaccgatttatacagcgacaagcaccggtgaaagcgcccaccaggatgaaggaagacgaaccacaaggggaaacccaggggccaggaggaagggaagacaccgacctagaggcaaagcggattatccaggagaagagaatgcgcggaaaatgagcggtcccacaaaccaacaaaagaacagggcgaacaaaaacaaaacgacgaccatgcggggagaagagaaaaaaccatcatacgacccacgccggaggagcccctgggaggtaacagagaacacgacaccaaacatccaacaaaagatagaggctgtgaacaaaagttgagcaaccataatccgctcgatgaaccca

SEQ ID NO: 576820 - DNA, 140 bp, Homo sapiens
tcgagctcggtacctgttctggccgcacaagtcagtgtgtacatggtgtgtagactcatcatccttgcacatggatgtccttgttgatcagacacgttcttgcccttgatagtctaagatgacatgataccgttcttggt

SEQ ID NO: 576821 - DNA, 979 bp, Homo sapiens
  misc_feature (14)..(14): n is a, c, g, or t
  misc_feature (29)..(29): n is a, c, g, or t
  misc_feature (63)..(63): n is a, c, g, or t
  misc_feature (99)..(99): n is a, c, g, or t
  misc_feature (111)..(111): n is a, c, g, or t
  misc_feature (123)..(123): n is a, c, g, or t
  misc_feature (129)..(129): n is a, c, g, or t
  misc_feature (144)..(144): n is a, c, g, or t
  misc_feature (249)..(249): n is a, c, g, or t
  misc_feature (415)..(415): n is a, c, g, or t
  misc_feature (417)..(417): n is a, c, g, or t
  misc_feature (481)..(481): n is a, c, g, or t
  misc_feature (579)..(579): n is a, c, g, or t
  misc_feature (647)..(647): n is a, c, g, or t
  misc_feature (649)..(649): n is a, c, g, or t
  misc_feature (670)..(670): n is a, c, g, or t
  misc_feature (767)..(767): n is a, c, g, or t
  misc_feature (771)..(771): n is a, c, g, or t
ggtgaggcgccggngcacacccaaaccgngctgcgcccgctccttccgggccccggagatggngcctccacgggatgagctagccagcctgggcaatancagaggcggccntcggcgcgcgcnggggancgagctggtcgcccnaaccgggtttggatattgcgtagagtaggcatctggcggctgggagtcttccaagtgactggatgttctattctctgtgcgagccgaggatcatgtagagcgaanaagtgtgacgcgtcatgatgcacttcagacctgcttccaggcgtgtccagtgcattccgtccgcgagggcatgctggtggacctagtctcttgaggggcaagcaactggctgatctcagccatctgtcaatccgtaacacagtgggtgaacgttctagagtcatgncntggacgcgccgccttggaccgtgatcgaccggaacgtgtctaacaacatctatagcattcatantcattgcagctcactgtggctactcctgagatctcataactggaggcgcacaagaggttgccctgctaggcacaaagcttgaaagagggtgaggctgncctccactattttgaggagcttccctctgccaatggctcagtgcccattgtctggcagggcacccccngncctggctggtgatcaccatcntcactgtggacaggcagcctggcttccactacgtcctgcaggttgtgtcccagttccaccggcttcttcagcaatgtggcccccagtgcgaggggancaantcttcctgtgcaacgtggagcgtagtgtgaggcattttgatgccaagtggtcttccaagtattgtcctggtggacaaatcgctatgcagggcctgaggttgatctgggcggatgaaacctttggcgcaactgggtggccacaggacccgagcaagggcaaagccggaggacaccctggaactataaccaaaaagcccgatggtacacg

SEQ ID NO: 576822 - DNA, 293 bp, Homo sapiens
cacgtgcatgtgccaaatattccatactcttttgagggggacacttcacaaatgattacataaaaaaatattaccccacttcttattatactagtatatgttggacgggagcccaatctttaaccgaatcactttaaaacgcgcatatcactattttacacctgtggctttcttcaccctgtcagcatttgtcaaacatgaattgtcttccatgttttcttaaaggccacttgtggaaaagcctatatgttttgtatgagctttaagacagtatttaaccaggtcaagcacca

SEQ ID NO: 576823 - DNA, 260 bp, Homo sapiens
ctgacctagaggttccgtaaacgagcgcctgaagcagtctgtagctgttaggaggcgtgttaggaagggctggttaggaggcgctgttacggacgtgtaaggacggcgtcgttacggaagcgctcgttacggaggcgctcgttacggaggcgctattacggaggcgctcgttacggagggctgttacggagggctgttacggagggcgctcgttacagaggcgctcgttacggacgtttacggaggcgctcgttagggag

SEQ ID NO: 576824 - DNA, 401 bp, Homo sapiens
  misc_feature (28)..(28): n is a, c, g, or t
  misc_feature (94)..(94): n is a, c, g, or t
  misc_feature (102)..(102): n is a, c, g, or t
  misc_feature (148)..(148): n is a, c, g, or t
gttggtttatttcgtagtccttgggcanaccaatgtctttgttcgaaagagggaaaatatatcctaaacgtttttcttttaactttttttttangttcaggngcacatgtgtaggcttgctatataggtaaattgcatgtcaccaggntttgttgtacagattatttcatcatccggataaaaagcatagtaccagataggtagttttttgatcctcaccctccttccatgctccgacctcaggtaggccccagtgtctgcggttcccttctttgtatccatgtgtactctatgtttagcttctacttataagtgagaacatgtggtatttggttttctgtttctgagtgagttcatttaggataatggcttccagctccatccacgttgctgcacaggac

SEQ ID NO: 576825 - DNA, 892 bp, Homo sapiens
  misc_feature (14)..(14): n is a, c, g, or t
  misc_feature (29)..(29): n is a, c, g, or t
  misc_feature (63)..(63): n is a, c, g, or t
  misc_feature (99)..(99): n is a, c, g, or t
  misc_feature (111)..(111): n is a, c, g, or t
  misc_feature (123)..(123): n is a, c, g, or t
  misc_feature (129)..(129): n is a, c, g, or t
  misc_feature (144)..(144): n is a, c, g, or t
  misc_feature (336)..(336): n is a, c, g, or t
  misc_feature (372)..(372): n is a, c, g, or t
  misc_feature (492)..(492): n is a, c, g, or t
  misc_feature (560)..(560): n is a, c, g, or t
  misc_feature (562)..(562): n is a, c, g, or t
  misc_feature (583)..(583): n is a, c, g, or t
  misc_feature (680)..(680): n is a, c, g, or t
  misc_feature (684)..(684): n is a, c, g, or t
ggtgaggcgccggngcacacccaaaccgngctgcgcccgctccttccgggccccggagatggngcctccacgggatgagctagccagcctgggcaatancagaggcggccntcggcgcgcgcnggggancgagctggtcgcccnaaccgggtttgatttctgatgactctggcctgagttccaggatggttttttcttgggaccagacatgaacaaaagttgacctcatgagcacttcaacctctccagctgccatgctcctccggaggctgcggcgactctcctggggcagcactgctgtccagctcttcatcctaacagtggctgacccggttnctctcgggggccccccccttttggggccccttgggncccccccccctgggtctctgtcacctgacttctacactcttacttctatctgcgccattggcatctgaaccaaatgagccaagagttcctgcagcaaagcttgaaagagggtgaggctgncctccactattttgaggagcttccctctgccaatggctcagtgcccattgtctggcagggcacccccngncctggctggtgatcaccatcntcactgtggacaggcagcctggcttccactacgtcctgcaggttgtgtcccagttccaccggcttcttcagcaatgtggcccccagtgcgaggggancaantcttcctgtgcaacgtggagcgtagtgtgaggcattttgatgccaagtggtcttccaagtattgtcctggtggacaaatcgctatgcagggcctgaggttgatctgggcggatgaaacctttggcgcaactgggtggccacaggacccgagcaagggcaaagccggaggacaccctggaactataaccaaaaagcccgatggtacacg

SEQ ID NO: 576826 - DNA, 422 bp, Homo sapiens
tacatagtgctattggggccgtaagggaatctgaacacagactgtcagattattggtgtggatcctcgtggccttcttgagtggggccgtggtccacggccatggagaaggacgtccttgcccttaggatgcacccaaaaggctcagcaacgagagagagaggatgcacatgcagcaacttgtacttttcttcccgtttttacaaaataaaatctttgaaaatagaaccttgggtgatgtggtggtggaagaacacactgggctgctttattttacaagctggatgcctccctcgtgagaacggcagaacgagccgtggtacatccgcaccgtggagcgtttccaggcatctagagaatcagagcgtgatcatcaccagaaaatcccagctgactgaggacgacatggacaagcgatgacag

SEQ ID NO: 576827 - DNA, 377 bp, Homo sapiens
gaaactgagcttccttagcctagcagagaggtcaaagcttgaggcatcttgcttggaggacagtcagactagagatcggagcaggccagcagtgagacactgatctgcccggtgtcccagcatcatctcttaactcggaggcctgcggaggcacaccaatccttagtttctcctttagtttgagaaaagacagacttggggtgggtatgtttttgtataatctttccttttctttttttacgcataagctccgtcaagcttgctggatgagcgcccatgcagcaatggctggaaggaagcgtcagagccctgtaagatcccagctcgctctccccagtgtcagcaacagcacttccttcgtggaggaagtggactcg

SEQ ID NO: 576828 - DNA, 152 bp, Homo sapiens
caggaggatcgcttgagttcaggagttcaagaccagcctgggcaacatagtgagaccctgtctgtattaaaaacaaaacaaaagaaaaaacctataaagggaactcttaattggaatgactcctaggtgctattgaaacttctaaaactagg

SEQ ID NO: 576829 - DNA, 1230 bp, Homo sapiens
  misc_feature (400)..(400): n is a, c, g, or t
  misc_feature (410)..(410): n is a, c, g, or t
  misc_feature (420)..(421): n is a, c, g, or t
gcacgaggctgctgaagaacctagagtcttatgtattatacaagatactactaattcaaagacagtgaatgaacggatcactttaaatttaccagcatctactccagtcagaaagctctttgaagatgtggccaacaaagtaggctacataaatggaacctttgacttggtgtggggaaatggaatcaatactgctgatatggcaccactggatcataccagtgacaagtcacttctcgacgctaattttgagccaggaaagaagaactttctgcatttgacagataaagatggtgaacaacctcaaatactgctggtaagctacttagaaagccccatatttataatttttgtgcactgtcacctactacttgaggatgcagtttcccaaaggaaatangatgtgtttngtaatttgtnnaataaattaatttttttcatttctatgtcggctcttgtctatcacgtgctgtagaactaacatagattacactggcacatccacagcaacacttattcgctgtatacagtcatgtatgccgcacttgcgatttaaccatatactgctgtcttacaagaccactgccacaccagggcatgggggtgggtactagcgataagtcaaagtagccaacaaagactctccctgtggtaccagtagtgacccatatccatctaggactaaagccatatgccctgcgttcgctgtcaaatcatcacggtaggatacattgacgcgcttaatcagtatcttgcaatcaagagtccttctccgtttctcacattacttcccctaacctggccacctattcacaggaaatgactgtctcgtataacctttacacattgtttccactttcctattctcactaatcggtattattctccaaaagttaacaataacttaacagtgtgacctatgtaccgtggattcacagcacccaatttcgtccattagcatcaaaatcatcttaaatggacgacactaacttcccacacatatggacggggataatatccatactagaaccgaatttgagtaattacttcctcaatcccctctgtaacattctttccaaagggaacacattgtaacgtttcaacaccctagcgcgcaacaagaaacagcacggggcctcacagcacatgtgcctcggttgtacagccaaatcttcagttcgcaagcttaacgccgagtctacatctgtgacatacgcctgttcaaccgcg

SEQ ID NO: 576830 - DNA, 123 bp, Homo sapiens
tgatgaaactgcgtatttcagaaacacagaaacacgagacctcaaaatcccctgagaaggacgttcccagtggatagaaaagaagagcaagaaacccaagaagaaagagaaaaaacacaaaga

SEQ ID NO: 576831 - DNA, 1532 bp, Homo sapiens
  misc_feature (81)..(81): n is a, c, g, or t
  misc_feature (96)..(96): n is a, c, g, or t
  misc_feature (111)..(111): n is a, c, g, or t
  misc_feature (175)..(175): n is a, c, g, or t
  misc_feature (178)..(178): n is a, c, g, or t
  misc_feature (188)..(188): n is a, c, g, or t
  misc_feature (213)..(213): n is a, c, g, or t
  misc_feature (270)..(270): n is a, c, g, or t
  misc_feature (322)..(322): n is a, c, g, or t
  misc_feature (343)..(343): n is a, c, g, or t
cccagccccgggccgatgacagcttttcctgaggaccccggccacgcagctgttcccccacatggacagatggacacacanagcctcggcggcccntgctggcacggtgtnagcgccaggcatttcccccccgcccctcccgacggcccaaccaggggctgtgcaaacgtggggnccncggaacccanatgccctttagaccagggagctggnccggcctttggcaggcccccccctaacttattttgcccggctgaggttgtggggggngcctcctggggtgcccgattccctcagctttgggtttaatgtattatatttntttggggccgccagtgccccnataaagggtcagaagtgaaaagaaaaaaaagaaagaaaggaaatagattctgaagagaattcaatagatgaagcaggtgcggggaaaatagagggataagatagaaaaggggaacactgtggttagatgagactggttgtcaagagacacatagaagtgtatataaggtgcacagaccgcgggcaacacacacatgtgggcacgggatctcccacacaatatcacaggtgaccgatgagtaatcaaacaaagaacagagataaacgcacgcaggggtaagacgcctcggcaaataccaagccgaacactcgggggacaatgaacgataccacggagatccacacggacaagcgcgacaccacaaccagaaaacggccccagcgaaggggacgcgagccaaacccaccacaagcaccatccaccacgagccaacaatcgagagtaaaagaccagagacacacgggcaaagacaagaccaaacggacggcagcaacacaacacaggcacagaggcaacaggaccgacaagagagaagtccaataggaacacaggaacgcacagcaccaccacaacaccacaaacagccacacggacgaaccaaacgacaagcggcaaccaaaggacacttagagacacaccgagaaagcgagaaagacacaacagaataaagaagaaaccacagaacgaaagccagcagcgagacagacagaggcggacgacccaaacaagacaaaccacagaaaagcagagcagcgaaaacacggaacaacaacggaagacaaaaacacccgacagagacaccaaggagcaacgagagagcagaaaaacaagagacagaccgaaacgcagagaagaagacggaaaacgaggaggcaacgaaagaacgacacggggaaacgagagagagaggggactagcaaaccgaggaaaggagaaagaccaagagactaaaagcagcggagaaaccaaggcagacaaaacagagagaggaacacaaggacacaaggaggcaagacaggaaaagaccaggcaggagacgaacgaaggaagaggggaaacaaagcgacacgcgcgcgacgaggaaacagaaaagagagaagaaagacgcaggaaggagcgagcgagagtcagcgacagaggaacagcgcagccgcacatgtccgtcatctgctcagctgaagaaacagaa

SEQ ID NO: 576832 - DNA, 118 bp, Homo sapiens
caggctctctacctatagttggaccaacagtggacccaaaagggttatgggtcttcagcggttttaattatatccacgactagatacgtgggggtctggtattcttcaagaggggtgg

SEQ ID NO: 576833 - DNA, 1430 bp, Homo sapiens
tcgtctggtccctgttcaacaccctcttccatgaacccctgctgcctgggcttcatcagccattcgcctcactccgtgcaagtctcagggcacaggcacagcatggttggcgcacgtgcaccggtggccccagagcctcatgcctcccaccgccaagtgcctgcaacatctgggccctgcattcatgggccatcctccatgcaccacattctgctccatcgatcatccccagatgctagcatcattccaaggcctcatggcatcagcatccaggcaggcatcaactgcagagccaggcagcatctgcccaatgcaacatgtatccacacgtacctccaaccttcacaatgtcctcgacccatgacacccacgagagaccgagatcctgatatcaggccacttatatacctcacaacgacattaatactaccaaaatggccactttcaagtaaaagagtgacaacgaatgtaaacatggctgacaaacacaccaacacaaacaaacagcaacacaaaacaaagaaacaaaaagaggaatgagagagagaacaaacaacaaaccacaacgagaggaggcaaacagacaacaaaggaacaaacccaacaagacaaaacaacgacaacacacagagaacaaaataagagagaagagcaaccgacatagaacagaacaagcacacagcaaacagagaaccagaaccaaacacaccaaagcgaacgacacaacagagataaaccacaagggagaaacaacaagagagaacacaaacaggaagacaagagaacaacccacccacagcgacacagaaaccacaacacaagagagcccacaacacacacaaacaagagacaaaaaacagacgaacaaaagacgaacaacacaacacaccacacaaaaacccaaccgcacaacacgcaccaagcgaacacacaaaccaacacacaacgaccacgagaacagcagagaacacagcaaacaacgtacacgagataccaaaggaaaaagacgaaacacaaacacaaaaaaagtaacaaagaacagaacccgaaagaacagaagaaaaaaagaccaaagaaaaaaaagacacacagacaacgaacagaacagagcacagaagaaacgagaagaaaaacagagacgagaggattacgaccagaagaacaggaagcagaagacaagagaggaacaggaaaaaagagagagaaaggagaaaaggacgagacaagacgaaagagagaacaagagcggaaaagagcaagaacgaagaaagaagacaaggcacagagcacacagagcacaaaagaaaagacaatgaaaacgaaaagacacaggaacaggagagcgagggacacgagcgacaaggcgacgaaaaaaaagcgcgaagagtagaggaagcagacatgagagagacgagaagcaccagtcgaaa

SEQ ID NO: 576834 - DNA, 360 bp, Homo sapiens
  misc_feature (81)..(81): n is a, c, g, or t
  misc_feature (96)..(96): n is a, c, g, or t
  misc_feature (111)..(111): n is a, c, g, or t
  misc_feature (175)..(175): n is a, c, g, or t
  misc_feature (178)..(178): n is a, c, g, or t
  misc_feature (188)..(188): n is a, c, g, or t
  misc_feature (213)..(213): n is a, c, g, or t
  misc_feature (270)..(270): n is a, c, g, or t
  misc_feature (322)..(322): n is a, c, g, or t
  misc_feature (343)..(343): n is a, c, g, or t
cccagccccgggccgatgacagcttttcctgaggaccccggccacgcagctgttcccccacatggacagatggacacacanagcctcggcggcccntgctggcacggtgtnagcgccaggcatttcccccccgcccctcccgacggcccaaccaggggctgtgcaaacgtggggnccncggaacccanatgccctttagaccagggagctggnccggcctttggcaggcccccccctaacttattttgcccggctgaggttgtggggggngcctcctggggtgcccgattccctcagctttgggtttaatgtattatatttntttggggccgccagtgccccnataaagggtcagaagtg

SEQ ID NO: 576835 - DNA, 1746 bp, Homo sapiens
  misc_feature (139)..(139): n is a, c, g, or t
  misc_feature (154)..(154): n is a, c, g, or t
  misc_feature (284)..(286): n is a, c, g, or t
  misc_feature (356)..(356): n is a, c, g, or t
  misc_feature (445)..(445): n is a, c, g, or t
  misc_feature (519)..(519): n is a, c, g, or t
aatttcggacttgttaacatgtctgcagttctgaccatcatagcctatcaatgcatacatgtaagagagtctagtggatagttagtccatgaatgcaccttcgagtcgtaggcgcctagtgtacgcacatcgcatgccnccacagcatgtaccnacaccgtcgcactccacaacacttctgcacaatcgtacgtagccttcccgttgctcatcgtaccttatcgttggtccttacgcgtacctcatagatgtcgtatccacctcgtcttactcatcgcatgagnnnccttgcttgcaccaatgtggctgtcctcatacgcacatcttctgtccgttacactacctcatgtagaganctccatacaggcgatgaatggccacatgattgtaggtggcgctgagcgcatgacacccgtgcgcgcacaccaatgtgacccccatatgncccatcacaattcagactcaataagaatgaactgtggaatcactcgatgtggcctcgcgtgcactatgtatgtngtgctgtctctatctggtgaacccacatttctatgacataattcacttcaatatcgccaaatctgtttgggtaatcgcatctcaatgttgactcttgtctgaaaaatcacgaaatcgatcggatatgtgtctaactcagaaagtgcaagtggtcccaggttgtatgtggggtccatgtcttgcgggtagcgcccaccagttgatgtcaattcacacaacttaaataatcaatcagtaaatcttatttcaccaaactcctcatcattctttccccacgtggctctcgcctgagtaatgtggtccctcctgtcgcaaaacttctctatggaccgggctcttgacaaactttgtgttatatctcctcggatcattttacctttctctcaattcactttctggaaaataaactctcttcaggtctcccctgtggttcacctcttctaactaaagttaccttcgaaagggtgtctatcggcaggaaccatttcaactcaaatgttgtggtcgcctatcttaggtattcccgctcttacacaaccgtggtccgccacttaggaggctatatttctacctttttacattatcgccgcggttaattatggtccgtttatattaacttgtgggtgattaaaacacaaggaaaacacttggccttttctattggcttctacatacatcacggcggattggcacatttatctatggaaggattttttcccttttggccaaagaaaacccccccaaaatgacgaaacaagggcccaagcgattcgttttggcggcacacaacatttttcccaaccttttgggcgcccttagggggggaacacgagacagcaaggctcctcttgtacattacaacggcaaacactttggtttttgcggcgccgacacgcgtgttgtgacacccttctacctgggctaccatttccccagcaaatacgttattagcggctactaccatatccacgtttatgtagccttccctctggttaaccaaccagcgggcatttttgcgacacaaaggttttaacacccaaccacaagtatggggaggacctgcgggcccggggggtatcccaaaccccccttgtgttgtagcggttttagacacacagcacacagagcgtatcttctccttggacaaagagggccgaagggaacacgctttttctcgaagccacaatatattcatcaaacacgactgttaatagaggcccacgtcga

SEQ ID NO: 576836 - DNA, 231 bp, Homo sapiens
gatgatcaccggcttacacatagcgacggaatgcgaggcagtataaatcactgccgaagttctgttgaggcgcagtggttacgaatccaactaggaacatgaggttgcaggttccgtccctgccttgttcagtgggttaacgatccagcgttgctgtgagctgtggtgtaggttgcagatgcggcttggatccggcgttgctgtggctctagtgtaggccggtggctacag

SEQ ID NO: 576837 - DNA, 1476 bp, Homo sapiens
taaaaaaaggtaacgaaaggtcttcaggagatgtagagttttatttggtctctgtctggatagaggtttgcgatttgctctcgcaatgtcccacgggtggcaagagaaactaggagaaaacgcccaggatgtaccaggtctatctgggcataactctatctcccctcattctctcatctttcacccatcaaccagagacgacgcacgcaatcacttggcttgcagaaactgaaccttaagaacgcgtggatttcaccgtcagagttctcatctggcgctcaaggtagcaagatactgaggacgtctatagactcctattcttgcgcccatctttttcctatacctagacctactctatcacaagtaggtaactactagttaccccatcacagaacatcactgaggaccacaccggctaacagacgtctacccccaaagtataaggcgccctttatctgcgagcggcgcaatattactagtaccacgattctcaaccctctctcacttttcacaattcctgtttgccccttatacgcgtgggactcgcatataccctaccaagagtgagcttatgcaccacctgggacagaccttaacctattataccccgcgcgaacaccaactctgcttacggggcgaacactcgacttgacctacgtaggggctcccttggcagcaccttcctggaacacaaactcccgaccggcagacggaggaacgcgagggtatcacggcaacacccctgcgtccccggaccgtataccgcaccgcccccaacagagcccaacatcacacatccaccgttcttctcgggcgccgtgcacgcatagccggcgggccctcgcggcaaaaatatcaaccccattatctaagcgcgcggcgcccctagaaacgtccacagggcgatacaacaggcgcgcaacgcggctcgcccagaccaacacgccatagaggcggagaccaacagccgggcagacgaacaaaacacaagtcaaaccgagcacgcacacgacgccaaatagaaggcaacacgctcgacatccaccacaagtacgcagaccgaccaccgagcagacaccacgcgcgacgccgagcagacgcagaaccacacccgcacagagccgcgcacgaccaacatgaccacgacgaaacaaccaggacacacgcggacagagccgaacgcgacagacgcagcacccacacaacgagaccgccggagcaggaaacggccacgacaccagcgccgcaagacaccgccgtggccgtcccccacagcccgcaccaccgcgctaccctcacgcgggacggcgcaccggcgaggcagacaacgtcccgcgcccgcactgcacgtctccggcccccccggccgctgcagggagcgacgacgtgactcctccacgaccgcagacgacgccgcccgacgcgcacatcccgagagcacgaacacacgaggccacacacaacaccaacaacaat

SEQ ID NO: 576838 - DNA, 340 bp, Homo sapiens
actagtctcgaggattattattttcattgtttagattcttgtccattctttattaattgaagcacagcgaaatgcggctgagagattaaagagatttatgtgattgagacagggtgttggctttacaccaacgaattggatgaacatgtggatacgcttttgatcgtgatcacctttctgttattctcatggaaggctgtgcttttccttctaggcgaatcgggtgtacttatcgtcagacttgcataattctctacataagctgagacactatccatcagctatcagttgctcttctagggtcttggactagtgtgtgacaggctcagctggtgcacgc

SEQ ID NO: 576839 - DNA, 676 bp, Homo sapiens
cggccagccatctgcttaatttttatgtacattgcttatttttgtttcttgagataaaattcatgtattaataattttatttatttaaatgaaataaatgaagacgaacaccagctcatcttcaacttatcccaaatgtttaaatctcctcttaagtcattcagacctaccagatatctcatcattttcatttcttgaaagagtcatcattttttttttctttttcttttttttttggagacggagtctgggctctgtcacccaggctggagtgcagtggcatgatctcggctcactgcagactctgcctcccaggttcaagcaattcttcctgcctcagcatcccaagtagctgggactacaggcatgcaccactatgcctggctaattttggtatttttaatagagatggagtttggccacgtgggccaggctagtttcaaactcctgacctcaagtgatccgcctgcctcagcctcccaaagtgctggtattacaggcgtgagccacttgcggctggtccattttcatctaggaggagtcatccatacatttacacctccttgaatgagtttcccgtggaagtcttctggcctgctggattatgaacaactgtgtcctataagtcatccttgggatccagggaatcttacttcacaggcatccgtggagatta

SEQ ID NO: 576840 - DNA, 150 bp, Homo sapiens
gctagaatcttttgtccagtctgtatatttgcaaaatagcagtgtgtctctgatgtgttacctgcagtggcaccctgtacaacaaaatcaacagacttattgcactaaacacaccaaccacaaacaaacccaccaacaaaaaaacacaac

SEQ ID NO: 576841 - DNA, 110 bp, Homo sapiens
catcaaacaccttgaagatagggtccaggatcctccctcggatagcacagttgccttgatcctcggtgagaggccggagagtgctcgttcatggatagtcgacgtcggta

SEQ ID NO: 576842 - DNA, 680 bp, Homo sapiens
ggacgcgtgggtcgatccacgcgtccgtgacaacatgccagtgttaagaccatgatgaaaggtgtcataaaagccgtaggatcgcgcaacccttgtgtagtgtggttgctggtacgatgtgatctttgacaaccttgagattaagtccctctggaatcagagcttaaccagcatagttatatgatagactattaggatggttgctatgtattagttggaacaaacgtgacttggtaaacttggtaatgctgacatgctatatttacgttatacaacgttgtaaattggaagtgtgtcaatttaaatttatgtgatttgcttaccatttcggaaggtttgttagaccagtgtaaggttatatgaaagatacgtacttgtgatgtgctatgtgatatttatgcttgttttcaagaagcacaactctatgaatgtcgggttgatgagtgatcaattcataaagaattgctccatataacatgacattggcaagcgtgatgcgctcctgtgtgatccatgtacagcagtcttcacgatcgtaggtactcttcatgatagatttgttatctgtgaaagattccttgataactgtcatagtgctctctgatacaccacttatgcaggtcggtctaatcatcatgtatctgtaaggtcagttgtattggcactccaaacttgtgagt

SEQ ID NO: 576843 - DNA, 386 bp, Homo sapiens
  misc_feature (123)..(123): n is a, c, g, or t
gtcggtaccgagcagtatacagcatgtctttttctgttccaggatccatccaggaaaccacatttccatttgtttctgtaggtgcctctggctgtggctgtttcttcttagacttgtcttgtntctgatgaccttgacagttctaaggagttctggttgggtatttagtaggatgccccactattggaatttgtctgatgcttttctcatgattggactgggcctgtgggttctgggaggaagaacagagatcaagtgtcattttcatcacatcctatcatggtacataccatcgacatgacatatcactgctgacattgacctcagttgcttggctgaggtcatgtttgttgactgtctccactgtaaagttacttttttttttg

SEQ ID NO: 576844 - DNA, 1230 bp, Homo sapiens
tccagttgccatcctgctatatccatggaatagaacagtttgtgacttgggcccccaagtttcgagagaactgggctttcggcgcggggggacagaggaggactcgtgggagagcgtttccccactggacgcttacgcgcagacctgtcagtaagaaactcatccagacccagtgagacgaccgtgcctcagaacttggggaccctgaagagcccggagaggaggctgcagatggctcagacactgtgtgtcctcagtctctttccctgcacccctgagcctgtgaatcctgaaccggatgccagtgtttcctctccactaggcaggcagctccctgaagcactccaccacatctcaccgaaccggcagcgagggaacgaggtgtcacgctctgccggcctagccctagtactcccgtgtccatccaccagcgtcagctagcacagggggagctggaccagctgaaggagcatttgcggaaaggtgacaacctgcgtcaacaagccagacgagcgcggcttcacccccctcatctgggcctccgcctttggagagactgagaccgtgcgcttcctgctggagtggggtgccgaacccacagaatccgtgggcaaacgagcgagagagcggccgtggtacgcagggccagcaagaggcgggtaacacagaccattgcgggggactggctggctggtctggcgtggagcgtgggaccttcagcattccttctgctcgggactgtgatgcgaccgtccccttggtggtatcgcttcggtcgccgggaaaccccggtgtatattggcgtttgataggcctttgtttggcccgaggtcgtggtcctctaccactcggattctcggtctgtatcacacccgcagatggacctgtcatggggggccacctgaaggaatccagccgccaagcgacacaagggcgacgcaagaagacgaacgacagatctaacgagagagatgaaacgaacaaaacacgaggagactggaccaccataacaagaagaaagtgacagagcgagtgaaaaacacaaacggcgtgacgcacctagcgcatcacgaaggaagaaaacacataaacaggaacaaaaaagagagaagcagagaagcacacagacagagcacacctgcaacagaaaagtagagcaagacgacaagcgcagctagcggctatatattctatctgcccgcagcaccacacgtcgagaagataaggagc

SEQ ID NO: 576845 - DNA, 145 bp, Homo sapiens
aaagtgacagagagtatagaagtccgatactatcagagcacagaggtgcacgagttttcagtcgacagagtgcaataacagtcagagactttgatgacagaggcatcattctgattcaggttggatatttttcgtgttcctagag

SEQ ID NO: 576846 - DNA, 151 bp, Homo sapiens
ctataaaatatgattaattaaaggtagttaatactcaagatggtcttgagtttttaggtctaacatcatttagatacttcaatcagaatcacttacaagctgattgacaggtggttctaaatttaatacgtcagcttttagggttgagctt

SEQ ID NO: 576847 - DNA, 953 bp, Homo sapiens
gccgacagcgacacaaggaagtctcctgcccctcctaaagctgaagactcatgagcgacaggctattcacaaggccaaggaaggcagtgcttcgcaacagagtgtccacaggcctacatacatatagaagaacgatccgcactgtcaccactagccttccggcgtgtccgtaagacactgcagtactccagagagaactagcaccaatgtatcctcgtgcaatgagctgcttcaccaggaggaaatcgacagcttgaccacgtatgctatcatccaagtttccgctgaccactgagtctgcgcactgcaagacaacatacgaacgacaacaagctacacgttgtgtacacttgtggatagtataaaggcctacacaacgcaccagattaaagcagcgctgttgaacgaagcatctcatgacagttgaatgtgcgcgcaagggtctaacatcgcctgaattcgtgcctgatggagtacgaagcacatggcatcatggttcgagctggctcctgattgaccgatgcttatgcgatgttgccaaccaataaattgggatcattctaaaactgcagtccagtctgacctaattctgaatatactctactatgattaatagccctttgtacaccaataataaatggaaacgcatacaacactctcggaagagagaacaaatgcatccagaggtgcgcgcacagaaaaggagggggtcctagggaacacatggggagcacaggtgagttccacattaacataggagctttaccaagatgagctccccaagcaaatatgcagttttcgcaccaccaatgtggggcaatagaactcccgtggccggggcttgaccccatagtatgaagtgaggagaacacgtataatacaaatattcgagaggaacaactccacaggcgtagatagacacccatagacaaacagagaaaatcacaggcaaa

SEQ ID NO: 576848 - DNA, 660 bp, Homo sapiens
ggacgcgtgggtgcgctttgcactattggggcaaaaatgtcttaagcagtggggaacctgccaccccaccctgaccctcagcctgccacagccccctacacacacacacacacacacacacacacacacacacacagggactatgcacacacggatatgggaaggcaatgctatgctgcccgtcagggcacgtgtctcttcccccaactccgttcagggtgttccaaccaggggtgtggagggccctggaggagcacccgcgtgtcactcgtgtgctgtgtgctctgtcccaccggcccccctggtggacgcccccagcagggggcgctgacgaccccgcgctgtcgctgcccagccgcggtccgggcgcgccacgcccgagggatctctggacaggacaagactccggaattcctatctccccccccaagcaacaaccagcccgcgaggaacccaacaaacccaaggtggtggacccccagtgctccgcaaatcttggacctcaccacgaagtgtcacactcaacacagacctgtcgactggatggggcagggggctgggatgtgaagggcgtgtgcattgaccgttggcacaagggtggagcccaagaacggggggacagtgagggacgagatgacccagagagaaacgcaacaccaa

SEQ ID NO: 576849 - DNA, 496 bp, Homo sapiens
tctattggaaaaccttgcgtacatgataaagcagcgggacagattttgaaccctttgtacgaaatgacatacctttagagaagcatgtggccagtttggcaaagcctggtacttttgctggcaatgatgcaattgtagcctatgcgagatatcatcagttgaatgtattgatatatcaccttaactgcccctttgtggcagattcgtggtacagagaaaagcagcgtgcgggagtacagatcgtatgtcggtatggagagcaccacgacagtgttcggaggatcctggacaactcagaggcacctgcatatctccagacggatgtgagtaaggcctctgcttactcccgtattccccgccctactggatacagatcgagagctgtatatctggcgctaaaaaccagtaatgtttttgtagaatgttggcattgagaatctgtgggcctgatttaaacatatttttcatttcttagtttaggtactccgtgaggggc

SEQ ID NO: 576850 - DNA, 487 bp, Homo sapiens
tgctcatcctgcaagccttgttgtaccctcctgggttatggtgccacccctcccctgcgctttgtaaccgtgggtgactggggaggggtccccaatgccccattccacccggcccgggaaatggccaatgccaaacagattgcttggactgtgcagattctgggggcagacttcatcctgtctttagggggcaattttttcttccctggtgtgcaagacatcaatgacaaaaggttcccggagaccttttagggcgtattttttggccgctccctttgcaaagtgccccatgacccctgtgggccaaatgcccccgtatgttaaacccccatggacatgtgttccagccccagtgttatgctttgtgggtgggtccccttttttgagtttcggggggcaatgggggagggagggagggaaagcttcctccttaatccagcctctttttgttttttatgttcaataaaaaaaaagttgccaagggtga

SEQ ID NO: 576851 - DNA, 223 bp, Homo sapiens
cgaggtcactctacaggatcttccccttgtattcccaccaccctattgattatgcagcatgctcagaaaattgtggggctctcaagataaaagacagaatgttaaactaggagttgactcagatatcctaataaagcttttcaaaggttgctttccagccagtggcagtgggtcatggctgtaatcccagcactttgggaagctggggcatggggatcgcttg

SEQ ID NO: 576852 - DNA, 227 bp, Homo sapiens
  misc_feature (220)..(220): n is a, c, g, or t
  misc_feature (225)..(225): n is a, c, g, or t
actaattttcaccagtgaagcaattgcaagcatagcccacgagggtctggattaggtcctctgcatatatgtcatgactgttagcttggtgttttagtgggacttctaacaggaagaagaggtgtatttctgatttttttttttttttacctgcttttggggctcttcctattgggttatcttgtccagcctctatatgagggcttttgctctgtcttantatanct

SEQ ID NO: 576853 - DNA, 165 bp, Homo sapiens
ggaacatccgaattattgttcctctgaccaccagggggagttatctctgatccgacctaaccattaggaaccagctttgtgtaccatttgtctgacctctgtaaaaaatgtgatcctcacagaggtggagctggatagtcagatagttactgcctacccagagca

SEQ ID NO: 576854 - DNA, 985 bp, Homo sapiens
gaacgtgcatctggccccatcggtgtgctccagagcatattcagtttgctctgagccctctgccctgcttccccttacatcaggtctcctctgacaaaattttaagtctcggtaatgcagcgagtgatttctagctcacatgagaaagcaagatggattgtcgaatgctcatagaggcatcatagatggcgggtagtgagcaatcttgagagatctatgttcaaaaagtaggcttatgaagcagcaagttcatgtaaataggtgtatgagtggagctgttgtgaatacatgtcatgaattagttgatctcacatgtgcctacaatagtgttgcatgggatattttcagtagtgaatcgatttaataggatcttggttgagtgtgccagtgacacagtgggagaagaatctggattgtcaccttatacgtcctctcttttgtcctgagaggataattaggtcaatggaattgggccaggagtgttgcggggtcaaacaaacgttggttctggtactgcattagttggcaaagacaggaagttttcgggcgcctattgggtaccctacattgattgaacgtgagatgctcctgggaaacggatcaatgactcgatcggaataaggaatgagggaagacgggggaagagcgactttctgacgatggatcgtcacttgcatgctgacatagttacagacggagcgcgacaataagccgactagaatgaaccttccatgtagtcaaccaatgaactccactcctgctgatggaggacccctagggatacagagacagaccgtagtcttacaagaacgagagagggtctgcaggccggcatggaccacgtggtgccccccagcggatgggacgggaagcgatggccttgacaactgacactcagaggtcccattcttgggcagccggggccaccaaccccggggatatcgtcagggctccgctggacacccatacaggagaggtgccacag

SEQ ID NO: 576855 - DNA, 578 bp, Homo sapiens
tctgcagctgacaaagtagatgcgggctgcctacagcaatagcagtatccagtctgatagcaggggtacatctcaggatggcttaatatagatcagaatcaagcttgcgactctgtctgggtagcactagtgtaggaggtcagatatggcgctatctctgccctcagtatcaacaatgattgctcaagacttcattcgtggctttgctaaaggacagagtcaccaagatgggaatatggctagatggaaaacgttctaagatcaataacagatgctcatcctccaggaacagcaatagtagcatatcaagataaacagcatgatccaaactctgacaactatgcaaacgacagcggaggactctgatttattgaacttgacatttaagacgacgtgatgggacgtgacgaacctgttgaactctagactgtctgattcaagaggattccaagggttgaagtactgcatgtattgagcctctgcaattctcaagccgtgactggaaacgactcatcccatacacaacagatttccatcattggcacatgggcatcacttggacacaatatacctggtca

SEQ ID NO: 576856 - DNA, 968 bp, Homo sapiens
  misc_feature (43)..(43): n is a, c, g, or t
  misc_feature (45)..(45): n is a, c, g, or t
  misc_feature (230)..(230): n is a, c, g, or t
acacgctcccccacacaaaaccaaaaaccttgttgttaaccgnanacggacctttacaggtgttcctatctgtgtatctgcccttctccttgggatactaggaataaagaagtgatcattgtctacgttgaaagcatctgccgtgtagaaacgttatccatgtccggaaagattctgtttcatctctcagattacttcattgttcagtggccggctctgaaagaaaagtntcccaaatcggtgtaccttgggcgaattgtttgacaaatggcaactgacttctttagaattttgcagttaactagatcatgcactcaaattggggggaaaaaaaccctacttgtttctcgtcacggcgtccgacagtcctgagaatatgtgatggtaaggaactaaaacccgacccgatgacctcactgacaaacaaaacacaaaacggccctccccccgcctcctagtcggagccttgccggccgccttacctttaaggaggcggtaaagcgcgaccctcccgcaccgacacccgcacccacgaccgccccctctagccaagcgccccctcaccttccaaggcagtcacacctcgatacccccacttacggaattatctcagaatcgaaaacctccggagagccaccaaaccgctcgagcactgactcccgtccctgcccttgagactgcgattgcccaccgcggcgtgaagagataactagtgccctccttctaccgagatactcgacatcgcccggcaacaccatactgttctggctacgacacacgagcgcaccaaacccgccactccgcgccctcttccgattacgttctccccagccctatataaatcctacagctgccacaactaccactccgcatctactctgtccacggtaatcatctcagccacacgcgtccgacgtactacacgtcccccacgccacttcgcgtcacccaatcatatatctctctct

SEQ ID NO: 576857 - DNA, 986 bp, Homo sapiens
  misc_feature (24)..(24): n is a, c, g, or t
  misc_feature (69)..(69): n is a, c, g, or t
  misc_feature (74)..(74): n is a, c, g, or t
  misc_feature (248)..(248): n is a, c, g, or t
gcccgaggggccgttaggcgaganagttatatctttgagaaaaggctgggttatgtgttgcgtaacttnccagnacagtgttcctatctgtgtatctgcccttctccttgggatactaggaataaagaagtgatcattgtctacgttgaaagcatctgccgtgtagaaacgttatccatgtccggaaagattctgtttcatctctcagattacttcattgttcagtggccggctctgaaagaaaagtntcccaaatcggtgtaccttgggcgaattgtttgacaaatggcaactgacttctttagaattttgcagttaactagatcatgcactcaaattggggggaaaaaaaccctacttgtttctcgtcacggcgtccgacagtcctgagaatatgtgatggtaaggaactaaaacccgacccgatgacctcactgacaaacaaaacacaaaacggccctccccccgcctcctagtcggagccttgccggccgccttacctttaaggaggcggtaaagcgcgaccctcccgcaccgacacccgcacccacgaccgccccctctagccaagcgccccctcaccttccaaggcagtcacacctcgatacccccacttacggaattatctcagaatcgaaaacctccggagagccaccaaaccgctcgagcactgactcccgtccctgcccttgagactgcgattgcccaccgcggcgtgaagagataactagtgccctccttctaccgagatactcgacatcgcccggcaacaccatactgttctggctacgacacacgagcgcaccaaacccgccactccgcgccctcttccgattacgttctccccagccctatataaatcctacagctgccacaactaccactccgcatctactctgtccacggtaatcatctcagccacacgcgtccgacgtactacacgtcccccacgccacttcgcgtcacccaatcatatatctctctct

SEQ ID NO: 576858 - DNA, 459 bp, Homo sapiens
acattactaagatagggggaagatcttagaccagggggaggacttcccagcttcagagataacagggatcgccaggctgatggaaaagaacaggatgagtgacgggaagaaggaggagctccagaagagcttaaccatcctgacggccttccaaaagaagggggccgagaaagaggagctgtaaaagggctgtctgtgatttcccagggttgggggggggtagggaggggagatgtaacctggtggttgtgagtcccttgtggaatataggggggtagggggaaaggggtattaacccacgattctgagccctgagtatgcctggacatcgatgctaacatgaccatgctggggatgtctctagcgggtcgggggatagcgggagcacttactcaggttggttggtgaattgacacctcagagggattgagtgctatagagaggagagaggagtgtata

SEQ ID NO: 576859 - DNA, 224 bp, Homo sapiens
gtagaagatatcgttagggacaccttaagaatagtctacatacttttctagggttgtcaacaggaactatttagtcacataactaactatcgaggcactggaacatacctgaactaggagttaaatctattactttatactcacttaagttcaggagtcccatctaagacacataggtaccttatctgagactcttgcactcccccacccagggcagaaatgag

SEQ ID NO: 576860 - DNA, 134 bp, Homo sapiens
tacgaactgagttagacgagggttccttctttcattattcttgtggatatagagtccgcacagatcggtattaagttctatctttagaagagtctagataagaattctagctagtgcaatcaccgctacatccg

SEQ ID NO: 576861 - DNA, 223 bp, Homo sapiens
agcctctttcctcagcaggccggagtgatctgctctcatctgcctgctgcagatgttccatgatgtctgtcataggcagagggtgtcctggtgtgagacaggctgtctcaccgaaggctcttgttcagcttctcttagttttgtctgtagaagagagtcaggctctgtagttgtcagtcagcaagcctagcttttgagagtactgcgtgtttctccagatctt

SEQ ID NO: 576862 - DNA, 808 bp, Homo sapiens
ggccgggacagggtggcgctttgacgagtttcagtagctgcagtcgggaccccccggcggcttcagagcagtggtggtgtacctggcggatgtctggaccatcatgcctactttggagagagtgggtgaggtgcctgtgaccagatagaaagctgcaagtagtgcaggtacctcccaaccgcatgaggcagaaggggacacggatgcctgtacgtgaacaggacaccttgagtgccattggagcacgcagccagacacgttcgtagacggaacgcagaaactccagaggtcagcatacagtcaggaaacggacgactgagtctcctcagttagagccccacgtccagcctctgcccgtacgaacacgtgcgtgttacattcggctatcagctccaatggcctggctgtaagagccgttggtacccatccgattggggatttgtgggagagactcgcgcgtgccagagaggggaagaggggatcgtcttagtggagcgttgagtggtggctatggcccagaatgcctagatatcgccttgggagcatttggcgtccgaggaggcggggacttatgggcgagttagttatcacacgtttgtaggtacatggaagttggcttaaccttaggaaagtccgcgttttcctctttggacacgaaagagtccgcggtggttttcggcgacaatgctgggaaagggcttttggagaaatggtggcaggggaggtggcagtggaccacagggtgaaaggtaaaatgcccaagcccaatggtgaagtggaacgtaaagcttccgattgaaaagaattg

SEQ ID NO: 576863 - DNA, 1061 bp, Homo sapiens
gctccgagcgaccaggttttgtgcgcaaaactccgctgttgtcccaatggccgtcgttaatgtcgtatcttgtgttggtaaccgtcgtgcaagaggagccgccaattggttcgccccgcttatggggagcgcccccctggttctcgcccccagttgcactggccttctggtgatcccgttttatccttttgggtgaagaagacagcagttaattggttccgtcggcaaagtttttgaatgggggaacgcggttgttatgtgtttttagattatgggttatcttatgctgttaacaaccacgtgtggtgctgtggccgcgcgtccctgtatcatgacgagtgaatcgccttcttctcgccatggatgatcacgggagacgcgcgtatgcttacaccatacggagattggttgctccacacatgtgggaaattgtcggtttggtactataagagcctttggtgagtgggttttaccacatttctatctcgtactgtattgtagttgagattgtgtttcttccacttttctctcggagaagtggttctctgtagattgaagaggtggctcactcacgaggatattagggcactcacgcgcgtgcgtcaaaaccatggctgtgaggtgagatccctgtcgcactgagaatatgcgtcttgagtggagatcccacactgggagacacacttatacagtgaataagccacgttctataaatatggtgatttattccgaaatattcgtaagcgattaccacggcacccatccacttattctgatgacccatatagtctaataactttgagaccccacaagttgtcacgagtgtggtggaatgctatgtgtttaggaaatcacgtccacgatgtggagttttttctcacagcacacctcacctgaatacctaaataatggacatacacttttttctttgaaagggtctgtataatcactttttctaggaagtatgggtatctatactaatgtttcttatatgaagaacataggggtctttgtggttctttaagaccactgtgaaataacaattggttcaccgcctggta

SEQ ID NO: 576864 - DNA, 847 bp, Homo sapiens
ggttacaggaggtctccagagccttctctctcctgtgtcaatatggcgactcttagggaaaaactcattgcgccgagtagcggaagaagaggcatcagttccaaatggataagatcactgtagtgggtgtggacaagtcggtatgggggtgtgctatcagcattctgggacagtctctggctgatgaacttgctcttgatggagtgtttcggaagataaggcttgagaaggagcatacgtgaccgcgtagtctagcaagcagtcgggagctattaattctcctgtcagaaaccgagcactcatacaattccggtgagacacctagtgacaatgaattgtagtgtcttggctggagcgcgactcatagttcctcaccgaattatgtcaggctcgtgttcaatctgggcgagggacgtgtccgtgcacgccaaggaaaggtgcggaaaaggtccgcgtgtcacctgctgaatgtccgatgaccctgtcaatgtcgtctttcataatattctatttgaattgcccgtcctatggatgctggtcataccgtatcgaagtgacctagaaattgaggttacattaaataggatgggattatagctgaactcagagtgggacatttactttgatgttatatgattgagctaggtagagactgataggtgggatttaccacaaaatgaccgggatgaatttcggggaaagtaggatgctaaatcttgtgccattgcgtgggtgaatgatgtgtggggtcaatctgttattggtgttaaactgaaatcttgggaaattttctgtccatagattaagcgtgctgaatggtagtgggatgaagggggggaaaaaaatg

SEQ ID NO: 576865 - DNA, 962 bp, Homo sapiens
gttccgtcccctccggcttgggggatccctcttcgacccggtttttgggctttccacgaggggcttttccctttggggaggcccttcgttctccctcgcccgctgtgcgtcctttggggtgcggcttaccccccgtgtgcaccctgggcaaccctggtttccgtcccctgtgttgcgccgcggacgacacctgggtgaattttcatgccctctaggagttgcaaaccccttggtgcttgtgcatatcgcttgcatttggggttgttgatctccccgtctcccccgcctccaccgacgtgtgtgcgttctcccgcccccccgccctcttatggttcatgacacccctcagggtccagaccaggaccccttgtgatcttggcccccctggatcttgagaacgaggtttcgccatctttccccggagagcaccccacattttgttctttccccgaggtggtatccacccccccgaggttgccatatccccggcgttgccaccaagtctcaccaccacccagggtgggtggaccaactggggcaccaaagagggggattcacattctcaccccaagcggcttctaacccacccgaatctgccaatgctcccttcttcacccaccccctctctgcaggtgcctgcgcggcacaacccccaccccccgattctcgccctggtgtcacactgggggccaccgcatcttgtatacccgtcgtttcccctcctgcccattctttcctcccctgcgaatggttttacactggtgcacactctggggcacagctgatgcccctggcggcccttcctggcgggacccttagaaggagaatccgacttccccccgggtgcccgttgaaaaccgttttattaactgaagttttttttcacgggccccacttttttttgtctgtcccccttttgagtgtaccccccttttataaaagaaatttttcttaagggaaca

SEQ ID NO: 576866 - DNA, 155 bp, Homo sapiens
agtagcgtacttctcaggtagttgcgtaacttctaggtcagttgcagttacttcttatgtatattctgacagtgaattctagattaccagagtggttgctcctggggatgtcttgcaggtctgtccctccggaagattgatgagaagaaacgcaa

SEQ ID NO: 576867 - DNA, 132 bp, Homo sapiens
tctcatgcgtcaattgattgtggcagtattatagaaaaataattgatttattcttgtgtttctcttttctttctttttttttagactgtgtcttgccctgttgcccagtctggagtgcagtggtgtgatctc

SEQ ID NO: 576868 - DNA, 178 bp, Homo sapiens
cctgcattctgacaggatagccgagagtgatcacagtgctcgcgtgctgaacattaccacttcatcttcgagtaggtccaaaacgacttgaaataccgcaggagtgatctgtgagacattgcggcgttgaactgacccataccaaagtgcgtcgtgacctggtaaaccctttcgggct

SEQ ID NO: 576869 - DNA, 964 bp, Homo sapiens
  misc_feature (10)..(10): n is a, c, g, or t
  misc_feature (75)..(75): n is a, c, g, or t
  misc_feature (86)..(86): n is a, c, g, or t
  misc_feature (104)..(104): n is a, c, g, or t
  misc_feature (111)..(111): n is a, c, g, or t
  misc_feature (120)..(120): n is a, c, g, or t
  misc_feature (125)..(125): n is a, c, g, or t
  misc_feature (144)..(144): n is a, c, g, or t
  misc_feature (174)..(174): n is a, c, g, or t
  misc_feature (187)..(187): n is a, c, g, or t
  misc_feature (192)..(193): n is a, c, g, or t
  misc_feature (197)..(197): n is a, c, g, or t
  misc_feature (199)..(199): n is a, c, g, or t
  misc_feature (208)..(208): n is a, c, g, or t
  misc_feature (218)..(218): n is a, c, g, or t
  misc_feature (243)..(243): n is a, c, g, or t
  misc_feature (247)..(248): n is a, c, g, or t
  misc_feature (260)..(260): n is a, c, g, or t
  misc_feature (269)..(269): n is a, c, g, or t
  misc_feature (277)..(277): n is a, c, g, or t
  misc_feature (281)..(281): n is a, c, g, or t
  misc_feature (288)..(288): n is a, c, g, or t
  misc_feature (294)..(294): n is a, c, g, or t
  misc_feature (298)..(298): n is a, c, g, or t
  misc_feature (313)..(313): n is a, c, g, or t
  misc_feature (320)..(320): n is a, c, g, or t
  misc_feature (336)..(336): n is a, c, g, or t
  misc_feature (344)..(344): n is a, c, g, or t
  misc_feature (346)..(346): n is a, c, g, or t
  misc_feature (348)..(348): n is a, c, g, or t
  misc_feature (361)..(362): n is a, c, g, or t
  misc_feature (379)..(379): n is a, c, g, or t
  misc_feature (386)..(386): n is a, c, g, or t
  misc_feature (888)..(888): n is a, c, g, or t
  misc_feature (945)..(945): n is a, c, g, or t
ggagcccctnagctcaggcggccgaggcggaggcagcggcggcgggatggcggacgccaacaaggccgaggtgcncggggccactngtggcgacagctcgcacntgcagcncgcagagcngccgngcgagccgcggcgagagcnatctcccgcggaggcggagaagcagcagcngcagcacagcagnagctnnaatngngttaaaatngagaattatnaattagcaaaagaagagaaattttntttnnaggaaaaatttntaggaagtnagaaggcnaatngattttntttttntttnaaagataagaatttnggcactngagaaaagaagggttnaaattgtnananagtttttattagnnacatttcatattatatnaaatggnaagctattaaagatctaatgagagagaaagttgtgtgaggttacatacgtggagctctttaaggatgcggaaggaaaatcaaggggttgtggtgtggttgaattcaaagatgaagaatttgtaaagaaagccctagaaactatgaacaaatatgatcttagtggaagaccccttaatattaaagaggatcctgatggagaaaatgctcgtagggcattgcagcgaacaggaggatcatttccaggaggacacgtccctgatatgggatcagggttgatgaatttaccaccttccatactcaataatccaaacattcctcctgaagtcatcagtaatttgcaggccggtagacttggttccacaatttttgttgccaatcttgacttcaaagttggttggaagaagctaaaggaagtgttcagcatagctggaactgtgaagcgggcagatattaaagaagacaaagatggcaagagcagaggaatgggcactgtcacttttnagcaagcaattgaagcagttcaagcaatttctatgttcaatgggcagtttttatttnatagactatgcatgtgaaa

SEQ ID NO: 576870 - DNA, 346 bp, Homo sapiens
  misc_feature (10)..(10): n is a, c, g, or t
  misc_feature (149)..(149): n is a, c, g, or t
  misc_feature (330)..(330): n is a, c, g, or t
  misc_feature (333)..(333): n is a, c, g, or t
  misc_feature (339)..(339): n is a, c, g, or t
  misc_feature (343)..(343): n is a, c, g, or t
acccggcctnaaattcctgcattagggacacacagtgcatgcatagtactgcagggggttcagcagggagccagaggatggctctgcccccaggccagaaatcgagacccctggttcctgccctcgtgtctgaacagctaagtgacatncttgccctgccctggttatggtgggagtgaaatgaactaagtacttgagaaggcttttctgtttgagacagagtctcaccctgttgcctaggctgaggcaggagaatcacttgaacctgggaggcgaaggttgcagtgagtcgagatcgagccattacattccatcctgggcaacaagagnaanactctnttcngaa

SEQ ID NO: 576871 - DNA, 275 bp, Homo sapiens
tggctcatctcccagtggtatgaacactcctgatctcctaagtgcaagcagtgcctgagacagtgcagcacaaggcctggaggatttgatggcacggggtcctggctctttcttctttggcatttttagctattgatgacgggaagatggggacagggtcaggagagaggtgtctctccttgtgcaacctccccctttttttttgagatggagtttcgcccttgttacacaggctggagtgcagtggcgcgaatcttgggtcactgcaacttctg

SEQ ID NO: 576872 - DNA, 290 bp, Homo sapiens
  misc_feature (79)..(79): n is a, c, g, or t
  misc_feature (168)..(168): n is a, c, g, or t
atcctcggaattgtgtggtgttatgttccatgcttgtcttatgtgcttattttaactacgtgttcgcatgttagtatcncatgggcttcgaagccactaggtttgtttcgtctaagtcccgttacttgggcttttgccacctctaggattgtgcatgtaagttaaccncaaacccctttaaagtgtgaatacggtttcatactatcaacgtgagcctttgattgcttatttgtcacatgatagccttaggacttgtttaacgccccgtgcatgcataacaccacacaatt

SEQ ID NO: 576873 - DNA, 779 bp, Homo sapiens
tggacccgcccccttatttgctccggaatctctcctccctcgccctggccctgccttctctggtgttagtgtggtgtgctgatgctgtgcctggtgtggcaactgcactgctgcctcctgctgcccctccctatccctgtgtgtgggatgttgtgctgcaccccttttatccccggagcgctagtgtgccctgcccctccgctgggtgcccacccccttctgtgctgcagttgcttagagtgctatcttggtgtgatgtgatgtgtggtgcttggtcccatgctggatgcctgcactctatctgccctgctcctggtgcaaaagctggggtgtgctgagtgtagagctgatcctgtggaaatcctttgatcctgggagccctagtgtttcctctccagccaactggtggctgtcgctgccttaatggtgatgtgagcactcaggaagaggttgtgttttgggcctgaaactctcccaatgtggcatagccccttttcctggtatggtggtctcctacacccacgcagcaccacctctccggtcgctgttggctgcctctacagcctacctatactgtccctttttccccccaactgggaattgagaggtaaggtctttctctgagaaatccagcagtagagtgaagggaccacccaagaaaactaaaaaccaatgcaccttaccagtctgtctggggacatggatcccttgctgaacttccccaagccactactgggaagtgcccctcacctcagacaccgcaaactgtgatctcctat

SEQ ID NO: 576874 - DNA, 189 bp, Homo sapiens
gctgtatcacagtcaagtttaatcattcttggaattcttgtacatgaacagggtgtagtgtggattcattatttacataacattctcctctcccttttgcctgagggagaaaggggctttctctgaagccagtagagaccctcccccatccccttatctctcctagctgaaaggccacaagcatgcctg

SEQ ID NO: 576875 - DNA, 459 bp, Homo sapiens
aactctaagtcacaaataaataaataaaagatctgtgataacaagggccattcatgatgactcataatgactcataataatttggttcaggccgggcttggtggctcacgcctgtaatcccagcactttgggaggcctaggtaggaggatcgcttgagcccgggagtttgagaccagcctgggcaatataaggagaccacatctctacataaaaatttaacaattggccgggaatggtggcacttgccctgtagtcccagctactcaggagtccgaggcaggaggatcctttgagcccaggagttcaaggctgcagtgagctatgattgcaccactgcactccagactaggtgacagagcccggactgtcttgggaaaaaaacacaacaacaagacgaggatatagtaatgtctgcctagttagtaacgttatacacactctcacacttgatgtaacat

SEQ ID NO: 576876 - DNA, 1321 bp, Homo sapiens
ggtgccgcggagccccggaactccctcggactggcagcatcccggagtgcgcaggagatctcagagtgacacaccgctcgcccgacacctcactgtctcctcccaagatgccacagaagccgaagccagagactgacagcacgaagagaaaaagacgggaggagcacaccagggcctccagcggcgacgccaacaccgagatgaaagcggcaatgacaggcacagtcaaaccgtggagacacccggactaccgacaagactgacggcgaaaaacggacagcagcaccaaaccagagaagaacgccaacaaacgacagcacaagacagcgccaccgaacacgccaaacgcgtcgagaacaacagaaggaagggcacacaacaaagcaccacaccacgcagacgcgaagaagcacaaacgggcaacagagaccgagaaactacgtcggacgcgacgacgaaccaacgtgcggccgccaacacacagggccgagagggacgcaccccacacaccacacaccccatcactggagcccgagcacggcacaaccagcgccggggaacaccgcgactcgccgcgcaaacatccgacagaatggaacccaagcgccagccagacaaccggaccgaccccagcgcgaaccaccacaaaggcacaaacaacacccaccagcacgcctgcacaaaaaccacccggggcacccccacgggacaaaaaggcaacaccgcaacacaagacgcacacagaaccgcagaccagtgccaacaccaccgacacaggcagaccccaaaggacagacacgacaaagacacacacggcacagcacaccaaagtgacgcatgcacaacgaaacaccgcacaagacagaccaacacacaaggcacaccgacccaacacacaccgccgagccacacggagcacgcaccggcaccagagacaccgtcgacaagacacaacaccacacaaagcagaacaggcacaggcacccgcggaccaaacagcgagacacacagacagccaagcacagacaacggcaacaaacacaagaacggaagagggaaagagaccaacgtgacacaggaacactcacagcacgaaaccaaagacacaggacagcgcagcaacaaaggcaggccaagcagccagagggccccgacagcaccgaaggcacccgctagaacacaagtcgaatgaccacagcaaacaccgacggcaaagggcagagacgggcaggcaagcagaaccacaggagcgaacgcgaacactacgggagggcgcagaaaagtaaaagagaacgtacccgcgcctcgcttttcagcgagg

SEQ ID NO: 576877 - DNA, 641 bp, Homo sapiens
  misc_feature (207)..(207): n is a, c, g, or t
  misc_feature (210)..(211): n is a, c, g, or t
  misc_feature (261)..(261): n is a, c, g, or t
  misc_feature (557)..(557): n is a, c, g, or t
tcccctcctttttatctaaagtgtaagaccccaccaataactcctaccaaccaaatataaaaccctttcacacctttttcaaccaacatattcttccaaccctaaatactcatctttacaacaccacttctacctactaataacatctcaccacataacccacctatccaaaatgtataccaacatcttttacaggaggtgtacccnccnnacatcaccaccacccccacaataaaaaccatcaaacacctttctccctcnattaaccccttcttacctattacacaacacccaatccgacttatgcccctctacaaaccttattatcttttaccttcatcaaaaaattctccacttaatcttattttcctatatccctcaccataccatttttacatatcttacacttcctccaccccttcactccatccctccaataacaacacactttccctatttttcattttacacaaatacctcttttctccaacctttaactacaccccctacaacactccatcctttccccaacttttttacttactataatgactctntatctaaacttagttaaatatcccaacataatttctatcctctttttattttaaactcctctttcatactactctattctaaac

SEQ ID NO: 576878 - DNA, 159 bp, Homo sapiens
ttttttttttttccccgaaacccctttttgaaccttattttaaaagaaggggggggatggcgggcttaaaggccgttaattaaaaacccaaggccctttttttggtttgtttttcccccccgaattttgccataaaaaatttttttttgtccccttcca

SEQ ID NO: 576879 - DNA, 1130 bp, Homo sapiens
  misc_feature (1130)..(1130): n is a, c, g, or t
ccatttcaactaccaagaacacaggttttagtttttgttttttgagacaggtctcagtctgttgcccaggctggagtgcagtggcaagattgcagctcattgcagccttgacctcctgggctcaagcgatcctcctgcctcggcctcccaactagctgggaccacaggtatgtgccactacacccagcgaatttttaaattatttgtagagtcagggtctccctatgttgcccaggctggtcttgaactactggactcaagccatccatcccacctcggcctcccaaagtgttgggattataggcgcgagccaccactacctggcctaaaagcgtcgttctgatcagacttcacccctgaatgtttctatcatttgctttgcttgttcatgggataatgtttgacgaaaccagagttctggctcctgcgtttcaacaggcctggggatgcggatgggcagtgactctggcgctcacggcaagtctcctcctcccaggttcaagtgatcctgtgggccttagcctcccgagtagctgggattccaggcacctgccaccacgccgggctaatcatcatcatcatatatatatatcatacacaagcaacatgctctcaaaaagagatggggtccaacatgtgggccccgccagtgctcccgacaccccggaacacccggggcaaaaccccctggccgtggaactacgcaaagagccgggccccacagggcggcagtgaccaccgaggcgcacccaacatcagcagcccaagcccccaaagcgcaccaagcaacacggagaataccccaaggcgccccagcaccccagtgacccccagggcaaagacccttggccccggggcgatcccagcagacacagcaacacaccgacaacgggaaaactccgggaccaagcgcgacccaaaccacggaacgaccaaagcgcacgaaccgccacatgcactctaccacatcaccgggcactaatcggactctacacacacccgtaattcttcctccttgttttctcatttgtatgcacaccacatccaccccccacacagctacccaacgaccacaacacatcgctacacacacacccgcatccaccaaaaaacaccaacaccagcacggn

SEQ ID NO: 576880 - DNA, 150 bp, Homo sapiens
cgtcattttgttcagttttctcatcattcatattcaggttctccttggcagctgtattctggagtctggatgtagctctctaaagacctttcctaaaattttgtacaaagaaaacccctttatttgggggggggggggcctttggggggg

SEQ ID NO: 576881 - DNA, 763 bp, Homo sapiens
  misc_feature (763)..(763): n is a, c, g, or t
gaatcgcgtttccggagagacctggctgctgtgtcccgcggcttgctgctccgttaggtggactccgcgggccttcggcagatgcacgtgcctggtggtagtctcctttctggactgagaacgatgataggaatggagaatgcccctcttcccattagtgcctttgcattgagttagagctttggctacacagcagctggtttgttcctgggtgagtgatcagtatggctatgtaaaaacatgggcagcgtgccgtccctggcttgcaaggggctgctcttcggacagtctagcctggcctgggtgcttaccagctgtatcatggatccaaggaatccgtttggggtttcctagcagccttctagctgatcgaagagtgagccaccttggtagtagatcctgcagtcccaagtcaagccttcggattgactgagacttcgtggcaatttatctgactgccatcagagaactccaatgccagaatctagccatgctgagctacttctataattcctgaacctacagaagactgtgtgacctgaataaagtgttgtcttcttattttgaaggacagatgccaggaaccttgcaaagacacaggtgcttttcgcgatgatatcggctgggaaagattgtctagacctttgtcagtggggggaggctgcccagagcgggcttgtgctcttgtggcacacctcgtgaaccgctaagccaaacccgtgggtttagtcctacctgcggaaggtcgatgcgcgccttggan

SEQ ID NO: 576882 - DNA, 122 bp, Homo sapiens
atttctgtcaatttctatggaatgcaaaggaggttcatgtaaatacatgttttgttgtaaagcttaagaaaaacaatctacatcttatactttagcctccatacttaaaaaaagaaaagaaa

SEQ ID NO: 576883 - DNA, 915 bp, Homo sapiens
gaagccagattacgactttgtcctcatactcttacagctgctgcaaagttgtgtgcatcgctaaagagagccccaacactatacagagagcaaacaatgcagataagaggaactgtcggcaaagcttgccactgaaacacaggtcaccctggaagttcgcagggttggctgtgggcatctgtagattactcgatctcgttagatcgcaggcatctgtgacatcttggcaagtgcctatgttatagtgccagatggcctgtaccatattatggaaaactgttaactgcttaatgggtaattgtcaaagaaagtaatgttgttaaatggggcgaaatagagaagttaaatttgaaggtgaatgtgttcaaatgaaaggttggataattgcatctgttactaacttagatttgcataggctcttaagtaactaggtatgtcattaggatattggggcaacaattagcagctctgactaaaatggtgtctctgaaggaatacatgtagattgtatctctgtcaaggaaataacacaacatataggcgttggtgtatggtataaactggtgaaatcttactgttctgacaagagatagcatgtatgactattgtccagtgtagaattgctacatgtatccagagtaaattgttgcgactgagcttaactatctaaattaaagacatgccgattaatcaagagactcgatacaagagggccggaacagataaaacacccatggtgatcgtgtgctccgccggaggagaaaaggaaactggcaatgagagagggcggcatgaggggcaagtgacggggtgtcgcaaaggaccgcaaagttttccatgggtccaatgggggtacccctagagcccgcgtttgcgcggagaaggcaagagattcatttgggactgggagttcaa

SEQ ID NO: 576884 - DNA, 219 bp, Homo sapiens
tccctcattgctcagtgtttgagcccagccagagccaagggggcatctttgcgtgtccctccgcagctaggtcacgcctggcccatgacaggctggaggaagtggtcaccgcagggctcactctagaggacattcatgagaccgggtgcggtggctcacgcctgtaatcctagcactttggaggctgaggtggggagatcacctaggaagccatcacga

SEQ ID NO: 576885 - DNA, 452 bp, Homo sapiens
gagcagcgcctcggactttggcgcatgtgctgctgggctggctggatagttcaagctggagcaccccactattcgtttgcaactgttgctcaacgacagcaatgccgacttgtttcgcgaaacggtcaacatcgccttgcgctttggcgtgcctagagactccagcctggtggccctgccggtgtacccgatcaccatcgcattgcctgcgccagccccgactacctggcgcgccacggtactccgcatacgcccgaagatttggcccaccacagcacgctgcgctatatgcgccggggccaggccaatagcacctggtatttccgccagggggcgttgcttcaagaagtcgaggtgagcggtgactacctcagcgatgacggcgagattgtccgccgctggacgttggcggggcatggcattgcctataaggccaaccgcgtccgtagcgg

SEQ ID NO: 576886 - DNA, 405 bp, Homo sapiens
gaatgaagacgcggacttcgtactgagtgttcagactcttctaagtggtggacaccaccaagagtgtgcagcgcacacagattctattgtgagagaaccaaagaacaaaacttccgtagcatggaaagggacccccagcaggttgccctgccggctgggttgggcagcttttattctcttattattatccggccatgttctgttgattggtccatattacagagtgctgattggtccattttacagagtgctgattggtccattttacaaaactctagctagtcacagagcgctgattggtgcatttttacagagcactgattggtgcattttacaatccccttgctcagaccgaaaagttctccaagtccctacccgacccagaaggtccaggtatgccgggca

SEQ ID NO: 576887 - DNA, 527 bp, Homo sapiens
  misc_feature (35)..(35): n is a, c, g, or t
  misc_feature (46)..(46): n is a, c, g, or t
  misc_feature (77)..(77): n is a, c, g, or t
  misc_feature (89)..(89): n is a, c, g, or t
  misc_feature (95)..(95): n is a, c, g, or t
  misc_feature (146)..(146): n is a, c, g, or t
  misc_feature (152)..(152): n is a, c, g, or t
  misc_feature (158)..(158): n is a, c, g, or t
  misc_feature (175)..(175): n is a, c, g, or t
  misc_feature (205)..(205): n is a, c, g, or t
  misc_feature (338)..(338): n is a, c, g, or t
  misc_feature (395)..(395): n is a, c, g, or t
tgccttgtgtgcgactgagatgcaggatttccttnacgcttccccnatgtgtcttagggactctggcttctcttttngcaagggcttcngaatcngtctgtgtccctgttagcacaatgtgaggaggtagagaaacagtccacctntgtgtntaccangacccctttcctcacantgacctgtgttccttccctgttctcttttntattaaaaataagaacctgggcagagtgcggcagctcatgcctgtaatcccagcacttagggaggccgaggagggcagatcacgaggtcaggagatcgaaaccatcctggctaacacggtgaaaccccgtttntactaaaaaatacaaaaaattagctgggcgcagaggcacgggcctgtagtcccagcnactcaggaggcggaggcaggagaatggcgtcaacccgggaggcggaggttgcagtgagccaggattgtgcgactgcactccagcctgggtgacagggtgaaacgccatctcaaaaaataaaaattaaaaaat

SEQ ID NO: 576888 - DNA, 786 bp, Homo sapiens
gcttcccttgaagaggaaaatttaaaatcactctttcgtctgggtgcggtggctcatgcctgtaatcccagcacttcgggaggccgaggttgggggatcatctgaggtcaggagtttgagaccagcctggccaacatggtgagaccccatctctactaaaaatacaaaaaaattagctgggcatggtggcgagtgcctgtagtcccagctactcaggaggctgaggcaagagaatcgcttgaacccaagaggcggagactgcagtgagccaagatcatgccattgcactccagcctgggcgacagagtgagaccctgtttcataaataacataaaatcactctttttactttatatattttttgagacaggatcttgtggtacgcaggctggagtgcagtggtgtgtgatcacagctcattgtagcctcgactcgcctgggctcaggcagtctgcctgcctcagcctcgtgagtagctaggactacaggtgtaagccagcatgcctggcccttaatgttgtttaatgagcatgtacagtagtcccgcttgatccatggtttcacattaccacaatttcaattacctgtttcaactgcagtcagttacttttcttaagatatctgagggttataggctcattgccttataccccagcactttgagaggccaaggccagcagatccttgagccaggagtcaagaccagtgtgggcaacatggtgaaatctgtctctacagaaaatacaaaaattagcgaatgtggtggcttgtgcctgtagtcccaga

SEQ ID NO: 576889 - DNA, 378 bp, Homo sapiens
gctgacttcaggagtcttaccacgggtgctctgtggcgctcttcgtttcccctagggatggggctccctgagagctgggctgcagtgattgttattgctcttctgggtctagccacccagttgggctaccaggcctgggatgctgctggggaatgtctgcggagagtcctgtgctgtgatccgtcttcgggtctcccagccatgggttccagcacctgctctgctggaggtggcgggggagtgaagtggactctgggggggtccttggttgtagttttgttgagtgcactggctttctcgaatgctggttatgctgcagtgaagttgtcacgtggacagactcgggacctgtggacagccaggagattgcggtgtttg

SEQ ID NO: 576890 - DNA, 122 bp, Homo sapiens
gcattgtggttagtctcgcagttcattcattgcccccacaatcctaggcctacccgccgcagatactgatcattctatttccccctctattgatccccacctccaagatatctcatcaacaa

SEQ ID NO: 576891 - DNA, 171 bp, Homo sapiens
agacgacagaaggggaacttcagcatgaaaatattgtagcactctatgatgttcaggaattacacaactctgtctttttggtgatggagtattgcaatggtggagacctcgcagattatttgcaagcgaaagggactctcagtgaagacacgatcagagtgtttctgcatc

SEQ ID NO: 576892 - DNA, 364 bp, Homo sapiens
  misc_feature (334)..(334): n is a, c, g, or t
tcaggggatacaagtgagtagtgagagaacatggctccaggaaagcacagaggaggagagtggagatcaggccatctccaggcttatgctccaggcaaatatcctgcagatctgtgaccatcatccaggcctggttcctggcgaaccaggttatctcttcatcctttacagcaactagcaaactgcctgctccctgaatacaggctgaatgaccagaggttcagctcaactttcccacccggcgtccaccctcagggcctggctggtggtcctgagttgcccagcaatcccagttaccctctcacaatttggaaagagagtgttcacacaaaangggaacatgttttactctttgcacgaaact

SEQ ID NO: 576893 - DNA, 358 bp, Homo sapiens
atttcggtgtaaaatacttaaatttagcttgtccttcggggtttgccccgccccatccagccagaccccacgctgaccatgcgtcaggggcctaaaggtggagttcttagctatccttggctttcagagccagcctggctttgccccctcccccatgggctgtgtcctaaggcccatttgagaagctgaggctagttccagaaaacctctcttgacccctgcctgttggcaggcccactccccagccccagccccttccatggtactgtagcaggggaattccctccccctcccttgtgccttctttgtatataggctttctcacggcgaccaataaacagctcccagtttgtatgca

SEQ ID NO: 576894 - DNA, 118 bp, Homo sapiens
ggtgatacgtccacctcgcctttctgtgccctataaactttactcttctgtgaaatggggggattttctgggaccatccccatggcagtggtgtttgagttttttgatgtgtccccat

SEQ ID NO: 576895 - DNA, 431 bp, Homo sapiens
  misc_feature (92)..(92): n is a, c, g, or t
catttggcagcagatgtggaagatcaaggaatgcctctccctcaccctacagccagctcaaaggcccagaagactgcagacacggagggagnacactgaatgtagaatagcaggctccacccccaatctacagccagaccccacgctgaccatgcgtcaggggcctaaaggtggagttcttagctatccttggctttcagagccagcctggctttgccccctcccccatgggctgtgtcctaaggcccatttgagaagctgaggctagttccagaaaacctctcttgacccctgcctgttggcaggcccactccccagccccagccccttccatggtactgtagcaggggaattccctccccctcccttgtgccttctttgtatataggctttctcacggcgaccaataaacagctcccagtttgtatgca

SEQ ID NO: 576896 - DNA, 218 bp, Homo sapiens
aaggtaagctgtcactgtcctattaaaataattactgtcaagtcaatggcaccaactctgatgctctgcctgtgtatcagtaacagtccaccactcatgtctccaaatttctatggcgtcattgacggtttaatagagcatcagatcagagtgtgctaaagagcattactgtgctgacttgccataaatctcattcaaaagcaaagaatcttgactgc

SEQ ID NO: 576897 - DNA, 164 bp, Homo sapiens
aggagactttgttaggagaaaattgaaagtaacttacagtctcgaatgtaattgcgaatcttcacctcagagtggagttgaaacttgctatagcctaagcggctgtttactgcttttcattagacaattgctcacatatctttgggcgaggaggagaagcagca

SEQ ID NO: 576898 - DNA, 104 bp, Homo sapiens
gtgagtagtagatgctgatagtaggatatataatagttaatacgatggtatgtagggttgtacggagaactgctattatcatcctatgctggtattgaggagta

SEQ ID NO: 576899 - DNA, 118 bp, Homo sapiens
cgtgtgtactggtcggctgtgggaggtggtggatcttcactgactgcctgagcttgtcatgcgggcaggtagtgtgttgtgatctggtgatctgtggctctgtagcaagtggtacatt

SEQ ID NO: 576900 - DNA, 1439 bp, Homo sapiens
gaagaggtttcactgtgatgtaggtccgtaccgacctctcattgacataaggaggtcggtgagcctacggtctcaggcctccagtacacatggccatcagcctgtagcacctaacgtgctgactctcggatatgggcagcgcgaactagtcttaacgcggtggtctcgggtgcgtagataacgcgtcggcggtctagtaggacaacttcagaaggcccatttccagtacggtcctcttgcgacttggagcatcagaaaccttcgttgcatgaagacggcccatgagtcggaacgaagctggagctgacaagatcatattatgttttgctcaagctgcttagttgatcgaggtaccagctacatggatggcgttcacatcgggctttcgtccagtgggctccttgttttgcatcggtgaggttagcggcgctgttggaagtcgtttcattgaccttatctgcgcgccgtaagccttggttcctcattgaaagctcgtggaaggagctgggctcgccttcggaggtgatcgttagacctcggtagggtccttgtgttagccaatgtgacggggcagtcatcgaactgtggtacgcgagggaaggcaactaagttaccaggacacaatggaagacgttacgttaaacggcatcaaagcaaccaatggagaagcttacttgatcaaagaaccccccctttgttattgcatatggccgaattggacggaatagcgcatcagttagggccaatatgcaataagcccgcgaagtacacctatttgttccctgcaagacttctggattggcatgtccaccagttaataatcattatgtgcatcttgtctggacaatactttcacagggatactcgacaaaccctgatatattagcgagtcatttccacatcgttagagtggaatagaacgaaattcattgaggaagaccgtggcttgcgtacagcgtttcccagttcaccaaggaaaccccgaaggtggatgccactttaaaccgtagaccgtctataggcacagggactatgaaccagagcaaccaaaaagtgacggatatttcctttaattcaactgtttcttttatggggcggacttctccctttgagatatgcgagattctccatgggatattacgttccccatggaagaaaacttcccaattcgaacctgctacattcctaaagcttggcagatggaaaacaccaaataagcttgtccccgagacaacgttgacagcaaggaagtgggggacaaaacccagtgtccctatcaccaaaggagaacgtattccctatggcaagagtggtacccaatcatttagtaaagggaacatattatggagggttgacacatacaagttatgcatcaatatcccaggggtatctgtgttgacagaaagttcagagtagaccgttacgcgacactcggcaac

SEQ ID NO: 576901 - DNA, 400 bp, Homo sapiens
ctctttgagtgtaccttggggacagagagataataaacaagataaatagtaaaataaattgatagtttgacaatgataaacgacgagaaaaataaagtcaaggaaatggtataggaggtatttggggttttgtaagagatagggtcaaagaacaaacactggtggtcaggtcatttaaggtcttgtagatcattttagggacatctgctctgagtgagatggagacccattgggggattttgagcaaagatgtaaaatgacctaacaacgtttttacacaatcattgtggctgctgtttacaaaatactatggtaggggtgaaagtggaagtaaagagaccaattagagggatgttgcagtcattccgccaagagaggatggtggaatgacaaggcaaaa

SEQ ID NO: 576902 - DNA, 162 bp, Homo sapiens
cgccattgcagtatgatattacggtgtagagtgaagtcatatatagctcttactattttgagatatgttccttcaataccttgttattgcgagtttttaacatgaagggatgttgaattttattgaaggccttttctctgtcttatcgaggcaatcaagctt

SEQ ID NO: 576903 - DNA, 937 bp, Homo sapiens
ctgtctacgctgtttacgcgtgcccttcgcttatttgttttactgtctcatccgcattctagattgcctttggtccgacttttcgtaacgtgttaccgtactgcttgtatctcatagtacctggtgcgtgcttcgaggcccctcttacttggcagtccaatcctcgttcagttcttgggtcagtgtcgcggcccatgccgaccttgttacctttcccgtctgtttgcctgtacctcacttatgttttctgtacatcactttcctgtttctgtgccatgagtattattcttgccacgtggcagccccagagtgtgcctctgaacctattctggttcttagggttgcctgattcatatacttgatttttgctcaagttatactctgttagatttacgctttttcttttcgtttaactattctattcatagctttttttttcttttttcagagacagtctcactctgttgcccaggctggagtacaatggtcacgatcatagatcactacaaccttgaactccccggctcaagctagcctccagcctcagcctctgagtagcaaggactgttgccatcatgcctgggtaatttttgtatttttttgtagagataagggtctcactttgttgcccagggtggagagcaatggctattcagaagtatgatcattgcacagtacagcctggaactcctagcctcaagggatctttcctccttggcctccacaaagtcctgagattttaggtgtgagctaccacagcgcggccctattcatagcttttactttcgtttgtaattgtgcatttgaacagtgcgttacttgaatgactgactttcacactagtctggaagttcctttatggcagacaccttgttttcctagggttagcacactgaaacatcacaaagaaacatgcataatctcagtgggggcgggg

SEQ ID NO: 576904 - DNA, 158 bp, Homo sapiens
gttacttgatcaattttctaaaataaggtttttggacaatgacagttagataagggaagaacacatggcggaatgaagtcctaattattatacgtgcatatttttttgacagtagggagaccccttttacagataagttacacacaaagaaaaggcaa

SEQ ID NO: 576905 - DNA, 213 bp, Homo sapiens
ctctctacctcatgggttcaccatggaattccgggacaatccagtactcagtcccatcacggatgccccacccagccacggaaacgacagggtttatatatgtggggtccgggtattcggcatagatgcctccggggtagttagccagtctttctgtggccattattccacagcggaggggaccattggcgtagatttctgccatcatcttcg

SEQ ID NO: 576906 - DNA, 331 bp, Homo sapiens
  misc_feature (1)..(1): n is a, c, g, or t
naaatgagaattggggggcgggggcctttcctgtgtcttgggggggtgaggggttcaacatcgttaaggccctccccaaacgcaaaccccctttttttaaagcccattgggcatttcccttaattcctttatgccaacttggggtttcatgggttgttttttcccccaaatttccccttagggtctttaaacccccgggttaaaattgatattatgaaaaattttttaacccaaggattttataaggttgggggctttgttttcctggaggggttgccccagggaaaccccagttttgtcctttttttttaaaaaagtccccccttgttta

SEQ ID NO: 576907 - DNA, 124 bp, Homo sapiens
ggatctagaaaatagcctgaaaaaggcaaatctaagagttattgatcttaaagaggaggtccaagggtaggggaaggtagaaagtttattcaaagggtagtaccaagaccctcccaaccttggg

SEQ ID NO: 576908 - DNA, 290 bp, Homo sapiens
aaacataatttcatcaagaagctgtgatggatatacagatctgttcactctataggaagtaactctaacatgatcatggagatggttagatctgggggcagacaccctacctaattaccatggcaaaggctcccagatgtatgggtggtgttgcaacatctactttaacagactctgcagcatgggtgttgcataggtggtgacgagcctgtctgctctcagtcgcattctgaaggtactggatgcctccacagcgttcccagattttttcaacctgttttggccagatc

SEQ ID NO: 576909 - DNA, 599 bp, Homo sapiens
gataaggccaaaaacaaccagtggaacacacgagagaagacccttctcgaccacggggaagcatctgccacaaatgtgatcgggaataagtatgcctgctcctttgcatatcattctaggagcacggtgaacaaatgaatcgctactagcacctaatgggaacatggtgtgaggaagaggtcagtaacaggttactatcaaacaagggagttccctacgatgtacgttgtctaaaatgctctacgcttggctgtaatctcgtctcaaaaacacagggttttggtaacagtgtggtcccaacaggaggacacattcatgaacttcgcatcaaaagacaattctttatacaacagtggctaaaaatgggacttcttttcacattcttataaatatgaagctcaccctgtgtgcttacaattttttcaattgtgtattttccaagtgtggcatatgtgtacacttttcgggggatatgcttagtaaatgctacgtgtggattttctggaggttcgataacttggctgtgcagtagattttctttaaacagaatgggcagttacatgccataccttcaaaagtattttcctgtaaaaaaaaac

SEQ ID NO: 576910 - DNA, 835 bp, Homo sapiens
  misc_feature (15)..(15): n is a, c, g, or t
  misc_feature (235)..(235): n is a, c, g, or t
  misc_feature (245)..(245): n is a, c, g, or t
  misc_feature (258)..(258): n is a, c, g, or t
  misc_feature (268)..(268): n is a, c, g, or t
  misc_feature (303)..(303): n is a, c, g, or t
  misc_feature (340)..(341): n is a, c, g, or t
  misc_feature (525)..(525): n is a, c, g, or t
  misc_feature (600)..(600): n is a, c, g, or t
  misc_feature (636)..(637): n is a, c, g, or t
  misc_feature (657)..(657): n is a, c, g, or t
  misc_feature (701)..(701): n is a, c, g, or t
gaaacggagggcaanaaacaaccttacggctaggtaagcgaggccgggtgttcaagactcaaaagcttattaccacctgcttgagcaggtggctccaaaaggagatgaagaaggtgtcctgctgtgttattgacatgtcaggactgcgggagaaggatgacatccagagggcagaatgcatgctgcagcaggcggagaggctgggctgccggcagtttgtcacagccacagatgnttgtccgagnggaaccccaagtntgaacttggncttttaattggcaagcccctctttaacagaatacncgctgccctgcgacaaaccagaaagaaccaggacatnntgactgggggtgctccttgaagcgtgagaacgagacgaagaagcggacatttaggaaactggatagagactcccctgggtgttaacgcctcgagctcaatcactttgtaccagtggacttatacagatgccccctggtcagtcgttccagctcctatgaaaagatcaaacgttccctgttgacntggaacagaggtaaactaaaccggcgataccccagaactggggagcgcaactatgaagaaagctttgagaatttngtaactacgccggtagcaattggcggaagacatcannagcgaagttctcccctggtntggcatccggctggagcaagatcctcagatgaagcgagaaccgnactcctcagcactggccttgaatttggcgagctaatgcagacaggtatacactggagatatcctccgaagaaactggtggtgggccagaaggtccatgatgaccttattgtcaactgggtgatgaacattgagg

SEQ ID NO: 576911 - DNA, 1107 bp, Homo sapiens
tttattactcaagagcgatcttgattgttcgttacatgaacacacggaaattgtataaaccattatagatgttgcaagaccgatgcagttttgccttttctcttttccactaagagtttttgttagttggtagtacgtgccctggcttgtaacacagatggacatcactgaaaggatgaaatcaagtaggcttgtttcaaagagactcctgtgaatcaactatgaatatgaacgtatctcccagaacacatgttgacgtgtttcacggagactctgaaacagggcacccattttttgtttccttcctcaaaaatagtctccttgaaatgtgagcaaagaactatgatgatgcagtccaggtatctaagtagcgtcagatcacgcaagcaccgtgtgagaatggtacttataccagcacaaaggttcaaatacaagtaacctgggcaatgccaacagaagacacttgtaagatcatttgcagaccgtttctggtggcaggaaccgtgagggcaaaagacaaactggtgaaacaatgttccgaaattagatcttttgtgatgttcatagccagatattcagtatttcggtatggtttacaatggggggaaaatgtcggttaagggtaatcatactgagtagataagagtagcgaattaaaccaaagggaaacttttaatacagtcatttgtaagcccgtggtttatggctagttcccttttgctcaaggaaaacatagtactacttcagggtcatgaaaacctatgatccactgtcgaatcttcccggagacgggttacaagtcacaggagtgaatcctaccggaaaataactaggcgccagaaaatggagccggaagactggaaacggtcgctacccaactcgacaaaaaacgcgtaaggggccacaaggaaaaccccggcagaccgaattccacagaccccagagagtccaaacaaaaaagacgccgcccatagataaccctagggagaccgaatacacgaaccactttcacaaaacacccaacacacacaatagagacacgaaggaaacaaagtcacagcagaacacgggacagcacccatagagatgacaaaccaaatcctacaa

SEQ ID NO: 576912 - DNA, 210 bp, Homo sapiens
aaaatccccgttttttgggggcccccccccccccttccccggggtttttttgtttttggggggttttttttttttgggttttaatttggatggttccctggggttttgataagttgggtcccctgggccgtttttggcccccttgggggtttgggggccttttgggccccccctttttttttttttgttggtgggccctgccaaagccca

SEQ ID NO: 576913 - DNA, 494 bp, Homo sapiens
ccggctattggtcaatctgcgcgcgtatttgatgctcaacttgcgcgagcgcgtgagactgcttgcgtggcacaacatatggcgagcctctggtcggagcgttttgccggggacatgtcgacacagaagcgcctgactgatcactttgcgcggctgcttgagcgcccgtttgtcgggccgctcaacgaggaacgggtggctcaggctcgcgaagcactgaggggcgagtcattggccgacgtggtgtatcgggtactgcgcgaacaagctcgcgacctggaacccttgcgcttggccgagggcaatgtatttgctggtatcgccccctccgtaccgggtttctataccaaaaggtatctgcagtactttgagacgcaggccccacggttggttgacaccattgcccgggataactgggtgctcggtgagggtgccgacctgggccatcaagatttgagtcggctgatggcgcaattgcaacagcgctttttcag

SEQ ID NO: 576914 - DNA, 823 bp, Homo sapiens
agcctgccataaattcttatatgacgaggattgaatgccctcgccccccccaaggaaggttctaagctcacaaacacgggggcccacacacgggagggttccgagaggggatccccttctggagagcctgctggagaatcaagaatgggatgggagttcgagatcgaagagaaaaggtcacacatgtgcacaaggtggtaatcacatcgggcgcaccccacacccacagagggccacgagtcaccccctgggagttcccggcccctcggcttatacggggccacgaggaatcgcggctggagcctcgctattaaaaatgtggaattgtaccacactcttccctcgtagaccgcgccgccccacgagacagaagagtttcgagatgttgttttcccacactgatttacactcatggcgccacgagtgagacctctttcttcttgaggaggggttttgagacttgtgagagagctatgtggccccgccccgatatagattttcacggaggctgagtattaactccactctgtcacggaggacatggaatgttggctcgtccctgataaaacccgtaacacttgtgcctcggcccagggagactttcgacgagaaagcactaaccagacttgttcatcacatgaaaggacgagccacaggaggcactgaggtgtttaaccaagtgacccttctccttccctccaccacacccacttacggggctggggctttttttgcaccccccgcacctttgtccccaaacctcatttccctttttttttaccccggattggttttttccaaaaatagaaaagcttgaatccca

SEQ ID NO: 576915 - DNA, 243 bp, Homo sapiens
ccggtgaaacgggaggacaatccatccagcccacagaggcaatccaagctgtctagaattcagggatcaaacgagggctacggaaaggagagacgacctgacctaggagggccatgatattctatagaaccggacaaagttggtttccaaggaaacttgattccttggaacccggaaagttggttcttttcatatgcaattccaaaccctgagctccttcccaaagcctgcctggccgccagc

SEQ ID NO: 576916 - DNA, 959 bp, Homo sapiens
ctatcacctcaaaacctgtcctctaaggcaacggatagatagtcctaccttattaggatacgttgctccatttcgagatcaacatagattgtcgataccttaactctgatttgcccaggtatatacaagaagttacaagtggctgcttcacaactgcccagataagcgtatacagcttagatggagaacaactctatatcctcgtttcccggagtcagcattctaccaggacttgtgtatcagagccacagaatcaccactgagcctcatgctacatgaaatgtacaatagggagcccagatcatgtgaggacatgttcattgctttttcctgaggggaaggactgtgacctgccataaagactgaccttgaagttcagcctgggtgttacaggatatacatcactcagttactattgattcaaagttgcggtagtgaatccaggaagccagtaactgactaggagtagtctggtatcagatacagcttccctcactgtgctacagaacgcaagatagggaataggtggtctgaacgtggtgtctcactctggaagaagtcacgcgaatgtaagatgatgaatagagacaatgtaatactgttggtccaaaagcatttaaaatcaactagatctagggattatgctggccttaggtagtctggcttgtcacatctcttcgcctatacagtcgatccatgttaccacatagtgagtctcttaagtttaggattcagtaacagtcaagtgtttactatgtgcaaacaggtattgaagttcttatgaccacagatcatcagtactgttgtcatcatgtatatgctagaatatctgaaataggtccactcgttatgcatatgttaaaaatcgactgtgtgaaatagaaatgagtgctatcggctcttgatatctgcagtgtccgttatgagtgccaaaaatataccccggagcgagctacaca

SEQ ID NO: 576917 - DNA, 341 bp, Homo sapiens
ctccccccctttgacgtggggggtggcattgccctcaacgaccactttgtcaagctcatttcttggtatgacaacgaatttggcttcaacaccagggtggtggccctcatggcccacatggcctccaaggagtaagacccctgggcccccagccccagcaagagcccaaaaggaaaaaaaagaccctccctgttggggggtccctgccccactcagtccccccccccattgaatttcccctcctcccagttgccatgtagacccctttaaaagggggggggcctagggagccgccccttttcttgtcccctcaataaagtaccctgtgctcaccccgttta

SEQ ID NO: 576918 - DNA, 253 bp, Homo sapiens
  misc_feature (184)..(184): n is a, c, g, or t
  misc_feature (217)..(217): n is a, c, g, or t
tcaaagtatccctggcccgacacacttggctgacttatgttttgtgggcattttggcaggaattttgtcttttcaaagactcatcctcaaaacaagacttgaccctgtgtccttgccccagtcctaggaactgtggcccccaaaaatgttcattttaaaaacggatttcatgaaaccctcttgnacttataaaaaagccctgggtagccaagtgatnttcccattcccaaagttagtaaacctttgttctcca

SEQ ID NO: 576919 - DNA, 280 bp, Homo sapiens
aaatacaaaaaattagccaggcgaggtggcgggcacctgtaatcccagctactcagaaggccgaggcaggagagtctcttgaacccaggcggcggaggttgcagtgagctaggatcatgccactgcactatagcctgggcaacagagggagacttcgtctcaaaaatcaaacaaacaaacaaaacaaaataagggttaatgggctcttgcatgagtccttaagagcctctctattgagtaaggaggaataaactatctaaataaggcattttcatgacat

SEQ ID NO: 576920 - DNA, 146 bp, Homo sapiens
aatcatatactgtggctgtattgagatctgcggcatggatgatgactcctagaggtttttcagcctcttcttctggcagtccatccttcatctctgcccttgaggagttcatattttagtgggtttcagacacagacatccgcact

SEQ ID NO: 576921 - DNA, 179 bp, Homo sapiens
actagtaagaagtcacagcgagtaatacgggtttgcttcaatgtggcgtttggggacatggctgggtccttcacctacagcctgccgcccaggttcctgctgcaccacccgcagccccgtgggttgcccatgcttctgtcatctgcctcatcaatgctattgaaacttctaaaactagg

SEQ ID NO: 576922 - DNA, 203 bp, Homo sapiens
tcacatttgtggttttatcatgtttctttttaattggatgggtaggggtgactgttttaattgggctgagaggcaaacctgaggacaagtaactcaacttaacctaaagtcagacttcaggattcaaaaaccctgaaagcgtcctagactgggctcatggaaagggaaaactgactccaatttgaccagttagtttctattgt

SEQ ID NO: 576923 - DNA, 836 bp, Homo sapiens
gcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaaagaagaagggtggatctccaaccaggccagagaaagattctcacagaaggtttggaactctagaattaaatgggttgggtaataaattggcttctggttcaaaaaaaaaaaacaaaacacacaaacaaaaacacaacaaaacaaacaaacaaaaaacacaaaaaaaaaaaaaaaaaaacaaacaacaaccaaaaacaaaaaaaaaaaaaaaaggggggcgcgccagtaaatagaccaaagggagagaaaagataacaaccccaattttagtaaaagggggctcaaaagaagaatgataaagaaaaacacaacgcacccataaacaaaaccctgacgaaaaacaacaatgaggaaaattagaaaacacataacgagaggagaaaacatgccgccaacacacacgaacaattaccacacgcgcgagagaaaatacacagagagatataagggggaacacacagagtattagcgcgagaaaaaatgtacgagaaaaaaagagaacacacgcgggacgagcaatagg

SEQ ID NO: 576924 - DNA, 246 bp, Homo sapiens
agctgagaaccccgggaacaagtcaggacaggaatgagcttctgcaaaagtacaagagcctctggatgttcgaaatccccaaggagtagagtgaggctgacttccttagaaagagggggaagccaatggcctgtctccccactaccatccccaaacgctccttggggcgtggttcctgtggaccccagctcagctcgtcaagctgcaggggcggggctcctgtgcttgtactgctgtgatgggggt

SEQ ID NO: 576925 - DNA, 1071 bp, Homo sapiens
gtcctcgcgcgctgatgtgtgcacggcatgcgaaggatgcagtcaagctctctggtaccttggaagcaggcctgccgtcttcatgtgcactctcctcagtcaagtcagaccccagctatgcaggttggctggacaatgacgctggggactctcgcagacggcaaaacgaagggctgtgtactaattggataggctggggcaggccgggtgaatgaggttagttacgagcctattgccctgctacatcatacgagccaagtagcatagagttccgaccagtgtccagctgtgtgcacgaactagtgcacatgaaacctggtaaagcaagacgtcactgcagaatgccatggagactagtgctgggcaagatattgcctgactaccaacaaacgagggaggaacagtaggtcagaccagagttgggcgactggcgctctgacgggagaaaaggatgcctagagctaactagggaaacggcttggatgtacattgtggacgcatcgggtggtacactattcctatgacgaggggagctgtgatagtagcgcgttgcaacgctatcccatgtgaggttgagtagtagaccaatgtaataggccgtcaagtactggcgttggttgagttttgctacaccgggacgtgtgagttagtcccacgaggtacggcatgagcttcgggagtccggttcttcttcgttaatgagcccattggtcgccttggctgtgtttcccgctcaaagacattggggagggcgattgcgcgccgtatgattctcggcgagttatgagtgccataggggtggagagaaggagttccaatgcaacctgggggaatcgcttccttatgtttcccccatcggagttgaacacaggagtgcttagtgagctatggtggatacagcacctttacaaataccgaaggggtggaaatccttcggggagaagaaaactgaatacgggcgccttctttgggacataagaggacgtcgtgctcggggaacacgctattccccggtgaccctaaaagttggtcagaaatgattcagggaattaacggatttgatgaatcccc

SEQ ID NO: 576926 - DNA, 1318 bp, Homo sapiens
  misc_feature (115)..(115): n is a, c, g, or t
agcggagttgctgctgtctccctcccagagtgacatggtgttcggggcttgtcctgtcctttcattcacttcccctccttccagccggtgggtggaaccgagagagcctctccanggagcagcgtacgcagtccagaaggctgcagtatttcctccaagaaaaaaaaaaaacaggggctggcttcaacccctggttggcaagcaaaggtcccgattccctctggctgggctatctcgaatagcaaggcgattttggcagcaacggctggtgccgtgggaactggacctgaagaactcaaattgcggggcgggggagattattccttatccctccttccattttacccaagacaaggagctggcttttgggtccctcttttggggccaaggtcccaagggtggagggattacaatggagaaggaccttggcctttcttggaaaacccgggagggcaaggcccttcaatcaggaccaccagggtctggctggccaaccattggatgttgggacggggctcaagccttccaggaattggtgaggacattaccttggtcacggtcggcttaacgccacatcaagtctagtggtacatgggttatatagcaatccgtggaacgtggggtggaacacaaacgcacgcgaacacacacttttttttaatacagtgggccatactaacccggttatttacctactagtcaattaaaattatttcctcaaaagaatattcaccacaatatccctggggaagaagtgtgcaccgatttttcaccgaccttttcgcaacagagcgagcaaattgtggaacaccatgtagggcggttgtaactcaccccttattccccagatgtgtgccccacgtgacacacaagcgtgacacagggaaaaaatccacgagacccgattggtgcgtgatgggaccaccaagagatgtagatgccccagacaatcaactatggggggcaccatacaagggcgggtatctatgggagcaaaagtgcgggtcggatcaaaaccgcctgctggtggtttagcaaggaggagaagcggagttatttataagcgtacacacaaacgacaatgggtttggtatggtgaggcgaccacaatgagtgtcgcgaagagtgaagtttttactaaaaacaacagtcgtgtgtcatacaagtggaatcgacacacaacaagagtataatcagatggatcacacaagactggttacaaatgacgaattcatgcatgctagtgtcgttctcctctttctctttctttctcctttctctgtttcctatctgtgtgcagaaagaacgaaggagcgct

SEQ ID NO: 576927 - DNA, 812 bp, Homo sapiens
ggctgctcccaaatggaggaggctgtcctgcgagcacaaggtaacgaaggaagctggtcctggtgcttggaactaacgtattgaactggctccccaacggcagtgtagtcgagacgacaactggcgtgagattgacctgtcgagaatgagttgaccaaccgtgagctttgcaagggcgcaacggatacccagacatcacggtcaaaatacatcctgatactcggttgccgagtgtgtccagttagactccgagggccatctgagttcacgtcgtcatgagagaagggtcagaagcgctgcttaggagctgaaagacctcatgtagggtactggggaacgtattgccgccttggtgaagtgcgcacccactattcgtgtgggtgttgtgggtcttcccaagggttgggcaagcagcgaagcctggatctaatgaggcctgcaagcgctacagcggcgcatgacgaatcggtggcgagctgttcctggcaattaccacaatgtcatgcgagagcagggtctaacgctggacgaaggttcagtccggtctctgtggatgctgcccaggctagttgctcgcgcaggagccccaaactcacgaggtgggcagcgaatcctggcggtaaccgtgcaggtccagcgtgcagagagctggccagaacacactgtgacacccaggtggagatcgcatcctgctagtgctggcaatcctggcaggagatttccacagtatctatggcggtctctgggttccagaacaactgatgacacgtttctgacggcggatggtaccaccgtttgggggaaggaagaaa

SEQ ID NO: 576928 - DNA, 445 bp, Homo sapiens
ggtcacgtaagagtctgggaggtttacgcactgctcaggaaacagtaaagacttttgatcttgatggattctcgctctgtcacccaggctggagttcagtggtatgacatctgctccctgaaacctctgtctcccaggttcaagcagttctcctgcctcagcctcccaagtagcctggactacagacatgagccaccatgcccggctaatttttgtattttcagcagagagagggttttgccatgttggccaggctggtctcaaactcctgatctcaggtgatcggcccgccttggcctcccaaagtgctgggattacaggcgtgaggcactgtgccgggccatgatttatttgttttaaatgaagtgtctggctactttacccagggtatactgaagagtatgcgtttcttagaaaatagctcaaggggtatagacgcatgaaa

SEQ ID NO: 576929 - DNA, 1044 bp, Homo sapiens
gtagcttttctgtaggtcctacttaagggtggccccgtcctgtggggatctctgggatgtttgaggctatagctctgttctaatccaagcacgcggggaaatatgcggcggcgtcgaggtggaagcccaatatctgtaggtgtcagcctatgatgttcatcggggctcggaatcaacgccgttgagttacgggaatgtctatggaggtgagggtaagcgagttagaatcagcggccatggcggcatagaggctactccgcggtttcgcgggaataagtgtacacccgggggaggtaggtccggttgcggaagcccgcaatcggtcgattcctgcctggtaagcctctgtgtgaagccgaaggtgtagaagtgtggagcctgggccccggtggacaggagggccgggggtcataaggcaccgagggcaaggacgcgaggataggagcgcgctgatgggatgcctgttagagtgttaggtgtagaggtgcctattagtaggtagccgtagagcagagagcgccagcaggtcgcgtatggagctagcgcaaagccttgcagtgtagaaagagtgttcggtttggggcgagcctcggagcagaaccgcaagcctccgagcagtacatgcgtaagaacttcagccagtcaaagcgaaacgtagctagacgtcaagttgatccaataacttgaccaacggaacaagttaccctagggatgaacagcgcaatcgctattgctagagtccatatcaacaatagggtttacgagcctcgagtgttggatcaggacatcccaatggtgcagccgctattaaaggttcgtttgttcaacgattaaagtcctacgtgagtctgagttcagaccggagtaatccaggtcggtttctatctacgttcaaattcctgcctgtacgaaaggacaagagaaataaggcctacttcagcaaagcgccttcgccccgtaaatgatatcatctcaatacctaccgtatatacccacacccacccaagatgggggggagggggggtgtgggggggggggggggtg

SEQ ID NO: 576930 - DNA, 294 bp, Homo sapiens
aggacgggcatgaggagtcgagaaagcctgggcgactggtgaaacctgtctctacaaaaaatacgacagtgctgggattacaggcgtgagccaccacgcccggccctaactttatagttttataaccattaattatactaatgcgaatttggcagaaccatagaatttagtcttggatgggtgacgggccatcatggtcactagccagccttccacccaacatggagataagctctccggaagcatccttcgcagatggtcatccgacctttctattgtgaacctaattggagt

SEQ ID NO: 576931 - DNA, 923 bp, Homo sapiens
  misc_feature (923)..(923): n is a, c, g, or t
aattaaggctaggtacgaggcgggtggtgaatcggccgaggcagatgcctcaccattccgtgtcatcacccatgtctgccacccactgattgggcgatagtgggcccatggggtggaagcccccagatgactgagcagttctacaagaaatggccagcacgagcggggactagcagggtcctgattttgtgtctgtgcctcttcagtctctctggactctgatctccttctcccttcccatctccaggccttctgtctgtcccagataaagggcgctgtttctcccatcctccctacccgcatcctcgtccaccaaatcgctcccaacttgttgagagccgaaaggctggcgcgttctgacttgcaggtaagcgcatacacggtaggaggcctagcttgggaccgatgtattttaaacgcagagtggacagcagagagtcgaattctccctttgcgtcgggagtgggcatgtggggtggctaacttgtcttcggccaaccaggggcctgtgtgcccaggcgactcaccagctccgcctctggtgagttggctgccgacggtgggagtcagccaagatttacagggatgccagcgatggctcttttcacaagctaccagtcccactgtgggtggagaactaactggtctttctcctcaggatccggcggaggcatgtccctgagcccaggagccaaatgtgagggggggggacacaccggctatgatagggcgcacgtggccaatgaccgttcccgcgcgtacccctgttttcctggtcacgggtgggagaattggcggacccccagaaggggcgccagaaaataccgatgggcccagttcacctctatgttgtccaccacacccaatgaaggccccctgtgggaagacgcacagacaggactgctttaccaaggggggccccn

SEQ ID NO: 576932 - DNA, 339 bp, Homo sapiens
tgctgagtaagattccagaccgaataacacaattgttttttaagacggagtctcactctgtatacccaggctggaatgcaggggcgtaatctcagctcactcactgcaacctccacctcccaggttcaagcgactctcctgcctcagcttcctgagtagctgtgaccacaggcacacaacaccatgcatggctaattttggtattttaagtacagatggggtttcaacatgttggccaggctggtctcgaactcctgacctcagtgtaactgcctgccttggcctcccaaaagtgctggaattacaggcgtgtgttaccagtgctctgccaaaaaacaa

SEQ ID NO: 576933 - DNA, 1726 bp, Homo sapiens
tagtgacaatttttaactatgaacatgtttgtttaaaaagcaggctggtacctggtcctggaattcccggtgatatctgaaaaaaaaaaaaaaaaaaaaaaaaaaaaaaaaaaaaaaaaaaaaaaaaaaaaaaaaaggggggggccctccctttttcaaacccacaatatagtttcgccccaaattctttgagaggagaattttggtggcaagcggcgttcgcccgcgtggggcccccgggggttttgtggccagaggcctcataagaccttggtgtcgtgtggtacgccgcggccccttgtggccctatggggattgtgccgccaacaatatctgttttttacccccgcggggaagaggcgcggggccacaaagatcctcctatttttttctataaacgaggagcatctcggtgagatacttcgaccagaaggaagacacattatctcgcggtgcacaagagaggggcgcactctcatctaaatgtgtgagaggagacaccacccccgtgtggatatcccccgagacacccccccctgtttattttttcattgaaacacacattgtgggggcgccacgatcacacctttttgaaaaaaaatatctctctctcctccctctataaagagagtgcccctcacaaaaagaaaacactcctctcacaagacgagagggggaggagagaaatatctcttctccccccccagatgggagaagagtgttttgttgtgttgtattcttgcaaaaccccgcaaagtgtgtgtctcttcagagaagagagattctttccctaaaaagatgtgtgtgtcacccccaaggacgccctctttagagaggagctagtgacacaataataatagagagtgaccaaacaagtgatgtgttgtttctagcccggcgaccacatgatgttggttatcacacagaaagagaggttcgtgctctctcaacaaaagaagtgtggtgtgttgtttggcgcgcagcacacatgtttttaaacagatgtgctccctaaaaaaagaaggtattttatgattacacacaccacaacaagtagacggggggacccccccacagtgatgagtttttctccccccctgtgttatttaataaacaccccacagccccgcagggaagtgaaactatctcatatatgatcaaaatcagaaatagtggcgttgccctccaaggagatggaaacattcactttacaaacgacctactacatacaatcggccggcggaaaatataaatataaaggtagggtagggtgagacccctatccttaacaatcaaaccagatggatttctatgtagcgaacttcttattagatgccaggagaaaatatgttatattctacccacaccgagactgattgttgttcgtttgtagaaaaagacaaccagccacaaaaaaaaagagtgtgttgttgttgtcccaccaccatcgatggtgcagaggtcccccccaccgagacggcggagcccccaccaaattcttttgtttttgttgggtggaatacgaaacacacaatgcaactggtactgcaacatgtgtctgaattgtaacatctcgatgtggcggaccacataatacaacacattttgtgtttgcacgacggcacacaaactgagtttggtgttgtataatagcagacctcaatgcattggttctgtcaacacaacacacttgtgtttttttggtgtagaaaagaaactcctgggc

SEQ ID NO: 576934 - DNA, 103 bp, Homo sapiens
accatactactgctacattaacatgcgattttaagaccctcattttttcctgagaactctttggtttccttctaagtaggttcggataggcagtgtatcaata

SEQ ID NO: 576935 - DNA, 881 bp, Homo sapiens
  misc_feature (103)..(103): n is a, c, g, or t
  misc_feature (612)..(612): n is a, c, g, or t
attgacgggcaccggctggcgcgcctggaggccgagggcgctaggcgcctcacgctgctgcgctcactcagcctgcaggacacgagctggcggcactcgcgcnggggctgctgggccgcctgcccgctctagacgcgctgcacctgcgcggcaacccttggggctgcgggtgcgcgctgcgcccgctctgcgcctggctgcgccggcacccgctgcccgcgtcagaggccgagacggtgctctgcgtgtggccgggacgcctgacgctcagccccctgactgccttttccgacgccgcctttagccattgcgcgcagccgctcgccctgcgggacctggccgtggtttacacgctcgggccggcctccttcctcgtcagcctggcttcctgcctggcgctgggctctgggctcaccgcctgccgtgcgcgccgccgccgcctccgcaccgccgccctccgcccgccgagaccgccagacccgaaccccgatcccgacccccacggctgtgcctcgcccgcggacccggggagccccgccgctgccgcccaagcctgagcggccgcggccgcctggagcgctcgaagcttcccccatgcctttgccctccctntacactgtctgccggcgtcaacaagcgacacagaccgaaatataaatatgaaaaacttgagttttctgttctgttattttctaagtttttaaaccttttcatttgctattaaaattgtgctttccattaattaaattctttggaaccaaacttggatttacctctttccactggtggcccacccaacttcttccaccccatgttttccttaacccatggcaggtctttccttccctggccgcccgtagttagacgcatgggatggcccg

SEQ ID NO: 576936 - DNA, 669 bp, Homo sapiens
  misc_feature (103)..(103): n is a, c, g, or t
attgacgggcaccggctggcgcgcctggaggccgagggcgctaggcgcctcacgctgctgcgctcactcagcctgcaggacacgagctggcggcactcgcgcnggggctgctgggccgcctgcccgctctagacgcgctgcacctgcgcggcaacccttggggctgcgggtgcgcgctgcgcccgctctgcgcctggctgcgccggcacccgctgcccgcgtcagaggccgagacggtgctctgcgtgtggccgggacgcctgacgctcagccccctgactgccttttccgacgccgcctttagccattgcgcgcagccgctcgccctgcgggacctggccgtggtttacacgctcgggccggcctccttcctcgtcagcctggcttcctgcctggcgctgggctctgggctcaccgcctgccgtgcgcgccgccgccgcctccgcaccgccgccctccgcccgccgagaccgccagacccgaaccccgatcccgacccccacggctgtgcctcgcccgcggacccggggagccccgccgctgccgcccaagcctgagcggccgcggccgcctggagcgctcgaagcttcccccatgccttgacgatcatttacactcgatgtctgtgtatgcgcgacacacagcgaggtccgacatgccattgtgttt

SEQ ID NO: 576937 - DNA, 787 bp, Homo sapiens
  misc_feature (518)..(518): n is a, c, g, or t
ggccctgggcctcacatatttgtcccttctgctcatccctgctgcaggtgcctcctcctggcccccgcactccactcccagccatggctccccttccccagtgaaacatgcccgagacaagtggacaacagaggccgagacggtgctctgcgtgtggccgggacgcctgacgctcagccccctgactgccttttccgacgccgcctttagccattgcgcgcagccgctcgccctgcgggacctggccgtggtttacacgctcgggccggcctccttcctcgtcagcctggcttcctgcctggcgctgggctctgggctcaccgcctgccgtgcgcgccgccgccgcctccgcaccgccgccctccgcccgccgagaccgccagacccgaaccccgatcccgacccccacggctgtgcctcgcccgcggacccggggagccccgccgctgccgcccaagcctgagcggccgcggccgcctggagcgctcgaagcttcccccatgcctttgccctccctntacactgtctgccggcgtcaacaagcgacacagaccgaaatataaatatgaaaaacttgagttttctgttctgttattttctaagtttttaaaccttttcatttgctattaaaattgtgctttccattaattaaattctttggaaccaaacttggatttacctctttccactggtggcccacccaacttcttccaccccatgttttccttaacccatggcaggtctttccttccctggccgcccgtagttagacgcatgggatggcccg

SEQ ID NO: 576938 - DNA, 136 bp, Homo sapiens
ccctcacttaagagttgtgactccgaattcagaaatctcatgttttagaaaaacaattctaactatgttgcaagactgacagttgatgtttatttgccacagatcaaaggttcacaaagtatatcaaatttacatc

SEQ ID NO: 576939 - DNA, 299 bp, Homo sapiens
  misc_feature (145)..(145): n is a, c, g, or t
  misc_feature (184)..(184): n is a, c, g, or t
  misc_feature (213)..(213): n is a, c, g, or t
  misc_feature (239)..(239): n is a, c, g, or t
  misc_feature (244)..(244): n is a, c, g, or t
  misc_feature (278)..(279): n is a, c, g, or t
ggtgcagctgctttgaaaaatgacttggcagcacctcaaaatgttaaacagagttaccacatgacccagtaatttcacacttaaggatatactcaagagaaatgaaaactaaaaacatacggctacccaaaaacttacataagantgttcacagcaacattattcataataaccaaaatatggnaacaaccacaatgtccatcaattgataantgggtaaagtctggcaaactcacagnatggnatattatttggtggtaaaaaggagtaaagaactnntatgtactacaacatgggtg

SEQ ID NO: 576940 - DNA, 120 bp, Homo sapiens
caaagcgagatctgccgggggacggggccccccatgctgtcggggcccagtgctgctgtcctgcaaagagcgcacaatgaagtacatgcagcgccgatgagtgtccatggccaagcgcca

SEQ ID NO: 576941 - DNA, 462 bp, Homo sapiens
  misc_feature (169)..(169): n is a, c, g, or t
  misc_feature (171)..(171): n is a, c, g, or t
  misc_feature (174)..(174): n is a, c, g, or t
  misc_feature (184)..(184): n is a, c, g, or t
  misc_feature (192)..(192): n is a, c, g, or t
ctcatgcctgcacccctgctgctcttcctgttccttgtcagtgtcagccgttgttttgaaagagacacaatgggaccccagtctattgcttcttaagctggggcagagtttatgttttgtctgaatggctgcctccttattcttcagagggcccaataaaatatgttananacnacacgggtgngtaaaatngctgagggaagaaacacaattattgggcaatgtttcttgggagtttcaggatgataaagcagagtttggaaataagactgtgtgaactatcgagtagctgtatcagtttgtggaattaatttactgaggaggttagctgccagttttccgcacacacacacacacaaaaagcccaaattagttccattattttttaacatgtgctaagtgcccatagcatgttggtgccttcacatgatatcagaatgcactatggagggaactgaactt

SEQ ID NO: 576942 - DNA, 197 bp, Homo sapiens
atcgccatgcacgcattgtgccttcacagcagatgctcgcagcagctagttaatcagccccagactcattcctgtcaattccagccccatcccttccattatccccatcaaggcacatcacttttcagttcacatttcaatcatctcatcagcaacacactccccaatgcacgggtgttgcatgttcacatcaaatc

SEQ ID NO: 576943 - DNA, 783 bp, Homo sapiens
  misc_feature (599)..(599): n is a, c, g, or t
acctattctctacaaaccacaaagacattggaacactatacctattattcggcgcatgagtctggagatcctaggcacagctctaagcctccttattcgagtccgagctgggccatgcacctaggcaactcttcatagagttaatctgaccactatctactaagcgtatataccgtacaacatgccctccatgacattcttgtacatcaactctattcttacatacgataactacccaatctaattaatactgagaaggctattgcgactagagctcgaatctagctttcctcgcatacagtgagactgccgggtggcactccactgaagtgacttgtgtcccgggttttcccacaccggactaatttaaaaaaccaataggccaactttcaataaaagggggcccctttttccaattcggaaaccccttccttatacaccttcacgcgtcatctccttacctccgtggcttctgcactctgctatatgtggattcgcgcaggagcatcgagaacataggttagaacaagtcatactccgtccctgttacgcgagggaacttactcgcctaaaccatgggaatgcggcatccggtacgntacctaacacccagtactttataccttttgaaaagcgcttacgacaacgcggtagttcaataccaatcctaatccctataagaagggggcccaattcacatctttatcaattctaacataaaacataacgttttaaattcaaaattaactttaaaatgtccccccaccccttgaccctaattaa

SEQ ID NO: 576944 - DNA, 118 bp, Homo sapiens
tttgattcaacacaccacaatactatggctgatcagtctagagctaatgtgatcgtggggttgtaaacacaccacaatactatgtttcgttctgtcctctgtgatcgtggggttgtaa

SEQ ID NO: 576945 - DNA, 744 bp, Homo sapiens
actcgcccggctgggagagctgggtgtggggaacatggccagggctaccgaggctacctagctgctgcccctgcttctaggcgctggctcgcggcctgcctggggccctggctgcccaagaggtgcagcagtactccccactgcacgactgtccccgtgggagcctccgtcaacatacacctgctaccaccagcgggggcctgcgtgggatactacctagaggcagctacgggccacagccccaagaacatcatattactaacgaggacggggtggtgcccactaacggacagacggttaccggggccgcatacgacttctcagggtacccaggacaacctgactatcaccatgcaccgcctgcagctagtcggacactggcacctacacctgccaggccatacacggaggtcaatgtactacggctccggcaccctggtcctggtgacagaggaacagtacccaaggatggcacagatagctcggacgccccaccaagggcctctgccctaccctgccccaccgacaggctccgccctaccctgacccccgcagacagacctctgccctacccttgacccgccaggcagcctctgccctccctgcggccctggcgggtgatctccttcctcctcggggctgggcctgagggtggagtgtagtactggcgaggaccagataagaactgggctcggggcgataaaatcggggcattttgttacgagcctttgaccagcgtgaaag

SEQ ID NO: 576946 - DNA, 727 bp, Homo sapiens
gccaacttacacttaggagatttcaacttaacttgaccgctctgagctaaacctaggccccaaacccactccagcttactaccagacaagcgcttagccaagaccatttacccagaataatagtataggcgatagaaattgaagacctggcgcaatagatatagtaccggcgagggaaagatgaagaaattatagccaagcataatatagcaagggactaaccccgtataccttcgtgcataagtgaattaactagaatataactgtttgcaaggagagccaaagcgtacagacccccgagaagccagacgagctacctaagaacagcgtaaagagagcacacccgtctatgtagcaaaataggtgggaagatttataggtagaggcgacaaacctaccgagcctggtgatacgctggttagtccatggatacgaatcttagttcaagcgtttagaattgtggcccacagaatcctctaagtcccctgtgtgaattctaactgtgtagtccaaagacggaacagctctctggacacataggaaaaaaccttgttcgagagacgtaatcaaatttaacgacccatagttaggcctaaaagcagccaccaatttacgaaagcgttcaagctcaagacccacctacgctagatgaaatcccataacatataacctgaactcctcgacatccgaatttggaccaattctatcaggcctatagaatgaacta

SEQ ID NO: 576947 - DNA, 141 bp, Homo sapiens
  misc_feature (32)..(32): n is a, c, g, or t
  misc_feature (40)..(40): n is a, c, g, or t
  misc_feature (68)..(68): n is a, c, g, or t
  misc_feature (104)..(104): n is a, c, g, or t
  misc_feature (117)..(117): n is a, c, g, or t
tgctgcccggacgcggagcgagaggctgaaanagtcgganacactatccgcttccatccgtcgcgcanaccctgccggagccgctgccgctatggatgatcganaggatctggtgtnccaggcgaagctggccgagcaggc

SEQ ID NO: 576948 - DNA, 188 bp, Homo sapiens
tggatgcctgaggtcgacctctacacggactccccgggacgtgggacgacgaacagaccgacacgaccgactgactgacctacagcacgtacctctgacactggacccaccacgtgtttgcacactactttgcaactttatttgcttgttttggaacgtgtactcactacaacccacgacacacacgt

SEQ ID NO: 576949 - DNA, 276 bp, Homo sapiens
gactgattagactctaaacggaactgaattaataggaaataacacggtactatagttgtcctatggtgcccctatgggtgatgggttccaagaaccccctaggatactaaagtccatgatgttcaagtcccttatagaaaatggtgtagtatttgcatataacctgtgcacatcctaccatacactttaaatcatctctagattacctataatagctaatacaatgtaaatgcttggtaaatagttgttatactatattgtgtctaaatgcaatca

SEQ ID NO: 576950 - DNA, 310 bp, Homo sapiens
ggtcgaccgagttcctctgaccgcccaagggaggcatcaggcctggcgcacgaatgcgtcggagccggctgcctgccacaggctgcttccacttttctgttcggagccggctgcctgccacaggctgcttccacttctctgagcaggtgtccatcttttgtgcagccccgtccccaccccaggcacagggactgtggaaggaaggccctccccaaacccctggtctttcctccagcctccttcaaacaccagggccaggaggagggcacccaccaccacctgtgcccactcacacgcgcttctttcagaa

SEQ ID NO: 576951 - DNA, 1244 bp, Homo sapiens
tatagtgtgaacgatctaataatactctgctgctggtggcccatatcgttatctatgtcactcagtataatgtgggaacttggcgattatcgtcattactggtaaatgcttgttcgttcattctgtctggtctgttcaatgtgttaattaatgatcgaccggcgtattctttcgtggtaattacttattttagataacacgaccttatggtcgatgtgataatactattgtctgtgatgtgcttcctgaatcgtgctttaatccttgggtgtgtctatattcgtcctcgtgcgtgttctctatgtctgtgtatgaaagtgtttgtgtatttggtatcagggatattggttgtctacgattctttgtctttgtgaattttctctccctatggtattatttgcatctgctctattgtattctccgtttactctgtgcgtgctcttggactctctcgctaccttgtctctttctttttatacgcgttttacacatcgttttctccaccgtttgtagctatgtacgtctttatacgtggcccgcgtctctgttgattcctctgaggtttgcaaccgcgtgctcatgctttgccccggttcttccagtatattccgttaaatccgtggcgtctactctttcgtatgtctagtatgttaggctctcgtctccgtccccctaccgttggtctagttgcctacctcgtctagattgtacatctgcgtctctctctacctacctcttaccctcatacctatgtagatatttgcttacagtgtggtaggaaaataagtataccttaatacttccaaggccctgctttttgttcttaaatagttactttaaaataggaaatttgtttgtattttttatttacatttgatatttttgtacatattgttagggtcagccatgttcttaatgatctcggatgacctatagccagccttcggagcgttctctgtcctacttctgactttacttgtggtgtgaccatgttcattataatctcaaaggagataaattaaaccttgtaaaaaaagcataaaatgactaacagaaaacaatcttattccgagcattccagtaacttttttgtgtatgtacttagctgtactataagtagattggtttgtatgagatggttaaaaaggcctaaagataaaaggtttcatttatataatcattttttagtcatatgaagttgctgtttattttttttggcttaatatgatggatgtgtgaaacaa

SEQ ID NO: 576952 - DNA, 248 bp, Homo sapiens
acagagactccaccgtgcccgccactgtcacacccacatgcgtcgcgcatcgcagggctcgtacctagtggcacggtggtatacctatgctgtggcaaggtggcaaggtctggctgttgatgacgctgcacttgcgctcggcccaggagcgccggaaggcattgagactgcaggggtctgtcacgaagctcacgtccccgcacagcgggctctccttccacgagttcaggaactccagctcgctggat

SEQ ID NO: 576953 - DNA, 857 bp, Homo sapiens
  misc_feature (541)..(541): n is a, c, g, or t
  misc_feature (619)..(619): n is a, c, g, or t
gccaatccctggagagcaagtaccaaaaggagcagctactacatccatgatgtagttagacatgccacataagtcttggcactctaaaaaagggcttatggcagcagccaagaatcatcagacgggagggtaaagggcaaaactctgcctgcagaagcaatgctggtgcttccagaaatggggtggggagcctgacaaatccagagtatacgcttccagagaacaaggagccaacttaccatttattcacaaaatcttgaaattccagactgaacactccactgggcagttttggaggaggctgcaaacacatgttgagataagaaaaatgcctggctccttgctccagccatctcctctccccatcccacccctcccaccagccagtgctacttttttttaaagtcttctctgcagtccaaaggcagtactactctcatccagtcaaggaaaggcacaggtagaaggccagtgctgcctgttgggtaaccatgttggaaccactgatctcaaatagcacatttagaattgggaccagtcnagtccactcacttgtcgggtgattttgaactaatcactattcctctatgagcctcagttactcttctatgactgagangttgggcctaatgatctcagggaccctttcaagctctgacactctacaatggtaaatcttggagtgcggcatgggaacgtaaccagcaatttactggcagcaacagctaggggcacgtgcaaaccaccaggcatagcccaggtctgacagcacctgcagaagcaaaccggtttttaaaaatcccttttctgagccctagagaagcagtgaaaagttaataaaacattaactggcaaaa

SEQ ID NO: 576954 - DNA, 335 bp, Homo sapiens
ttctagaggatccctgcaagaggcgttagtgcagaggcggggttacagtttttcttgttttttttttaaaaaagaggggggttggagtgtaccaatccggatccaaaacggaaagggaagacagttcccccctaaaatacttagaggggtttctcagagtcctttcccataaagggaatataatggaaccacatctcagtaaggtgagatgagatggctaaaatacttacagaacataaaaaaacagctaaaacaaagctcagtaaactctctcaccctcctatggatcccggtgggtggcggctcttttttcccataaacgcctcggcggggat

SEQ ID NO: 576955 - DNA, 356 bp, Homo sapiens
atatagcagtgtgagaacagaataatacagaaaattggtagagaggagtgagggattgctagaaagatacctgaaaatgtggaaacagcagtggaactgggaaatagacagaggttgggagagtgtggagggctccgaagataggaagataaggggaagtttggaatttcttagagatttgttaaattgttttgaccaaaatactgatagtgatgtggaccatgaagtccaggctgagggggtctcagatggagattagggacttattgggacctggagtgaaggtcccttttgttaggacattgtggttggagaacttgtgcccctgccctaggaatctgtggaactttgaactt

SEQ ID NO: 576956 - DNA, 694 bp, Homo sapiens
  misc_feature (5)..(5): n is a, c, g, or t
  misc_feature (24)..(24): n is a, c, g, or t
  misc_feature (40)..(40): n is a, c, g, or t
  misc_feature (45)..(45): n is a, c, g, or t
  misc_feature (124)..(124): n is a, c, g, or t
  misc_feature (274)..(274): n is a, c, g, or t
  misc_feature (287)..(287): n is a, c, g, or t
cccgnctgagcttcccaaagtgcngggttataagcgtgancactncacccagccccacggcttcttactgcactcagaataaaatccaaatgaattagtatagcctacagagtgtcaataatcngggcctaatcacccattgcatcatcctttactgtgctccacccatgctggcgtcctttctgtttattgagtgcagcaagctttaacctgttcgggtctttcatttgcagtttaccctgaatattccctttctcttacctcacctttgatnggcgttttccccnttgcagacctgcactctggcatcctctcctgagcaagccttctttgattgctgcctcccaaacctgtttctccccatttctctagctcattggcctgtgttacttgcttcatagtgctcactactatctgaaatcatttcattacttgatttatgtttgtactgtctatttctgtctttagaattaaaactccttgagggcaaggactttgcttctctggttcatggtgggatcctcatcacccagcacaagcccaacacttaggagaggctcagctagtttgaaccaatggaaaatgccattcctgaggtgcaccacatcgtttcttttgtgttggtgtgcatgctgaccttcagtttgtctcctcttcccacaccctgtcatgtgctcctaaaactcccccttta

SEQ ID NO: 576957 - DNA, 355 bp, Homo sapiens
gttctcatttttcttccctgagtaggaaggggttaattacaataagtctacagagatattgtgaagcattttacaaaagatcattcagataaagcgcttaacacaatctgtgaaacatagtcagtgttcaataaatgttatttattgtttttgttattagtattgttgcatcatcatcatttttattgagtctattaaacagcctcaagcaagcaaaggagacacactttgtcaggctgaattttaatttcaatgtcacaggggcacagcattaagcaagctactgacatcatcaacatcaggcagtagtttctaagtgttgaaataatttcaaaaatggatgagggccaatgca

SEQ ID NO: 576958 - DNA, 1408 bp, Homo sapiens
aggcatcggagctccgggccactcagacatcatgagttggtcacttgcacccccggaatttaattctctacttctatgctctttaataactctcttcaaccatgtgtcagcgatcatgttggctacccagcagcacaactagctgcatcttcagcatgcaaagcattccggtcagtatattggtcccaactcacctgtggccattggccagcattatcctggtctaccttaatcaacaccaaacgataagcaccaagcgactctacagatcattgtggcaagcaccatctgtacagtcaacgctctgcacacacgcaaaaacatcagcaagtcaacaccagcgtgactaacaagccaattcccgaacatccacattcattaagtccgtgcatgcacatccatcaacaaaccaacatcattgcatcagcacgcatggctcacgcttgcaacgtcccaggcacacactggtaacgcaagcaagagttatgcaacatcatgcacagccatccggacaatgatacacccacacagtgcacgtctcacagggtaattaccgacctcttatctggcgacgcgaacacattcatcttcaacgtctccaccccatacaagttctacacacgccgcacgccgcacacacctcggacgaccccgtaggaaagaaactacgccacccatggcacgtcaaggccccacccaacgcgcctcgacccattgccccaccaaaaatgcccaccacaaaagacagcatagaacacataggggaggaaaagaacacaaccggaacaagagaacatctactggcacacacctatggcaggggcaactgcaacatgcaaccaaccaggaacacgaaacaacacagaaaaacacaacagccgccccacccacacactaagacgacgtgccacagcgcaaacagaccaaccgataaaccaggaacacacaccaccgaacgaaacatgcaaaaccaccagaaagcagcaaacctcacagagcagacccaagcacacaaaggacaactatcagacacctaggaacgaattcaacatagaacaaacacccagcacagacagccacagcacacacactgaacacagcgcagtagccactactcatgccacacgggagatgaacacatcacgacagcacacaaccagagacaacaccggttaaagagacaacggcccaccacgcagcggccacgagtgggcacaaacaccaacaaccacacaagacaaacagcgacgaccaaggcggcaagtaccagcctgacgcgaccatctaagaggggcaacagatcgaaccgaccaggaagcacaccaaaacagactgaacaacatcaaacaagacaagcaacagacaagcaatagagaagaccacacacaaccaacgacaggcagacaca

SEQ ID NO: 576959 - DNA, 107 bp, Homo sapiens
cagcttgttccactggggacctctgccgtgggccacttacagcttcctttcagtcgccttcgcttacttcttctttgtccgcaaaatggaagtgattcgccccagct

SEQ ID NO: 576960 - DNA, 952 bp, Homo sapiens
  misc_feature (388)..(388): n is a, c, g, or t
  misc_feature (408)..(408): n is a, c, g, or t
  misc_feature (454)..(454): n is a, c, g, or t
  misc_feature (473)..(473): n is a, c, g, or t
  misc_feature (477)..(477): n is a, c, g, or t
  misc_feature (480)..(480): n is a, c, g, or t
  misc_feature (487)..(487): n is a, c, g, or t
  misc_feature (521)..(521): n is a, c, g, or t
  misc_feature (523)..(523): n is a, c, g, or t
  misc_feature (527)..(527): n is a, c, g, or t
  misc_feature (538)..(538): n is a, c, g, or t
  misc_feature (589)..(589): n is a, c, g, or t
  misc_feature (606)..(606): n is a, c, g, or t
  misc_feature (668)..(668): n is a, c, g, or t
  misc_feature (675)..(676): n is a, c, g, or t
  misc_feature (684)..(684): n is a, c, g, or t
gaggttacagtagggtaccttggctttccagcccactagtaggttgcgtcttctcatccaggagctcacgcgtgcccacaacggagatttctgggtagtttcgcaccctatctaaggttgattcgacccgaactcctaattcccgcaatctctggattgcaaacggctgttcgaaattggaacgtctgggaagtgcattcacaggcagatattatccgtggtcagttgggaggagggaagagtcgcaaaatctgacagctctgtgctgacctctaacgacacactgatccatcactgcaggcggtcatcttctgcaacaccaagaatgaaaggtggtactgggctgacggagacaaactgacgggaagccaacttcactgtatcctcnatgcatggagacatgccccnagaaagagcgggagtccatcatgaaggagttccggtcgggcgccanccgagtgcttatttctacnagangtntgggccngggggttggatgtccctcaggtgtccctcatcantnactnatgatctccgntaataacagagaattgtacatacacagaattgggagatcaggtcgatacgnccggaagggtgtggccnttaactttgtaaagaatgacgacatccgcatcctcagagatatcgagcagtactattccacntcagatnngatgagangccgatgaacgcttgctgatcttatctgaagcagcagatcagtgggatgagggagactgttcacctgctgtgtactcctgtttggaagtatttagatccagattctacttaatggggtttatatggactttcttctcataaatggcctgccgtctcccttcctttgaagaggatatggggattctgctctcttttcttatttacatgtaaataatacattgttctaagtctttttcattaaaaatttaaacttttcccataaactcta

SEQ ID NO: 576961 - DNA, 898 bp, Homo sapiens
  misc_feature (514)..(514): n is a, c, g, or t
gtaatatataacctaccaaccgaaaaaagctcaggatctgatggattcacaactgaattctaccagacgtacaaagaaaagctggtaccattcctactgaaaccctttcaaaaaattgaggaggatggactcttccccagttcattctatgaggccagcatcatcctgatactgaaaactgtcagagacataagaacaaaagaaaacttcaggccaatatccttgatgaacgctgatgcaaaaatcatcaaaatacatggaaaccaaatccaataacatgtcaaaaagctaatctaccacagtcaagtaggtttcatccctgggaggcaaaggtgtggtcaacatatgcaattcaataaatgtgattcatcacataaacagaattaaagacaaaaacacatttatctcaatagatgcagaaaaggctttcgataaaactcaataccccttcatgttaaaaactctgaataaactaggtatggaaggaaaacctcaaaataatagcatctatganaaaccatagcaaatcatactgaatgggcaaaagctggtagcatttccttgaaaaattggcacagggaaaggatgtcctctctcaacatcctattcaacatggtatgggaagtcatagtagagcatcagggaagagaggatcccaaataggaagagagggaagtcaggtatccctgttggtaggatgatctgtagaaacccctagttaagccaaagtctttaatgtacaattcgcaattcgggtcaactcatggggaattcgtttttccacagagaggggcaagagggcctcatgcgaaaaacagcaaagacggggggattgttggaagggaaaaaaaggggggggatggggggtcttttccgtaccctgcgtcaaacattcatc

SEQ ID NO: 576962 - DNA, 104 bp, Homo sapiens
ggaggaagctcgaggtctcctgggcaagaattatacctggggagggctgagagaggagaggaggcagatctcgggctgtggtcaggttgtgatgggcctgaacc

SEQ ID NO: 576963 - DNA, 549 bp, Homo sapiens
cgtgattcgccgcattctcgtgggacaatttttgtctctagggcccgcacatagttccggcggccactttgttcctggtgacacccaggccgcttgcttgggagcctcttcgaagtgcgggattgcccaccgcgcgagtgggggaatctcttccggcggttcggtcggcccccctctgtgtgtgaatagttaaatatgagcacttccgcacagggagacgtttgtggcactctactcagaggtggctgtcgcgccccactagtagcgtctatgacaccaacagtcgccttttctccggcagtctgttttactcgctaaccctaattttcttctcacgccgtacacctgtcgcctggggagtatacaaaccggcgaactacaaagcttcttagaactttcttggaggacacgaaaacaaccgattactgagccgccatgtcttccttaaaatgttaattctcgcctcttcataattattcgggaaaaatggacgccctcgtttgttccccttatcagctcgccccccttcccccttttggccccaaaaca

SEQ ID NO: 576964 - DNA, 599 bp, Homo sapiens
  misc_feature (21)..(21): n is a, c, g, or t
  misc_feature (74)..(74): n is a, c, g, or t
  misc_feature (84)..(84): n is a, c, g, or t
  misc_feature (95)..(95): n is a, c, g, or t
  misc_feature (129)..(131): n is a, c, g, or t
  misc_feature (135)..(137): n is a, c, g, or t
  misc_feature (140)..(140): n is a, c, g, or t
  misc_feature (142)..(142): n is a, c, g, or t
  misc_feature (148)..(148): n is a, c, g, or t
  misc_feature (152)..(152): n is a, c, g, or t
  misc_feature (166)..(166): n is a, c, g, or t
  misc_feature (169)..(170): n is a, c, g, or t
  misc_feature (174)..(174): n is a, c, g, or t
  misc_feature (176)..(176): n is a, c, g, or t
  misc_feature (191)..(191): n is a, c, g, or t
  misc_feature (203)..(203): n is a, c, g, or t
  misc_feature (207)..(207): n is a, c, g, or t
  misc_feature (220)..(220): n is a, c, g, or t
  misc_feature (230)..(231): n is a, c, g, or t
  misc_feature (242)..(242): n is a, c, g, or t
  misc_feature (252)..(252): n is a, c, g, or t
  misc_feature (259)..(259): n is a, c, g, or t
  misc_feature (262)..(262): n is a, c, g, or t
  misc_feature (277)..(277): n is a, c, g, or t
  misc_feature (281)..(281): n is a, c, g, or t
  misc_feature (303)..(303): n is a, c, g, or t
  misc_feature (315)..(317): n is a, c, g, or t
  misc_feature (319)..(320): n is a, c, g, or t
  misc_feature (326)..(326): n is a, c, g, or t
  misc_feature (336)..(336): n is a, c, g, or t
  misc_feature (355)..(355): n is a, c, g, or t
  misc_feature (365)..(365): n is a, c, g, or t
  misc_feature (367)..(367): n is a, c, g, or t
  misc_feature (372)..(372): n is a, c, g, or t
  misc_feature (374)..(374): n is a, c, g, or t
  misc_feature (378)..(378): n is a, c, g, or t
  misc_feature (380)..(380): n is a, c, g, or t
  misc_feature (382)..(382): n is a, c, g, or t
  misc_feature (384)..(384): n is a, c, g, or t
  misc_feature (386)..(387): n is a, c, g, or t
  misc_feature (390)..(392): n is a, c, g, or t
  misc_feature (398)..(399): n is a, c, g, or t
  misc_feature (406)..(406): n is a, c, g, or t
  misc_feature (411)..(411): n is a, c, g, or t
  misc_feature (434)..(434): n is a, c, g, or t
  misc_feature (439)..(439): n is a, c, g, or t
  misc_feature (455)..(455): n is a, c, g, or t
  misc_feature (466)..(466): n is a, c, g, or t
  misc_feature (476)..(476): n is a, c, g, or t
  misc_feature (487)..(487): n is a, c, g, or t
  misc_feature (520)..(520): n is a, c, g, or t
  misc_feature (527)..(527): n is a, c, g, or t
  misc_feature (533)..(533): n is a, c, g, or t
  misc_feature (535)..(535): n is a, c, g, or t
  misc_feature (539)..(539): n is a, c, g, or t
tggaaaaattccaaaatatanagacgcttcttttctcataaaaataaattattttttataataaaaaaaaaacnaaaaacaagnttaaacaaggnttaaaagcaacaagcccgtaggaaaatctttaannnattnnncangncccggntganaataacacgtgganaanntcantnccgtgtacacacgcnttcagccatgtntaanccgattgcctcancttccccccnnggccgcgcgcnggggcttggngaggggnagngggagaagcagagantttnttatttatttgtttaaatagtngttttttttttnnntnntattangggggggggnccatttgtttgtggggttngtttggttananatttngntatntntntntnnttnnntttttnnttttttnttttnttttttgttttgttaagttttcnagtgntaaattttttttgggncggggggggtnggggggaggnggggggttggnttctttttggagttttagttctggttggtttgnggatgtntgttgngnttgngttagagtggggggagggggtgagttgggggtgggggagctggttgataaagttcgggag

SEQ ID NO: 576965 - DNA, 433 bp, Homo sapiens
  misc_feature (302)..(302): n is a, c, g, or t
  misc_feature (305)..(305): n is a, c, g, or t
  misc_feature (369)..(369): n is a, c, g, or t
  misc_feature (383)..(383): n is a, c, g, or t
  misc_feature (394)..(394): n is a, c, g, or t
  misc_feature (409)..(409): n is a, c, g, or t
  misc_feature (422)..(422): n is a, c, g, or t
ggcacgagctaataaagcattcttttttttcttggagacggaatctcattctgtcatccaggctggagtgcagtggcgccatctcagctcactgcagcctctgcctcccgggttcaagcaattctactgcctcagcctcctgagtagctgggattataggcgcctaccaccacgcccggctaattttttgtatttttagtagagacagggtttttaacatgttgaccagcttggtcttgaactcatgacctcaggtgatccacccgcctcggcctcctgaagtgctgggattcaggcgtganacncggcgcccagcccactaataaggacattccttttctttaatttgctatcttgttcttcatcaanctgttccctagccnttcttattaantttgtggcagacaantcccaagttggcnttcagttcaca

SEQ ID NO: 576966 - DNA, 139 bp, Homo sapiens
ggtattctgagctcgaattcatcgatgggatagtccggcacactacttccggccacggccggacacgtaccaaatcaagtctatatgaaaagtgcatatgctatctgctgcacgcgtccggccactacgtgtccggcca

SEQ ID NO: 576967 - DNA, 644 bp, Homo sapiens
  misc_feature (560)..(560): n is a, c, g, or t
tactgctcgaagcagtcatgtacgagaacgcggtactccacattccatcgcataacggggttccagcccgcaaactgctcagcttgttgcctgagcgaacgccataccttgctcatgtggcctcatgaatttcagaatcaaggagatgatgagttaatgtggcacgtagttccacaacagtatagcttaaggttccttaagcattaggtaagaatagcttaccaaaaggaggaacctacccaagccttacgctgatgagtaattttgaagcattaaggatgtgaggtgccgcagcgctgttggcgctgatggaaaattgacccaccctgccgattgaaatttgacccagggcggattgctgattttgttaccagcaactgtggataagtctaccagcgcagttgctgttgcccccactccttcgctagcccagttcagttgtttaagacctgccacacgcagccatgtagcaggccgtcgtcgccatgaaatcagaacggctcatcgtcctccggttcttggccgcccttacgctttcgctcccgtgatttgatcttggnctgggccgccaagctactgtgttgcaggcgataggactcgttaccggttcgacgatgtggagtggtggtcagccgatcagcagg

SEQ ID NO: 576968 - DNA, 182 bp, Homo sapiens
aatttttttttcccccggggggaataaaaaaaaaacccccccctttttttaaaggggggaattctggcccccgggggggcccgatcccccggcttttttaaaaaattaactaaggggtttcccccgtttttttttttaagcggggtggtttataacccggccccgcttcccaatttgaatta

SEQ ID NO: 576969 - DNA, 102 bp, Homo sapiens
tagtcggacgagtataacaggcaaaggaagctaaagatgaccagaatctgaagtgaaacggactgggtgggaataccagctctgccggtccgacttaacttg

SEQ ID NO: 576970 - DNA, 149 bp, Homo sapiens
  misc_feature (1)..(1): n is a, c, g, or t
nctgttgactcttgctgatggagcttctctgaagggcaaattcaaagtacaagctgggtgctgcagcactggtttgcgaactcgtggctgtggttatgaaggagcctcggcagctatgcctttagcccctggtgaagcagtgtcagtca

SEQ ID NO: 576971 - DNA, 194 bp, Homo sapiens
gaggagcaatgatcttgatcttcattgtgctgggtgccagtgacagtgacctatcttctgcatactgtcggcaatgccagtgatacatggatggtgcctgccagacagcactgtgtatggcgtacaggtctattgcggatgtccacgtcacacttcatgatggagttgaaggtagttacgtggatgccacagga

SEQ ID NO: 576972 - DNA, 150 bp, Homo sapiens
cgtcagaccggccagtgtggcagactatgaagaaactgtaaagaaagcaagagaagcatggaacatctgggcagatttcctgctccaaaacgaggagaaatagtaagacagattggcagatgccttgcggggccagcaagatcccaagta

SEQ ID NO: 576973 - DNA, 170 bp, Homo sapiens
ggacagttacacatacctaaatagtagggtatgccttccagtatttcataactgatctgcatcagttgtaaaggggaactggtatattcacagactgtagactttcagacagtcagtctcatgaagcttacaacagtagattatccatgaacgatattctgtcttcagca

SEQ ID NO: 576974 - DNA, 787 bp, Homo sapiens
tgattttttttttttggatacttgcctaacatggctttgtgctggtaaaaatagttaacaggggaaataacttgagatagtgggctagctttggtttaatggtcttatgaaattttcatggaacaatccaaggcataattggttaaagaacacgtgtattcaacatccattgtaatgtggacataaaagttttaatgaatggcacttttcaactacactttctctaacagctttccatgtaaattaagtctgggtcctgaaacttctctaagaggaaatggtcacatttttggaaatttatcccttaattccctcttggcagctaaaggggctcttaccaagttttaaacacaaaattatatcataacaaaatttactactaattataactacggtttccagtgtcccatgatccccatctcttacctccccaccctgaaaaaaattgagttcctattttttttctggagacaggggggcgatccgcattagacaaacactgtcgtgtgtcccatttaacacatcttgggcatatggcattatctacacttagcgaagcccacaaagtgtcctgtggcccaatcagtgacatggcggtagcattaaccggtaacgttatggggcttccaaattcaccttatagggttttttaaagaatttcctggaatactcttaatagccatggtgttcacatttagatcccttagtcctcgtctattttggcaagtttgcccaagattaccttcgtgattaagcctctggcttgtaaccaaccattctatttgcg

SEQ ID NO: 576975 - DNA, 658 bp, Homo sapiens
  misc_feature (53)..(53): n is a, c, g, or t
  misc_feature (92)..(92): n is a, c, g, or t
  misc_feature (95)..(96): n is a, c, g, or t
  misc_feature (114)..(114): n is a, c, g, or t
  misc_feature (122)..(122): n is a, c, g, or t
  misc_feature (128)..(128): n is a, c, g, or t
  misc_feature (134)..(135): n is a, c, g, or t
  misc_feature (158)..(158): n is a, c, g, or t
  misc_feature (169)..(169): n is a, c, g, or t
  misc_feature (187)..(187): n is a, c, g, or t
  misc_feature (198)..(198): n is a, c, g, or t
  misc_feature (220)..(220): n is a, c, g, or t
  misc_feature (230)..(230): n is a, c, g, or t
  misc_feature (234)..(234): n is a, c, g, or t
  misc_feature (243)..(243): n is a, c, g, or t
  misc_feature (256)..(256): n is a, c, g, or t
  misc_feature (268)..(268): n is a, c, g, or t
  misc_feature (314)..(315): n is a, c, g, or t
  misc_feature (318)..(320): n is a, c, g, or t
  misc_feature (396)..(396): n is a, c, g, or t
  misc_feature (418)..(418): n is a, c, g, or t
  misc_feature (544)..(544): n is a, c, g, or t
  misc_feature (552)..(552): n is a, c, g, or t
  misc_feature (565)..(565): n is a, c, g, or t
  misc_feature (584)..(584): n is a, c, g, or t
  misc_feature (586)..(586): n is a, c, g, or t
  misc_feature (590)..(590): n is a, c, g, or t
  misc_feature (592)..(592): n is a, c, g, or t
  misc_feature (649)..(649): n is a, c, g, or t
ggcccggcgcggggcggggggggggggccgagcggccagcggcgggggaccanggcccaggaggcgcagcgcggggcccaggcagagggganggnngagggggggcgcagggcngggggggnggggcngggggnngggagagcccggggaggggcacnccgcgcccccnggggccagcggggcccgngggagggaggnagggagcggaggggccgggggngggggggggnggangcggggggnccaggggggaacnagagggaggggngaggggggggggcacagcgggagggggggctcgcgcggcgtcagcnncgnnngagaaggccaggctcctgccaagtgcaaactcagccccacggagcccggaggccggacggcacgggtgggtgcgtntgggtagagcccccgaggggcnggcccgctgggcggaaggctgcgcccggcccggtgcggggggatggagcgagcagaggtggcacgaggcgtctgcgggcgtgaatgaaccagttgttgacttgcaggatggtgagccccgtgttcngcgccacngttttcttctgcncccccgaggggtacgggtncnaaangngctggaacaaccaggctcgcatgaagttggtggccaccttgggggaagaaccccctnttcttgttt

SEQ ID NO: 576976 - DNA, 200 bp, Homo sapiens
catggcggcgactactgccaaccccgcaaatgacatcagatgtaccatcactgtggtccagcacattgcctcatggaaactcatggacctggaaattcaaggctggacggagccacttgtccagaaggcgctcttacagcgtgcgaccagtggactggaacttttgaatgaatgactggacgaacgggacacagctaaac

SEQ ID NO: 576977 - DNA, 294 bp, Homo sapiens
ctagcaagcggcagtagcctggacgggccctagatctcccggtcttcgaggcgggaggttttgcaccaccccagcccgtagcagccccccggtgactccccatcttcaaacgcattctctattctgagtaacaaagtgactggccgggacagatcaggctggattccagcggggagccacgtctctagcacagtggtctctgcatggacccgagggctgtgagaacttgggggacagtaatcaagtaatccccttatccataatgcataaacccactctcatgacatcacgcac

SEQ ID NO: 576978 - DNA, 335 bp, Homo sapiens
ggcgggatcccggcgtgggcatacttggcacgtgcgctatcaggagcagctccttcctgtacgtctccaagagcttatgcgaaacctcatagaaatgggttagtaggccacgatgtggaacagcagggggtcgtttactcatcctccccactaatggtagttttctagattcacaacattcccttgagtaattgaagacagacttttccacttttcaccatgtattataggtcaacccactccaaggatggcctgctagtacctacacacagacttctccagattcctcgataatattccacgacacaccattttcttcatatttccttcgaagg

SEQ ID NO: 576979 - DNA, 156 bp, Homo sapiens
gctcgacgtcgacagcatctgtcaccccattgtacgccagggttgattcggctgatctggctggctaggcgggtgtccccttccttcctcaccgctccatgtgcgtccctcccgaagctgcggctcggtcgaagaggacgaccatccccggtcgac

SEQ ID NO: 576980 - DNA, 738 bp, Homo sapiens
  misc_feature (738)..(738): n is a, c, g, or t
tgaggtgtcagtgttcccctgctggggggtgcctcccagttaggctgctcaggggtcagaggtcaggtgtcagggacccacttgaggaggcagtctgcccgttctcagatctccagctgcgtgctgggagaaccactgctctcttcaaagctgtcagacagggacatttcagtctgcagaggttcctgctgtctttttgtttgtctgtgccctgcccccagaggtggagcctacagaggcaggcaggcctccttgagctgtggtgggctccgcccagttcgagcttccctgctgctttgtttacctaagcaagcctgggcaatggcgggcgcccctcccccagcctcgctgccgccttgcagtttgatctcagactgctgtgctagcaatcagcgagactccgtgggcgtaggaccctccaacccaggtgcgggatattatctcgtggtgcgccgttttttaagcccgttggaaaagcgcagtattcaggtgggagtgaccctattttccaggtgccgtctgtcacccctttctttgactcggaaagggaactccctgaccccttgcgcttcccaagtgagggcaatgcctcgcctgttcggccgcgcacggtgcgcgcacccactgactgtgccactgtctggcctccctagagagatgacccggtctccgatggaatggggaatcccggtctgggcgccacgggggggtgcacggggggtcctttggcattggccn

SEQ ID NO: 576981 - DNA, 263 bp, Homo sapiens
  misc_feature (28)..(28): n is a, c, g, or t
tgatctagaggatccctgagagacgttngaatcgggatgaatcttatcatgatgctaagtgaataagccagacacaaaaaatcaagatgtatcattctacctgtatgaggtactttaagtagtcaattcatagagacagaataagattgtggctgccagagaatgagggatgggggaaacgggaaattgtttaatggataccagcatttcagtttggccaagatgtaaaagtttgggagatcccattgcaacacggtctctca

SEQ ID NO: 576982 - DNA, 325 bp, Homo sapiens
acaagttcgatctaaggatccccgattctctgtggagagggtgatgctctcttgtggggtgacgctctctcgtgtggggtgacgctctctctgtgagggtgacgctctctctgtggggtgacgctctctctgtggggtgacgctctctctgtgagggtgacgctcgctcttgtggggtgacgctctctctgtggggtacgctcggggggcaggataagctgcgagcagtgtggcgctcttatacgcgccgaagatgacggtctagggtgtgtggtgtactgctgcggaggctgatggagtggaggaagccaaggtggagttgcat

SEQ ID NO: 576983 - DNA, 126 bp, Homo sapiens
cgtgatgattggtgcctgtttcctcattgtaagtctattctctgctaatcttggtgtatcagatggcttctctagaatcattctgataatacttctaattaattatatcattttatgattttcaaa

SEQ ID NO: 576984 - DNA, 334 bp, Homo sapiens
gtaccaacatggtgaaacccatctccactaaaaatacaaaaattagctgggcagtggtgggcacctgtaatcccgctacttgggaggctgaggcgggagaatggggtgaacctgggaggctgagcttgcagtgagccaagatggcgccactgcactccagcctgggggacagagcgagactccgtctcaaaaaaaaaaaaaaaaaaagaaagaaaccaaggtgtggacagtagatgggggagtattttatgggtttcccctcttctttatctggattggttaacaatttctttaaacaaacacgtatccctggtgtcatcaagacaatggtatg

SEQ ID NO: 576985 - DNA, 129 bp, Homo sapiens
ccgagatggtgccactgcactccagcctgggtgacagagcgagactccgtctcaaaaaaaaaaaagaaagggtgtctcctcatcacttatggtctcccaaagattcttatggttaccctttcccgggct

SEQ ID NO: 576986 - DNA, 427 bp, Homo sapiens
acaacacgcaccccacacagacacagagggaaggggttgggattgggacaaggttccaacaagggggggtatggcagccctctctccaaaaaaacagcttctcctactcccataagccccctttttttcccctttcccagtaagggaaacatagcgtgtttatattttatggccaaactattttgaattttgttgtccggccctcagtgccctgccctctcccttaccaggaccacagctctgttccttcggcctctggtcctctctggtcccctcctgggtttcttacgtagttgatttttcctctttagtctcccccgacctgcgcccagccccgtggcccctgcccctctcctactctctgtggcagtttcatatttgctaagacgaatttgctcattaaacattttgttgtattttactttaa

SEQ ID NO: 576987 - DNA, 1219 bp, Homo sapiens
tccggactagtgcggggacacccattaatgacgcagatgagaccctggaccttctccagcactgacctgcatggaaacaacctcttcctgtgtgtgcatgtgcatgagctgtggccacgcgctggggctggagcactccatgcaaccccaatgcccatcatagtgctgccgttctaccagtggaatggacgtttgacaccttcaatgctgccctgcaggacgatactcctgtgtgcatccatgcagctctactggtaaccccatgacggtcatgccacatgcctacccatgccatctcccacactagtgacgccacgtgctggacaggccggccatgaccaccggcctgccccgtgccatccccaagacaagacaccacccaggctgggaatgcccagaacatggcccccaagcagcccgcgcgcaaccacccaccgaccaaagcacacacgagacacaaacaagacagcggccccgacccaagaacaggaccccaaaacgactcataggagacaccagcagagccacaccagcggcaccacaagctggagcaccaatgaataaccatgagcgacacactcggtaccgctttgtactcaacgtgacaccacctagcgaaccacaggcagcattacacaaggaactaaaccaatctgttcacttggttacaaaacctaaacaccccaaagagcccataaataatgcaactaatcttgggcgacattgccaccatgtcccaccggtgcatccctccttccacactcgcttggacccgatgtgcatgccgcaccaacaaccacttggtcaagtacaaaatgtactcacttccaaccaaacatcaatctttgaccacgcgtatcaactggacatcctactcgcgcaaacacgacgaaatcctattgcatccctcggtgcatcacctataccacacggcagagcggcaccgcgaaccggcaaccagggagcaagccacacgaaaacgacacgagacaacgcccaacgaggccaaccacatgacagacgcccacaccgacccacggcacacgcgccgccacgcgccgacgcaccggcacagggcacgcaccaacaagcgaaccaacccccgcgggagacacccggatacccaaggacccactgccggcctcagacgcacccgcaccgcccgccgaaacgctgacaagcacgccccgcccccacacaggagcccgcacaggaaaca

SEQ ID NO: 576988 - DNA, 102 bp, Homo sapiens
gcagatgaacgatggtggctggaaggagaggggacaggaggacgaggctgccttctctgctccaagggaaggcacttgcagttggggatggcctggtgatgg

SEQ ID NO: 576989 - DNA, 267 bp, Homo sapiens
ttttttttgtttgttttaagttgcccggggggatttttgacttggggcccttttttccagccagcccctgccttttttgtaatattaagggccttgagttggaatggggaagggggccaagggtcattttttggggtgggggcaaaaatcaaatcagcccagggatttggttgggtttttttttttaatagggaattcctaattttttcccccaaaggggtccccctttaaatgttttaaaatttttgttttggggtttaaccccca

SEQ ID NO: 576990 - DNA, 417 bp, Homo sapiens
  misc_feature (16)..(16): n is a, c, g, or t
tctttaaaaacctagnatttctccatgccatttattccatccaggccaattgttgagtggcccactgtgtgttctgatgaagccaggaggccccgtgtgatgccaccaggtgagccaagaccagataaagtccctaccagtccaggaaggtgctatgtttagaaagccaagatggcccgtaatcccagccaatttgggaaggccaaggccaggtggatcatctgaggtcaggagttcgagaccagcctggccaacatggtgaaaccctgtctctactaaaaatacaaaaactagctgggtgtggtgccaggtgcctgtaatcccagctactttggaagctgaggcaggagattcacttgaacccagtaggcagaagatgcagtgagccgagattgcaccactgcactccagcctggg

SEQ ID NO: 576991 - DNA, 354 bp, Homo sapiens
atggaaacatgagattgagatttaaaatctataaaaaaaaaaaatttcatgctctcctctatagcggtatcagatatttagtcacagaatgggattttatgtaaattgctttatgtttggggagttggagcacggtatcttttcatcaattataaggaaaggttgaaacttctgagtacctttatagggggttctcttactatttggctcttgctagaactggtccaacccagattggtcagagatctcatattggagccacatacaggcaattcacatatttctttccctttgaaggatagacattggatgggataagggacaaggcctgttgggttcacggccttggactgg

SEQ ID NO: 576992 - DNA, 1031 bp, Homo sapiens
ttagttcttccgccgctccgccgtcgcgttgctctggccgtgtgagtccggccccgtgcctcgtgggcctgtatctggacgtcgcgaggcctgagccccccgaccccggctggtcccgctgccagtctgccgaggtctcgtggtgccttcccgcgggagctgaaggcggggtgggtcgggtcatgtcgcattgtggaggacatcgcacgccttggctggagtcatggaacgagaggctccggacgagtgtgcaaaagctgggtttttggtgtgagtaccagacgctaccactgagaccggtgtaactccatcacaatcgttcgaggcagaccgccaggacatcatcgtgcgttcactgtgctgggcatggtggccataaggagtcctagcagtgaggcctgacgatggcctacgatgcaaagcagtggatactgagactaagaaagtaccccgagtatggagacaatggccatcgtacatcaaacctggtaaaggaatgtggataaagtatcatgggtaacccactaacatatcgtactcactgagactgcgcgtggcccggaggagcacccagtgctgctgaccgaggcccccctgaatcccaagggcaacagagagaagatgactcagattatgttgagaccttcaacaccccggcatgtacgtggccatccaggcgtgctgtcctctacgcctctgggccgcacactggcattgtcatgtggcctctggagacggggtcacccacacggtgcccatctacgagggtacgccctccccaggccaatcctgtgtttggagcttggtgtctggactgaacgatactctgaagatcttcaatgagcgaggtacaggttcacccaccgaggcgagcggaactcggggcgactctaggaaggtgtgtcgtgccggttagggggtgccggcggtctcctttttgggaaggaagcgcggagccggacaccatgagcgtcgggcgagcggtcaccttctgtgattgggccagacctactcttgtgtccctaacgggg

SEQ ID NO: 576993 - DNA, 307 bp, Homo sapiens
ccccttgaaatgcgcagaaattatttgggctatttgaaatgggcacagaaacttagtagtccacatctcaaaaactgaaaagaggaagaaggatcaaggcatgttatgagcaaattaaatcttcatcttgcacatatcacaattcaagagataaagtccatagttggttattctaaaaatagtaatattaaaatattatttagagatattgtaatcatcacctgaaaacactataataaaagcagaaagctgagtagttgcctctggaaaaatttcaactattgtttttcatacattatacatttca

SEQ ID NO: 576994 - DNA, 327 bp, Homo sapiens
tactttcacagggaacaggcatgtgaagacacagaaagaggtcggaagccaaggagagtagccttactagtaactagaccctgtaaggcatattcatcttggacttccgagcctccagcaagtgtgagcaaaataaatttctggttaagccacccagtaagtccatggatattcatgtatgacatggcctcgactgactaagtacaagagtgccatatagttctcctgatctcaaaagtggaatatttatgggggcatttggaagcaagaactcattacgataacacagagatattataatggatgattaagatcaaactccagtcc

SEQ ID NO: 576995 - DNA, 236 bp, Homo sapiens
ctcgacattgatcgcccctccacatcgggatcctttgactacaagaagcctcctcctgccacgggcacagacactgtcatagcacactgggtggttcagccactctcagcaatgatccagaagtcatcaggcatccctgtcaagccagtaaatgggcgcaagactagcttagatgtttacaacagtgcagagccaggattcctggctcctggagcccgtactaacatccagtaccg

SEQ ID NO: 576996 - DNA, 119 bp, Homo sapiens
cacctgtggtcccagctactcgggaggctgaggtgggaagatcagtggagcctgggaggtcgaggctgcagtgagtggagatggcaccacttgccctccagcccgagcaacagggttaa

SEQ ID NO: 576997 - DNA, 110 bp, Homo sapiens
  misc_feature (74)..(74): n is a, c, g, or t
ggcggccctggccagaagcggaggaggtggcacccgggaccgagctggggtcttggaggaagagaggatggcgnagttcggtgcctgactcggtgtgttcctgcgactgc

SEQ ID NO: 576998 - DNA, 322 bp, Homo sapiens
gcgtataaatattagacaaatggctactagaataaacagcatagagaagaccttaaatgacctgatggagctgaaaaccatggcatgagaactacatgatgcatgcacaagcttcagtagccgatttgatcaagtggaagaaaggatattagtgattgaagatcaaatgaatgaaatgaagcgagaagagaagtttagagaaaaaagagtaaaaagaaatgaacaaaacctccaatttatttggaactatgtgaaaagaccaaatctatgtctgattggtgtacctgaaagtgacagggagaatggagcgattagggttagt

SEQ ID NO: 576999 - DNA, 155 bp, Homo sapiens
gcatgactattaaccatatactcccccaaaatcagaatatacacacccgaccacaccgctaacaatcaatactaaacccccataaatagtttatgctgtaatagtttatgctgtaatagtttatgctgtaatagtttatgctgaaatagtttatg

SEQ ID NO: 577000 - DNA, 589 bp, Homo sapiens
gtatccaatagatatattaaaaactttcaaaacccaataagaaaagcaacctgatttttaaaatgagtaagactcatacagtgaaactatgaaacattttttaaagaaagaagatataaataagtggaaagatgtcatatgttcatgaattggaaaacttagtcttgttaaggtggcaataatccctaaattgatgtacaaattcaacaaattcaagtgcgtatcagattcccagctgtgtttttgtagaaattgaccagctaaaatttatgtgtaaatgccagagactcagggcagacagaacagtcttgaagaaagaagacttatacttcccaatttcaaaatgtactacaaaaccacagtagtaatcctgaccatgtggggctggcccagggacaggcatggagatcagtggaatggaggtgatagtccagaagtgaacccttccatttatgggcaagtgatggtcaacaaagatgtcaagatatccatgggggaagaatagtcttcaacaaaggtgctaggaccactggatatccacatgcaaaagaaggaattacagccagctgtggtggcacatgcctgtaac

SEQ ID NO: 577001 - DNA, 412 bp, Homo sapiens
cacccgtccccaaaagggggccccttgggtgggcctggccctgctttttacgccaatttttttccaggtccatgttttcccaaataccgttggtttgaatttttttaaaggcaaaaccgtggtctttattttaaaaaacagtggttatcacactgcggttggtcattttttttccacatccctttaggccaatgggtttggcaaaaatcaggcagaagtggggacctttttagaaatcattgtcagccttggtaattgaaggtacacccccttgggttgggggttctttccccaatgccccaagttgtccctgggatttaacccctccaatgctgggggtgagctgtaattttttgaatgccccctcctgtgtaacggctacaaaataaaacttggttttgaatttttttta

SEQ ID NO: 577002 - DNA, 120 bp, Homo sapiens
tcaggcattgagaagcagctgggcaatatagagagaccctcccccacaaaaaaattttaaaaattagccaggtgtggtggtatgtgcctgcaatcccagctgttcaggaggttggggcag

SEQ ID NO: 577003 - DNA, 222 bp, Homo sapiens
ttatgcacgtcactgggatgaggacgtcacttacaagaggggtagtaaaatacacaggaaccaacagcagtgagtcagactcaactaaatcgattcaaagcttcacgtcaacaattttcataaacacatggtataccaccaatacaacccaaggtgagaacatttctttctaacatagtagatatcacatgttccataatcacttgggttgtccccaaaggt

SEQ ID NO: 577004 - DNA, 152 bp, Homo sapiens
taacatccaacctctattctggaccctgctcatcttcttatagcccttgctaatctagaattcctatttaactattgtctatttccagtcatagtactgtaccttgtaactcaggtatacttaattatcaaccaatgtatatactatatata

SEQ ID NO: 577005 - DNA, 888 bp, Homo sapiens
  misc_feature (8)..(8): n is a, c, g, or t
  misc_feature (21)..(21): n is a, c, g, or t
  misc_feature (42)..(42): n is a, c, g, or t
  misc_feature (116)..(116): n is a, c, g, or t
  misc_feature (123)..(123): n is a, c, g, or t
  misc_feature (185)..(185): n is a, c, g, or t
  misc_feature (219)..(219): n is a, c, g, or t
  misc_feature (270)..(270): n is a, c, g, or t
  misc_feature (275)..(275): n is a, c, g, or t
  misc_feature (297)..(297): n is a, c, g, or t
  misc_feature (335)..(335): n is a, c, g, or t
  misc_feature (342)..(342): n is a, c, g, or t
  misc_feature (349)..(349): n is a, c, g, or t
  misc_feature (392)..(392): n is a, c, g, or t
  misc_feature (420)..(420): n is a, c, g, or t
  misc_feature (500)..(500): n is a, c, g, or t
  misc_feature (552)..(552): n is a, c, g, or t
  misc_feature (742)..(742): n is a, c, g, or t
  misc_feature (755)..(755): n is a, c, g, or t
  misc_feature (758)..(758): n is a, c, g, or t
  misc_feature (801)..(801): n is a, c, g, or t
  misc_feature (807)..(807): n is a, c, g, or t
  misc_feature (873)..(873): n is a, c, g, or t
ggaggggngagagcggagganggggaggaacagggggaccanggagggggcgaccagcagggcggcggcggcgggggcgacggaggcacggggcccaggggaagccagccccagangcaggcncgcagggccaggggagggggcaccaggcggccccccggagcgacgcgccccaggaggacgcncacgggaacggccaggacgaccaggaggcgggcnggggacgggaaggggccaaggaaggcgaccaacgcaccccagaggaaagcnaggcncggcgggggcggagcggggacngcagggaccgcgcgggggacgggcgacggcgggggggngcgggcngagcggngcgcggggagcgcgcacacgcagcagcggcacagacgggacgnggggagcgcggccggggacacggacganacggaccgcgacgggcggggggggggggaggagcggcgcaacgcgcaccgagggccacgacgcgcccggggaagaagggnaggacggggaggaggcagagaccgacaaaaagaggcgggcgcgggacgacgngcggggccggggggccgaccaggagggggacgcgagggccacgcgagaggagcggacagccggccggcaccccgaggagggcccgcacaggcgggacagggggagggcggaaacccgggaggaccgggacagaaacaaagagggcgagggccagggggaggaggacagcgcggagcgggacgcagccganccggggggagganganccggcgggggggcagacggagaggcagcagggccgggacggcngggagnggaacaaggaggggcaacgggaaggggaaggaagggggccacggggggcggcccccggcccaagancaaccccggggggaa

SEQ ID NO: 577006 - DNA, 303 bp, Homo sapiens
  misc_feature (16)..(16): n is a, c, g, or t
  misc_feature (42)..(42): n is a, c, g, or t
  misc_feature (60)..(60): n is a, c, g, or t
  misc_feature (62)..(62): n is a, c, g, or t
  misc_feature (76)..(76): n is a, c, g, or t
  misc_feature (112)..(112): n is a, c, g, or t
  misc_feature (126)..(127): n is a, c, g, or t
  misc_feature (157)..(157): n is a, c, g, or t
  misc_feature (169)..(169): n is a, c, g, or t
  misc_feature (209)..(209): n is a, c, g, or t
  misc_feature (277)..(277): n is a, c, g, or t
cacacacacacttagncttgtaatttcagggcagaaattctnaacactattttgcatctntnttctttttctaagncatgataatatagatgttctggtctatcataaaagnatgtttatgtacanntcagtcattcggtatgtgggctttgtaaantaaagtataggnaaaacatttctgttatacatagatatataattcccccccngtaaaacttagtttgcacaaatgggcacaatattttttgagactgtttttattgagacccctaggctnccacagaacctaaagaaatatgctgg

SEQ ID NO: 577007 - DNA, 1311 bp, Homo sapiens
ggagagaactagtctggttttttgtggttttttagaatatggtggaacttatactggttaaaatcactggccattgaaatggatcactagctaagggtcactaaatttacaaacttagggaaattatatataggaagtacggcaaaaacgacaagtaaaaagagctgaagttcgcccatattctggcggtcaggaagtctcttgcactcctaagcttacatatgtggtccttctgggcctttcaaaatattctggctaattaattacctggtgatattcctccctgtatggagtactatccctatgtggtgcaccccgaggggccaagaaccttaccaggagccttactacgcttcagatggccatctattttggtgatagccatttcagaacaggtttcccaatggatacgcctggcgtagaacagaacagaggagatacgcttggcctggtgctaacatatatatattactaccctggtggtaccgcctggtactttgtctaaggccagggaggctacctctcatatttatggggaaaatctactgtctctgtattgcaagcttggtgtggacactcaatacaaggcgagcggtaaaatgcggggcccttgtgagacattattctttcccaatacgtgtagggtaacccgaggtgcctcgcgtgaaaagtgaatatcccgtattacagcgcccatgaatatacagcgtggtcttattcaagacctgcgattctctcttatcattatacgccgcggactccttactatcagcgctatatattctgcgtggccattttttatagacccccatttaattttgtgccacaagtaactcaacttccgtagagcgccttataaatgtcgccaccccatgacagacttggggatttctcacccaattctgggtcgttggccatccacggttcctgtggtgtggccccttataagttcctttataggccagacaaacaccgatgttggtaactctaatttcccccagttggggggtcaccttccacagtgtggttccaaacagtgtgctaaaaccttttcacagtcttcctcgggaagaggcaaaacttccacgactgaaaaggtgggggcccttggtggtgggggaaaaaatcttcccataattccaacaaggtgttaaaaacacgttgtgctcccaagcggtgaaggatttagggactgagcaacttacccaaggcccatcctcattcattctattttcacacccccgccttggggagcacaacaccttcttatacttcattccccaccattttgtgtcgtttttgggcaacccc

SEQ ID NO: 577008 - DNA, 920 bp, Homo sapiens
tcgtcgttatctgcgccatcagttgctttggccttccagcagcatctgctcaagctgctcctgggcttccagccatgccatttcgcactcttccaggccggatttggcgctggcttgctgttgcaggcaggcggtcaactccgctttacggctctggtcatacagttcgctgtcgccgagtttctcttccgcctgcgccagttgcgcgttcagcttctccatctctttttccagacgggcaatctctttacgcagtggctgggtttgcgcacgcagctcagctttcccgacgcttctgatctttacgtgcctgggcgctgttcgcattctctttggcgcttcgtcggtctggttttcctgcttttgtacgtcgctcaaccactgttgataatcttccagatcgccgtcgaacggttcgactttacgatcgtgaaccaggtagagatcgtcagtggtggaacgcagcaaatgacggtcgtgcgaaacgacaaccagcgcgccttcaaactcgattaatgcttcggtgagtgcctgacgcatgtcgaggtcaaggtggttagtcggttcgtcgaacaagcagcagattcggccgctgcagacaattaatgccagcaccaggccgggctttttcccccaccggagaagcgggcgcgtatacttcggttactttatcgccctgaaaaccaaacgccgcgaaggtagtcaacgccattttctgttcccaactcctgacggaggctaaacgtgcacgattgttgaataagtgatcggtcggccgcaaggatttccaagttaatgtgggcgaaatagcccagttgatccttttgcagaccaattcaccgctgaattggggacaattaccggtaaaattgaataaggtcatacccgcgcatgaggggtaaaaaacatacagcggaccg

SEQ ID NO: 577009 - DNA, 370 bp, Homo sapiens
ccccgaagtatccggcctatccaaaaaaaatttaggaaaacaatcccatttataacagcaataacaaaaatatgtggatataaagttaaccaaggatatgaaaggtctgtatactaaaaagtataaaacactgataaaagaaactaaaaaaaaacacaaatagatggaaagatgttctgtgctaatgaacttggagaattaatgttaaaatgtccatattacccaaagcaatatacaaatacaatgcgacccctatcaaaattccaatgtcatttttcacaaaaacagtacaacaatccttaaattcatatggaataaaagacctcaaagaacaaaagcaatattaaacaaaaaagaataaagctgaaga

SEQ ID NO: 577010 - DNA, 133 bp, Homo sapiens
ttggggggccccccggctttccatttttccatggggttttcccccccccccgggggctttttcctggggtttcggcctgccaattcccccccctgccccctcttttcccataaaatggccttagggctgggga

SEQ ID NO: 577011 - DNA, 404 bp, Homo sapiens
tttttttccggaccccttggggtttttccgttttcccccccgttttttttccccttttccttttacatttttccctttcccccccccccggggccccccccgggttcttccttcccctttcccttcccccccctttgggttccctttcccggggggccttttgattttccattggggttcccgggtttcccattttgggttttttttttgggttgggttccccttccccggggttgttttttccccccccggggcctttttttttgaacttttttcccggccttttttttagtgcctttcccccctttttttttgcccttttttcccccccttttcccgcccccgggggccattggggttttttcgggggtggattttaattaattttttttttttttttttta

SEQ ID NO: 577012 - DNA, 1473 bp, Homo sapiens
  misc_feature (984)..(984): n is a, c, g, or t
  misc_feature (1108)..(1108): n is a, c, g, or t
ggtgcctagctacggtggtccgatcgaccctcgccgtccgtggtgtgtttgtgtgtatcactcacttctgcctccggtgtagtggtggggtaaaaaccaccatcgtgcccgacgctctttgagtaccgttggtgttggtcgtgtattccgtctggtagcccccgcttctggtcccaccatcagggaggggggggcgacccacgcccccagcgcccccgttgtaaggtaaatatagttggtgtcgcttccctcctttgtgggagagctcctttcaactaattgtgggtgccacccccgcccgcaaatgagcgtctcgttcgtctgtccgactaaaggatgtccccctgtattttttgtgaactcccctcccccgcgtagtgttaatattccgccggagtgtcccccccccgtgaaaatgtggggaggcatacacccgcgtgtttttccgcggcgagcggcccctcttgtgggtggttttcccgcagtggggggccccccccccccccccctcggggttttctctcgtccttggtggacacaccacacggtccccccacacgtccttggtccacactcccctccccggaaaacacatccgcgggctttctctcgggccgcgagagccacagcgagaggtttccctcgtgcccccccttctcaacgcgtgtggtgtcctcggctcccccgcgcgttggtcgcggtcgcccccgcgcctatcacacacttgctctcgcggggagcttcctctctcgcgcgcgcacacgcgcacgatgtttctcatcacgcgcgcgctgtgcgcacacgcgggagacctcgtcgcgccacgctctcgcggtgcacacaccgtcggcgtctcacacgcgctgggcgccacacgctcgtgtggcgccccgcagcaatatggtgtgttgctcgttgctcgccgcgctctgtgagagccacccccacgcttttgtcctcgctataggtagagagagagagatnttccgccgagagcgctatatccctcgagaggcgccgcccccgctgtatcccctcctgagaaactctgagagagtgagcacctctttttctccacaccgctctccaccgcactcacacccccccntcgccacagaagagacccaccgctctcttgtggcccacacaccacagtctctccgctcagagcgcacaccctctccacaggtctctcacacagtggaccacaccacacacacaccacggccccaccacaccccaccccacaactccgctaaccacgcctggaacccgcgccacaacactcaccgcctggaaacccactggagaaatccccacctttcctggccccacggttcacacatggaaaggaggtggaatggttaggtcctgctgggatgggccctcccagccccaacctcctgctcccgggcccagacccgactctgactctcctcttggggctgctgcccatttaaaccctactactaa

SEQ ID NO: 577013 - DNA, 332 bp, Homo sapiens
  misc_feature (85)..(86): n is a, c, g, or t
  misc_feature (130)..(130): n is a, c, g, or t
  misc_feature (134)..(134): n is a, c, g, or t
  misc_feature (220)..(221): n is a, c, g, or t
  misc_feature (275)..(275): n is a, c, g, or t
  misc_feature (279)..(279): n is a, c, g, or t
  misc_feature (284)..(284): n is a, c, g, or t
caatgtcccttgggccagaatggacctgccctttttgctccaaacttgggggtaaatagggacccctccttttaggcaaagcctnnctttccttccattggtgggtggatgggtggggggcattccaaancctntaaggtagccagttttgttgcccattcccccagtttattaaacccttgatatgccccctaggcctagtggtgatcccagtgctttnntgggggatgaaaaaaaggccttttatagcctgggcataagtgaaatcaccaaancctntgggnggatgtgtaaaaggcccttcaaaatgcataaacctgttccaatgttta

SEQ ID NO: 577014 - DNA, 167 bp, Homo sapiens
atacttacatacacgtcaaacgttagatggtgatcaggttcggatctgtgtccccaaccaaatctgaaccccaactgtcatcctcatgtgtggggggaggatccagatggagaggtgactggacccacagagagtagatttccccctatgctgttctcactgatagt

SEQ ID NO: 577015 - DNA, 133 bp, Homo sapiens
agttccgggtcccccactacactggaatctcccctcctcacagttgccagtgtagacccctttgaagaggggaggggcctagggagccgcacctttgtcattgtaccatcaataaagtaccctgtgctcaacc

SEQ ID NO: 577016 - DNA, 526 bp, Homo sapiens
gggccgggcgcggtggctcacgcctgtagtcccagcactttgggaggctgaggcaggtggatcacctgaggtcaggagttcaagaccagcctggccaacacggtgaaaccccatctctactaaaaaaaaaaaaaaaaaaaaaaaaaaaaaatttttgggcggcttgggcccttgaaaaagttttctataaacaattctcggttggggcgcgcggcgggcgcccagttaggagtacaggtagaacattgggtcaattagggcgtgggttctcctataggagagagactccgggggtcatatagaattaggggggcttgggagatcttctctcacacaatataaaaaaaaagcggcgcgcgggggggaacaccgcgagaggcgggtcttgtgagaaaaacatctccagaatgggggcggcttctagagaggggctcaatctaaaccgggggcttcttatctcacaccggggaggtccacagcggagagcgtctcagattctctaaaatttagcgcccggcttctgggt

SEQ ID NO: 577017 - DNA, 198 bp, Homo sapiens
tcgagctcggctaccccagggtagactaacagagtcaacgtcctccctctgtgagtggagtggaaaggtcgtgataggacaacaatcctgttctagtccacttccccttccccaaaatactattccgcacttgacttgagcttggacatgaaacagtcatgttcaatgttcttcatacttctataccaaaggaacttg

SEQ ID NO: 577018 - DNA, 799 bp, Homo sapiens
ggtggggcgagaatctcaggtaccccgggcctagggccgttgggcccatcgggcagagtatccctgtccggttgagcctcatgattgcggaggtgcattctgtggacgcagatcaaacaagttctgtgcgaaagccctctggaggcttctgtctatttcgaggtcaccccagtcgccggccctctggacgtgcccctgacgccatggtggttcccccccaggtggtcacccgtgctgatgaccagcgctgaagcgaaggctggccttccaggagccattagatcgtgatccccagggcctctttagggctgtcaaagagtgaggaacctggctcacagtccagccaccagctccacgcacagccgaggagggcgcggaagccatcacgtacccgggccacagagccgtgccgtgagccctgctgaagagtgcctagcgtggcccagtttgtgctcacacccagcacggaggtgtagcagcccccgctatcaccgcgatgccagggacttcggtgcagatcaagagcctgggcagccagcttgctactgaggccaggctgataggagctcaggagggcgagggagtcggacgagaggaggcaaggcccacggtgggcttggcaccctcacagacacgcggggctggccccctgtgctcaccgtctgggctttgtctccgagcctttgctcccagcgcaccactgagcatgagctgacgggctgccatggagcggctctgattggaggcttgaggcctgtggctggtcgggtggagctgctgatattcctcagatctgtga

SEQ ID NO: 577019 - DNA, 228 bp, Homo sapiens
  misc_feature (38)..(38): n is a, c, g, or t
acaggaacctgtggagagcgaaggcagccagcaggttnggggtggcgggcccaagctcagtgtggcttcctctgaggcctcacccagttcatgggcactctggagccagagaagggagttgagccttctacaaacacccctggcctggcaccagcattgggatatgtgctgcttcctgacagcgggtgggaccttggcgaggtgctttgttggtctgtaattcctgct

SEQ ID NO: 577020 - DNA, 1259 bp, Homo sapiens
gctctcgcaggaggcctgcctgggcttcattgctgtgctcagggtacatgggcgagctacccggtaccaagaggacacgctccggctgcgagctcaccgaccatgagtctttgacgggtccccgtgatacagccgagccctctgacacggaactgagtggcattatgtcgctgattcctgcagaggcaggctgtagccgacgaagccatccatcagctgcttcgctggcagtctgccgaagagcgactgcctcactcggccattcgtactgcactgacagaacggactctagcaatagcgcctgagatatacgggtcccggcaggttaccctcccgcgaagcatgggtggcagggtggtacggcccataccagacgttgaagcagcgagctcacggattttgccagcgaagtagtctgatttcgcgctgagatgacaggtgacgaagttcactcctgctggatgctccactgtgaggccctctgctgatgcactcagggcttgctgcagccatggtcccaggcagctctgtgactgcctaaagggtcacgcgttcctgtcttgagaagacgctcgggaggggatgggacgagcgctgtgggaacgacactcacgtagcatggacgtatgcccgttttccatttatgctttaaagtagccattgccccaagactcgtgtggcgccacaaggaggggatgtctggggaccgcgtgatgggggacctctagattttatagaccggcaataagctcaagcaggggcggccacgaggtagggtaccctccatgtccccgggaggaacaggtgcccctttgaaattagtacggcctcgagattgccgtcacgttggccccctttccccaagggtaccctctcgtacaagtggttacctcccaggcttcacagggctcacaggggagcttcttgccatgacacaattctgggctacccatgaggtctggcgtacccttcgtaaaggttcccctttcaagggcagaagggaaatctccaagggcccctcctttgtggttctaaaacaatttggacacggaacgcaccctgggctccccttacaagtgggtttcccgttgtaagaagatattgaccttttcgtttgccatattggaaccttttgggttccgccaccagcgttttggagtcacgcaccttggggttttaaaacaaaaaacggctccgggaccccattcgacattggaaccgggaaatcttggttggggcctccatattctcacacttta

SEQ ID NO: 577021 - DNA, 838 bp, Homo sapiens
  misc_feature (158)..(158): n is a, c, g, or t
agcgggggggccagtgcctgctcgggaaccgtggcggctggccggaggcggggatcccgcggctgcggcgacggtggcctgcggtggagccactggggcgggcttggcttggtgtgacggctggcttgcggctggctggtggcaggccatgcgactangtgtacaggcggtcctcactcttggccgggtactattggtcggccagcctagcactccatatgagctcggctatgctcattggctttagctcaggcactacctcagacaagacttctagagtgcacccagttgggccctccgttgatacactgccaagctactgaggcgcgatcgtcgtccctggcctgtcgatccgttcgagtcgaccttgtgcactttgagcttcataggtgaagccctcaagtgcacgagatcgaacggcgcgttcgatgccgagtcgaattgcacccgagttcccctcacgcagtgatggtcttagatcggcaagatggtggcgcgataccgccgatcagactgcatgcttgtggacaccatgtcggtagtaggtgtgttgcaggacgcgagagtgggagattgttggtaagacttcgggaaggggtccagttggatgtttgtagacaccacaatggagaggtgattgggaagcagggttgacacagtgtacgtgggtgggtaaggcgggcagtggttgctgcttgggggaagcaggaaagcatcgcgagaggagaggagaaggagggatggagcgtttagatatggtgccaggtgggtaggtcgttgttgggaggaggggatgttgagaggggaggagactagtagaggggtagatgacgtaggc

SEQ ID NO: 577022 - DNA, 588 bp, Homo sapiens
aaattttattatcaatctttaaaattttaatcttgaccataagatacagcttccataagccttttttaacctttataacctttattaaggggtcggttaacacttcaagaaaacctttttaatctgatgcaggggcccgtatgctggtattgcatcagtgtgcctttgacatcaattattaacttgcagagaaactgaacttattttgtctctcaaaatcagcccttacaatctcacatgcctacctcttctggggtagttcctgagccttgaggagttgaatagcttttacttctggccttatgtctcaggaatgcagtttattttgattggcatcttctaccaggcctgaagatgaggttttaattgctgtcagggcttaagatttagcagaccttggtgtccttgttagacccaggagtcaaaggcctgtaacttaatgtcacaggtactttcaaagcacctacagaaatatacatggatgtaataaccttaattttaaaaaattatctcagatactttttcctgaggcaatcaaaaattattattacccgccttacattgttttaaaaacccaaaaaatctgtt

SEQ ID NO: 577023 - DNA, 1467 bp, Homo sapiens
  misc_feature (1231)..(1231): n is a, c, g, or t
  misc_feature (1234)..(1234): n is a, c, g, or t
gatcgtttgcgcgaaagtgtttctgacaggcgtctaaccgaccaaggccctgctggtgaacaccatagtaagagagagtgattatcttcgcggcgacactcaccaggtggtttccctcctgagaacctcatagttatttctccccttggggggcagcgctccttaaaagggaagctcatctctgtcccacgatggttttttataaaacacgagggggataaaaaacatttgattcgcggggcgacaaagaaattttcttctggcgccacaggacacgcccactcatgtgggggcaccccaaaaagtgttgctacaacccggcgggggaaaccccaacgcccccctgtgagtttccccttgtgatggggtaatggtacccccttgggtggcacacgaacccttatggagttgtaccacccaggggagggcgtgtgggcccccaacataagggaaaaggaggcgcaactttcactcgggaagtgtaaaacctctgtttgttgtaggaagaaaaatttcactgcagaaggacaacggacaacggaagtggagtatcccccaaatgtgtttggttttaaatgacgccaccttttgaggggctttcgaaattttgcccaccccacgggaccccgagttccacacactcggcacagtgcctctcggtggcgccttgggggagacacacacagagagttgcaacagactggagatagagagctttctctgaagatatccgccctacacacacgacttcccacagacacacatcgtcacattgtggggcatatgcgcacagagaatatatccccacagtgggtttgtatatttatccgtggggttttcgtgggagacagagaagcgcgtcgctataaacagagacatatacctataacatatatgtctcgtgtgggtatatatatagggggagatttgagaccacatcggttatactcttctgcacaaacaccacagcgagacacatcttataagagacacattttatacatatatgtatataggggccacatagagaggagagatatatgtggagaaaactacacagagaatataaaggagaatactgccctcttaaaggagaggcttaccacaattcactgtgccgcgggttccgcgtgggcgtatcatccacgccctcgtaaattcccacgccacactcttgggagagggctgagagggcgcggtggaatacaccctataaggtgtcacggagagnttntcgagagagaccacagccctagccacaacactggtgaaaacctcgcctttatctataaaaaacacaaaaattagccacaggcgtggtggcgggtgcctgtaaatcccggctaactcacggagaggctgaaggcacaggaagaattcgcttgaacctgggaggctgaggttgtcagtgagccgagattgcgcccttgtaatccagcctgggcgatgagccaaactccatttcca

SEQ ID NO: 577024 - DNA, 1098 bp, Homo sapiens
tcttaggtgtgttcgttcctctcttgtgttccctctctctttctctctgcgtctctgctcccccgccttgtcgtcgtctccgctcgttgtttctggatgctcgctgctgctctacccgctgttctacccctggtggctatgtcgctcccctgcttcggcatttatgctcccgtttccttctccatcctgtgccgttggcttttccactcgtcctttccgcgcgccgtgaccgcctgtctgcttcgggctgccggcagcctcagtttcttcttgcctgttttgttctcctgaggatctccacatcatgtctctgttgtgcctttttccctggtgagcaacagttagggaaggtttccaaagcctctgatacatgtgcttccgtgatcaggagtgcgctccaaaccagatacgcccgcttgccccgttgaggccagtgagctcagcctcccaggctttgaagccacatttcagtcaagagataagtcgcctgagagctcgcaggttcattacaagaaggcgcaagcactggtttctctcctctagaaaagtaggtttcttggcttgatgtagactggcttgcctttggatttctctacttcgaagggacatgtacgtaaaacccaactagggcttggctgttcaaaggagacaggatggatggatggatgggatggatggatgtatcggatgaatagatagatcgcgtgtttgcatgtaaacttgcagaggcatacacacaagacccaaagctgattggaacacaattaacttgtgggtgtctggagggggtactgtcgcaacgctttgggcatgcctttgagacagcggtacaagagttctgtgcctgtgtgtccagccctggagccagccagtgcatttattttcagctcttagaagcaactcctgtggcccaggaatgcgtgacccctgcagatgggtccacgcatctctctacacttccttctctccgtgggatactggactcgtgcctctgcgcccaattctcttctcacgcatatccaatgagctttaatttcactttctggatcacggtacgtccataaagccaggtattacacttaaatcgagattcttttt

SEQ ID NO: 577025 - DNA, 115 bp, Homo sapiens
ccgcgtgtcacgcggaagcgtctgcctaatatcggagcggcttgagcgtcgaggttaggtgtacagcgcggacgtttaaagcagttggtcagtcattgtcgcctgcacattgctc

SEQ ID NO: 577026 - DNA, 295 bp, Homo sapiens
cgacttctgtacttagtttccttgatacgaaatgaaagaaacaactttatattaatagatgagcttgctggctcttcctgctgtcatacacgataattctgtaaaattacaaataatgctagatcacaaccctaatctcctggtaatctctttcatggttttcatttgttcacgtctttgagattatgaggaaagcaaaatccctgttactgaaatatcaatactttcctcaaaatccctgttagtaaaatatcagtacttttctgaaaggttgtagggaaggaaggttgctagg

SEQ ID NO: 577027 - DNA, 298 bp, Homo sapiens
tgggaaggggggccccattttgtggccaaaattagagaacgggggaaaaatcggggccaacggaaatttcggcttcgggggccaaaggaattttttggcttaagcccccgggggggccgggtttaagggtttttgccacaaaaccgggcaaattttagtttttccggaaaaaagggggtttgcccaattgggccgggggggcctaaaactctggccctagggggaccccccccccttggcctccaaaggggtggggtttacagagggggccccccccccccggtttaaattttttaaa

SEQ ID NO: 577028 - DNA, 768 bp, Homo sapiens
gctgggattacaggcaactgccaccatgcccggctaattttgtattttagtagagatggggtttcaccatgtggccaggctggtctcgaactcgtgaccgcaggtgatcctcccgcctcggcctcccaaagtgctgggattacaggcatgagccaccgcgcctggcctctgcttactttttatatagcaaaatgattcctcttggcaagatgtttcttatattattccaaagttatttcataccattattatgtaaatatgaagagtttttttctgtttataattgtttataaaacaatgacttttaaagatttagtgcttaacattttcccaacgtgggtgggaagcattattgtttaaggaattggaagtagggtacccttggtatggcggtgggtcgctttggcattttccctgagtgttattacagtgaccgggtctctttgcgtaaacgagaatcaactaggtatttaagaactggattattttaaccaatttatttggtttccacttagcagtgtaactttggactaggaatttggttgtaactttttataacagtgtgttaaacagagaaagggtccatgaaggaaagtgtatgagtcgcatttgtaaaaatgagactttttcagtggaactctaaaccttgtgatgactactaacaaatgtaaaattatgagtgattaagaaaacattgcttagtggttatcactttaagtttggacacctagattatagtcttagtaatagcatccactggaaaaggtg

SEQ ID NO: 577029 - DNA, 1091 bp, Homo sapiens
ggagaactagtctcgagttttttttatgtttttttgggacaggaagtaaaattatgggggagtataaaaaggggggcagcacttgggaagccctcatgagtgcagggcccgccatttgtccagagggccacgacgggggatgtactggaccccgacagccatcgtgggagtgagccgctttttcagccaccagtggtctgtcaaattcactcagcattgtgaactgggtgaagccccacttcttggaggagtggtggactcttcgtggcggccaggaaacgttgaactgggccctgcgcagggcctcaattcacatgtgcatccgtggtccggcagactgggagcggagtggacatgattaacttggggccacagtggtgaacccagtggccacagagtgcccgtggggcatttccaaaggcacctcgacattgccgtgatagggacgcacgtgtaggcccaacaggaacgagcgaacaaaccaattctgggtgcgaaatgccgagaaatgaccgcgtggacaaggggcgatggaagaccggaaccgcggggaatagtgcgagagccacatatgtgtggggcacaccaacgtgatgtaagccagtgagtcacgtgataagtggggagcaaccagaaagtatgcggggaacaggacgcagacaaaagacctaccaaggacgggacaaggccatgtatgcgggcaaaacggcaccagagaacggtatcatacccaacccgagggggaagcaaagggaggtaccaaatctacgaaaaaaatcgtagcggtgggcaacgcccgtccagaaatagacaaggacggagcggcataaggggggtgaaggacacaagaccgaccattcaacaatgtatagcaaacaacaaaagcacacggataacaatcacacattccgtgagaggaaccccagcaacggtccggcgagggccccaatccacagcacgagaaactatggacgaggactaactagggcaggaggcggacccacagggcacacacccacccatggtaacaggggtagcccccggacggcgacaaaggggagagaacatgtgcgaacaaacgaacggtggaa

SEQ ID NO: 577030 - DNA, 1049 bp, Homo sapiens
  misc_feature (17)..(17): n is a, c, g, or t
  misc_feature (87)..(87): n is a, c, g, or t
  misc_feature (135)..(135): n is a, c, g, or t
  misc_feature (144)..(144): n is a, c, g, or t
  misc_feature (152)..(153): n is a, c, g, or t
  misc_feature (158)..(158): n is a, c, g, or t
  misc_feature (161)..(161): n is a, c, g, or t
  misc_feature (167)..(167): n is a, c, g, or t
  misc_feature (169)..(169): n is a, c, g, or t
  misc_feature (185)..(185): n is a, c, g, or t
  misc_feature (225)..(225): n is a, c, g, or t
  misc_feature (229)..(229): n is a, c, g, or t
  misc_feature (248)..(248): n is a, c, g, or t
  misc_feature (347)..(347): n is a, c, g, or t
  misc_feature (353)..(353): n is a, c, g, or t
  misc_feature (359)..(359): n is a, c, g, or t
  misc_feature (363)..(363): n is a, c, g, or t
  misc_feature (397)..(398): n is a, c, g, or t
  misc_feature (410)..(410): n is a, c, g, or t
  misc_feature (413)..(413): n is a, c, g, or t
  misc_feature (438)..(439): n is a, c, g, or t
  misc_feature (445)..(445): n is a, c, g, or t
  misc_feature (472)..(473): n is a, c, g, or t
  misc_feature (483)..(483): n is a, c, g, or t
  misc_feature (489)..(489): n is a, c, g, or t
  misc_feature (495)..(495): n is a, c, g, or t
  misc_feature (509)..(509): n is a, c, g, or t
  misc_feature (561)..(561): n is a, c, g, or t
  misc_feature (824)..(824): n is a, c, g, or t
  misc_feature (831)..(831): n is a, c, g, or t
  misc_feature (836)..(836): n is a, c, g, or t
tatggggaaggaagccnatccctttctgctagtataaacgaggccctgaacaacaatgggatcctgtaaagtgttggaaagttctcnactgttaacccagtctatgttggcaatgtggcctggcccacattctgnccttgaggnccctgcannacccnaanaaaacncnaagcatccgaggacanttctactatatctcagatgacacgcctcaccaaagctatnatanccttaattacaccctgagnaaagagttcggcctccgccttgattccagatggagctttcctttatccctgatgtattggattggcttcctgctggaaatagtgagcttcctactcagnccaatntacacntatngaccgcccttcaacggccacatagtcacattgtnnaatagcgtattnacnttctcttataagaaggctcagcgannatttgngcgtataagccactctacagctgcggnngcgaagccangcaganaacggnggagtgggttggtncccttgtggaccggcacaaggagaacctgaagtccaagactcagtgatttanggatgacagagatgtgcatgtgggtattgttaggagatgtcatcaagctccaccctcctggcctcatacagaaagtgacaagggcacaagctcaggtcctgctgcctccctttcatacaatggccaacttattgtattcctcatgtcatcaaaacctgcgcagtcattggcccaacaagaaggtttctgtcctaatcatataccagaggaaagaccatgtggtttgctgttaccaaatctcagtagctgattctgaacaattnagggacnctttnaacttgagggtcgttttgactactagagctccaattctactcttaaatgagaaaggatttcctttctttttaatcttccattccttcacatagtccgcataccaccgactcatcacactgtccgactcgctccatcacccccccaacacccccccccccaccccccccccccccccccccccccccacacctacacacccctcaacccccccc

SEQ ID NO: 577031 - DNA, 121 bp, Homo sapiens
tgagcaccaggatgtcagctgccaattgtgttttcctgcagcacttccataaacacatcctggtgtcatcacagccaaggtttctaggttgctataccaatggcttattaaagtgaaaatg

SEQ ID NO: 577032 - DNA, 140 bp, Homo sapiens
tgtaacatctatgaacaatcgctatatccttttcctttcttcctaggtagtataatactatcctagtattgcatcagtataggagatatcagacagtgtgcctagttgatcaattagctgcataacagattactccataa

SEQ ID NO: 577033 - DNA, 464 bp, Homo sapiens
gacgctatatcatgcaaaacaaataaattaaacctaatggtacttctggctgaggctccagaggtccccaggagggagggtgtttgcgtggagggggccttggttccacagaatggtggcttatggacgcttttaagacactaaagaaacccacatggtaaaaggctgggtgcggtggctcacgcctgtgatcccagcactctgagaggctgaggcgggcggatcacaaagtcaggagttcgagaccagcctggccaacatggtgaaaccccgtctctactaaaagcacaaaaactagccaggcgtgatgtctggcacctgtaatcccagccactcaggaggctgaagtagaagaatcgcatgaacccagggagcggaggttgcagtgagccaagatcacgccactgtactccagcctgggtgacagattgagactctgtctcaaagacacaaacaacaaacag

SEQ ID NO: 577034 - DNA, 143 bp, Homo sapiens
attatcatcatcagcatcagcagcagcagcagcatcatgttatatatggcagggaatgtaactgcacgttatggcagtgattattactctaaaaacagaatagggtagtgaggaggctggtaactctggcataatcaattgag

SEQ ID NO: 577035 - DNA, 627 bp, Homo sapiens
  misc_feature (147)..(147): n is a, c, g, or t
  misc_feature (164)..(164): n is a, c, g, or t
tctggagatcccactctgcatctggcaggatacacacaccaagaaccagggaggttgggccccatgaacattcccttatatcagatcccaagcgcaccattgctcaggattatggagtcttaaaggctgatgaaggtatctctttcnggggcctttttattatngatgataaaggtatccttcgacagataacaataaacgatcttcccgttggccgctctgtggatgagattatacggactagtcccaggccttcccagttccactgacaaacatggtgaagtgtgtccagctggctggaaacctggcagtgataccatcaagcctgatgtcaataagagcaaagagtatttctctaagcagaagtgagcactggaccatttttctgccaggcagcattgagcagccagaagaaactcttgtactctactcgtgcttaaacacatgatgtggtgtgattccagataagcctttcctacagggctggggatggatagcctttcttccactattggtaatggtctgagctgtgttttgggcagaccaatcttctatcagtcacagaaaacaacctgttaattcttttttcttctttttttaagtatctattaaacgtgaattctgaaa

SEQ ID NO: 577036 - DNA, 873 bp, Homo sapiens
  misc_feature (26)..(26): n is a, c, g, or t
  misc_feature (67)..(67): n is a, c, g, or t
  misc_feature (123)..(123): n is a, c, g, or t
  misc_feature (179)..(179): n is a, c, g, or t
  misc_feature (183)..(184): n is a, c, g, or t
  misc_feature (219)..(219): n is a, c, g, or t
  misc_feature (239)..(239): n is a, c, g, or t
  misc_feature (249)..(249): n is a, c, g, or t
  misc_feature (252)..(252): n is a, c, g, or t
  misc_feature (258)..(258): n is a, c, g, or t
  misc_feature (295)..(295): n is a, c, g, or t
  misc_feature (310)..(314): n is a, c, g, or t
  misc_feature (317)..(317): n is a, c, g, or t
  misc_feature (320)..(320): n is a, c, g, or t
  misc_feature (323)..(323): n is a, c, g, or t
  misc_feature (374)..(374): n is a, c, g, or t
  misc_feature (397)..(397): n is a, c, g, or t
  misc_feature (399)..(399): n is a, c, g, or t
  misc_feature (411)..(411): n is a, c, g, or t
  misc_feature (491)..(491): n is a, c, g, or t
  misc_feature (551)..(551): n is a, c, g, or t
  misc_feature (574)..(574): n is a, c, g, or t
  misc_feature (578)..(580): n is a, c, g, or t
  misc_feature (585)..(585): n is a, c, g, or t
  misc_feature (587)..(587): n is a, c, g, or t
  misc_feature (590)..(592): n is a, c, g, or t
  misc_feature (596)..(596): n is a, c, g, or t
  misc_feature (610)..(610): n is a, c, g, or t
  misc_feature (626)..(626): n is a, c, g, or t
  misc_feature (628)..(628): n is a, c, g, or t
  misc_feature (635)..(635): n is a, c, g, or t
  misc_feature (650)..(650): n is a, c, g, or t
  misc_feature (680)..(680): n is a, c, g, or t
  misc_feature (689)..(690): n is a, c, g, or t
  misc_feature (706)..(706): n is a, c, g, or t
  misc_feature (731)..(731): n is a, c, g, or t
  misc_feature (735)..(736): n is a, c, g, or t
  misc_feature (739)..(739): n is a, c, g, or t
  misc_feature (825)..(825): n is a, c, g, or t
gggagagttaagtaggcaagaatgancagccacggattgttgaactgttaccagcaccatgcttttnagcgaagcgagtttcagcgtgagttggaaacattttttacagcaaaaccattaccncgaagtcctcgtccgcctaaaccacctttatagccagtctcaagctaacacccaanttannttgcaacacacctgggtataaaaacacagttttanaacaaattaagaaaaaatgnaaaactgaanacncacttnatgccctctaatagatgtgatgtaaccctctcttctntagtatgtcttgccnnnnnccngtnagntctaaatgggcttttcaaaatgttaattttccattttggctaaatgggtgnatctttgcccacattctgggcangngagaacgaacanaggtaaatgcgtgaaaaaagccctctattgtatgtcctggtagagttgtcttaaaagaaccctaaaaagctggggaccangtaaaaatccacagaaaattcaactctttgccttttaaagaactttttgaaaaactgttntaaaaaaaaaaaaaaaaaaaaancccnnnggggncnggnnncctnaaatttcttaaaancaaaatgtaaaaagtnanattttgngtggtttctcagttnacaaatgggggagtttccaaaggggtgggnaaagggaannaggggggtggtcaganatgggtttctcttttttggcttttntttnnctngtttttcgtcttccacgtcctgcagcgcttctttattctgctcttcaccgtcaccctgcatgtctgaagtccatagtgtcagattntcacgtaacaactgcatgataaagtgtagagtccttatagctttcttc

SEQ ID NO: 577037 - DNA, 110 bp, Homo sapiens
gcggccgcctactactactactactgctcgaattcaagcttctaacgatgtacggggacatgattctccagtatatttgtaaaaaataaaaaaaaactaaacccaaaaaa

SEQ ID NO: 577038 - DNA, 336 bp, Homo sapiens
tagcaaattaggattttcggcgggtttcctctcttaaactcattctttcctccaaaggattggttggccatctccgggttcattcaggtgcttaaaaaaacctcaaagggccggggaaggtgaggaggccaaagtctgggtctgtgtaggagttgtcacagctattggtgtaagaaggtctggcaaccaggccttgggtggtgggttctgccaagagattggttcttgaacacctgggttgaaatccggtgccctgtaaaaggtttatgatggttcaactggatgtctggtaaaacacattggtaaacttccaataaatattggattaaaaaaaga

SEQ ID NO: 577039 - DNA, 184 bp, Homo sapiens
gcaggacaagtagagggggaaagggagaaaaattgggtagaatagggacagtatgtatcaacagtataaagcatcccacttagagtcactttaatgtcaatatatttttcaaaaagtatatagtaattgttttttctatttttttgagccagagtctggctctgtccgcccaggctaggaagtg

SEQ ID NO: 577040 - DNA, 373 bp, Homo sapiens
  misc_feature (27)..(27): n is a, c, g, or t
tgagaatagagtctcactccgtcaccnaagctggggtgcagtggtgcaatcttggctcactgcaacctctgcttccccaggttcaagcaattctcctgcctcagcctcccaagtagctcggattacaagcgtgtaccaccacgcctggctaatttttggatttttagtagagatggggttttacccaggttggccaggctagtctaagaggtggctgatatacccatcttccagaagtccagaagtgggagctgaggatcgttgatagtcagtgacttgcagagctggtcaccaccgacctggtgatcagattcggatgctctgaccacagcaccacatctgcctcccacacattttccatttctctatacag

SEQ ID NO: 577041 - DNA, 148 bp, Homo sapiens
tagaggatcctatcggcagaagatcactccagaagatcactctacattattggtgcagacttaaccttaacctgctatagatagcctttccactcctcaaactctaacatatcagtcttgacgtttttttccctcttaatcatttttc

SEQ ID NO: 577042 - DNA, 1171 bp, Homo sapiens
ttgtatagtgcctacgttgttgtgagtcttctgtcgtccatgtctgattggccttctgtcgttatatagctgatttagctgttttcggttttaacgcgggtgtgatcatatgtcagtcttgctcaattcggctgttctttttgcatctcgtctttctcagtcggggttaccacctgtgatcgtctctttctgtctactttgtctgattgtcatcgtgatgtccaagactccgttattcttgtttgtatctgttggaagcttacggttatttgcgcgcgttggtgaccttatgtcttttttgttcttccggatgtttagatgattcatgcacctccttcggttcctccatttgtgggtgctagtgtactactcttggtgtgaggcactatcagctttctctctgcgctttggtatgtttattttgttgttttttgaactactgacttctattgctttgttgtacggttccatcgacttggatgtgtcaggtgtagttagagttcttatgcgcctcatgctatgtattttcttcttcccttttccgggtttcgtggggaattatttcagcgcgccgtctagcgttctcttgagcgtgaccttgggtcatttcatgctgcgccaacactctatcttcctcctactgacaatctctgaagtcttctagatacagtggacgtgcgttctccccatgattgtcccggctcagtctggcactcttgacctcaggtgatctgtctctgccactgtgcctctcccatgatgctgggatgtattatcgcgtgacgacctacagttgctccgtccttctatactcgcaacactgttaaagtagcttggagtatggcacattccatggtgtgcgttttgtagcatccatttgtaaacaataacaaataaggaagctccaggcaccattggctcacgcacgtaaccccagcagtttgggaggcgagagcaggcagatcacctgaggtcaagagttgagaccagcctgaccaacatggagaaacccgtctctattaaaaacacaaaattagccgggcatggtggcacacgcctgtaatctcagctactcgagaggctgaggcaggagaatcgcttgaacctgggagcgaaggtcgcagtaagctgagacttaatgccaattaaccccccgcctggcaaacagaca

SEQ ID NO: 577043 - DNA, 407 bp, Homo sapiens
attaacctctaggtagcacacaaacagggtggatggaatactactcggccataaacagaatgaattaatggcatttgcagcaacctggatgagattggagacttattctaagtgaagtaactcaagaatggaaaaccaaacgctgtatgttcttactcataagtggaagctaagctatgaggatgcaaaggcataagaatgacataatggacttcggggactcgggggaaagggtgagaaggaggtgagggataaaagactacaaattgagtgcagtatacactgcttgggtgatgggtgcaccaaaatctcacaaatcaccactaaagaagctactcgtaaccagacaccacctgttccccagtaacctatggaaaaaaatttttaaataaattataacaatgcca

SEQ ID NO: 577044 - DNA, 456 bp, Homo sapiens
  misc_feature (11)..(11): n is a, c, g, or t
  misc_feature (198)..(198): n is a, c, g, or t
  misc_feature (454)..(454): n is a, c, g, or t
agttttcaaantcggcctccgcctggaaaaaagtttgctgttgaacctcctctgcgattttttaaaatcccagttaatcctttaaataaaatcccaattttcctagtattttaaaaatttaattatatttattttattttatgttatttttaagatgaggtcttgctgtgtttgttgcccagagctggagtgcagtgngttgagcatagctcactgcagattcaaactccggggctcaagcaatcctcctgcctcagtcttctgagtagctgggactacaggcatacactaccatgcctgtctatcaaaaaaaaatttttttatacaaggggtcttgctgtgtcacccaggctggtcttaaaatcctggcttcaagcagtcttcccacttcagcctcttgagtagctgggattacaaggtgtgagccactgtgcctggctaaaaaaaaaaaganag

SEQ ID NO: 577045 - DNA, 283 bp, Homo sapiens
tcgaatcgacggtttctctgctgactgcagaccaggtctcggcctcctcggactcctgctcagtaccctatgacgggcgcacgtggcagggggctggaggtggagcgctcgccgtcgccgccgctagcgctgagctgcagcaattccaccaggtcgctgttgtctcccctcgtgcaccagagcttccagtttgacgaggacgacggtgacggggaggatgaggaagacgtggctgatgaggaagacgtgaatgacagatgcccatgatacagaggccaaagtg

SEQ ID NO: 577046 - DNA, 409 bp, Homo sapiens
tagctttaacgatttcgtaggaaacgggaatatcttcatataaaatctagacagaagcattctcagaaacttctttgtgatatctgctttcaagtcacagagtttaacattcccttttatagagcaggtttgaaacactctttttgtagtatctggaagtggacatttggagcgttttgatgcctattgtgaaaaaggaaatatcttcccataaaaactagacagaagcattctcagaaacttgtttgtgatgtatgtactcaacaaacagagttgaacctatctattggtagagcagttttgaaacactctttttgtggaatctgcaattgcttatttggatagcttagaggatttcattggaaacgggaatacatatagtacagcagcattctcatcttctttttgg

SEQ ID NO: 577047 - DNA, 475 bp, Homo sapiens
tttttcgtgtcaaatataatacgcattgttctgagaccaggctggcgggcgagggggagctgaccgaagagagtcgggcaaggagaaagataaagagagccttctaaatcattgtctgatgactgattttcacatatctatgcacacacacatctatgcacttacacacacgcactctcacaaaaatacacacactgaaaaaatggttcaaccccctgagtcaatacatgttacaatcacctgccagtaattacagctgtgattctttctgggtacgtctctaagagttttgcacaccttgattgtacaatattttcacattattatttaaatagttctttcaagttggttgatgaccattgctagacagccatttaagtcttgccatagattttcaagtcgatttaggtcagaactgtaactaggccactcaggaacatttcaatgtcgtcttgataagtaactccgacgacgc

SEQ ID NO: 577048 - DNA, 124 bp, Homo sapiens
tgatccggtcacgggtgagggagtgtgagacatagcaggacgcttcagcccgagggttctggtgatggcgtgagcgcttggctttggatcgtgcagtgtgtgtcggctggcttggtgtggtgct

SEQ ID NO: 577049 - DNA, 254 bp, Homo sapiens
tccctgaaagcagcctgctgagagtggcaatttaaaaactacaattctggcacgatgtttcacgcctgttatcggagcactatgataggccaaggcaggcagatcacttgaggtcaggagttgagaccagtctggccaacatagcaaaatcctgtctctaataaaaatacaaaaactagccaggcatggagttaggtgcctgtaatcccagttactcaggaggctgaggcaggagaattgcttgaatccagtag

SEQ ID NO: 577050 - DNA, 476 bp, Homo sapiens
atgattagtgcaacagactgaaggaagaaaacaacatggtcatctcaatagattgtggacggctggaagtggaggctcacgcctgtaatcctaatactcctaccaacagtgtataagcattcctttttctctgtaacttcaccagaatctgtttttttgtttgtttgtttgtttgtttgtttttgactttgtaatagccatgggctgggctcagtgactcacacctgtaatcccagcactttgggaggccggggagggtggatcacttgaagtcaggagttggagaccagcctggccaacatggtgaaaccctgtctctactaaaaatacagaaaattagccagatgtggtggtgtgcgcctgtagtcccagctactcgggtggctgaggcactagaatcacttgagcctaggaggcagaggtggcagtgagccgagatcacaccactgcactgcagcctgggcgacaaagactgt

SEQ ID NO: 577051 - DNA, 373 bp, Homo sapiens
tggcccaggtgatgcttaaaccccccgtgttttgcaacacaacctcgggtggaacctcagcagaaaggatggaaaaatgtggggaggaaaacccttggggggttggaagtgtgtgtgcgccaggaacacaaggctgtgccctttattgggactgtgaaaaaaaaacgctgcgtgggcccgtggtggtgacgtggaacaccagggaaaggagaacaccgtgggcgtggaggcgagagaaacacggggtttgtgccccagccacagtgtgcgggagagggggcaagagcgggtgtggctctccagaaaagtgtgtggacagcgcgaggtctccccacaagaaagagagagagacctcgagggggccagtgtccct

SEQ ID NO: 577052 - DNA, 214 bp, Homo sapiens
agatatttcagtataaaaaatgatgacatttaactttggtaacaaccaacaacaaaaacctaccattgctgggcataattagtcatgcttgtaatcccaacaacttgggaggctgaggagggaggaccacttaagctcaggaatttgaggctgcagtgaaccgtgattgcatctctgcactccagcctgggtgacatagggagaccccaactga

SEQ ID NO: 577053 - DNA, 131 bp, Homo sapiens
cccctgcagacagacaacagcatgaggtgcaaaataaaaaaatctactattaaatcccttcgtaggaatgctttacactttccacagaacagaaactaaaaataacctgttatacaattaagtctacaaat

SEQ ID NO: 577054 - DNA, 510 bp, Homo sapiens
  misc_feature (442)..(442): n is a, c, g, or t
aatggtattttcaacaaatacagcagtggattaaaagacatccgtcatcgatttcaggtcgtgcaggtcggagcagtatatacaagttcgcccttcatttttttgttgaaaatatcgtgttaaatcctgaaaacgcaaaactcacagagttgcaactggccgaaggttaaatgatggtcgacatgatattgatactaaaattattgagctcaaaatgaaccaactggagaaatgacgagtttcattatggcattgctgtttaaacaattcgactatgttctgagcgtgtagatgatcgagcgtgattcaatttgccataaatagtatgattaaattggattaacgataatgtggcagcggttaaatcaccctaattggcactggaaaacgttcaaatggttaggcctccggggtgggataagcactttccagaaaattaccntgggggggtggggtttccatttttttagaaggttccatccggtttttccagtaatattttggaaaccc

SEQ ID NO: 577055 - DNA, 1019 bp, Homo sapiens
gaagatggcgcgcgctcgtattctggatttgcaattagaatttgatgacagaggcatgtgctttatggagaatatcactctatcctgcattgaattccgcgttgatcctcaggaaccaggatgagatagatgtctaacggttgtgcctccggacagcgagcataggattaaatatctagggcaagaacgtgctgtcactgggaaaccgactataatgtgtcctagaaatagcaaccctggtttgtccggtttctgctggggaatcgcaccagagctatccaatggtcacgttctcaaacaataatcgaaatcgaagcaagtgagataacgtgtgattccagtaagtctagtgctgttggaatgaaggatgcatatcggagtggagattcatcacgacatttccgaaacgttgaacactggattgaggacttgggattgatccgacgtggtgtaggggcgctcagaccgagttcctcgtccgtcgagaatacggaggtacgatccgatgaaagaccaccactagttctcatgagcgatgcatggtgttcagatgtggaccgtcgattgaagcaagaaaattctatctgacgtgagaactgtgcgatcaacgggtggatattggtgatcagaatagtcgtatgtggattcattagactgatgcggcatatggatgattgatcctctggtgttcttagagaatgactacgtactctgattgtgtgctactagattcgggtatcatgaagcgtataggcttggacctaacagtagattgggtttcatgtgctaatgcatccaaattgctgggatggtacttccatgtatttctaaatccgaaggttcagtcctgtcgaatgtccctgggacccttgatgaaacttttgttgtacgcgtttccgagtacaagacaagatattgtaccaggaggagaacgattggcagccgcggggtggaaattggcagacagagtgaaaacgattgcgtggggggcttgccgtccccgagatgtaagaaacgag

SEQ ID NO: 577056 - DNA, 321 bp, Homo sapiens
acgatcggtggacatcggtttgggcgttcggcgtgtgcagtatgggcgctcggcgtgtgcagtgtggttttcggcgtgtgcagtctggacattcggccacgccgaacgtccacacacttcttgaagtcaaaccataatcgccgatcttcacgagggcgtaatcgccgatcttcacgcgtgaagatcggcgatattggtatggatactcggcgtgtgcagtttggatgttcggcgtgtgcagttgggggcttcggcgtgtgcagtatggacactcggcgtgtgcagtgtgggccttcggcgtgtgcaattttggttactcgg

SEQ ID NO: 577057 - DNA, 173 bp, Homo sapiens
ggggtcaccggccggtgtgtttctctacatatgtaggcagatgacgagtgtttctgggtgcacggtgatcagtgcatgtgtcgctggtattctgagcatgttagtctacgtggtgtgcatccagcatgcttcctgtggattctcagtgtctgtccatcacgagagaggctgca

SEQ ID NO: 577058 - DNA, 130 bp, Homo sapiens
gcaccacatggtatgccatgtcctgccgggcaagcaagcactggtgaggctcgacgaaatgcatgaacatgctgagcttctgcgtctgtcagtgtacaaggacagtgctcatgtgggccaggcccagtgc

SEQ ID NO: 577059 - DNA, 261 bp, Homo sapiens
gtaatgaggacagaggacgaaaaaaataaccgtccaacgactgcctcaaacgaacgcggacgccgcgaactgccatgaacagcaatcggtcaatatccaacacagccaacctaccctgtgcatgtctcctgggaatccagtataccctcagaccttgcatcttcctcaggctccaccctatacgcgatgctccacgctgcctactcaagagctctatctgtccgagctttgtgcacccatggggctagcacaagtccccac

SEQ ID NO: 577060 - DNA, 268 bp, Homo sapiens
atgggtggtagtgacaactggctgcatatgtgttctatgccccgagtgagggcaacgtgctgacttagatggtcacttgttatcagcccaggcagttgacatactgggtttctatttgaaaacagagggagtaaccacgcagtgagcatcgcgcccctgcgggcggggcgcagggctctagcgtccttggtctactctgggccattcacgggttcacactactcacccggaccgtaagagagatgagtgccccccccttatgcctata

SEQ ID NO: 577061 - DNA, 567 bp, Homo sapiens
  misc_feature (37)..(37): n is a, c, g, or t
  misc_feature (545)..(546): n is a, c, g, or t
aatagcattacaataattttatcaatgaaatattcanctacactgtcagccatattacaaataaagtgagttagaaaatgataaatataacaagatgacaagtttttgcaggaggaaaatgtatacataataagattaaaattatctaaataagtgtcacatgtgtacattgagctatgtaaataggacaaaagccatgatgaaaaaatatattttacataaataatatcacaacataaaaattttagaaaaattttatttaaaaaaatttttttcatgcttttataaaatttcttacattaatcttatattatttttattatgttatcacagaagaagaaacaaccagtccatatcagtgatgaatctgtaaagaggctcgattccttcaacactgggtggataaataaggctctgggcatcaagctagtgagatgaaacactgaacaccagttacattaaatatggctacaggcaactgcaatcacacgcaatacctagatgccccaagtattacctggaatagcagtacaatgactctcatnntaagattaaaaatcatatttt

SEQ ID NO: 577062 - DNA, 138 bp, Homo sapiens
attaaaaaaaatttaaaaaaaaaaagaaaattttatggtctatcccaaagggcccgaatgacttttttgggccttttttttaaagagctgcttggttatcccaaaatgaaaattccaaataaactttgaagaaaagga

SEQ ID NO: 577063 - DNA, 882 bp, Homo sapiens
  misc_feature (882)..(882): n is a, c, g, or t
ggccttctctcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccactctggcatcttccttcaaaaaaaaaaaggaaacttgaatagggcaggagacaaagagagacacttacaccacacaaagaagaggcagcagctcggcacaaaaagaaccgccaccagtagcgagggcaccgcccatagtgactgcccaccgaagcatggattccccaaacaagacgtgcgccccccgacaaggagtagcccacaataaagagccataccaagcacagcgactcgaccgcggagcacatcacgacggaacgacgggggcgaaacagccctggactggagggccatccgtcggaggagcgaacacgatacacacgagcggggagaaagcaactggcgagagagtcacccaacaagattan

SEQ ID NO: 577064 - DNA, 653 bp, Homo sapiens
cgccgcgaacgcagaggagaggaagcaacccaacgaatcccaacccagcccagaataaacacgcgacgcaattccccaacccaattcctgctccttgcttcttcctcacgccgcacgggataatcttcctcctcccctccccaaatccgctttattagcccgcgccccgatcgaaaatccatccgccctcgattccccccgccccaagcactccgcttcttcgagctcacgattccttcgttcgttcaggagccccccgaatgcgccgactccatcccgccgggaccagattctgacgccaaattcgctcgcgctcttccgccccgccgattcgggttcgtctccggccgggatcctcgctcgcccccggccgccgtccaatttggtgtggatagttgagaggctctgagcttctcgattcgagctcgtcggaggggagagcgtctcggattctggcgaccatgtccctgtcggcgatttccctgtacaccgccccgccgggcgccgcctactcctcttcctcctccgagttcgacctgggctcgcgcggctcgacgccgtgcagcaccgcggcgccgccccgccggccgctcccaccgccgtccgccggcgccggcgcctggggcctctcctgctcttctcctcccccggcc

SEQ ID NO: 577065 - DNA, 804 bp, Homo sapiens
  misc_feature (48)..(48): n is a, c, g, or t
  misc_feature (50)..(50): n is a, c, g, or t
  misc_feature (804)..(804): n is a, c, g, or t
aaaaaaaaaaaaaaagaggttttttttggcccccccccgcccccgccncntttttttaattaaaatgaggggtggcgggggaaacccccgggggtgcatcacacaggggtggttaaaaattttaaagggcccagttttttttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccactctggcatcttccttcaaaaaaaaaaaggaaacttgaatagggcaggagacaaagagagacacttacaccacacaaagaagaggcagcagctcggcacaaaaagaaccgccaccagtagcgagggcaccgcccatagtgactgcccaccgaagcatggattccccaaacaagacgtgcgccccccgacaaggagtagcccacaataaagagccataccaagcacagcgactcgaccgcggagcacatcacgacggaacgacgggggcgaaacagccctggactggagggccatccgtcggaggagcgaacacgatacacacgagcggggagaaagcaactggcgagagagtcacccaacaagattan

SEQ ID NO: 577066 - DNA, 843 bp, Homo sapiens
  misc_feature (843)..(843): n is a, c, g, or t
ggccttctctcttcctcggcgctgcctacggaggtggcagccatctccttctcggcatcatggccgccctcagaccccttgtgaagcccaagatcgtcaaaaagagcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccactctggcatcttccttcaaaaaaaaaaaggaaacttgaatagggcaggagacaaagagagacacttacaccacacaaagaagaggcagcagctcggcacaaaaagaaccgccaccagtagcgagggcaccgcccatagtgactgcccaccgaagcatggattccccaaacaagacgtgcgccccccgacaaggagtagcccacaataaagagccataccaagcacagcgactcgaccgcggagcacatcacgacggaacgacgggggcgaaacagccctggactggagggccatccgtcggaggagcgaacacgatacacacgagcggggagaaagcaactggcgagagagtcacccaacaagattan

SEQ ID NO: 577067 - DNA, 746 bp, Homo sapiens
gcctgaggtctctaaggctgcgcccgcccccgccgggcttctaagctgtccagagcggggagcctcagacccagccgagccccacttctgggcttagagcttgacccaacacgttcgcaccgtagcgagcgaggtccacatttagccatgccgcaggcaaaagaaggattcggcttcggtcctggcccagtctgccatcccggggcgcctgccttgtaccgggtcccgcggagggcggccttggcgcctgcctccctggagcctgcagtcctgcagtgggtgagtgaaagcgagagaagaggagctcaggtcctcagcctccaaactcgtcttcttggagagcttcagtgaaggagatggccttgaagtcctgggtacaaatcctgactctccctactcctttacatcttagctgctggaccttggcgagaaagtcccctgacctctctcagtgtcttcatttctgaagacggggaaggtcgtatgtgaggcgcaaagcctcctctagcagttgggcgttgcgagggtcagaggggacaatgactgtgggagtctggagagggtgtgagctcatttaatgccagagtttctttcctgcctcctggacttcggtgctattttgggcgagccaactgccctctagatacacctgcatctacggtccggaaggaagacatttttagaatagagcctctaagaggaacagaagaagaccatattgccaggtccgcacaatcagtgatccc

SEQ ID NO: 577068 - DNA, 856 bp, Homo sapiens
agcggagcaccctgccagccgcccccatctgtgtctgtcggaacccacacacaaatctgcactccaattgctgacagagccctgacgaagcctactttccccagagatggccaataagggttcttcctatggcatgagccgcgagcgtgcaggtcccagaatcgaaaagaagtaatcgaccgagtgagctggcagggagcaggcgtggtgcaagatgggatctactagtgcactttagtggctccatggatgtgggccggacccagaccagtggagcgcttggggcattttcacgtctggcttgaagaaatggcgtgattctgacccacacgctggtgaacacggacttgtcaccccgtcgcataggattctctacatgtccggtgaagaggtgcctcgagaacgcgcgaccacatcgcaatgggtcttgcagacgtcgagaatggcacgcttgtggtctcaggatttcacgtgaaacggcggcgtgaggcactatggggtcgatcaaagactgaccatgttccagacgggcttgacctcgtttgaaggcgtcacgacattgggagcagttgcatgcagggaccactgatgcgcttgtgggtccagcccttggcatggtggaacaaggagaatgattgggcactatccgctgcgacgatcgcctcgcatgggtgtccatgcataccaaaggcagctaggaagcagtgctcagggtgaagtgccctaggagaggcctaactgccggcaggcgaaagacatgtccattgcgccgttccatatggggccgcccacccagagggggccggtcccaggctcggagtgaactggtttacggacgacctcgcgggaattcatc

SEQ ID NO: 577069 - DNA, 816 bp, Homo sapiens
cgagactgtttctacaccattcgtctgtggcgcgggcccaatgattagttgaccctggttcactagctgcttgcttacgcagatcctggtcatgactagtgctctgccagttctcaccacatacaaaaatgactctgtgacaagccgagcgttctgtatcaactgccagaatggaggttcctaagatcacttacggggtctcttctcaacagggcagtcctcgtcggagactcggaatttcaagatgaacaaccccgtctccatgagtgaaaaatgacaaaacatcatcaagaaaatcaaagattcatacctgtcaaagacagggctgttcccaattgaatttacactcaggttctctctttgagggtcacggagaaattgcttgataatcatactccaaaaagaaactgggaactggacgcgaaggaagatgtgattgaagttttatcaggaacaaacggggggtcattcacacagtttaagatattcttttaattatttctctttttccctcaatcccttttttactttttaaaaaataaggttccttttgtacatgtgggtgtccaaagagcggcacttgaacatctgggcacccccattctctttgaaagcatctgggtaatttgaattctatgtgctcatttatcattactgcttggtttacattgcggctgatttggagatccaagcctcagtccccttcatataccctcttccttttaaaaattacgtgttacacagacaggtcaccttttcagggacatggcattttaccgctgtggtgaaaataaatcgacatgcaggtcacaaggc

SEQ ID NO: 577070 - DNA, 123 bp, Homo sapiens
tgttctgggacgatgctgacgactccactggtcgagggaccacattttatcaggaatacgagacgttctatggtgaacacagactgctagtccagcaggccgagatcttgagattagcaaaga

SEQ ID NO: 577071 - DNA, 934 bp, Homo sapiens
ggagagaactagtctcgagttttttattttttttcttggactttttaaatgaagtaagcctttatttcctgtgtttggcaaataacacgggctaagtcggtggcttttgggtgatcaggtcaaagagacgaaatcccatatcctcgtccgactcctccgactcttccttgtggcttcaaccttagctggggctgcagcagaatcgaggagcagcttgtggtggcagcagccacaggggcagcagccaccaagggcacgatggatcacccaaggaaggccttgaccttttcagcaaggtggagaaggtgtaactccgtctccacagacaatggccagagactcgtttgtacccgttgatgattagaagggggtactggactgcaacagttggggtacgccaatctggacagacagacttgcggcacttcttggctggacaccccatccaaggaatgtgaacaattgccagagttcccttctgtgatactcaagccctctcaagcggttcgtcaaatcgctcgcattggtcacccaccctgttaggatagaccagcccaaatggaagaaggcggcacaatgttgacaatgtccaacagtcgtcgactcccactgggccaccacaatcagcgacacgcaggccttcgatcacaacgtacgcatctcaccacaagggaataaaacatgggaaagccccctaggaaaataacgacggcaaacaccaaacatcgctgcacaaagaggcaacacggccgccaacaccacaacattggcgacgcaagacagaatcaccatggcgcatcggccaccaaccaaacccacatgccccaaatcggcaacaacaccgtcatgacaacgaacgcgcactggaagaacaaccccaacaccccgaccataagcacactacccacaaagaaagcacacagagcccaacaag

SEQ ID NO: 577072 - DNA, 360 bp, Homo sapiens
  misc_feature (36)..(36): n is a, c, g, or t
tccctaagaaaaaaaaatcctaagaaggtgattttncccccaggtcaaaagggaaggaacattggaaagtcctcagaatactggctgtgcccccacattggaccagtgagtgttgagggcctagggttctgtcgtcatagtcacccactgtagctttagatttttttcctgagagagggtctctctctttttttctgcttttgaggtttaaaccatggccagagacagggtctcgatctgtccctcaagctggagtgcagtggcgtgatcttggctgactgcaaactccacctcctaggctcaagccattctcctgccttagcctcccgagtagctgggattataggcgcgcaccaccac

SEQ ID NO: 577073 - DNA, 309 bp, Homo sapiens
  misc_feature (133)..(133): n is a, c, g, or t
gaaggggccgagctcccgaggacgcctggccggggctccggaagcgcaagttcacgccaaccgcacgctgagggttcaggtcaatgaccgttctcacgccatagagcgcagtctggatcaccaggaggggccncctggagtggacatatcctggtggtctgcggagctgtagttctaatgaaaggagctgtgcccaccctgttctcttggcttcaccccacaattgcagggccgcttcttgggcctggacccccatggggaggaagagtccccctcactacaaataaagaaagctggcgtgaccctggg

SEQ ID NO: 577074 - DNA, 245 bp, Homo sapiens
tgaggatcctccccgattagcccgacagcatcagtgtttatcaaaatacaataagaaaaaagtagaggttgtctttttcgatggcaaatcttgaccctatgcaggctgagtggagagaaagctacatcacacacagagtgtgggtgtgctccctgagtgggctgttggtctagtgtggacctgcctgtctgggctaagtctgggtggggtacctgactgctcgatattctgtaaatcagtggtca

SEQ ID NO: 577075 - DNA, 230 bp, Homo sapiens
gggtgcccagccccccccccaaaaaaaaaacattttttgccctttttccaaggtttttattttttcccccgggcccaaaaaaaacagaacccaactggaaaccccctgggtaaaagtttgggaggggtgggcccccactgttaaccccccgccctgcagccgggggcctaaaaaggggggtggagcaaaaaacccgccccccaaagtgtttatttcccctgtttttttta

SEQ ID NO: 577076 - DNA, 291 bp, Homo sapiens
tgatatttagaagtgtgatgttggtacctggtgcagaccatgcaaaagttctgaaaagctcctttatgccatctgctgaggtggccacactatcatttattcctggattggctagaactgtggtgaccacacagctatgaaacaacatttcagctagtttgacagttgaccttttgcacgtttatctttaagcaatgcagctatcgtccattgcatctactcggtcattctcccccatttccatcctattcaccccttagcccattgagcactaaaggcaaatcagggcac

SEQ ID NO: 577077 - DNA, 119 bp, Homo sapiens
ggtcaggaggaaggtgcccaggaaccgcgggtcgctgagatgtagaagaatcgcatgtggacagacgattgccgcaaggagtgcttctgcgatatcgcacagaggtctggtgccggatt

SEQ ID NO: 577078 - DNA, 406 bp, Homo sapiens
gtagtcttgtggtggcccacattctgctgcagttgtaaacatccccagatctctgtggtttagaaaagctggccaggcatgatggctgatacctgtagtcccagcactttgggaggccgaggcgggcggatcacctggggtcaggagttcgagaccagcctggcaacgtatgaaaccctgttctactaaaaatataaaaattggctgcgtgtggtggcacacgcctgtgatcctagctgcttgggaggctgaggcaggagaatcgcttgagcccgggaggtcaaggttgcagtgagccgagattgcaccattgcactccagctttggcaacaagagtgaaactccatctcagaaagacaaagaagaactacggctgtcatacttggagtctcacatctgtaatccc

SEQ ID NO: 577079 - DNA, 594 bp, Homo sapiens
  misc_feature (103)..(103): n is a, c, g, or t
aaaaaaacaatccccccaaactctaaccttaacatcaagaaaaatatcccccctgcaagctagcaattgtccagaataaacccgggaaacccattaaaaaaancatacccccccgtattcaccttaagatatttttgtctttactggtgaaaaggatttggtattgatttaatttccgtgctcctgattgtatatatttcaagcatttgtggaaataagagtttgcagtcagttagatcaaattgcattagtatatttaaaattgtatttgatacattgatgtagaagtttttaatcttgcttcatactggttgttctgttttgttgtttttaattaggaaaaggcaaactgtacctacaagctaatccagcctgcttcttgtttttatcttttcctttttaatttttttagagacaggatctccctctgtcacccagggtggagtacagtgactacagtgatcatacctcactgtagctttgaacttctgggcataagggatcctcccacctcagcctcctgagtagctaggattagaggtacaagccactgtgtccagttacttttagatttttaaacagttgaaaaaaaaa

SEQ ID NO: 577080 - DNA, 221 bp, Homo sapiens
tgtatatcttaaatgcctatcttatgaagcgagggaaggctggaaccagagtgttgcattgcgaatataacagagggtgcatccattcttcgacaggaaaaaaatttgctgtatattgatgcgccagtcactgtttgtggggacattcattggactattctttgatttgatgaagctctttgaagtcggtggatctcctgccaacactcgctacctcttct

SEQ ID NO: 577081 - DNA, 303 bp, Homo sapiens
ctagaggatcccacgggctgcatatggcaggatagatttatgaacagaaaaagggagtgaggtccagaaaacggaagtgaggtgcagaaacagctggaatgattatggctcagcatttccgttattgaacacttgaatagtcagcctcctgtaattggcagatgcgctatgattggcacaagagtagattacagtctgtttacacatccagttgggttacagttcactatataggaagaaacctttaggctgaacttaaaatatgtaaggaggtgactttgacttaacaatggtcagtgttag

SEQ ID NO: 577082 - DNA, 309 bp, Homo sapiens
gacaataaagaagggtcccaggttgtaagagcccaagttgagaacaataatgaacaattattgtatgaacaattgttagagacagctaatcacaaacaacctgcgggctcaatgacctcattccacacgtagcacccttcagcaggaccctataaaactttcctccagcccttgcctctttgtaggtagccccttctctgctgagctgcccactgcaacatattttcacaatttctctaataaatctgcccttctttacctacaactatcttggtaaatggctttaccacctgctaaactgaccctagg

SEQ ID NO: 577083 - DNA, 331 bp, Homo sapiens
gggaaaaaaaccccccccccctgtttttaaccccccccaaaaacccttttttttttttgggggttttttttaaaaaccctttcccccgggggtttttttaaaaaattttttttttgggggcttttttttaaattttttggggtttttttttttttttttcccaaaaattttttttttttttttttaactttttttttttttttttttttttttttttttaaaaatttttaaattttttttttcccccccctttttttttttaaacccccccttttttttttcccccaaaaaaaaaaaaaaaaaaaatcaattttttttttttcccccccca

SEQ ID NO: 577084 - DNA, 362 bp, Homo sapiens
  misc_feature (166)..(166): n is a, c, g, or t
ggacccggaggtggtgggggtagaaaagagatcttctgtgatatgtgatgggaggtgtcagatcaacttcactgtggggtggacttcactggtccaatggagaacccttctcaactgaattcctaaaataactgagttcaacaggggtcaatgagtacctgatggnactgtggagtgtgggccgcgtggttccaggactattgactccagacaaagctgttcccctggattttggattttgggggccaggttccccctggactggcaggtcttcgcattgaattttgccttgaatttcaaccccagtaacccctactgtgcaggcatccagggcatagtggatgcctatccacaaacacctg

SEQ ID NO: 577085 - DNA, 394 bp, Homo sapiens
cagctcggggcttgggtcagatgaaatcatagggtgtcgaagctgtcctctttctctgagtcgcttctgggtggggacacagaagccgttggctggtcccggtggagccatcggtcatcagacatgcaaaatcctgagaagatatctcagaaggccaatcctaggttctacgaaagtaacattatctgcaggggtaactgaggaagttgcatatcttgtggcttctggaataacgcctcacaattgtttttgtctacaccttagcagaatttaggctcctctcctcctcctagcctggtggtctctcagtattacaagggtggttgagtttcggggaagggttattataatttaaactatcaactaaatgactcccacatgtagcttggcttaa

SEQ ID NO: 577086 - DNA, 341 bp, Homo sapiens
  misc_feature (293)..(293): n is a, c, g, or t
  misc_feature (325)..(325): n is a, c, g, or t
  misc_feature (334)..(334): n is a, c, g, or t
aaagaaagcaagaagtttggtaagcttaggcatgtcagttcattatcttcctattaaaaatggctttatttataacaaataattctaagacttcttaagcaaggtggaggtagatccagcagaatttatgaaaaaagaggtctaaaacgttggcttgatttatagccgtttcatagaacaaatatgtatatctgtaaattttctttaattaaaattctgcagtatgtgactgtgacagcgattgtgtattcatgctgtaatcaaatatatatattcataaggaacagcagttngtgagaaaatgaagtgcagtccaagtagaganagtactagnctgagag

SEQ ID NO: 577087 - DNA, 108 bp, Homo sapiens
gtgcctagaggatcccgcatttcgtcccatcaggaaggctaaaatttaaaagtcgaacataccaagtggtgacaatggacatggagcaaccagaaccctcacgcactg

SEQ ID NO: 577088 - DNA, 451 bp, Homo sapiens
agtatttaacgagtaaatgctctataaattagactttagaaatgactataaagaatctcttcctgccaccaagatgcaaaaggaaaggcagaggaggaggtggctctggccttggtgtcatgaagaaacaggaggcaagaaagtggtgatcctgtttgcgcgtggtggctcacgtctgtactcccagcacattgggaggccgagacaagcggatcacctgagatcaggagtttgagaccagcctgggcaacatagcaagagcccatatctaccaaaaaaatttttttttaaattagctaaatctggtggcacaaacctgtagttccatctacttggaaggctgaggagggaggcttgcttgagcccagaagttcaaggcatgcagtcagctatgatcaccactgcagtccgcatggataacacgaggcaacgaacctgtctcatttaaatt

SEQ ID NO: 577089 - DNA, 594 bp, Homo sapiens
  misc_feature (280)..(280): n is a, c, g, or t
cggttcctatcgtgtgacactcagctgtgcatactctgtagaatactcacgataactgtgccaggataataaatcaattctgaactatatatccctcaaattatacacataattgcccatggcacatgtaccacagggacatgataacacagccgagtcactatatgccttctggctagtgcaataccaataagacgctcagtgaggaccactggaatgaacgcaggaacaacggctcatgaagctgactctctgataacccgagctgactaaaggggtnttatgccttatgacgttgagacaataatggttgtggagaatagccgcaaagagggacattgagagataacctgtgatccatagtgagacataccgtgaggttcccaaatattttagcgcaaactcggtaagagtgtgactatacactatatcactatgatctccactgtagaggtgaaggagaaagaggcctatatgtaccgttacctgagagttcttacagcgggaactctggggataatacgcgaatcatggcgtatagcacgaggggcattacaaggctaagacatgagacacttattggagcgacgattt

SEQ ID NO: 577090 - DNA, 440 bp, Homo sapiens
ccacgcagaaaaaaaatggtggtggttcttccttattgagtcttacttcaggggaatcggtgcattcctatgtcacggccatatttatccttatgctcagggtctgtattgggggcgaccttgaaggttggacaatcccccttgggccttttaaagtagagggcagagtgtggtgcacaggtctggacccaacggtgttttatctgggccttttgggctgtggatctgtggtcccgtgcagggatttttgggtctctggttcaggtctttttatgagggcgggaatggattctgtaatgatgtgaaaacataagtatttggcaagccaacaatttggcacactgcagagcctacggctcttcgttcttctaggctaaacttctccgatgatcgacttatggatcacagccccagacccatggcttgcgggaagatgacgc

SEQ ID NO: 577091 - DNA, 1031 bp, Homo sapiens
  misc_feature (697)..(697): n is a, c, g, or t
ggggttcgctggctgctggcccgggctccggcccccgtagtgagcagcaccccccgggaatatgacattttctgctcccaccgagttggcacggcctgcttcctgaagtctcctgggtgtgtcttagctgccatgtcccgagcgactctcctgagatgcactagctctccatccaggtggtcaccagcaggaaggatcagtgggatgaatagcagaagcgatcgacaaggatgaggctgactatgaggtcaatgctggagacccttcccgaccgtgttcaaacacttcagactactgccagagtgactatgagcgtggacgacccaagaagtcatactctgtcgcgagaccattggtaaacaaatctgtatcgcaatcaacgcaacgggcagaagccatcctgtcagaaagcatggatacaacaatgaacgacaaattgcccacaatgaaaattcggggctcgcatccctaggacatactgtggagatggaatcagggctgagcgcacgtatctgcagatgcagtaaaatcaacacgcggacatcaagagtggatagccgaaaccaatcactaacgtatacacgtgaggtcatgtgtaccgaggtgggggcaaacgcccttgcgctagtaaatagcggtctcctgtgcataagtttgcatactctggggaaaacacatccgttggtacactccattntgtgcccccacgtgttaaccccaatagacacaagggtgcgcacttgtggtcccacctagagcaaaaatctgatcctagtacattagactatggttagaaggaacaacgaccgaagctcccccttgtaggggtataacgcgaatccccattggggtcagtaataggcggcaaaaacggcgagaaaagatttgagaaggagttcctaatagtaaaatcatatcgatgagaacatccacgagaagatttaacaccaaaaggtgaacacctgtgaaagaaggcaaccaatcccgcaaaaatgatagggtggagaacgtaatgaaacaaaatcttacca

SEQ ID NO: 577092 - DNA, 711 bp, Homo sapiens
  misc_feature (388)..(388): n is a, c, g, or t
cagactgcaatttcttgactaaagcttttaatgccaggttaaacaggagaaactttttccactagaagaaaatccttgctatctattttttccaatagaagaaaatccttgctattatatttaatttggatggaataaacaaatttatggcagtagcttaaaaaaaatttttttttaaaacagtctcactctgtcgcccaggtggagtgaagcagtgtgatctcagctcacgtgaactcaaactcccggagtagctgggattacagacatgcaccaaccaccctcagctaatttggtacttaagtagagacggggttctcgccatgtggcccaggctggtctttaactcctgccttacgtgatccgcccccctggccttccaaagtgntggggattacaggtgtgagccactgcacctggctggtagtagcttaaaattttccttgagaaaattcctgactttaaaaataaccttatataagtacaagtgattgtgacaaatgacgtaaaaatggcattccatgatggtttgaaaaaagccttagttagaatttcagaattcgactaaatgatttccacaaaggaaattcaaggtttaatttctatgattgggaaacattttggaagtttttaattcaatttccggtgagtttggcacaaaactggcatgacaaagggaggattcagggtgcgcagtgaagaatttgacgt

SEQ ID NO: 577093 - DNA, 305 bp, Homo sapiens
tgtaccaggagttgacgacagctgagcacatggcgagacacatcacattgttcttttcttttcttttcttttcttcttgagtggagtcttgatctgtcaccgagactggagtgcaatggtgtgatctcggctcaccacaacctccacctcccgggttcaagcaattctcctgcctcagcctcccgagtagccgggactacaggtgcccgccaccatgcctggctaatttctgtatttttagcagagatggcatttcaccgttttagccaggatggtctcgatctgctgacttcatgatccgcccg

SEQ ID NO: 577094 - DNA, 280 bp, Homo sapiens
gacgtgctatcttagaactgctaacacttcgcaggagaacagttccgtcttataactaataagatctgcaagtatgctcagtgccctcactgggccgttcctacgcttcacaagctgacctgtaactggacactctaaactgctttacagttaggggagttcatgactgacgccgacgacatcagtgagaatctcatgagctatgcgatcgacatacgggccccatgcacttactgggtcttaccgctgcgcttgtgactcatccctatgagtattggtg

SEQ ID NO: 577095 - DNA, 105 bp, Homo sapiens
gtggcttgtatattgtcttaaaaattgctttttattagttggataaatctgatttctgcctcacctttgaaaactcatatggctcttggttgagatatcaacctt

SEQ ID NO: 577096 - DNA, 118 bp, Homo sapiens
ccggtccccacctgtgtctcatctctacctgtgtgctccacctgtgtgctcagatatgttaaagccacttgcgtagtctatttatgttgtcagctggatgttttttacaactacaggt

SEQ ID NO: 577097 - DNA, 221 bp, Homo sapiens
agagtatatatggggggagagaggaaggcagaggtgggagggcagagacacaaacacatacacacacacacacacacacacacagagagagagactacggacgacacgaccagtaccacgacgacacgaccacgtgacggggggtcacagacgactgatttgacttcttacccatgggaccacagactacgacgtactacacttacgtgggggcccctact

SEQ ID NO: 577098 - DNA, 1278 bp, Homo sapiens
ggttcccaggatgctggggagttctgcaccccgagaggccgagggccgccctgtaggagccatgtggtgagaaggcgtcccgcgctaccagtcgcttccatgcgcctggtcctagcccgcgcccgtgtcgggacgtcgtgcttgcccataccaaggtaccaggtgctgtcgtgagatgttccgtgagcatggtacaccgatcgtgggccatgcttcctactaaactgttccgatactgcctctaccatttgctcaaggtccagccagtgggcagtgcaggacgactgaatgacgctaggccagttttggtacggtacgcggcgagatgtttgcgccctaagaatccataattccgatggtagcccaggactcctccttacacgcattcccggtcggggaagccgtcattgggtcgccccgaacctttcgatggaagtggcatcccaggggaggtcattacttaccacgactcagccaaatcggattggcacgttcatttggatgcaagggaagggcatgaccaagaaagcaggtcccctcccatgtcttagccggcccctctggcccgtcccgttgcagacgattgcgcaagaattcgttctaggcgccaagaacgcgttgggtgggaatgcacaggtcaagggggatgcaaagcccatcattggggctttccgtggtccatcgccactgaggccccccttggcattggtgtggggtggcctggggccgggacccatggcttgacctcggggctttgggtacccgcggcggcctttcgaaccggttgggatttggagagtcacccgggatccttctggaggcctggggcctggccgcttgccccccagggcacttcgccggctctgcgggcacggaaaaggtgcaacccaacttttcgttccagtggacgagttgggcaggaaaaggggcccttcttcacgagttccaaacttttggatccccttgtggcctctcttgcttggggccgccaggccaaggccgcctggtggttctccccccagggcccatgcatttttggccggaataagccacaggcaatgactaggcccggcgcgttcgtatgccgtgttccccaggtggttcctggaggtgggcggtgtgccccagggaatcttggtttgtacgcgggattccgaagagccctgggaagggactggagaagacaagtctgggcaccaggagttagaggcggtgtgccgggaagtagtggcgccatcgcgttggatcgcgttagaaacgggttgcgctgactgggcc

SEQ ID NO: 577099 - DNA, 882 bp, Homo sapiens
agcggggaggccaaggtgggtggatcacctgaggccaggagttcgagaccagcctaaccaatatggtgaaacccatctctattaaaaatataaaaatggttgggcgcggtggctcacacctgtaatcccagcactttgggaggtcaaggtgggctgatcacgaggtcaggagatcgagaccatcctggctggcacggtgaaaccctgtctctactaaaaatacaaaaaattagctaggcctggtggcatgcacctgtggtcccagctactggggaggctgaggcaggagagtcgtttgaacccgggaggcggaggttgcagtgggctgagatggcgccactgtactccagcctgggtgacaagggcaagactccgtctcaaacaataacaacaacaacaacaacgacaacaacaaatatatatatatatatatataaattagctgggcatggtggcggcgcctgtagtcccagctacttgggaagctgagataagagaatttgttaaacccgggaggcagaggttgcagtgagccgagatcacaccagtgactccagcctgggtgacagagtgagactctgtctcaaaaagaaaagaaattttgaaaataaatcgtgggtatttgaaaatgctgtgaattgacataatacttcattttgccagtcatgtgataaagtattatttaccagtgtaagagcgaaaaaagcaaagaactgtctgtaggaacactgagggtatggacgctctccttcgtgctctcaaactcaaactccagtcttcgggcagtatgatcgggtaataccgctcgtgggttttactcacgagttaccttacacttcttctcctgtctgagatgttggatcatctgttaatctgtaggta

SEQ ID NO: 577100 - DNA, 479 bp, Homo sapiens
ggacctgccgctctatcctgagccaagcataccttgcagtgacacccaaagtgctggaattacatgggtgagctaccgtgtccagcctcaatttaaaaataaagagcataattgcatgtttgtaacacaaagaataaatgcttgaggggatggataccccctttaccctgtgattattacacattgcatgaccatcaaaacatctcatgtaatccataaataatacacctactatgtacccacaaaaattaaaaaacaacaacaaaaaaccccacaccactacctcactgatgccataatgtttaaccatgcctttcacttaaagaattacaggtatgagccactgcacccatcctagattgcttataacacaaagggtaagtgcttgaagggatggataccccattttctatgatgtgattattacacattgcatgactatcaaaacatctcatgtaatccataaataatacacctac

SEQ ID NO: 577101 - DNA, 102 bp, Homo sapiens
tacctgggcgtttggagaaaacagtaatactaggaatattgtcagcatggcaatgcccaagtgcttcccgggtctctcccccgctgacttggaaaccagaga

SEQ ID NO: 577102 - DNA, 260 bp, Homo sapiens
ccaatggtgataagagcttcaaaagtgttatgtgccaattgctacagaggattctgttcttagatgcatcagcttgtaactcagttacttaaggatatgttagctgtatctcagtttgcatgtggtcagtaaatttagagatgctccttggtcacaatcatgttactttgtatcatggcagtagggtaacattattatttgtttttgtaaatgtttttcttagacagagtcctccctcttttacccgggactcgccttta

SEQ ID NO: 577103 - DNA, 1259 bp, Homo sapiens
gatgtgcccccgtgtgacctcaggcgccgtaagaccctgctgtccaccaaatagggttcttgaaaatttttctggaggggagtggaggtgttcccaggggaattttccagaagtgtttctcgctttgctcttttggaaggatatcttcttttcaaacgaatttaatctccacaaaggggttctgcagcacaaccgatagtggtgtgaaagggctgaagggccctggattttttgggcccccacaagtggagaggtcccctctattgacaattctgtcgcgccctaccttattggggaaatattcggaatttttgcgccatctttaaagtttttgaaattaggagaaaaagaaatagttggggggaagaatttgggaaccgaattttttggtgggccccccccaagagtttaatcacccgggacactgcccatataggggtttcccaaaaaaaggtgtcctgttcccgtttcaattaggccaccgcggggccacataaatcacatggttgaggaagaagtttattttgttgtaagaccacatatccccaacactttgggaaacgcgggtcactgtccaacatagcccacgggagatagaaaagatatcctggttaaattttttaattccccactatgtatatttcttaaaatgcgttaaagttcttccacgctaattttttaattatattaatggtacactctatattgttggggtgccacactcaattaaaatttatttcccgccccccctccccacaacttcttatgggatttagataagattttataacaccagagctcttatatttaccccccaaaaacgcatttttaattccctctccgcattatacctcttgatagaaaagaaacttttataagataataggctctctcccccgatctattgttgttcacaagattccacaaagaagattccaaggaggaccacgaaaagtggagagccatataaaacacataaccccaattagttaaggtggtgtatattagaacaccgccaccgcccacgccacatatttagtgttcccacgcccaaatatatccatatttataccaccccgagatgttttcttaatatgaactttatgtggcgttttgtaatgtttgcgcttgtttttaaatttgcacgcctttgcgcttgaggttttgaaagtaaatttaaagaggctaataatgtattggggaaatttatatatctgttcattttgaagtaacaccattaaaataatgtagagccacca

SEQ ID NO: 577104 - DNA, 770 bp, Homo sapiens
  misc_feature (7)..(7): n is a, c, g, or t
  misc_feature (93)..(93): n is a, c, g, or t
  misc_feature (114)..(114): n is a, c, g, or t
  misc_feature (126)..(126): n is a, c, g, or t
  misc_feature (129)..(130): n is a, c, g, or t
  misc_feature (135)..(135): n is a, c, g, or t
  misc_feature (159)..(161): n is a, c, g, or t
  misc_feature (169)..(169): n is a, c, g, or t
  misc_feature (173)..(173): n is a, c, g, or t
  misc_feature (178)..(178): n is a, c, g, or t
  misc_feature (183)..(183): n is a, c, g, or t
  misc_feature (185)..(185): n is a, c, g, or t
  misc_feature (189)..(192): n is a, c, g, or t
  misc_feature (201)..(202): n is a, c, g, or t
  misc_feature (205)..(207): n is a, c, g, or t
  misc_feature (211)..(211): n is a, c, g, or t
  misc_feature (219)..(220): n is a, c, g, or t
  misc_feature (225)..(225): n is a, c, g, or t
  misc_feature (231)..(231): n is a, c, g, or t
  misc_feature (246)..(246): n is a, c, g, or t
  misc_feature (272)..(272): n is a, c, g, or t
  misc_feature (274)..(274): n is a, c, g, or t
  misc_feature (288)..(288): n is a, c, g, or t
  misc_feature (311)..(311): n is a, c, g, or t
  misc_feature (328)..(328): n is a, c, g, or t
  misc_feature (333)..(333): n is a, c, g, or t
  misc_feature (354)..(354): n is a, c, g, or t
  misc_feature (366)..(366): n is a, c, g, or t
  misc_feature (411)..(411): n is a, c, g, or t
  misc_feature (428)..(428): n is a, c, g, or t
  misc_feature (456)..(456): n is a, c, g, or t
  misc_feature (496)..(496): n is a, c, g, or t
  misc_feature (509)..(509): n is a, c, g, or t
  misc_feature (518)..(518): n is a, c, g, or t
  misc_feature (531)..(531): n is a, c, g, or t
  misc_feature (534)..(534): n is a, c, g, or t
  misc_feature (539)..(539): n is a, c, g, or t
  misc_feature (545)..(545): n is a, c, g, or t
  misc_feature (552)..(552): n is a, c, g, or t
  misc_feature (554)..(554): n is a, c, g, or t
  misc_feature (557)..(557): n is a, c, g, or t
  misc_feature (575)..(575): n is a, c, g, or t
  misc_feature (597)..(597): n is a, c, g, or t
  misc_feature (628)..(629): n is a, c, g, or t
  misc_feature (662)..(662): n is a, c, g, or t
  misc_feature (673)..(673): n is a, c, g, or t
  misc_feature (688)..(688): n is a, c, g, or t
  misc_feature (694)..(694): n is a, c, g, or t
  misc_feature (705)..(705): n is a, c, g, or t
  misc_feature (748)..(748): n is a, c, g, or t
gagcttnaggtcacaacagtaactatcagttcaactacaaccaaggtttccgaaagaaaatggcttctccacccaagcagagttgtatataanattccaaataagaacctaggnatcaccctaganggnnttctnacttcacactgttggggggatttnnnaagttggntttngggtngagtntntttnnnnggcacattnngannnaganattttttnngggtnacgatnagactgttacatttngcaatcaacagcatggggtgcaaaananaaaatcttcatttnaaccctttgttgggatgctttanactttccacagaacagnaactnaaataacctgttatacaattngtcacaaatacngtcctcgggttttttgcccatacgcatagggtatttgtctgaganatgtcttctttgtagcngctaggccctgccaccactgtgcttggntgggattcacaaatctgttgtgacctgtggcttccctgtnacttctctggctntcctctccngctaagctttgtntcntaatnaaaatnttctgcnantgncatagctaatgctgctgntgggaccgccatagacaacttngtttcgtggttttgcaaagtattggcctccnncgccataagggccagagcttctgcctccaaaanttcctcccttnatgggtccaaaattngaagantgattgttgtnattcccaaaatcattgtagcttccacaactccaaattgcttcnatcattaccaaatccattatag

SEQ ID NO: 577105 - DNA, 202 bp, Homo sapiens
  misc_feature (21)..(21): n is a, c, g, or t
  misc_feature (55)..(55): n is a, c, g, or t
  misc_feature (95)..(95): n is a, c, g, or t
  misc_feature (110)..(110): n is a, c, g, or t
  misc_feature (149)..(149): n is a, c, g, or t
  misc_feature (180)..(180): n is a, c, g, or t
cctttctttcttttctcttanctttcttttcctttctctctttctctgtttctcnctttctctttctctctctcttactttctttctttcttttnccatggcagtgagcnctaaatatgatatggtgtcactttcttgattagtgctanggtagttttacctgccatttcttttgtattntcaattgcaaattgtcaggttt

SEQ ID NO: 577106 - DNA, 101 bp, Homo sapiens
tcttcagtgtatactgagtgactcttctgtatagcataacttgacacaacactgtgaatcaactatactttaattttaaaaagtaataaattaggagattc

SEQ ID NO: 577107 - DNA, 897 bp, Homo sapiens
  misc_feature (897)..(897): n is a, c, g, or t
agcggacgggcctctggctccggagctgcgggcacgccagctggagctgggcgccgagcacgcgttgctagctggacgctgtctggccaggtgttctcctggggcgggggctaggctagtggacagctgggccagtgggaccctggcaggcagagctggagccacggctgttggaggcgttgcagggcctagatcatggctgaggtggccgcgggagggctggcattctgtgtgtgtgagtgagactggggatatttatatctggggctggaatgaatcaggggcagctggcacctgcccaccaggtaacctggcagaggatggagagactgtcgcacagggaaggcacatgaactgaatgaatgatggttctcaggtgaagagaacgggtggggctgaggatggagcgccctgcccccttcatagctgtccagcccttcccggcagttactggatctccgccatgtggctcacgatgcagtcaaggcaagctgtggatcccggtcgacacagctgtggtgacacgaacagggtgagctctacatctggggcgtggggtactatatggactagctgggccacgcaggacgacgcaccagcttggatcggtctcgccgtgtggaactacttgtagatagcaactccaagtaaaggctgtcacctgtgggccgtggaacacctacgtgtatgctgtggcagaaagggaagagctgacatgtggaagatgggcattacaggttttcaggagaacctgctgaagcttgcttttcatcgttacccagaatgttgggatcattcccccagcggacccgaatttattgcaggacgcaacagcacagacaccaaaggtggcactccgtgactgtcactataggcggtactcaggcttccatcacn

SEQ ID NO: 577108 - DNA, 418 bp, Homo sapiens
  misc_feature (297)..(297): n is a, c, g, or t
  misc_feature (323)..(323): n is a, c, g, or t
  misc_feature (399)..(399): n is a, c, g, or t
  misc_feature (408)..(408): n is a, c, g, or t
cctgtttctcccctgtggtatcccattaaaactcttgttgaaactacagttaacctcctgacaatccagatgatgctcctgctacagcggcacgatggataccaacccgtctctcaagaataccccaaaaattaagtttttctttttccaaggtgcccacgccacccctatgtcacgcctgaagtagttattgagaaagtcgtccctttccccttttctataaccaaatagacaggaatgggaagattctcctcggggcctggaaagcttgcgtggatgaatgaactcctcctcctncagggcccagtcccaagggtacaaanttgtcaccagcaggcaagataggcagagggcagggaagaggagctgggttggggaaggacacgtgaccccttggangattcaagngggggagggt

SEQ ID NO: 577109 - DNA, 397 bp, Homo sapiens
cgcgggcaaaaagtcattggggaaccccaaaaaacccccccaaagaagccaaaggccagttttaacatcccaattttaagggttttaggaactatttttggggggaggccacagatcatgtagaaaaagtcaattattgtttgtggagtttttcagctaaaggggggggggactattaaaaaccatttgtttttattcaaaagggaaaaaaaaataggtggccctggggttggggaacttaaaagccccttacagccctggggaagggttttttgttttaaggagggagttttagcatttaagttaaacaggtggtgccttaaaaaaggagcctggtacaaagaattttttggggagccctttttataagaaataaaaaaccagatatggggaatga

SEQ ID NO: 577110 - DNA, 104 bp, Homo sapiens
tctacaggatctataagcgagtcgggtatatatcctaaactaggtagaagtatgcattgtcacttacatgtcacttttctaaccaagcatagggctggaaaaag

SEQ ID NO: 577111 - DNA, 275 bp, Homo sapiens
gatgtataaagtcatcgctgagtaggacacgtgcttgcctcagtgtgatagcttttgtcgcgtgtatcttgagaacatgactccagtaaggctcatggctgccaggcccattcctgcaacgcttggggcgattaataacgtcactgagttggtcactgcgggcgagtccatagcgcagtccatgcagaaagtgctcgcagatacgcactggccaggcttgtacaagcacttgctgtcctatcagctcgaccgcccggaggatgattttgctgaag

SEQ ID NO: 577112 - DNA, 779 bp, Homo sapiens
  misc_feature (779)..(779): n is a, c, g, or t
ccggctctagcagtgccggcttctctgtccaagtgcccaccctggagctgggaggaggagtctgcgtaatgtgcgtgtgaagagactgggggagctggccgtgggctcacggtgttttgaccctgtcggtcgtgcgtgagaggaaagggaaggaggagtgtccctgaatagctggtcgccgaaatgttccggtgtggaggcctggcggctgggtgctttgaatgcatgaatgctggtgcccttggtgcggaccgtgtgctgtccgaatgccctgaggcagaggaacctggctcccatggcaacttgttccagcgatggcatgttcctctagaactccatgatgacaatgacaaatggctagctctggtgcatcagtggtggcaaacatctgataattcttgtgttagtccttattgtgggcttatcaacagtaggatgcttggtgcctatgcctacaagactatgaagagaggatgacaaaacagatacaatgaaagaatttcatgggttacgggctgacaccatgaacatgaaacacgacaaacaggcctgcgttatctgcttcagaaaggagcaggacacgttcctcaatgacaaaggctgccaatgtcactgtacctttccgtgcctaaatttggttggcaggcacatgctgctttttgctgcaggcaggatccatcctggtgctcgtggatcctgggtgccagggtactgattgtatctgaacgatcctgagctgccgtacattgcgactcctcatttcacacaagaactgtagn

SEQ ID NO: 577113 - DNA, 501 bp, Homo sapiens
tatgcagccagaaatgccaaaaccaagaatctcactgcgaacatattgtcatccctgtagaaacgtatggctggatgctatcacttcagggctgcgcggaccaacgggtctacagtttgacaaggctacttcttgggcctggtcttaacgctctctttctcctgctgctcatcccaccgcttacggaactcgtcgtccagggcaaagatagcggcgtcaaactcttcgcggcatatcaccgatgggtagcggtcgaggtattcggtgatcgctgatggtgcgatcggggccggcgcgcccatcatgccgacatactgccgtgaccgaccgatatgcccgtaggcctccaggatctccgcgaccacatcgtcgatctcaggcggatcctgggcacccagcccgaggcgctcatgcttccagcgctttttctcgttctctggcccggcccaatccctaccccagcgatatgccgctactgcttttccgcggtggcctgggcct

SEQ ID NO: 577114 - DNA, 393 bp, Homo sapiens
ccccttccatggaaaagctggaaaaaaactctggaacccatatccaggcttgggaggggtgctgcccacagttctggcctcccccatccctagggtaaaaaaccatgagtcctggaggaggagagggcccctcccaaaggactggagacaaaaccctttgcttccttggggccctccaagactccctgggggcccactgtgttgctccccccgggcccctctttcccttttagacctgagcttgcccccccagctagccctaagcaacatctccctgggggcgcccgttaattactgagaaatgtgaaacgggccattttgaaactgagggggtagaaaacttgatctgggggggtttggtttgttttttttttttaaaccccagccacgtga

SEQ ID NO: 577115 - DNA, 184 bp, Homo sapiens
  misc_feature (1)..(1): n is a, c, g, or t
ngtttatcgatgccacatgtcgtccagcctgagcctgctcaccagcatggtggatgacatgtggcattacgctggggaccagtccactgattttaactggtacacccgccgagccatgctggttgaggtcaacgactcaaagatttagaaagtataactaagcggctagtgggattgataaaca

SEQ ID NO: 577116 - DNA, 417 bp, Homo sapiens
gcattccatgctcccagacaggaccacgggaatatggcaacctatgtcgcagggttgtgcgtgggtattatctgtggttgtatcgagttggtatttagtctaaggcaaacacatcttgctagtgcaataacatcacttggtttggctctgacagagactgacatggtccaggcttattctggctccatcagattacagagcactgatgctagtaacatgccagtgaactattctactctttttatatgaaatgtaccacttggtaggggttctggtgatggtggtacctcttattaccttatgtaaaacacttgaaacagcctcatcaatatggccgtcactctgtataacactcccagtatatcttctcactgtctgtttacttaaaatctagtggagtgacataattaatacgca

SEQ ID NO: 577117 - DNA, 128 bp, Homo sapiens
ttagcagatctcagcatacagtattagatgaaataatgtaactgtttttgtatcggtatgtgtggacatgcttctggctggtggatgaaggtgctagaaaactgtcctgtctttacttaccctcaata

SEQ ID NO: 577118 - DNA, 181 bp, Homo sapiens
tatttgtgatggtttgaagtagctataatggaagctttcagtcatttttgttttcctaattagaatgtttcattttttaatataggaatgaaggttacttttatttttttcataaactttttttgagacgaagtctcgctcctgcactccagcctaggtgacagagtgagactccatctca

SEQ ID NO: 577119 - DNA, 182 bp, Homo sapiens
ttagtaatccaccattgagtataccactttctatacccatcactggccagggggaaggattgccctgtagacgaaattaggcccatttgtgaagttgggattgagtgtcattttcctcgcgttgagttattgaacgccttataatttggcagggtggacagggaactggcagttctacctga

SEQ ID NO: 577120 - DNA, 375 bp, Homo sapiens
  misc_feature (250)..(250): n is a, c, g, or t
tgccccagggaccccagcccagcctgttgccatgtccctttcagcaaacaagttccaggtcctcctggcaaaattgaagcaggcccagacccttatgagccccctgggttgaggaaaagggtgttccaggcctgtgtggaccccccctgcccgtatggagtccccccctttgaactgcttttcgggaggcacccctggttttaggattttaaggccctggcccggattttggcctcccagattccccaangcccccccttcttttttgagaacttggcccagggctcctgaggccctttcccaccattcccttcccttcccttgaaaggcaattgttggctgttttcataaccaggaaaaataacccgaagttta

SEQ ID NO: 577121 - DNA, 1758 bp, Homo sapiens
  misc_feature (303)..(303): n is a, c, g, or t
  misc_feature (337)..(337): n is a, c, g, or t
ggcgagacatgacgaactattcttcattgcaatcaggactgatcgcacgatctccagaaaatgtcgtacagttagctgctggaacggtgatcgtcacctagatacacggaattgctgcaacacgtgtactcaccacgtgcataccttggtcacgcgcagcgttcctggcgcggacagatgacacgctgtataggacgcatagctggacaggtagtgcgggacatctctacacaatcttccctcgagcgagaaccgtgtcacagcgccatcaggggacgaaagaccgccaacgagttgttgagncctctgagcctaatgttgattggcccccaatgantctataaatggactctagccacggacccttttcatttcacaaaagagtcgaagggagctcgcttgtacgcgttgagaacgaaaatctcccgtgggtctctccgacggcgcagcccatctcgagcgggccaaattatcgcgtagaggtagtgagaacgagttggacaagaagacgcgctcgattggtgggaacaccctgtcattatgcatagcatgcgcaggaagatgctagggtttgatcgttagttgcaggggaaactcgcttgcattgctaaacaagacgagagtcgggctttgggcagggaaggccaatctctgggcttggtggactcccctttgcggcagggaaagagctttcgagacaggattgcgaaatacgcaaaaggggccaatcgttgtacattttaaccccaaaggcattcccacggtccaaagaaggattggttaaactaaccaactttaaagaactctgctggtatatcgaagcaagcatcgtttcgcgttccctgtgtgggattccaaactagcaaagggctaagccggaattatgcccataacggcaaacggtcctcgtgaaagggcattgcacggggtttgcggctagataggtccaaggggtggcgtaacgccaacaccccgtgtttggacttggaagcgttgggcgccttcggtcatgaattacggcgcctggggagacttggccgaacgggaccctataccgggagtacgaacactggaacgttaagttgtttgaggaacagaggatctagcgagattttggcgccgcgaaaggtctcttaggaggcacccgcgggcgaattttcggcaactcccaacgaaacgaaaaccaccggaggtatatgcgccaacccgcgttatatgagcccacagcaagaaaaaatgcttagccgcatatcccgccgtggggtcaccatttggggtggcgataatattgtcaacacaatagcaggggccgattcgccaagatactggttggaacttggaacgaatacccatacacagtaggggattcctcaatgagggacactttacaacccaaggtggcggacgcagaacaaagagttggatcggccttccttctcccatggacacagaaatcgcacggtcccgacaaggaattcgggacactcctccgctttgtaaatcggggcaaaacgggacagcggaatggctgaaaacgcgacaaacaacagaccggaacatgaaacgtggctccctcaccggcataaacccccagggacagactggttggggagaaacaaatgggggagagtcacggtccaactccacacaaagggcatgccgccactagtgcccacgtaacgacaccacgagcatcagaggaccacacagacgccgtgagcaccaggtgcgtggcacaacaacacacccacaaagaga

SEQ ID NO: 577122 - DNA, 361 bp, Homo sapiens
ttccggcgatggtatgctggaagccttcaagcaggtgagtctgaccaagaaggtgaccgtggaagtggccaagcaatatggctcgtttgacgaagaagatcctgatgctgcgttggaaatcgatgacgatggcctggtcgaaatttcacagtggcgtcatgcgattgtgaatttcccgcatcccttgctgaaagaaggtctcatcatcgatgataccccgggactgaatgcgatcggaaccgagccggagctgacgctgaacctgattccgaatgcacatgccgtgctgtttatccttgccgcatataccgtcgtgagcatgagcgatattgatgtctggcgcaaccacgtcggcagcgga

SEQ ID NO: 577123 - DNA, 1066 bp, Homo sapiens
  misc_feature (440)..(440): n is a, c, g, or t
cggaacaaatcttaatcattagtgcaagcccaattacacctggaagtgtggaaggatgcagtatgcttactgctgcgcctgtattggcagccgggccgctcgacggtcgatgctaggctcgagccttcatgagagtagaccgtcacgaaaagtagtgacgaaacagatagctctctggctgtatcgaagacactctagtagattatgccaattcaggagcagcgacgtgagaagacacaaggtggaatctaaggtatggcggctatctggtcatataggatgtgtgattgccacattgctatgtcattcagatggactcgctcggagttggatggcgatgtaaggccatctctagagggctccaaacaatttgccgaccattcgctgtcatccatctgatcgcacacggtcctccatctctgaaatcacgagagctcagngattaattgggaactccgtagaaaggagtgcgtgacgtctcgaagaattcaggctttaaatgggaggtactttagcgcttgcctcatttaacgattgttggtacagataacgttgcccctatgcgctgttcagcacgtacacgaaaatttagccttaaaaacactagtccttgtctttgccaaaattcccttcacgtcaggtgtccactcctcgtcattcgaaagtacatgtgacccgttaacgcgactaaacattttccagctacgaggacaacggaaatcaaatgctagggtaattcaaaaaccttccttagagataaaatagacatttacgtctcgtatctgtcagcgcatcagacgatcactgtatgtcacagtctcataccatcaccaagagaagacctcgtatgggctcttccctggtcttaatctgaaaggcccaaaggcatgctattgccagtcacaatcatcacggaaggtagggcataaacccgacgaattcctcgtaacaaaggaaagcctggtcttcgggaggccttgaccgagttgtcaaggagaaccaccgaattagaggacacttttccccggaaataacggattttttgtgcacagggtcggctcacaga

SEQ ID NO: 577124 - DNA, 663 bp, Homo sapiens
ctgcagcgaatacggcacgcggagcacgagtcgtgcgagaatacacagtttgagtgtatatttgatgtgggctcttttaaaaaagtgtaatggggtagctaatgtgtgtatatgtgtttatatagtagtgtttataattaataggagtttaataggagattgtgaattttaaacactttaatataaatgtaatattgggggatatatttgagaccttaatatatagtgagtcaaatgtgaaatgtgtttgagggatatattttctctggtttttataaatcaatttttatacccaatattataacacccttatttgccacgcccgtctgtgtgcgttggcctctatgacacaggagtgcgctcgtgggttatacctaaacggtgtctctggtcacatcttggtgtgggccctcggttgactcttgccacggcagctctctacacgtgatcacgttggccacactctagagactcgtgtttgccgcggctatgaccttatacggtgcactttccttgaagtgcgcacgttgcagcgatcccagagccgttataacgcgaactcggccctaagttgtgacctgtttttctgtaaacgcttcgaataagaggtgccctcgcaaagagttgaaagataccattaggtgggcgctggcctgatcgcat

SEQ ID NO: 577125 - DNA, 819 bp, Homo sapiens
gagcgagctcagtgacaagaagcggccagagacggtcgccaaccagattcaatgatgatgcctcctgacatactggatgagagatccatgcagtctaatggagcccgcctacgtccgctgcatcaaacccaatgatgccaaacattggccggccgctttgacgaggtgctgatccgccaccaggtgaatgtacctggggctgttggaaaacctgctgcgtgcgcagagccggctttgcctatctgcctgcaaatactgaatgctttcctgcaaccggtacaatgtcacttgtgcccatgcagacgtggaccacagtgtgtgcaagtgacaggacgaagagatggggtgcgctgtgcttgagtcacgacacactgaggactacaacgcccacgaagagtacaatgatgtgtcgcatggaccaagatcttcacttaccgacattcccacaatgaccctgataaagacaacagaggactgaccatggaaggtccggcggcaggagcccaggaccagaaaaggatccaaagcctgactggacgtggcgtattcgcttggccggcagagaattactcgaggggtgacagagatcagaccagtctagcaactcccaggtcgtgggtggccgtgtggcaaccacctggtgccctgcagtgaagggcaggcggcaagaaggaagtgtgcgggtacaaacacattccggggggggatcatcagcaggctacaacactgcggcacggtcgcctgtctgcccgcgaaactgcatagttaaggtctcaatgtgcgacacctatattgggtcaagttatgtcgcacttaccg

SEQ ID NO: 577126 - DNA, 205 bp, Homo sapiens
cctcacaacctggaaggcagaagaactgcccgaggcagaagcaggaagcagtatgttaagtggtggagagtgctatggagaaatataaagtcggagagagagagagcacaatgacaaggtcaggttgaatgagtaggggtgttcacacatcctcttgtgtgctaggtagtggcgtgcatctgatctgagaggcagaagcaggaag

SEQ ID NO: 577127 - DNA, 893 bp, Homo sapiens
  misc_feature (21)..(22): n is a, c, g, or t
  misc_feature (24)..(24): n is a, c, g, or t
  misc_feature (47)..(47): n is a, c, g, or t
  misc_feature (52)..(52): n is a, c, g, or t
  misc_feature (54)..(54): n is a, c, g, or t
  misc_feature (67)..(67): n is a, c, g, or t
  misc_feature (86)..(86): n is a, c, g, or t
  misc_feature (88)..(88): n is a, c, g, or t
  misc_feature (102)..(102): n is a, c, g, or t
  misc_feature (116)..(116): n is a, c, g, or t
  misc_feature (121)..(121): n is a, c, g, or t
  misc_feature (146)..(146): n is a, c, g, or t
  misc_feature (157)..(157): n is a, c, g, or t
  misc_feature (159)..(160): n is a, c, g, or t
  misc_feature (162)..(162): n is a, c, g, or t
  misc_feature (175)..(175): n is a, c, g, or t
  misc_feature (222)..(222): n is a, c, g, or t
  misc_feature (227)..(227): n is a, c, g, or t
  misc_feature (232)..(232): n is a, c, g, or t
  misc_feature (240)..(240): n is a, c, g, or t
  misc_feature (251)..(251): n is a, c, g, or t
  misc_feature (255)..(255): n is a, c, g, or t
  misc_feature (258)..(259): n is a, c, g, or t
  misc_feature (261)..(261): n is a, c, g, or t
  misc_feature (263)..(263): n is a, c, g, or t
  misc_feature (266)..(266): n is a, c, g, or t
  misc_feature (296)..(296): n is a, c, g, or t
  misc_feature (304)..(304): n is a, c, g, or t
  misc_feature (316)..(316): n is a, c, g, or t
  misc_feature (340)..(340): n is a, c, g, or t
  misc_feature (344)..(344): n is a, c, g, or t
  misc_feature (363)..(363): n is a, c, g, or t
  misc_feature (370)..(370): n is a, c, g, or t
  misc_feature (385)..(385): n is a, c, g, or t
  misc_feature (401)..(401): n is a, c, g, or t
  misc_feature (406)..(406): n is a, c, g, or t
  misc_feature (448)..(448): n is a, c, g, or t
  misc_feature (460)..(460): n is a, c, g, or t
  misc_feature (524)..(524): n is a, c, g, or t
  misc_feature (631)..(631): n is a, c, g, or t
  misc_feature (661)..(661): n is a, c, g, or t
  misc_feature (664)..(664): n is a, c, g, or t
  misc_feature (752)..(752): n is a, c, g, or t
  misc_feature (783)..(783): n is a, c, g, or t
  misc_feature (802)..(802): n is a, c, g, or t
  misc_feature (830)..(830): n is a, c, g, or t
  misc_feature (868)..(868): n is a, c, g, or t
tgatgatttggaaattattannanaaagcaatttaaaaaaacaagtntggcnangaaagacccagcnaagccacttaggcaaaagncnatctttgatgtcanagtttccaagaagnatcanaagagtcaaacagttaaacatttcnctgggcttttntnncnatttcccagaaangttgtagagagaagcccaccaacttacttaaacaaaccagaaaaacngaggnggggngaaaaacngacatttccanattncannananaanggggaaagattcagaaatgactgagaaganacaggganatgaaattcaangcaaatatgggcaaatcttaaaanaganaggcatcttacaaaaaaanccccgtnggtacattacaattntccagccagtaattcnaaaangccagagggcctatgaggcaatatcaaaaaaaccagggaacngacatacaaagncaaatataaagagaggaacattcagtcatccacagataaaaggctatcgggacataagcctganacaagcaagacgccattcactgcgatttcgccggttttgcccttgccacgttctgcttcaaaaatgatgcttttggtagcatcagttccttgatacaactgaatttnccctgtcttccacttttcatcctcactcgnggncttctcccatgccagggcattgttactgtttttcacaaacactcgaagtttcccgactttgtctccggccagccggtaatcaaagagnaacagaagttgctttggggtgcaggtcaggnaggagaagttcaatcggcnatgtcttcttgtgactgccaagccggantgccatatagagcaatagcatatctcgatagcaggatncagtcaaatcatctctctatctgtt

SEQ ID NO: 577128 - DNA, 375 bp, Homo sapiens
  misc_feature (3)..(3): n is a, c, g, or t
  misc_feature (25)..(25): n is a, c, g, or t
  misc_feature (58)..(58): n is a, c, g, or t
  misc_feature (62)..(62): n is a, c, g, or t
  misc_feature (109)..(109): n is a, c, g, or t
  misc_feature (122)..(123): n is a, c, g, or t
  misc_feature (126)..(126): n is a, c, g, or t
  misc_feature (130)..(131): n is a, c, g, or t
  misc_feature (153)..(154): n is a, c, g, or t
  misc_feature (207)..(207): n is a, c, g, or t
  misc_feature (240)..(240): n is a, c, g, or t
  misc_feature (320)..(320): n is a, c, g, or t
  misc_feature (330)..(330): n is a, c, g, or t
aanatgcagtctggagtaaacaacnccaaagaaatggaagatggagtttgataccagnattngatgggaaaatcctttgatgggttgggcatcaacggctgatcccttntccaacatggttnnaancttnngtactaaagaagatgcagtttnntttgcagaaaaaaatggatggagctatgacattgaagagaggaaggttccaantttcaagtccaagtcttatggtgcaaacttttnttggaacaaaagaacaagagtatccacaaaataggttggcactgactatatctctgcttgactgtgaataaagtcagctntgcagtattnatagtccatgtataataaatacatctcttaatctcctaataaatt

SEQ ID NO: 577129 - DNA, 167 bp, Homo sapiens
aagctctactttactcctctctctactctgctcgatctctatagtggaggcgagcaggacaggttgacagcatccctccttggcagggaccatctccacctggagcctccatagacctaaccatctttcttcacctgcaggtctcctctatctatgggacctattca

SEQ ID NO: 577130 - DNA, 125 bp, Homo sapiens
tcggtacctgtttgtcctagctagtcaggagtgctgagatcactaagaatgctgagtcctgggaggcggtaggttagcagtgactctgaccatcatgccactggatatccagcctggtggccaca

SEQ ID NO: 577131 - DNA, 169 bp, Homo sapiens
cggcctttacgaatgctaaaatccgacaagcgttgaatttggcgacaaatcgttctgaattgaactcacaagtgctatctggtacgtcaacagcagcaaattcctttacaccaaagggcttgagtcaagctaacggggaggtattttgcaacgtattgtccaagctatg

SEQ ID NO: 577132 - DNA, 137 bp, Homo sapiens
gcgagaactagactcgagggagctgtaacgctgtccgctcaccatctgttatctatgcgaggcccatggaacagacgctgagatgaagagcaagagcatactctctggatctacattaccggactcttacactgcgg

SEQ ID NO: 577133 - DNA, 646 bp, Homo sapiens
gataattcttctgcctgagcctcctgactagctggtatttcaggctgccagtcaactatgtcacttgcttaatctgttcattacaaatagtgcttgtttgaactgttctttccagagagtgatgctgtctgataattttaaatataaattatggaggaacaggggtcatcatgtgatcggatacttgtgggtctgatataatgattctatttaattaatatttgtcttgtgggagccataagcgtaataggcataagtgagagcacagcacttgtaagtcagagtggttcattacagggtgagacagtgcaacaacattatggagtccaaacatggtcctttcatgtaatgttccttgcggaggcagggactatggtcttatcttgttcaccattatgtcagtactcagagtcacacactgcttgactgcctagtagcgtgttccataagagtagtcgaatgaatggatgagttgtctcattgaagcacttttagtagctcatattgtcttgtactgtggatagtcaagatccaattatatttcatttgaaggttaacaagctttggaaattaggcagtttttttgattaaggtaatctttaataaagcgtgaattttttaaaaggtatggatctatgtatacaca

SEQ ID NO: 577134 - DNA, 824 bp, Homo sapiens
gtcgatttcgagctcgaggtttcccccgcgcaggtgacttctcatcgcttgttcttttgcatttttcctcccaccgccgttgccgccctccccgtcctggccgtccgccctccgccctctgcagggacatctctacaccgttcccatccgggaacagggcaacatctacaagcccaaaaacaaggccatggcaagacgagctgagcgagaagcaaagtgtacgacgcgcacacccagggagatcgacctggtcaaaccggaccttaaaaacctcaacgatgacgtggtcaaagatgtgatttgaagatgtgattggcagaaccagaaggggacacacagtttgtgacggcattttggaaggccagtttcaccaccttcactgtgacgaaatactggtttaacgcttgtgtctgccctcttgtggcatccggatggcactcatctggggcatttacttcgccattctctctttcctgcacaatctgggcaagttgtaccatgcattaaggagcttcctgatggagattcaggtgcaatcagccggtctattccaatctacgtccacacccggtgtgtgaaccaactctttgaagctgtgggacaaatatacagcaagtccgaatcaacttgcagaaagaaatattaatgacatttcaagatagaagttactgatttttttcctttaaattcctgggcaattcaagttccaggtggttatacaagacactttgaatggatttctgggggaacaaagacaccttcagatcaaaaattagtgcttggggactactattgggggcgagttacccctaatttcccccttg

SEQ ID NO: 577135 - DNA, 584 bp, Homo sapiens
cgacgctcgccgcgatcctgtggactgctgggcagcagccagcgcctggctgagcaataccgcgttcaatggccactggcgcctgctgcaggactgggtcgagaacctccgcgagttgcgcgccctgatcggcagcctcggtcaggccgcgccgcgccaatccaccagcgaactgcgcagcgccctggatgcgttgctggaagactggcgcccgctggtccaggccggtgacgacgatgaagacattcgcaaagccgcgccggaacagttcatcgaagagctgcaagacgtgcgctggggcctgttctcactcaatctctcgcgctggctgctggcccgtacctggacggccgagcgtaacgtgcgcggcaaccgtcagggcgctgcgcaaatcactaactggctgccacgcctgttggccgacgacgccgtcgccctgcaactgcagcgctaccagcaacagccggaagacctggccgagcaactgccgcgtatcgaacgcattcaggcctggctgcaccatgcgcgccatgtggtggacattcctgagctggaccgtttgtacggcgaactgaacaagctgg

SEQ ID NO: 577136 - DNA, 714 bp, Homo sapiens
ggaggtaaacggtagaagaaaacaaggaatcaaaacacaataatgtcttgattgctgggagagtgaaaaccctctgccttcagaagaatcactggctctttggataggaactggacggtaggccatattttactcctggatctttcatgctcgtaagacttatacgtgtaatttacaacttttgtaattcggtcagagtcatgatgacagcacaggtaggaagccttagaaatgtcatgctggtattgggtctacaaccggaaaatgtactgaaggtacactaaagcagaatgagatacaatcttgcttgacggtgtgggagatcaattcttccacatgaagtgcaaaatttagaaaagcactaagttgaagtgagaaacagaattaggtgataagaaagtgagacgaacatctgttgagtacagagagaaataggaatcgtcttgtggataggaaatacttattctctcctcttgtaaatattctacttgttaaaaatgttcagatggaaagggtactcacatttttgaaatagctcgtgtgtatgaaggaatgtgattattttgaatttaaatatatgtaagaaatacttacaggtaaatgtgtatttctaaagaactatttaaaacacaatgttatatgttcttataaatacagttaatatcgttcattaattagggaaagataaatctgtgaagtacctaattgaagtaa

SEQ ID NO: 577137 - DNA, 234 bp, Homo sapiens
ttcggtcactactagcaggatcccctcccccagtgttcaagcgattctctgtcctcgatctcccgagtagctgggactacaggcttgcgccaccacgtccgactgatttttgtatttttagtggagatggggtttcaccacattggctaggctggtcttgaactgatgacctcaggtggtccatctgcctcggcctcccaaagtgctgggattacaggctctttgaatccagga

SEQ ID NO: 577138 - DNA, 413 bp, Homo sapiens
  misc_feature (413)..(413): n is a, c, g, or t
gcagaagggtaaggatgaacctctccctcctttgccgctttagctttagctggcaaacaaacctgctctgtaacctcttctgttacttcgttatactccccttcctcctcatcatcagtgtgggttccaaggtggaatgaaccagagtccacccttgtcccattgttaccttgatgcctccgagctccccttcttactgaccatggggactgctttaagagtactcgggtgtcctccagcttagttccacgttctccaactgtcgctctggtgatccttcgacctggattcgagcccccacgtatgggcgctgcttgccgagaccagcttggtcagggagacactaacccagtggtgctagaggaattaaagacacacgcacagatatagaggtgtggagtgggtcagggtcn

SEQ ID NO: 577139 - DNA, 1170 bp, Homo sapiens
tatttaaaatttattggtaatcggggctccgcgcaaaaggaagggggtggaggggtggggatacatgtgcaggggacacaggaacacgatgacatgtggccagggccacaacttcttctgctcggtggggaagagggatgaaaagacaagaccagggcttggagctggggtgagaaagagggagggggggacacttggcttgcatttcccccgcccccaggaagcaccttcttaggccctgtggaccccttcgttcaccctgtgtgccccttaagacttccatctcttatctctgtgagcttgtggcccatccgggcctctatcctccgtggatcccctttgacatttttcccctgtgaacaagatttctcaaggatacgagacagatgttcagggccttagacccaaaaccccacataccaccttattgaaggtgtacaacctttttgcgcgggcccatgggttcgtggagccctcctaaaaccttaaccggagtttcccttctttggggacaggtctagatcccccatccattcctttacatcacacatccccccgtgggaaaaaaaacacaaaaacggagaaaagaaaagagcaccaaaatccccacggggggaagggggcggcggaaacaccagcagggggagaacaacgagcctcggacaagggaccacaacaaaaaagaacagaaaaagaggaaaaaaagagccacaacagaacccacgtgaaacaacaaagagggcaagagggagcaaaaagagcaggaacaggaacataaacggaaacagacagaagacacaaagctccccgcacaccccactggccagtgggacagggagagcacaacaacaacaccaccggagcagaaaaacgagtagagagagagaaaaaaaagaacagagcaagagatcaccaacaaggcgaaaacccgacggaacccccgacagaaaacaaacccaccatccacagaaggaccagaagaaaaaaaacaaagaacgggaaaacaagggcacaagagaataaacgaataaaaacacccacgcacaaaaagaaaacaaaagacaaaaagaaccacaacaccacgaacaaacaaaaatgagcaaagaccacacgaacaaaagagaaccaagagcagacaaggacagaaaacaaccaaagaacacagagatc

SEQ ID NO: 577140 - DNA, 774 bp, Homo sapiens
attgctggagctgctgccgtgaggggctctgctggaagagtgcctgagcctgcagggcgccgcctggagctggggacagtggcactgtttcccagagccacaggcagctgcctcgtgtggccgtgggaggacgaggtgcgctggagtgactggctgctgcctgtgtgcctgctgaccttgcctgcttgcttctgcctgctgcctgctgcgtggctactgcctgccttgcctgcttgccctgtgtggcctggggctgcgtgccctgagtgtctgatgtgccctgtggacgctgagccttagaggaccttgcttaccagatgtggactgatgttctgttgggcattgcttggacattgcttcgctggctgactcgtcccactgtcgtcagcgagggctgtgccgccgcatccacggcgaagtgcctgccgatgatgccggctgcatctacagcatggatcgacctgtgcttggatggccttcgtgaggattggtggcgtggtgcctgtgtggcccaggatggatggaggcaggtcacccaaatggtcgagggcctgagttggggacttccccaggggactgttcaaggacgctccctgcacacgatgaactgtgcctcgcctcttttagacaagtctgctcccctcgagggccagaaggcaaggcctggcctaccgaaagcgccccggttctgttatcggaccggaagactacattcccttgttgcggtgaagggctcagctctgagggctgaccattgcgggccagagggaccca

SEQ ID NO: 577141 - DNA, 330 bp, Homo sapiens
tgggggacggagttaagctctggttcgctcaggctaaagtgcaagggcgcaatctcgctcatggcaacctcggcctccgggattcaagtgattctccggtctcagcctcccaaagggctgcgcccagccaggtgataattttggaggggagaaataactcaggggatagatctggaacattggtatggaggaatggggatttaaaatagtaagcagtagcaaataaccatagggtcttatacagtaagatcttggataaagattatgtaaaagcggtgaataggataattgggaagccaaagaatttagaagcaggagagccagcggggg

SEQ ID NO: 577142 - DNA, 218 bp, Homo sapiens
acgactcttactagtgtggttcaatctgtggcagccgcgtggcggttcatacgtcctacaagtataccctagaatgccacaacagttgaagtcactcactaaaaaatgattcagattgcttgcttcagacactagaatctgatgggttgcctaccccaaagtattgggattgctggcgtgagcaactgcacctggccttcttacacctatcttagtga

SEQ ID NO: 577143 - DNA, 608 bp, Homo sapiens
tcaggattcctgttactgtttgaatcgtcgtagtacaagcctgtcttacagtaggctgtgacactcgatgctctggaaggtttgcagattgagtcctcgaagctagcagaccacgagtcccatggtagggacgagagcaagctccacagcgcgctgccttacagagctgtacaacacgtcagccgcacacagggtcgtgctgtctctcagtcctgaaccccagccgaggccgcccgcacacccgaccagcaaggcaagtaacctctgaactcgctatccgaaccatccagaaggaacaagactccaagactgtgtccacaccatttacagtaagtgtgctcaagcatctcatcactggctattgttgtcccgctgtgcatttcagttcttcttgcaacgatcagttgagtaccaaggaaaccactatcccgaattacgagtgacccacaatacaccacacctccttttcactggccacgcgagaaatgcccttccctctaaacaccactttccgggtagcattacacatgacagctgccactgggctccacaactctcgcatgaacacgttgagtcaacagcgagcccttgtagcacgaaatctcctc

SEQ ID NO: 577144 - DNA, 391 bp, Homo sapiens
  misc_feature (1)..(1): n is a, c, g, or t
  misc_feature (67)..(67): n is a, c, g, or t
  misc_feature (176)..(176): n is a, c, g, or t
  misc_feature (188)..(188): n is a, c, g, or t
  misc_feature (211)..(211): n is a, c, g, or t
  misc_feature (224)..(224): n is a, c, g, or t
  misc_feature (229)..(229): n is a, c, g, or t
  misc_feature (232)..(233): n is a, c, g, or t
  misc_feature (247)..(247): n is a, c, g, or t
  misc_feature (252)..(252): n is a, c, g, or t
  misc_feature (259)..(259): n is a, c, g, or t
  misc_feature (263)..(263): n is a, c, g, or t
  misc_feature (284)..(284): n is a, c, g, or t
  misc_feature (316)..(316): n is a, c, g, or t
  misc_feature (319)..(319): n is a, c, g, or t
  misc_feature (326)..(326): n is a, c, g, or t
  misc_feature (336)..(336): n is a, c, g, or t
  misc_feature (338)..(338): n is a, c, g, or t
  misc_feature (387)..(387): n is a, c, g, or t
nggcaagacaaagtatatggaaaacatttacttctgtctttggtattagaactctacacaaatctgnagcatttaaattttccaaaacaaagtattaaacgtggacaaagatgtaattggtaatgtcacaaaaaggggctccaatatcctctgctaggaaacccccaggcccatgnaatgcaacaggnagactaaacaccatttataaggngagggtctattgngtaanatnnacaatacatgctanaatancatccanaggngtgtttctgcttgtgtgaggntgctccctccataacaaagttggggtgggggnganagacaanacattcccgngncagagtcgcagataagactttacaggaaagaatccattccaagagtacncttt

SEQ ID NO: 577145 - DNA, 1230 bp, Homo sapiens
ggtgcggtgtccaagcgtgaacgcagtgacatgcctcctggccctgcgggggcgtatgggcccactcgactacaacacggaacttgacgccgatggcagtgattgtcgagctacacgcatgttggccattacggattggaatcctgatctacgcggcactgtcacgcataagtgatacgctggaatgcgtgttagccgcagggctgccctacaaagtcgattgacttcatacgtgctcggcattcgtcgcgtgtcgcgctagatgttacagggcttggtaaacccgatgctggacggaccgttgcaggcatgctctcggggacgaatgcctggtacgcgatgggaggggccaatccactggatggaagggaaccgatgcccgcgaacgtgcgcataccgttgcgtgagcgaagcttcctagtggcttaccaacgaactagagcacctgtcatgcgaggttggcccccgcaccttggaattcggagagcgcaagcgtaggtaacgcgtggcttgcagcgacgccaacaagaaagggaggacattgcggttcggaatggctcgaagacgccgaaacgcgtctatactggtagatcgggttatcaaccgctaagcggtcacccattgctggacgcaccatcgctgggcgccatttcttgtggaatacgcccatggcaccaccatacccacgcgaagcttcgtgcggaaccgggcacattaacaattggacatccctgggccatgcaaaaagggaaaccagacagaaaggacccagacacagacagaaagattgggagcaccagaaggcgcttcaataaacggaaaggagaaagagaaagacaattgaacagagagaacgcataggccagggacgggacacgacgcgaatggggaaagaggatagacgactaccagcagttaaaacaccaaaaagaacggaccgaccaggacgagcaggattacgagaacacggttacgcgaaagtcaggacaggaaatgtaagagcagcattaggcgtcatcaggaacagagaaaaccgttatggtataatgtcaacggcgagacatacaagacggggagcaccaagaaggcacatagggcagcacggggaaggacggaacggaacatttcacagggtataggcaaaacagcggacaccgaaaaagccaacgaaagaaaaccaaaacatttacaggggacatagccacaatttccacgaaggcagggcacaga

SEQ ID NO: 577146 - DNA, 454 bp, Homo sapiens
cagtaaatcatagcagctgggagaaagtagtgtggtatcctgcagtggttctgttcaccaccacatgggcagagcatgagcaactttcctttcctgggccctcgttctgctcagatacaaagtgaaggcttacttgggctcctgtgcaactttaaaagtgaaacttaactgaaattgggcaggtgggctgcacttcttctaaaaagtaagaggcccactttttagaaaatattaaaccttggattacacctcagtttggcagttacatgacacattatttctaaagagccatctaattttatgccatctaatgtttatattgataactgatgaaaatacaggagcttattatgccactgaaactacgatgaagtggctcaaatttattctctcactgtaggttggatttgaggggataaggataagagagaaaatactattggtgctcaggtta

SEQ ID NO: 577147 - DNA, 253 bp, Homo sapiens
  misc_feature (233)..(234): n is a, c, g, or t
aacggaatgtgttacccatatacagcctggccctgttccagtcgttccttccgttctgccgaggatatccaacggctgtgtcatagctgtgacctgctgtaaagagaacagatgtgatataggctcctagagacatcttccacagtttacagtatgagcacggtgtctcttgacacaggccaaacttgttgacagcagacggtaaacacgcttggtcggtaaacggtgttccnnaccacaggatgagcaaact

SEQ ID NO: 577148 - DNA, 1041 bp, Homo sapiens
acaaggtctccttataacctaaattgtgattaatgttgctatgatatatttgactgtaagatagctgtcgagatatttggggtggggacagtgagttggatggggaaatgggtgggagggtggtgttgggaagaaaaatggtcagtttggctcggggagaaatcgtggtaacataaaagcagttcagtgggccagaggttatatttcctattgcgtctgaagactgcactggtttgctgcgaaaggcgtcattggcctgaatgagcatggaagatcaagacaaggccttgtcgatgccagctgccagtaaccaccttagaactaccagtacgagcgaccatcgagaaccctttgacgagccatcccaggtctaaatgccacgaagtttcttttctatacagtcacaactgcagtaggcagtgaggaagccagagaaatgcgatagcggcatttctctaaagcgggttattaaggatatatacacgttacactttttgctgctcttcattcctcttccaagccaagtcaatcacgccaggttcctagcagagtcagccacatgaacaagatctacagtcgattttcttgattgtgagcacgtggagctttttgttccttccgacgttgaccggcaatgcggcgggacagggtgactgaaacaccagggatttccggggggctaaaattgcctgtctggggtgctttgatcctggtcacgctgggggaggtcccagcctgtggtgaaggtcaagcttagaaaaactcttttcacacgaccgttggggaacctgtaccctatatattctggtctaccacagaactccttccttaactggttattttcacgcgcttgttaggtcaaaaatgatgcgcttaacttagacattggggtacgtgtatcttatgcccaacacacttcgggctttttcaccacacacccttttcccactgtgcctgactattacaccacacagagctgcatcgagtgcatcatgacacaatctccagtagtctactgtgacacgcagcatatcataggaa

SEQ ID NO: 577149 - DNA, 362 bp, Homo sapiens
  misc_feature (25)..(25): n is a, c, g, or t
tagtagagatggggtttcaccgtgntagccaggatggtctcgatctcctgacctcattgatccgcctggcttatcctcccaaagtgctgggattacaggcgtgagccaccacgccgggcctgtcatatatttctaagttctgaaagaaaatttattccaagtgtaattcacttataaatctacaattccatgaattctcagtgtgattcactgaagtatgtcttaatgtttgtaaatgattgcaaacttggaaggaagcatttcttggaagtaattagaatattatagtgtgtataatgtgggtggactttcttaaagcagaagcttccatttaaaacatatttgaatattactaaggattt

SEQ ID NO: 577150 - DNA, 82 bp, Homo sapiens
gccgaggacacggccgtatattcctgtgcgagagatactctggaccggggaggccagggcttttgactactggggccaggga

SEQ ID NO: 577151 - DNA, 186 bp, Homo sapiens
gatgcccctcccggttatttggatgagagaaccaaggtgctgcaagaggacaagcagacccgggagcagctgcatagcatcagcgactctgtgtagtttcttgcaggaatataggtgcatatgatgagcaattactctactccccccacccctgtcccacctaatcatgtccttgctggacggggg

SEQ ID NO: 577152 - DNA, 157 bp, Homo sapiens
ctacctccacaaacagatgctactccataaacagtgtatagccagtggaatgtgtggtatgtgctgtgtgctgtgtgatgtttgtggtatgtatgatgtatggaagaagtgtggcatgtagtgtgttatgtggtgtatgtggtactgtttgtggagg

SEQ ID NO: 577153 - DNA, 459 bp, Homo sapiens
aggtattggtaactggactctcacacgctatggctatgcgctcgtatgcacagccttcaccaggcagtctttctcagactcagtcccatcacagggaatgaattgtacaaatatccttttgctccgtcaagcggtcagctccagtgtctcaagcacaaattctagttcttcctgcccggtgaactctcctataatgcctccagggtctcaggagagccacattcactgtccccagcttcctcaaccagctcttcatcagaattcaccctcgcctgtacctagtcgtacccccacccctcaccatactcccccaagcataggggctcagcagccaccagcaacaacaattccagcccctgttcctacacctcctgccatgccacctgggccacagtcccaggctctacatccccctccaaggcagacacctacaccaccaacaacacaacatgtaaaaat

SEQ ID NO: 577154 - DNA, 1551 bp, Homo sapiens
  misc_feature (212)..(212): n is a, c, g, or t
  misc_feature (628)..(628): n is a, c, g, or t
  misc_feature (666)..(666): n is a, c, g, or t
tggactttttaatttattgtttaatgtgttttccaggtctcctcactttaggaggcacattttacattcaagtgctttggtctccctcctcacatgtgcgtgaaagcaagagtgtgttccctttattgtggtgaaaagcgacacaacgtgccgtgcgtgccttatctccacagcttatataatgtggacatctcaggttgtgactctcttanaatctcagaggactcatgtgtgtgtgtgcaccaatatacttgtgtgtggccccaaccaaaatttctcaacaagtgaccgtgcgtgagagaactcatctcttttgtgtgcctgtggccccatatgaggtgaggtctcacgtgaaagtgaacacgtctctatcacgtgagaactctgtggttctctctttctgtgggcacactctcaaacctctcagaggtctcagggagagagaaaaagtgcgctgtgagagagaaagtgggctgtgagcgccgagggggggacaccagatgtctcgctgcctctccttgtgggtgatatatattctcccctctgcgcgccgagggggccccgcggaagatctcctctcccgctcgggggtaaagatgtgagagtctccccaactctgcgggtctcnccccaagtggggggggcgagagtgggggggtatagccncttttataaaccaagagccccgaaggtgtgtagaaccccccccgggggtgtctccaccaccccgaggaaactctctctctctcatctaaccgacgtggtggtggccgcccccaccaacactgctggtggggggcaatctccccgggatccaacgggcctctcctactcgaggggaggctgttggggggggggcccccacgtgttttataccccgaggaggagaaaactgtggccctgttgtggcagacacgcccctatttgtatgttggcccgccttttgtttttaggcccccaaagaggcctcattgagggacagccagcggggaggcactttcattaaattcgctacggagggagtgggccgggggacgacacaacaaggcagggggttcataatgcggaaaacatctggggcgccaccagatgtgggcgtgcccaattaatggcttttggtttctcccctttgtggaaccccccaaagtgtttttcttctttgtgcttgcacccacaaaggtggtgtgtgggtacaacgatcttcattgagcggcgggggtgtcctcccccccatataagtaatggggagacaggcatccgaggcacaaaataaaataatcttgtcgccgtacaaataaaaggcacccagcgcgttgaaaccacgcggtcagtaaagtaagaaatgactgtcggacagacagaacaacacccgactgggtgaagagtcgatcgtgcgacagagaagagccagcgagagtacgagcagcagacacacgcacagacagcagcagacagagggagagcagacacaacacacacaatgttgtgatcgacaccaaacaaagcagaagcagcgacgcacagcacaacaccatgttccacagacgagag

SEQ ID NO: 577155 - DNA, 251 bp, Homo sapiens
  misc_feature (95)..(95): n is a, c, g, or t
  misc_feature (212)..(212): n is a, c, g, or t
gggcaagagtgatgcatattttatgggtggttttggaaacaaggaagaatgaaaagtccttaaccgtgaactcttcctttattccatcttttacnccacatatgcaatgacttttaattttaacttttgtagttaaatcctttgccccccaacatgaaatatagttgcaaatatggaaaccgacttggaaggacaggtcctgaatgcctttntccagtgaacatgttaactacaaaaaattctcagcaaaa

SEQ ID NO: 577156 - DNA, 278 bp, Homo sapiens
  misc_feature (54)..(54): n is a, c, g, or t
gtcccaagtttccttctcatcaaatccgacaagagagaagaaacatgggtgtgncttgccacagcggcctggtctccatggacctccccgctccctccaagcccgcgatggctgcagtcttgtactagactccgtccaggctgttctcatctcagctattgccccttcctttcactttcacacctcatctcactcctgttgtcactttccccgaaacgcataagctctccccagctcctgctgtgtaggctgcgccgaaaccccacacaaaaaaaaaa

SEQ ID NO: 577157 - DNA, 545 bp, Homo sapiens
tatgtcgatggtctatttctgggacttctaattctgtttctttggtctatgtgccctgtcctttcaccaataccacattatctggaagctggagctttctattacatcttgaaatcaggtggaatgaatgctccaattttgttccttttcaaaattgttttggctattctagttccttggcctttccaattaaatttcagacatagaatgtcaatgtaaacaaaaaatcctgttagaatttggattgtgacatatgggaagagagaaagaattaacatctgtactgtgttaagtcttcccatacaacagcacagtgtatctccccattcattcgggtcttctttggtttctttagtcatcgcatcctagttttcagcatacagatcctgactgtattttgtaagatttatacctaagtatggccaggcgcggtggctcatgcctgtaatcccagcactttgggaggccaaggcgggtggatcacgaggtcaggagatcgagaccatcctggctaaaatggtgaacctcgtctctactaaaaatac

SEQ ID NO: 577158 - DNA, 208 bp, Homo sapiens
  misc_feature (17)..(17): n is a, c, g, or t
  misc_feature (119)..(119): n is a, c, g, or t
  misc_feature (200)..(200): n is a, c, g, or t
ccaggctggtctcaaantcctggcctcaaggagtcctcccacctcaacatccctaggtgttgggattataggcatgaaccactgcacctggccagaaacccttatttaaactctatacnaatagaagcattcttcagaacccacctagtgaatctgctttgcttttactatatgcttagtccttcactgtacttatgttngctgtggg

SEQ ID NO: 577159 - DNA, 462 bp, Homo sapiens
atggactctcatcgcaaatggaatgaatactccagagatccttgcaaaagctagttgctacaattaaaagcagaatttgcatccagctttgggaacaactaaagaggaaagaagcaacccaaattctccctaaatttcatttaagttgcattaacccttctctagccattctggatgggacacatcatacagctacacactccccaacattagggagggtttattcaagggcagaccaactagtgcaaattaccatgcaaaggtacaccctgaggacccaggtgcccaacagcccctgcgcaggcagacaaggctaataaagtcttagttcctgcagaccactgcagctgctttggcagaagatgaaggtcaaggttagttgtggagcgagacggcattccggcagagacagtggcatgttccaagcctgggggcaggaatgagcagaccctaactcaggga

SEQ ID NO: 577160 - DNA, 103 bp, Homo sapiens
caataaacaagtccccctttctcaaggaaatacccttttcttgctccactaaccgtggcatgagggtggctctgggtctcaattggctttagggttgatcgag

SEQ ID NO: 577161 - DNA, 145 bp, Homo sapiens
atgatctagccgatcttagctctggaaaaggggaactatactgaggtatgcacggagttggggagttaagagggcagacagagagaaggggtgacaggccaatttgcggctcaggaagaggcccagtaaagagggcctgggatgc

SEQ ID NO: 577162 - DNA, 188 bp, Homo sapiens
tatgtgccccctcgactccttcacataatcctgccacaccacggaaattctggggatactccccagatggtcccatcctggccacgctccatccccccattcaccgatccccgaaccaaaccactgttaccactcccccaacctccatccctcctggccgatacacacctcagtctatactcgcacgc

SEQ ID NO: 577163 - DNA, 127 bp, Homo sapiens
tactagctctacaagtggaacccctgtcaagtgaaagcctggagtaagtgactatgcctgcattctaggcatagattccgccatagaattaagcataacctccctgagctctcaggtgtcttcatcc

SEQ ID NO: 577164 - DNA, 120 bp, Homo sapiens
caatcaccaccaccaccatcactaccaccagcaccactacaactacaatcaccaccaccaccaccaccaccacaactacaatcaacacacacaccatcactaccaccagcaccactacaa

SEQ ID NO: 577165 - DNA, 1400 bp, Homo sapiens
  misc_feature (204)..(204): n is a, c, g, or t
  misc_feature (444)..(444): n is a, c, g, or t
  misc_feature (626)..(626): n is a, c, g, or t
ttcccttattaccttcatttgtgttttttttaaaattgcgttgatgttttattgaaatttgtgctccatttttttaggtatttaaattattggcaaaaaaaccatttctccacttattgccaaagttctcttttatagaacgttcagtgaaaattcaacttcttcattacctctcatgtggttctcttcttttaatttgaccanaaaccttctccattttttcttcttaaattacaagagccgaatcttgttgtttcttgaagccaaaccttttctcccccgggagaacacacacacaagagcccttctcagagttgtgacaagcacacggctgtgacacctgtgagaagttattcccaaccagagtgtttgtcccagagaggcacacagagtgtgtctgttggccacacacacgagagagcacaccagagagtgtctcccggngagcccacacctgtgtcccccgccaagacaagaggcccccaacagctgtgacaggtgtgtgtgtggagagaggagagccccctgtgagaggtctcagagggggcccccgttgtctcgggttctcaaggggggtgtggccaggcgtgtgtctcccacgccaccctgtgggggtatatgtgagncggtctcagaggaggcctatctccaatgtgggagcgtgttggggagagagcgagcccaccagcttctcaccttctctgtgacccagagagagtggggcagacctcattcacagagtgtcgccctgtgagtggtgtcgtgacactctgtgggtgcacacaaacacgccccgggtgtggttatctcccgaagtggtgttggcccacatatttctctctccccccagaagaggggcgagaaacacacccccaaagagaaccgctttttcccaaagcacaccgtggcgcgcgcggccccaaacgttttgtgtccgtcgccgagcccgaggacaagcgtcccagccctttttcccaggcgtgtttgccgaggcgacacgaggcgtttcctctggtgggccacttcccatcgggttgtgtctctatcatccgtggtttacacacaccgtgtggcgtgtgctttcttttaacgtttttccttttaaacccctctcatttattggggctcacagtgaaatttggaattcaaacacaaattctgtggggtatgcgggtggtttctccacagtgcagacccatcttgtgttgggacctcttctctttttgtggacgaacacttatagccacatgttccaacactgtgtgcttcagtacaccccaccattttggtgcgcgatatacaccattttctcgtgtcacacattctcgcgcaacatcgtctttccacagattcccactctctataaaagatcatgatgagtcttaattcacaattgtgtc

SEQ ID NO: 577166 - DNA, 922 bp, Homo sapiens
agggtctcactctcacccaggctggaatgcagtggtgtgattgtagcacactttggccaccaactcctgggctcaagtgatcctcctgctttggcctcctctgagaagctgggattactggtgcacaccaccacacctggctaattttttatttttttttatttttggaaatagggtatggctatgttgccttgggcccgtcatgaactcctagcctcaggtgaccctcccacctcaggcctcccaaagggttgggattacaggagtgagctactgcactgggccaacatgttaatttttttttttttttttggaaatggagtctcccagggcgggaatgcaagggtgcgatctcgacttcactgcaatcttcacctcccgggttcgagcgattctcccacctcagctccgtgagtagcggggattacgggcaccggcatcacgctcggtaattttgggatttggagcagagagggacgtttcaccaggtgggccaggtgatctggactcccattccccccaaatttcccaaagtggcggggattacgggcataagccaaagccacctcacccagcaacatggttacatcttaatctgggatggctcatggagggcctcggtgggagaaataacactcttcaagtgctaaatctgggagatccgtgtgaatcacataattctttagaccaactggggtcaaaatcctcctttccctttcggggttattccatccatcttattagaagggaggcgctacgtggtggtggctgtaccctggccatttttatcacgggaggggggagcgcgggattacagggggttcacacccggactggacacggcaaacaggggggcgcggacatgtgcctcgcgaccaatcttgcgtgtcgcgctaaacagggggccctcacaaaagcgggc

SEQ ID NO: 577167 - DNA, 150 bp, Homo sapiens
aaaagaagaatacagacaaaagaatacaataatcttttatccacagagcatatgtggcacctctgatggatgcctgaaactgcgataggactgagcctctggagtgtaccatgtatttttcctatacaccaatgggcacacattatggag

SEQ ID NO: 577168 - DNA, 338 bp, Homo sapiens
  misc_feature (3)..(3): n is a, c, g, or t
  misc_feature (26)..(26): n is a, c, g, or t
  misc_feature (274)..(275): n is a, c, g, or t
gtnttcttatgcggataaaatttctnaggtaagaaaagttagctctgagcagccctccgcctgatactaatactttaccaatggagattttccttttcttttctgtttttgagacagggtctcactttgtttcccaggctggagtgcagtggtgccatcatggatcactgcagcctccatttccctggctcaagccatcctcccacctcagcctcccgagtagctgggactacaaggtgtgcaccaccacgactggctaatttttaattttttnntagagacgggggtttccctatgttgcccaggctggcttgaattcctgggcttcaagtgatcct

SEQ ID NO: 577169 - DNA, 414 bp, Homo sapiens
ggacgagggggaaaacccttggggctgtgtgagcggatcaaccgagacaatcagtacatcttcgaatccatatttcaagccgtggtagaagtgagacttatctagcagaacctttccaaaagtattatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttt

SEQ ID NO: 577170 - DNA, 300 bp, Homo sapiens
  misc_feature (42)..(42): n is a, c, g, or t
  misc_feature (77)..(77): n is a, c, g, or t
  misc_feature (88)..(88): n is a, c, g, or t
  misc_feature (109)..(109): n is a, c, g, or t
  misc_feature (138)..(138): n is a, c, g, or t
  misc_feature (284)..(284): n is a, c, g, or t
catcacactgaaggaggcaaatgaattctgcagcgcacaagnaagggaaagttgcccttgtaaatgaagatgatgancttgtggccancatgcccggacagacctgaanagaatcgggatacccactagctccaaagntgccagaaacactgctgtgtggggcgccattggcactcatgaggatgacaatataggctggattgctcgcccagctgtgtggatgtagtggttttggactcttcccaggaaatccatcttccagatcaatatgatcagtacatcgncaatacccttctccgt

SEQ ID NO: 577171 - DNA, 313 bp, Homo sapiens
  misc_feature (87)..(87): n is a, c, g, or t
  misc_feature (268)..(268): n is a, c, g, or t
  misc_feature (289)..(289): n is a, c, g, or t
  misc_feature (300)..(300): n is a, c, g, or t
tggtcagatccagatgaacaaccagacaaaaataggagtagagccgggtgcagtgcttcatgcctgtgatcccagcactttgggaancggaggcgggaggatggcttgagcccaggggttcaagaccagccttggtaatttagggggaccctttctctacaaaaatatgaaatcactacctgggcatggtggtgcatgcctgtggtcccagctgcttgggagactgaggtaggaggattacttgagcccaggaggtcgaggctgtganccgtggtggtgctactgtganccagcctgggnaaaaccctgtatc

SEQ ID NO: 577172 - DNA, 163 bp, Homo sapiens
tatcttgcccttgatatcagtgagccatcagaaggccaggaagcagccaggcatggtggcttatacctgtaatcccagctactcaggaggctgaagctggaggatcatttgtagtcaggagtttgagaccagcctgggcaacatagcaagatctcatccctac

SEQ ID NO: 577173 - DNA, 236 bp, Homo sapiens
acctgaaatgataaaatatgaattataagtgcaccatgaaatgttaagcttgcacattgtaaaccacagaaaaatcactttaaaagtatacaaatagatataataaagacatagatacatcaaaatggagtataaaaaaggccaaataacctgaaataggtaggaaagagaaaatgggaataaaaaatggaggacaaacagaaaactaatcataaaatgtacctaaatccaaatac

SEQ ID NO: 577174 - DNA, 190 bp, Homo sapiens
ataatcccagaggaggattcgttaacagaatatcaggatcgtgggagctgtagtatgatatgaaccattaccttagactacatttttcttctcacccaaaaaacactctacaagacatcctatttgcatttaggagatccccctgcttgatgtccacaatttaagaggggatccatctagcatgtcgacc

SEQ ID NO: 577175 - DNA, 203 bp, Homo sapiens
atctagacatcccgttattgagtggcatgtgaaaggacatttaaaatatcctatttaggctgggtgcagtggctcatgcttgtaatcccagcactttgggaggccaaggcccctttttttttttaaaaaaacagagtttcgctctgtgttgcccagtgcaggatgggcaagggtagagatctctggctcacgtgcaatttccc

SEQ ID NO: 577176 - DNA, 986 bp, Homo sapiens
gccagagctggaggtgggtgcccggcactgagggtcctgcggaccaatggctctgccctgcaccttagggactcgcggatgctgctgagccctgccaggggccttgtggctcgggtggcagcgcggatgacagcgtgggctccagctctgtcaccgcttgtcctgctgctgctgctgctcctactgtctggccactggcctagcatctggtcctgtgcgccgcctcagtccgtgactcagggggtctactaccacccggcccgcctaggtgccgctgctgtggggccgcacgcggtcgacctgctctgttggccagaccccaccaggtcgctggctgctagtgcccgagctgatgctggggtccacagacaatgaccttgatgcgacaggaggatgagcatggacacatgactatgaccatcgtcgctggatgtgtggcctgcaggcgtgaccctggggaaggcgagcagcacatgtggagaggcgtccagcccagagcaggtccccgtgcgggctgaggaagccagagacacgtgacacggaggtcgatctggtcctcggctccccaggaccagcgagcgcaaggggcagtgctgaggcccctgctgagtgacctgcacgtcctttgctggcagcggcatcctggggatgacagcgccagggcagctggggggccagggcctccatgtcaccgcactgtagaggccggtcttggtgtccccatcccttgtcacaggccgggtcactccccggtgctctgcttcccaagaatgccatgggttggaacttggacccccagcccagatgacatgctcagactgtcagccgctaccagttcccaatgttcccgggttgttcccccggcttagccagcgggaaagggcccccccaaaacacagggatcaggcaaccatttgaaataagacttccttcaggcgtgtacacaaagagcacaagacatgaaatacaggaaaagacaacaaaac

SEQ ID NO: 577177 - DNA, 283 bp, Homo sapiens
ttgatcgacaagctcaggatagatgtgaacacctatcaccaaaaagacatacaaatatagcttgactggatagtctagaaaagatagaaacacagcataaaataaaacatagtaatcaaaacggtaaccatggactcacaaaattacaagtatccttatctgtgtgacaaccctacccaaaatgagggcacatgcagaaaagaagctccaaccacaacaaacacagtcacttactgaatgttgacatagtataccagacacgggatatttatcgtgtgttata

SEQ ID NO: 577178 - DNA, 479 bp, Homo sapiens
taaagatgggtcagatggacacgaagaggcgaggcagtatgctattcctagcatggaatctaccctcaatcagtcggcaatagataggagacacttaatatcagatcctcaccaccgagtccgctataccacaacccaagaaccagcacaagtcaggagttgtacagcgtgtagcctgaggccaagaaggcaccgggcagcgggccagtgtctgagcggaatggaccacattctaaataagcagtggggtcctaccctattggaactccagtcagttcccgggctctccaagcctactgccctctacaggtgtggcagccgagtcctagacacttggaatccccaaagagcaaactagtgaacacagcacttgtaggccagcagctaggacatagatatcgtaaacagattgagcaaatagcagcttcagaatggagccatactgccaccaacctagtgcttaaaggaccatctagacc

SEQ ID NO: 577179 - DNA, 156 bp, Homo sapiens
  misc_feature (41)..(41): n is a, c, g, or t
  misc_feature (54)..(54): n is a, c, g, or t
  misc_feature (93)..(94): n is a, c, g, or t
  misc_feature (114)..(114): n is a, c, g, or t
  misc_feature (117)..(117): n is a, c, g, or t
  misc_feature (132)..(132): n is a, c, g, or t
  misc_feature (140)..(140): n is a, c, g, or t
acgggggtgggccgcccggggccggcgtggaaggagggaanaatgcccaagaangggcccagggtggggctggggctggagacgacgaggagnnggattaagtccacctgtccntcntgggctgctggattntctcgttntcctgccaaataaaca

SEQ ID NO: 577180 - DNA, 359 bp, Homo sapiens
ttatatatttaataacaccagctcaaagtttagccatgttatgtgcggcatcttatttcttcaataacagtttatttaggtcatagaatcatcctagagtatcacatagttcaatttttcagtcagtgaagaccgggagggaatgtctgttgctttggctagcctgtcctgtggcgatccacaggtctagccaactattgaaataggagtggagggtataatttgcctcgtgatgtttgcgcagtcactgtttatactttacaggttatattctaagctatgtgagattgcttttgggaagatcactagatttatggaggaattagtcactaattactcgtagaagatactgtcatata

SEQ ID NO: 577181 - DNA, 171 bp, Homo sapiens
ccctcgccgcgcgaagaggcgggagagacatgtgagtggctctgagctcagcgcgccagttttttgagagcagatgctgatctaacgtggaaaagccagtctcctctctgtagagacatgtgtgatataagttgtgatcgttggcggaaatttggatttagataatggcct

SEQ ID NO: 577182 - DNA, 153 bp, Homo sapiens
  misc_feature (142)..(142): n is a, c, g, or t
catccagtagcattttgttactctgaaggtctgagacttttgagcccttaactccaagttggtagtatcttcagtttttgctttctctaaagtccttcagtgagtccctctttagaaaagagaaaactctgccctgactcantaaggatcata

SEQ ID NO: 577183 - DNA, 184 bp, Homo sapiens
ggggggaaagggggggggaaaaaaagaaaaaaaaaaaggaaaaacctttacccccggtgggggggggggggttttccccccccccaaaaaaaaaggggccctttattttaaggggaaggggggttccccccccctttccccctttaccaaaaaaaaaaaaaaaaaatttggttttttttttcca

SEQ ID NO: 577184 - DNA, 768 bp, Homo sapiens
  misc_feature (389)..(389): n is a, c, g, or t
gctggggagtggagaggcaggaacgcagcgatctatgaagactggcccattagcagaggcagtccaaccagcatgatggaagcatcagcgccgtcccttcctggtccaaagtgaaccaggttctcatccgcatgtataaggccgagtgccgggagaagttgcgctgtgatccagcacattcaagttacgggagccatgcgtgccacatcgcatcgctgtaccacgtcgggctgaggaggggccaagccagaagagccgacccgaggccacagttgcctgtgcctgccttcgcccgaccggagcgatggggtactaccgtgagcgccgcccgcggcacgtccaggatcggcatgagcagagcggccacaaggggtaggcgtgctaggtcnacggacgtggcatcgcaggggcgcagcgagacgagactagggcgataggagcaggtaccaagaccgagaggaatacaggtgagcagaagcgatatggcagcccttgcaggcagggctccgcagatgctgtcataacacgagagccgcaggagaggaagcaggcgtagcaggggaaactttcgcgtgcggacgtcacgacttccacaaccctgcctccctggtggacacttgggggatcgtacatacccctcgcctggttagcgagcccccagaatgggggcctcggcgagggactcatggacgcccgttcaccttggcgaggaaaccctgagggggaaacagggagagaggacgaacaatatgggggaggggaatgggg

SEQ ID NO: 577185 - DNA, 139 bp, Homo sapiens
atgaagaattgagtacacacttggtccatggtgacctccaaaagaaaaatacataataccgtaatagatggaggcattgacattcatatgaaatgagttccgtgaaacaatctttgacctatgagaaataaaaaaaaaa

SEQ ID NO: 577186 - DNA, 808 bp, Homo sapiens
tgaggagattcctagtgaagatgatgagctggtataagagaacaagcagtaaccatgaaggggccctgctgagaggaagctggagatggatgactatcccaccttcatggcaaatcgctatgcctactttacagtctacaggaaccgctcacttcacaaatggcacgattacgaccaatgctgtcttctaggaaaactggcgaagggttttggcgcctttgaacgctcaatcttgactcacatcgaccatattctgatggacaaagagagattacttcgaacgacacagaccaagctcttcgactatcgagttcttggcaaacctgagccagcatctaagactcgtcccagacagtttgcaggggaaccgaacatccttactgatgcccctgctaatgctcatctgaaggacttgaatgaggaactctttgatgattatgacttttaccaccagctccttccagaactcatataacggaagaccaactccttggatcccaacgatcacgtggtcatgggaaggccgtgccttgctatccagaagttacgaagcacagtccacactaaagtgcataggaaagccagcaaaagcgggacacttcggttacatgtgcttaacaggctactgactttcatggcacctatagaccatactacaatgaatgacgatgccaggacagaactgttccgctctctttttggtcagctgcacactcccgacgaaggccacggtgattgacaatccccacctcctacacccactgggcgcctaggctggtgtggccgatgctccagatggacgaaaccc

SEQ ID NO: 577187 - DNA, 330 bp, Homo sapiens
  misc_feature (171)..(171): n is a, c, g, or t
tttttagcaggcgagggacagtgggcaggtgacatggctcaggcaggtaggcagagagtaagcaggaagatgtagttgggggctgcctgtgaggttgtggcatcctccagcgctgctgctggggctcggtctgtggcttagaactcggtgtccaccacgcggaaagctggnctggctgagtcaggcatcgacgaagaacgaagggtgggctccttttgtagctgaatctcctttagtgcaaatatggaagtagtgtcaggaagtttgtggatccgctcccccagactgaggaagaatggatgtctgcgtaaaagtgggctgcgtaaaagt

SEQ ID NO: 577188 - DNA, 113 bp, Homo sapiens
acaaacaccacccaacacccaccacccccccccgacccgaagcaaagttcacctatatggccctcgggttttagcgaacgaacgagcgccgcgagtattgagcggggaagcgg

SEQ ID NO: 577189 - DNA, 534 bp, Homo sapiens
gcttgtctttgcggaatcaccaatggcggctgggaccctggtacacgtagtcctgaaaactggagggtccttcgaaggcgtctcatcgcgtgcttgcagtagcagcggggctcaggtccgcgtgctctccgaacgcaccccacgttccagtttaggccaagaccaaccgcacccctgaatttctccgtgaatttcctgccggcgaaggtcccaggcgatttgagggtgatgatggattctgtgtgtttgagagcaacgccaattgccgtactatgtgagcaatgaggagctgcaggggaagtactcgcagaggcagaagcccgaggtggtgcagtgggtgagctagttgattccgatatagtgcccccagccagtacctgggtgtgccccaacttgggcagtcatgcagccgacaaggaaacaggccacgtgagaatgcaacaggacggaagtgaggcgaagttctggggctgcgtggatgcttacttgacagacgaggacttatctggatgggcgaacgagtgacattggctg

SEQ ID NO: 577190 - DNA, 673 bp, Homo sapiens
  misc_feature (46)..(46): n is a, c, g, or t
  misc_feature (61)..(61): n is a, c, g, or t
  misc_feature (64)..(64): n is a, c, g, or t
  misc_feature (69)..(69): n is a, c, g, or t
  misc_feature (77)..(78): n is a, c, g, or t
  misc_feature (115)..(115): n is a, c, g, or t
  misc_feature (130)..(130): n is a, c, g, or t
  misc_feature (132)..(132): n is a, c, g, or t
  misc_feature (134)..(134): n is a, c, g, or t
  misc_feature (150)..(150): n is a, c, g, or t
  misc_feature (152)..(152): n is a, c, g, or t
  misc_feature (166)..(167): n is a, c, g, or t
  misc_feature (169)..(169): n is a, c, g, or t
  misc_feature (176)..(176): n is a, c, g, or t
  misc_feature (181)..(181): n is a, c, g, or t
  misc_feature (184)..(184): n is a, c, g, or t
  misc_feature (189)..(189): n is a, c, g, or t
  misc_feature (192)..(192): n is a, c, g, or t
  misc_feature (195)..(195): n is a, c, g, or t
  misc_feature (198)..(202): n is a, c, g, or t
  misc_feature (211)..(211): n is a, c, g, or t
  misc_feature (229)..(229): n is a, c, g, or t
  misc_feature (241)..(241): n is a, c, g, or t
  misc_feature (269)..(269): n is a, c, g, or t
  misc_feature (283)..(283): n is a, c, g, or t
  misc_feature (300)..(301): n is a, c, g, or t
  misc_feature (311)..(311): n is a, c, g, or t
  misc_feature (315)..(315): n is a, c, g, or t
  misc_feature (322)..(322): n is a, c, g, or t
  misc_feature (324)..(324): n is a, c, g, or t
  misc_feature (327)..(327): n is a, c, g, or t
  misc_feature (352)..(352): n is a, c, g, or t
  misc_feature (354)..(354): n is a, c, g, or t
  misc_feature (379)..(379): n is a, c, g, or t
  misc_feature (415)..(415): n is a, c, g, or t
  misc_feature (467)..(467): n is a, c, g, or t
  misc_feature (469)..(471): n is a, c, g, or t
  misc_feature (474)..(474): n is a, c, g, or t
  misc_feature (485)..(485): n is a, c, g, or t
  misc_feature (487)..(487): n is a, c, g, or t
  misc_feature (489)..(489): n is a, c, g, or t
  misc_feature (492)..(492): n is a, c, g, or t
  misc_feature (497)..(497): n is a, c, g, or t
  misc_feature (503)..(504): n is a, c, g, or t
  misc_feature (509)..(510): n is a, c, g, or t
  misc_feature (512)..(513): n is a, c, g, or t
  misc_feature (519)..(519): n is a, c, g, or t
  misc_feature (543)..(543): n is a, c, g, or t
  misc_feature (549)..(549): n is a, c, g, or t
  misc_feature (656)..(656): n is a, c, g, or t
tggagtggtgcgacttatcgagtacaaaaatcagccgccgtacgtnaggtaggtgaactanaanatctncaacatcnngaatataatttataacattttacattttcagttaatnataaatagacttttntnantacagattttgttttngnttttgttttcttanntnctggagngccgnagntcagntcngcnctnnnnnttattttgntcccaaagcctcccccanatcatcactccntgcgcctcctcttaaggctagaggctgngtcgtgtgcctcanaattgtcgaccatgtcnngccatcagcnaggngcgattncncanaaggcgaccaatgagcgtgaaattntntaaaccaaaaggacgaagaaaaaanacatttcaaaataaaaaaaaaaaaaagaaaaacccnaccatattttgccacatgtgagagtccggtcaagcagtatttacaaaaaggntnnnggnacaacactctnananatnctctntgtttnntgggnntnntgtttnaaaaaaaaaggttcaaacttattntcacancatcatcacaaaatagaggatcaccattggtttgcttggcttttctttttttttttttcccccaagtgaggacctaactccaaataatacaatagaatatgcaaatnatcttcacatcaagagt

SEQ ID NO: 577191 - DNA, 1062 bp, Homo sapiens
ggagaacttgaagccaagaggatttaaaaccgctgctctaaagaaaagaaaactggaggctgggcgcagtggctcacgcctataatcccagaggctgaggcaggcggatcacctgaggtcgggagttcgggatcagcctgaccaacatggagaaaccctactggaaatacagagttagccaggcatggtggtgcatgcctgtggtcccagctgctcaggagcctggcaacaagagcaaaactccagctcaaaaaaaaaaagaaagaaaagaaagctggagctggtgggcttaggccatcacccttcccttggctggaactactgggacagaccctttggagatgtgcctgtggtgctgtggagatgtgtgtagcggctctcagctcatcggtcgagactcgatgctgtgtgccagcacaacccccacaccccgcctgaccgcaacatcgcaaccctccgcccgcaaccagcccccaccccctcacccggagacacatccgcatacactaatgccgctcccgccctccaacactgaactgacacgacagcgcacacatcacaaacaccaaggccccccgccccaagccctcccacccaccgcccccccacactcaaccacgggcaacaagagacctcccgccacggcagtccccacacccgccctcacccacggcacccacaccacggaccaccagggaccccaaccacacccttgccagccccccacccaacacacgcgccgccccgcctccccccaagacgcccctgcgccccatagcaccccaccccacagggacaccccaccaccccccccgcgccacacccaccccccccccgacaccacaccacagccccaccccgcgctcccccaccacgcccacccaccacgcccggcccacaacgccgcacccccaccaccagactcgcaaccgcaaaaacgaacccacaaacagccacgcaaccaccgacaccgcacaccccccacacccccgcacaccaccactccgcgccgcaccaccacaaaccgacacacaacaccaccccacccccaccgcacaccac

SEQ ID NO: 577192 - DNA, 736 bp, Homo sapiens
agcggaagtggcgtccccaggagctgggagcgggtgaccggcggcggggaagcggcctgggttggccctcagaattgcggggtctgggggcatctcgccgggcaaacccttggcccgcctacaaggacttcctcccggccagagcaatggccgggtgagaacagcaagcagttttggaagaggagcgctaagtctgccggggagcattcagtcctgtagtatggatgcacagcatcctcctcttgaccctagcggcatcacctaaaaatgtcattagacgaacgatcaaagagtcggcacagtgcctctgaagaataggaaggcctccagtttacatgagtttgcacggaataccagtgatgcttgggacattggcgcatgatgaggaagaggactgtttcctcaccttcttgtccgaaagctctgagactcaaaagtggctttggcaactgcgagcccaagttctagaaaagccagcagcaaggctgaggagtaaaaccaggaactggtccctagtcaacggacatcggacgtccctgctcatactatcaatggtcataagagtccagcagtgatgcccagctgtccagaaactctagtgatacatgcctgaggaacccactctcacaagactagcaatcactccgctctccggcccatcatccccctcgttgcccggatctcggatcagaacgcttctggggcccccccaatgactgtccgggagaaaacccgc

SEQ ID NO: 577193 - DNA, 760 bp, Homo sapiens
  misc_feature (651)..(651): n is a, c, g, or t
gaaatcacacgtcgccgaaggccgtgtctagaataggcagcagcggccggcgtcaactgaagtcacggaatcttggcaatcgactcgttcggttcgctcaagggatcgcgagacgtgcagtctcgccagtgatttgaattgacatgctgatagcgtcataacataacagacttcgagcaccacaggccgaacacttccgatcacatagtcttggtcgggaccacagtcggcgtaactctgggaaaacgcacaggcctggatataatagcctgatcagggcgggacgtaaagccatcgttccgcgacattgcgatccacagcgcgagaagcacaccaagcaacgacctactccacgaccttacacacaggacagagggcctcccgtgcaaactacacacaccctagtgcgaagcgccgcaaagagtacaaagcacgggcgcaaacccacaacgtgccgagaccaggaaaaccgcgaacccaacggcgctgcgaccaccggtggggtacccgtggaacgagccaagcaagttctcgacacaaggcgacaccccgagtaaaaaggaaggtacctaatcaacggagcacacggcttcaacgacgcacgtagtcgcaaccacgaagagccgcaaccagctcgaaggagaacgagcntcccgagcacctcggcgagtgcacggacagcgcccacaccgactctggggacacgggaccaaaaggcgggaacaaacccggcgccgggcgcaaaccgaaggaagtacag

SEQ ID NO: 577194 - DNA, 352 bp, Homo sapiens
  misc_feature (219)..(219): n is a, c, g, or t
  misc_feature (241)..(241): n is a, c, g, or t
  misc_feature (259)..(259): n is a, c, g, or t
  misc_feature (302)..(302): n is a, c, g, or t
  misc_feature (316)..(316): n is a, c, g, or t
acaggacacgatctgttgatgcggatgacgtggaaggggtggagccgcacccggatatggaagccatcttcgccacaacgtttttaccatgtactctatggcacaaattcgggcagcctccaggggcttcagagagacagctgcgtcatattcatctgcacaccatgtgggccacaaacgcggaaactcatccactctttgcactttttcacgccccanggtcaaacaatgcgaagtcttnggcattcagggacaccgntcggcagaagcgacgacttcggtgtacggctcgtttcttacanactaccggtaacanacgagaagcggcgaacgggtaccgacgctcgaactt

SEQ ID NO: 577195 - DNA, 920 bp, Homo sapiens
  misc_feature (697)..(697): n is a, c, g, or t
agcgggtcgggctcccgcgccatggggcggctggtgcgctgtggcgctctgctggggatgcgttgctggtcgacttcctgtggtcgagcaggcgttcgtggccacgtcagtcaaatcagagcattgaaatgcactcgcaggtagaagatacgaatcatgctgaggaacctttcctagcactctggcgaccgtggattaacatgggaagttgatacgctggactcatgaattgatgattgatcagtacgttctcctagagatggatctggactcctgatgtaagttgctggtgtcctcaaatcattctccccggacatctcgactaggtcttgtggcgacacagattaatgaccgtaggatggaactactgtaagtgagtggattcgtaaaaatgagagatacaaactcaatggggcactggcgataattaagtagattctagatcgatggtgtctatgaggtaatgtgccttcaatgtctagagtcctagctagtgggacatcaggtgagctatgtcactaggaccagaacgagtgaggatgagatttattcatctgtagggttgatatataacacacaccagtagattgagaggaatatatcacgctggagaattattttagagagatatgaatgaatggcaggaaaatttcttctggttgcatactgtagaaacagtacaaacgatgtagacttncttaccaagtagtgaatggacatcacagactagtcaggaaccggtcacattgctgatggccacaaatggaccgaactgaattctctgatcgctttctgtgaaagtatattagaagacatgacttgaaacttgacactggggccaaatgtgggtttactcacgagtgccaggatgaaagttaaaggtggtaggagaagggatttcgattccaggcagatgggga

SEQ ID NO: 577196 - DNA, 884 bp, Homo sapiens
catgagcatacttactattctataccctagtaggatcacatattcccctgacaacatcgcactgatttacactcaccaacaccctaggctcactaaacattactactactcactctcacatgcccaagaactatcaaactcctgagccaaacaaacttaatatgactagcttacacaatagctaattataggtaaagatacactcttatacaggacataccacatatatgacgtcccgtaaagccacaatgtcgaagacaccccatcgcatggggatcaaatagatactatgccagaaggactacattaaaaccaaggcggcatagtgtgtaataatacagccatcacacatcaataactcaaaccccactgacaaaaacacactagccataaccccatatccattgatacatactcaaccactatagagagcataaattaataacaaagctccaaatcatgcctacgaacgaaaacagaacataagaatcagcatcactatgcataacatctaaccacatcacaagaccacaattagacccctcgatagataaacaagaacatgcatgcatcccaaaaacaccactgaagagcattcaagcgggcagccagatccagtaccttcaatacatccggcgccgcggaaccttaaagaatacatcgagttaacgtaattacatgccataagccacaactcgagagacataaggaacagcagatcaacaagacggaatgaagatccgtctacataaagagaagctacagcgaatcttaattccgcaggaacataaatattgtgaggactatatagccatgacttagctaagaaatgacatgaagcccaagatgaagctatgggagagtcactggggaagtaaccagta

SEQ ID NO: 577197 - DNA, 152 bp, Homo sapiens
caggatggagggagggcggcctgggccttataggagacaccagggtacctatatgcacctcatgccccacccccaccaggaaggtaagtgtaccagaggaggagctggacgcaatgctgcaagatggcaagggaccatcaacttcaccgtct

SEQ ID NO: 577198 - DNA, 395 bp, Homo sapiens
ctttgcaccccctcccacgcgctccagggggtctctctgggatgcgccgccgtccccaccaattctctcggcggcgcatctttctggccctccacaacacagtttgtgtgttgacgcgcccaccggcgttctccccgggagcttctctcaccgtgccgctatttgttgggccgtcgcacactacttctcctctccccttgtctttgcgcttctgactcgccgccccgcacctaaatattttctccctttacaccaccccacacacactccctttggctttgtaaacccccccccttaattattgcgcgccttttttataaaatttgtttttacagcaattttctttaatttctcccctttttttgtatatagggccgccataacaaaacaaaaaa

SEQ ID NO: 577199 - DNA, 151 bp, Homo sapiens
actcatttcaaaatgaaaacctatctgccaaaagcataaaaaatctttctaaatatcagggaaaagcagtttgatcatagaacgctatatacatactataaatctaacctacttaaacaacgtaccttaatataaatatacgataaaattc

SEQ ID NO: 577200 - DNA, 1588 bp, Homo sapiens
  misc_feature (1210)..(1210): n is a, c, g, or t
gggaggtcaggtggcgtttgctgtggtggctaggccctgcgtgtcgcatggatgacctcctgcgctgtgcccccgctgatgcctcctgtccctgtgccctgtgctgcttgctgtgtctctgcctgcagtgctggcatgcatggggtggcccccggggccgccgggctggtgtggcggtgcgggccttgcttgcttcggccggccggggccgccttgccttacctgacatttttagcacggctggaccccggagggcatccgcgcgggccggtggcgaacccgcggaagccttccggcgagacataaccggcttctttacgaaacgttcctgcaagaaatcaacttctaaccctagaatgggctctcactacttgcactggaattggtctcttacacatttgcttgacaccaactcttttcaggaaaacacctaccccttttttaacgccttcgcttcgggaatggctacacatccttgcggagcgtggatttcccctttgggctacaccttcactttctggcacacacgtcaaaggccttttgcgtggaattctcacctttattctggcgcggcttaacagccacaagttgtgcatagtcccttttttatctccactcggtttaaacacaccaaaaggtctatacattctaactctcctggtcggaacactcctgggcggcgttggggatccacattttcctcgaaaacttgatggtcggggccacaaaaaccgctaatgaactatccagagtcgccaattttcccctcaataacccaaggaacaggcttactcttcccctcaagcgcgagcaacgacgagccccttcttcaaatacttggcccacgcttaaacgcacttcataaccccccgatggcaaagtctgtggcttgcgacaccttgtcttcgacgcacatgcacgaactccccaacgttttccccgactggcaacataaccacagccgggggtttgccccacaggtctttctcgtctggaaacaacaacctctggtctttaatctggcaaaccttctatctggacttcctggaaacacataatttcgccgagtgtcccaattgtcaaccaggacacagtggtaaccttctccttccccggagtgtgctcccaacaatggactgtggacacttatcacagtacaattttctctccctttatatcccccccttattgaactggccaccacaagtgncccacaccggcctagtgaccaaaaacacgggggtgaacggcacattttccactgctcattatacccgtcagagtattaacgttacatacccgtgacactataattctctccgacggcaaaactttatttcactaatcgtaccagccttgggcgcgcttcacataactatccttatgcgatacacggggtcccccatctctgtataggctcgctatgtgtaggtgccgactgccgccgtaatcgttctttcccaacagcttgtaagagaggtgtctctccgacaagtgctcatttattgctcgctgtgctcattaacctctgtggtgaccgacgacggcacaatctgtcgattgtccctccaccgtgctactgcgactt

SEQ ID NO: 577201 - DNA, 687 bp, Homo sapiens
gcgtcttgctctttcgccctcttttgccatctgctgtgggatggtgtagcaagagggccttcatgagacactaaagcaccttgatatcagacttcccagcctccagaactgggagaagtaaatttctttctttaataaattagcccgtctgtggtattttgttatagcaacacaaagtggactcagataggggctccagaaacacccccacaatgtgtaaggtaagacttatttgggaaaatattctatctcaccatggtaggctgaataatgacctccttcctccaccctgcctgcccctccccgccccagacatatctatgtcctaatccttagaacttgtgactgttaccttatatggcaaatggagactttgcagatgtgatgaaagatctttccatggagacattatcctgggatatctgagaggacccgataaaaccataagggtccttataacagggatggcaggagattagagtcagtagtagatatggagtcagatatggaatgataaagcaagactggtagacatacaaggatgaggccatgagcccaggaatgcagatgacctctagaagctggaaaaggcaaggaaagggattcttccttgaagtctccagaaggaatggatccctgctagcccttttggttttggactctcggcactgtaaaacaataaatttt

SEQ ID NO: 577202 - DNA, 315 bp, Homo sapiens
gtctacacctgtgcgaggccaacgctgtgggacgggcctggaagacacgcctcacgcgattctcccacatcctgccaccctgtgggacgacacttctacaggaatcgtaaactcatgtgacccagccgggacggaccacgactgaagaaactttcctgacctaaaactccgctgctgtccacacactagacccctggaacggagaccactcacctctcctgagggtcagcactcttcacctgcaaggacggtgtgggacgctcactcgctgtgaccccacagtactactcctactctcgcgcgtctctactcctg

SEQ ID NO: 577203 - DNA, 233 bp, Homo sapiens
ggccgggtgttggtgctaatagatgcacacgtacgctgccttcagactaacacatcagatgaggtgtgctgactctctcacctggattccacgctgcatcgcctgggtgctcccgcatctggaccggttagtgatgcgcaccttctggacgcaggtcactcctgctcgtgtgtcctggacgagagagctgcgcgccggctccctacagcaccccgggaacccccccccgcact

SEQ ID NO: 577204 - DNA, 852 bp, Homo sapiens
  misc_feature (34)..(34): n is a, c, g, or t
  misc_feature (112)..(112): n is a, c, g, or t
  misc_feature (126)..(127): n is a, c, g, or t
  misc_feature (137)..(137): n is a, c, g, or t
  misc_feature (140)..(140): n is a, c, g, or t
  misc_feature (154)..(154): n is a, c, g, or t
  misc_feature (195)..(196): n is a, c, g, or t
  misc_feature (198)..(199): n is a, c, g, or t
  misc_feature (201)..(201): n is a, c, g, or t
  misc_feature (204)..(204): n is a, c, g, or t
  misc_feature (211)..(211): n is a, c, g, or t
  misc_feature (216)..(216): n is a, c, g, or t
  misc_feature (218)..(222): n is a, c, g, or t
  misc_feature (224)..(224): n is a, c, g, or t
  misc_feature (235)..(235): n is a, c, g, or t
  misc_feature (239)..(240): n is a, c, g, or t
  misc_feature (246)..(246): n is a, c, g, or t
  misc_feature (250)..(250): n is a, c, g, or t
  misc_feature (261)..(262): n is a, c, g, or t
  misc_feature (269)..(269): n is a, c, g, or t
  misc_feature (274)..(274): n is a, c, g, or t
  misc_feature (276)..(276): n is a, c, g, or t
  misc_feature (278)..(278): n is a, c, g, or t
  misc_feature (281)..(281): n is a, c, g, or t
  misc_feature (300)..(300): n is a, c, g, or t
  misc_feature (302)..(302): n is a, c, g, or t
  misc_feature (304)..(305): n is a, c, g, or t
  misc_feature (307)..(307): n is a, c, g, or t
  misc_feature (326)..(328): n is a, c, g, or t
  misc_feature (330)..(330): n is a, c, g, or t
  misc_feature (332)..(332): n is a, c, g, or t
  misc_feature (353)..(353): n is a, c, g, or t
  misc_feature (370)..(371): n is a, c, g, or t
  misc_feature (388)..(388): n is a, c, g, or t
  misc_feature (393)..(393): n is a, c, g, or t
  misc_feature (403)..(403): n is a, c, g, or t
  misc_feature (405)..(406): n is a, c, g, or t
  misc_feature (408)..(408): n is a, c, g, or t
  misc_feature (413)..(413): n is a, c, g, or t
  misc_feature (418)..(418): n is a, c, g, or t
  misc_feature (434)..(434): n is a, c, g, or t
  misc_feature (480)..(480): n is a, c, g, or t
  misc_feature (507)..(507): n is a, c, g, or t
  misc_feature (509)..(509): n is a, c, g, or t
  misc_feature (530)..(530): n is a, c, g, or t
  misc_feature (617)..(617): n is a, c, g, or t
  misc_feature (658)..(658): n is a, c, g, or t
  misc_feature (806)..(806): n is a, c, g, or t
ttcttcaattatattattgtttttttctcatgtncatttacataaaactaccgctctaggttttggtgtgttttgtgtcagctactttagtgaataaacgaaacataaaggnactcagctacttgnnttcatgagantcngctttcaaaaaaancatatatatcatctcatagaatacttatgtcaaacccaggnnanncngtnactaagncacanannnnncncttttaaaganaagnngggggnaganaggtggggggnngggggtnggggntntngcnactgggccggggggccagngngnntntgcgcactgggaatttttnnntntntttacactttctcctgttctntttggtccacattccanntttttattttttttttnttacnttgttatctntnntncttanctttntttcaaaggtgaaagntacaagatggtaattgacataaaaaggttttaaaattcttcccacncaaaataaaataaaaataatataatcncnatcaaattataaagaaattcnatcaaaatgttgaccacataaagaagtcagaccatttgccttcgccgactgcctcagagggcagagcatgtgtcacctacaaggggngaggggggtagagtccctactctcccccggcctgtggtgtnagggtggacaggagccctttggcttccctggggttttgcttcctcacatagggaattgatggaggtgggctagatggctttaagagacttctcaactaaaagaatcaaagtcagcttgagagcccatctctgaacagacatatagggnggcaaaagaaatggattaaaaaaaggcggatgacgtctttctcacc

SEQ ID NO: 577205 - DNA, 900 bp, Homo sapiens
attaaaaggactatttctctaaaactcaaaaaaaaaaaaaaaatctcaagatagtaaaagcccctagtgtgatcaaattatcggtaaggccattggggggtggattcttccagaaaacagcagttggatacctaagcagcgttattggatggggctattcaatctatgtttagttgggccccttaagatactagtggcagctagatttcatttaggggaaatcaccagtaatttgactggaccaattggattttagagagaaggtaaccaaaccaaatatttatctggggcaaagtcataatattctccacttgaatggcgctcatgaaaaataggccacaaacaagagttctggggccacagctcaagcccagagggtccctgggggatgggagggctctctctccccaccccttgattctagagaacgtgggttttctcccagtactccgagcaattcatttctgacaagcagttgagccacttttttccaaatgtcccctgcagatgttcaaactcctccatttctctttccccttccaccttgcagttttggctggactctccactggtcatggagtgtacagcattaggcacattatgcttctgcgattctgaagacggtcccggtcatggatagactctgggtcccttaggaaaatattttcttccaaattccagaggaagtttagttattccccttttgcaaatgtctacgcggtcgcgactttggcttacaccctgggacacacaaatcttgcgaatgtgttccttggcaccagctctatttggggggtaacatcacgctcgacgtggagactcgtgtggaaatgcagaacgtgggcaagaggtcaatcttgcgagaacgactagagaaagagacagaagtgtcccacgaga

SEQ ID NO: 577206 - DNA, 244 bp, Homo sapiens
  misc_feature (108)..(108): n is a, c, g, or t
  misc_feature (118)..(118): n is a, c, g, or t
  misc_feature (139)..(139): n is a, c, g, or t
tgccaaagcgtataccaagtagccgggaccacaggcgcgcacaccatgcccagccaatttttttgtatttttatgtaaagacggggtttcaccatgcctggccaggcntggtcctganactccctagaccttgcgatcnctgcccacctcatgcctcccagatgtgcctgcgactacatggcgtgatgccaccactgccgtggcttattttttatttttctttttttctaagagacattggtct

SEQ ID NO: 577207 - DNA, 578 bp, Homo sapiens
tacctgaacgaagctggcgtataagacatgtaggctctaccagatatcgaaaagaagaaccatctcacgtagaatacgaggctaggacagtagttcatgaataatcgaataggcccttacatctactgccgttgccatcccacaggcatacttcaagcacagttacgtactttgcaatatgcatgtgcatactatacagtggctacacattgctcaaatgcactctggcgacgaacaattgtaacacccttgactaacacccatacatagagcgtcctaaacagtaggacctaagtggtcacgcacataccatacagcacagcgttcatttacttaagaaacgatcctaaatagggcacgcgcacacaatccacaccgcacaatacacaactgaaccgctgtgcccagaacgaccaacctataaccgcactacacctaactaaaacagtcaactctacacaacaagaggacacgtaggcatagaaccactacccagtacaacacgtcacacgaatgacactttccccacgccagagcatagcgcccctgagcaaggcatcacgacagaacgatccaga

SEQ ID NO: 577208 - DNA, 1137 bp, Homo sapiens
  misc_feature (1137)..(1137): n is a, c, g, or t
gcaggagagcttgcgaggatgagggcgcagagcccatgggctacagcgcggaggtgtactagatgagggctatccggggatgatcgacaatgggaggagaagcgcatcactggagggcagaggaagaacgagcgtgtgcgagatggtagttgctgagcgctggagacagtggagtcgtgtgcccaggaccgcgtagaatgatggaataagaggaggccataatgagttcatccactaggagaacatgaggccaaggcctgtggtagcaagtactagaggatcggctgcggcagatccggcctagtggcagagtccaaggcagacggcatcggacgagttcgaggcccttgataactagctcagtgtcaggacacgataggggcagcagtggggtaggggtcatttagggcaggggcagcctgtacatgaccccggccacagagtctttggttgttctttgtcagatggacttcacggaggttcataggagatcttcccctgtcagggagtccacaatgttagcgctttatagcaaagaagggcaatggatatacctctcgaaactaggaataatccatttgcttgggggctggcgggaaaccaaggggtatggacggactactggatttgttgtgtaatccccacaggtgtgctgcatttaggtggaccagaggcaaggggccgggattttctccactagaatttagtgtggtccgaaagtgcgatcgacttctctgatagtaagtgtggctgggggacgtcgagggaattggactgtgagattaatggaggaaaaagagtggtcgctatgttaaagaagttgcttgaggtttaacagaaaagagttttcaattgggtgggggaccgtggtggtttgaattaccaaacgggaggttgacaggcgcactcccattagacatcgcgggaataaagggtgggggcacagcggggagattccccaatttctgtggtgggccaatgtaacattgtggttaccgggggttactaggcggaaaaatgtggaggcattcgaaacatttgaatggtgagaggtgtgaaatttgttcctaatgggaagggtatttgccattctagggtgaattacttgtgaacaatgtgttaagaggggggagatgn

SEQ ID NO: 577209 - DNA, 246 bp, Homo sapiens
tgtgctgcaaatatgggatcagaagaggaatattcgggctctaatgggtatcagatctgccatcttgcatcagcggggccatggttcttgtgaggtgtctaagctggtgcctatgtgctatatccccagcatccttctgacagcctccagccgggacaggattcgtggggcctcctgtggacatagcatctgtagctccccaggtcttatgcgaagtagctggctccccgtcagggacccaagtgt

SEQ ID NO: 577210 - DNA, 171 bp, Homo sapiens
  misc_feature (13)..(13): n is a, c, g, or t
cgtctaatcgccntaacctgcccagtagacccatctgactctgcccagacacacccatcttcccgtggggtccctggacatccctcctacaggagttcaggcctctacccgcgcccctcccatgaccagctgtccattgtgtcgaacttgctcaagggccgtcctgcctgt

SEQ ID NO: 577211 - DNA, 151 bp, Homo sapiens
ctgttagcctcagcagttatgtgtactaaaaaacaaacaaacaaacaaacaaacaaaaaacaaaatcaagtctcttcctcggtagagaattacaccatttttcttcatctctggcgtatttagtaactttgacatgggcacacttatggag

SEQ ID NO: 577212 - DNA, 440 bp, Homo sapiens
ccctagattccatctcctctttcctactcgatatattgccccatgtattcttcccttttttgcccctcataccaatttaaatcttttttcattggatcattcccacccatttaacaaacgtttgttatttttcccatcttaaaaaacgaaacattgaccgggcatggtggctcacacctgtaatcccagcactttgggcggccgaggtgggcggatcacctgaggtcgggaattcaagactagcctgaccaacatggagaaaccccgtctccactaaaaatacaaaattagccgggcatggtggcgcatgcctgtaatcccagctactcgggaggctgaggcaggagaatcacttgaacctgggagacggaggttgtggtgagccgagatcgcaccattgcactccagcctgagcaacaaagagtgaaaaactccatctc

SEQ ID NO: 577213 - DNA, 108 bp, Homo sapiens
ctgattgcgaaccgcctgcagaggaacagctgtgcaacgactcacgtacttcgctggctgaggccattgccatgaacctggcagctggaccagcactgatgaggacct

SEQ ID NO: 577214 - DNA, 411 bp, Homo sapiens
gctcggcacccggtagcaaagccaagactagaacccaagtctctagaccgtacatggttcacagagcagctcactttggccttccggggcggttttaggactcaactgaaagaccgtgcatccacttacatctccacttacaatgccatttcctgagaatcctgtcctcctttgttttagctgaccagacatatctgtcctaatagaatggtgttggatggatgtttgagacagagcagccataaataatctggggcgtttggcctgttaactctccttccatcctgaatggtgtaataggtttaagataactacctctaaaattaactatcacttttgtgaggaaggtgaactgataaatcttgccttgaaactattacccatctgagtgatgctctgggactttctttc

SEQ ID NO: 577215 - DNA, 385 bp, Homo sapiens
gcagagccgctactactactaaattctccgccgatcgacccggcaccggtcacgttgggtagacagatatcgaagtccccctgcccaatatgcaacagctgaccactggtgttcttgaaggtattggccaccagggtcaggtcgttgttggcggtctccaccaccccattctggttatcaaacaggttgcctatctggaacagggtcttgccgtcacgccccagcgcacgcagtttgccgctctggttattgatgctattggcccgtacgctcagcgtcgtatcgctttcaataatgccggactggttgctgagcccaccgatcaccccaaggtcaatctggccacccgcaatctggccgtcgttgctgttatcaaagttctgcg

SEQ ID NO: 577216 - DNA, 301 bp, Homo sapiens
agatctcagctctacaaaaaatttaaacatgagcacgagtcaggcgcagtggctcacatctgtaatcccagcactttgggaggcgacgcgggccgattgcttgaggtcaggcgtatgagagcaacctggtcaacatggtgaaaacccatccctattacaaatataaaaataagccgggcatggtgcatacaactgtaatcccagtactttgcgaggctgaggcgggtggatcacgggctcaggagatccagaccatcctggctaacacggtgaaaccccgactctactaaaaatacaaaaa

SEQ ID NO: 577217 - DNA, 450 bp, Homo sapiens
  misc_feature (25)..(25): n is a, c, g, or t
  misc_feature (34)..(34): n is a, c, g, or t
  misc_feature (75)..(75): n is a, c, g, or t
  misc_feature (87)..(87): n is a, c, g, or t
  misc_feature (196)..(196): n is a, c, g, or t
  misc_feature (421)..(421): n is a, c, g, or t
aaaaaagacaaagatgttttccccnagaaatganaacgcgctgtgctgggccctgaaagccgtgaaagggcccanacgctcccctgnaagtggcccaaagtccccagtgagccccaggggcttgggttgagggtggggggtctggtagaacactgcaacccgcttaacaaataatccctcctttggccgggtgcgngggcacgcctgtaatcccagcactttgggaagcccaggtgggcggatcacgaggtcaggagatcgagaccatcttggctaacatggtgaaaccctgtctctactaaaaatataaaaaattagccaggcgtggtggtgggcacctgtagtcccagcaactcgggaggctgaggcaggagaatggcgtgaacttgggaaggtggagcttgcggtgagccaaagaacngccactgcactctaccctgggcgacagag

SEQ ID NO: 577218 - DNA, 1027 bp, Homo sapiens
gggttgaggcacaacgggtatttcatgtctcagggcagtcaggtttgtgcagttacagcttttctgttggtatgcataattacatacattggcagctgcaaagcagcatcgtgacacagcagcatggacggtctggcacagcaacaaatcggcacaggacacaggtaagtatgcacctcctgatacatggcagagaccattaagcaagcactggcagtaggtgtataggtgcccagcctattccatgctgcatttcattagacacgtattccagcatatgtgagccgtaacagcactacatagccttggaccctgcatctcatgtgaccatcagcttataggatatacaagggtgtgatccaagctatccaagacacatcagcatgcacggctcaaccatccagggccatcatctggcaatcttgccacagtcgctcatcatcctgcaggcagatggtcccagcacagtacagtccatctcgctctagggacccttggtgcaaacttagccactgcatcaacacagggcaccttcacgggcgccatcttacgtatcgttcggatggcatataaaggtagattcctcctgcaagtataggccgaaggtagcaatgttggaggtaataaaaccgtactgcaaggggcaggcccacggtatccgacaggggacgagaacaagagtacacggaagtacccgggcctcctcaaatctccaacgacgtgccaggaggaagacacaggttcacttcaaagagagagacggggaaatccaagggccgcacacaatcagaacccaagaccaccagaaggggacacgcgcacctgcacgcacggagcacaacgaactggctacggggccacccgacgcccaacagcccacacagtccccgggaacgtgagaccccgcccaccgcacgacagcaacccgcccataaacgaaccacacgcagggggattcatcataacgggggcacacccgcgcggaacaacagcggcggaggacccagagaacacaggaacctgacca

SEQ ID NO: 577219 - DNA, 131 bp, Homo sapiens
tgtgaacgagacgacctatttctatgtcatttttaatgtatctatatgtacattttaaagttcttattttagtatacatataaatatccagtattctgacatgtaagaaaatgttacgcgctcacacttat

SEQ ID NO: 577220 - DNA, 119 bp, Homo sapiens
cttagaggatcccattataaagttcctgtttacccttatccttctcctggctctgtatttaaagtatgctgtcagttctttatccctcactttctatcccttacgagtcgagaacatag

SEQ ID NO: 577221 - DNA, 1367 bp, Homo sapiens
gagttttttttatttatatttttaagttcatgtctttaattaactcatacagttactggtctcctgggttggtgcgaaccagtaagtcagacaactatttggccacaataaatggtgctggtgcaaagtggatcttgccataaaacaccccagcaccactattcatcaaaagcgcgctcgcagtttctacgctctcgcctggcctggcccgctacccttgcttggctccagcgcatatacgcatcgccctcttccctcgaaggaatcgaggggagaacctcgtgaccacacagccgtgggtgcgtggagaacggcgaagacaagaaggcggagagggggcctcaggggagaaaacagaggctgcacgtgggatgggaaaagtagagaaagattgtcagaggctgatggaagacgcaaccaaggacgcacaacttatccgcctagagtgaccctggggtcgtgagaccaaagttatacacatgcgggggggcgagacatcgccaaacaggaggggatacatatgaggagaaccattgagaggggggaaaaggacaatacataagcaaccaagcggtgggtgcccagagacactcatgaacccccgtggtgttgaagaaccagagggtgaacagccccaatggactcatatgggaacaccacaacacacggggcaaaaatattcttttcacaagggaaatctgaaacaaagcgacgcagcgtggaagcgaacaaaggggtaattgagggactttataatcccacacattccaaggcatattatcagagtagaaagcatacacgcgggatgatattggtacaatattttatttcccgccgatttatgagaagatggagaggacatggggaatttataaataattgcccccaacggagcaagcgttgcaactagggtggcgcacaaagcgtagacacccgttggtggggaccccccacagtagagaactaggggcataaaaaacgcaaaacagtgaatagcaaccaacaagaaaaaggaggaaagaaaggaaaagacacaagagggaaacccaaagaaaccagcgggatggaaaagcacaaaacgaaacacacaagcgcgacacaccacccatgagtcgcgaaacggcacgaaacacagtgaacaaacccgtgagagatcaagaaacaaaaagagacagaacatgctggcacccagtagggccccgcgaataaacaggcagccacaaaaaaggtatgatggccccacaaaatgaaacgaaagaaacacgcggcaaccaacaatacagatacaaaaacagaaaaggccgtagaccacaaacagacagcgaaaacacggaacactcagacaagaatcagctaacagcagacaa

SEQ ID NO: 577222 - DNA, 290 bp, Homo sapiens
gaacgcggggcagagagaaacggaacacggcaggagtttcacaaatgttcttctatacaatgtctggaatctatgaataacatcggtttctaagttatgaattgattttcaactactgggtttaggccaggcaggcgcaggcctggtttcgggcctagcgccaggctgcctgcctgtctttggttttacttccttgttgttttttcttaaaacaggtactgagtataaaacactatgagagggtctctcttccctcatagccacaactcattctttagcttccggtcgaa

SEQ ID NO: 577223 - DNA, 207 bp, Homo sapiens
  misc_feature (177)..(177): n is a, c, g, or t
ggctctgttcacaaagacctgcgtgctctgctcactactaatcctttcctagtacgctgcggagcacagacgggcgctgcgagagacggcctgcacaaagacaaataagaccaaggcggcaggaacaggagaggaggacaaacaagcgggcagaggctgctggaaattgtcttccanctgatgcatggggcttaaagcctaggagac

SEQ ID NO: 577224 - DNA, 93 bp, Homo sapiens
tatgggactatcgtcgaccacggcgtcgacagaaggcggagagagctggggctcagacattggtgtgcaccttaataaaccctgctgtctgcc

SEQ ID NO: 577225 - DNA, 183 bp, Homo sapiens
tagagactggaattaacttttatgcaaggtgtgagaccatgatacaattctatcataatatattctcaaatcattacccagtattagaataccataaatggaacaatccctacttgtggtgtgaattgaaaacgttaccctgttactagataaaattacactccatttctgtgcccatttcaa

SEQ ID NO: 577226 - DNA, 154 bp, Homo sapiens
tcacagaaagattcatccgctcccagacatgggtaccctcggcttcacgcctcggaagcgcacgagcaggcatcgtgggaaggtgaagagcttccctaagggatgaccccatccaaagccgggtccaccctcacaagccttccctggagtacaa

SEQ ID NO: 577227 - DNA, 370 bp, Homo sapiens
aaagggggccttttttttaaaaggggggggggtttccccaaaaaaatttttttggggggggcttttgaacaaatttttttagaaaaacggggaattataaaggggttttttttctttttttcccccccttttgggaacggggggggccccccagattagggcccctgggtttttttttgaaaccccgggccccccccggggggggggttttccccccctgggagccccagagaaaacaaaaatttttttgggaaaaaaaaaaaatttcttagtaaaacgttgaggggatttttttcccgaagggggggtttttaaaggggcttttccccctttttttaaacccccccccccattaaaaggggccaaggga

SEQ ID NO: 577228 - DNA, 233 bp, Homo sapiens
ctagaggatccccgcgctcacaacaggcacgggtacttctttcaattaaaaatgtaaaaactggatatttaaaataccactataccaagggaggataagctggaattttaaacttagatttaatagctctagtttggcagtttgggaaaatagcaggtttaaaacaaaattattatatgagctataaaaaagggtctttaaagagtaagtcttacacataaggggtcatttgg

SEQ ID NO: 577229 - DNA, 272 bp, Homo sapiens
  misc_feature (48)..(48): n is a, c, g, or t
gtccgtctgagcagctgggactaccggtgtgtacacccacggcttggnttattttgtatttttaatagagacgagttttcaccatgttggccaggctggtctcgaacgcctgacctcaatgtaatccacccgtctcagcctcccaaagttctgggattacaagcgtgagccaccatgcccggcctgatttttttcttttttaactttcgaggcggtatcaaagctgtggaaagagggcgggtacaagggatttttttcccagctggctcaga

SEQ ID NO: 577230 - DNA, 202 bp, Homo sapiens
cttttggggtctttgctgaaatttcccaggtaggacaaacaaccactataggggggagcggaaaggcccagcgccaagcgctaatggaaatacagggtctgctgttgcaggcttcaggagtaaggctgtagctcactgctgtgacagctcttgaggttcctagccttgatacacctagcttattctgacgccttttgctgaa

SEQ ID NO: 577231 - DNA, 569 bp, Homo sapiens
ccaaattggttgccttggtggcccttgggccttaaataaggggcattcggggccttacaggcttcaacagggcaaaacgggcccccaggccggggaggagcagttgaagatttggaggggttcctttgacatccccccgcccccgatggacgaaaagcacccttttttcaattccattagcaaggagggtcggttcgcaggctttaagcccggggatttcccccccttggaaagccttaaggacaccattgcccgggccctgcccttttggaaagaggaatttgttccccagatcaaggccggcaagggagttttcttttcagcccccgggaacagccttgggggcattttcaagcccctggaagggatttcaaaccaggggtttatggagtttaacctgcccccggggttccccatttttttttagtttaacaaggagtttaagccccccaagcccatccagtttttgggtttttaggaaacggtggggaaggccatggaggttttggtttcccagggcaaggccaatttaggggtgggtttgggcaataaaggcccctcccccccca

SEQ ID NO: 577232 - DNA, 955 bp, Homo sapiens
aagcctattttctttgcgtttagatacattgcctttagcctagtgctggcgtcgagacttgaggccgttgcagactttggcgcggctcgcgcctcctgcttcaagagcccagcgtgtgagagctggcctgcggcacgcggcctaatgccagtcacaactgtggagagactatgaggccctgaactttggtgttatcaatgaaaagggaatggttattcataggtcgcagcgcgaatggctggcctcacgcctgtaaatcccagcactttgggacggccgagacagtaacagtttggaggatcaagatgttgacctaatcttgaggatatttgcaagtgagtctatcagtactaatacccagattgtgtatattaatagatatatgctgctatcaaaataacgagcaggtttaaaaagattaaatgccacatgtgccgcttggtaagaagattgcagtttctctagccaggcttaagtacggaaatgatatcagatcccttcattccatcatcaatcctcccatagctagaatccgtaatattggaattatggctcatattgatgcaggcaaaactaccaccacgagaaagaatattgtagctatgccggatatacaagatcactgggagatgttgatgatgggatgagcagtgacgatttcatggtccaagcagcgagaaacgagattctatttcaatcagctgctgttccttttgatggggacgtttagaagtcagctaatgaaaacccaggtccagcgggtcattaccctgggggttagcggggccaaagtgtggtgtggccggggcaatgaacctcgagtgggttaggccgaaacacatttttgtggataaaaactatctaccatgctttccacagcgccagggacgaaagttgacatcaacaacccccgttctctatgtcaatagggcattcacacctcacacaagaccct

SEQ ID NO: 577233 - DNA, 262 bp, Homo sapiens
cggaacatgtatatgcgcctggaagctctgccaagagattgcgcatagattctacttgtctgctggctaggacatctgtgctgagggagcttactacattggaacttttaaccagagtatagagtaagcataggtcctgtttcaagagtccagctgacgaagcatgcacatttctgaccatgggcaagctatggacaattcaatcacatgtgatgcgtccctctgaggtgaatgcagttctggaatagcttgctatccctat

SEQ ID NO: 577234 - DNA, 127 bp, Homo sapiens
tcactaacagctataccatctctggccgtcgtttacactaacagctataccatcactgccgtcgttttacactaacagctataaccatgcactgccccgtcgttttacactaacagctataaccatt

SEQ ID NO: 577235 - DNA, 271 bp, Homo sapiens
gccttatgccgggaccgcagaggccatccaaggccctggggtgccaagcactgcgtgaaaggaagtggtcgaagctcacgtggaccagaaaaaaccaaggtggtcacgaccccgagcttcatgtgcgagacgggactccactacaattcatgatggggatccggagccatggtgaagaaagtgtctggaactcctgggaaaggggacgcgcttggacgtggccatttagggcaagaattggctctaccttgtgagaagtgggggttcaacg

SEQ ID NO: 577236 - DNA, 288 bp, Homo sapiens
catcttcatgctacagtcgaaagcacatatatccacaatgatttttaaagcttttgtgatattttagcattttgaaagactttcacaggtgagagtagaaggtagatttggaatcatgcattttagcaatgtggacttgttcgaaacatggaagcaagggccttcagctgtagcccacttcttgatccagatgctgttgcctcgtgacagcgtgtttctcgtggatgtcaagaggcagctgccgtggtgcccagtcttgcttctcgcacgtggtaggcatgacagatt

SEQ ID NO: 577237 - DNA, 742 bp, Homo sapiens
  misc_feature (32)..(32): n is a, c, g, or t
  misc_feature (71)..(71): n is a, c, g, or t
  misc_feature (90)..(90): n is a, c, g, or t
  misc_feature (95)..(95): n is a, c, g, or t
  misc_feature (119)..(119): n is a, c, g, or t
  misc_feature (166)..(168): n is a, c, g, or t
  misc_feature (171)..(172): n is a, c, g, or t
  misc_feature (175)..(176): n is a, c, g, or t
  misc_feature (184)..(184): n is a, c, g, or t
  misc_feature (204)..(204): n is a, c, g, or t
  misc_feature (220)..(220): n is a, c, g, or t
  misc_feature (235)..(235): n is a, c, g, or t
  misc_feature (246)..(246): n is a, c, g, or t
  misc_feature (248)..(248): n is a, c, g, or t
  misc_feature (272)..(272): n is a, c, g, or t
  misc_feature (276)..(278): n is a, c, g, or t
  misc_feature (280)..(281): n is a, c, g, or t
  misc_feature (283)..(283): n is a, c, g, or t
  misc_feature (286)..(287): n is a, c, g, or t
  misc_feature (296)..(296): n is a, c, g, or t
  misc_feature (298)..(300): n is a, c, g, or t
  misc_feature (302)..(302): n is a, c, g, or t
  misc_feature (306)..(306): n is a, c, g, or t
  misc_feature (308)..(308): n is a, c, g, or t
  misc_feature (329)..(329): n is a, c, g, or t
  misc_feature (340)..(340): n is a, c, g, or t
  misc_feature (393)..(394): n is a, c, g, or t
  misc_feature (407)..(407): n is a, c, g, or t
  misc_feature (425)..(425): n is a, c, g, or t
  misc_feature (432)..(432): n is a, c, g, or t
  misc_feature (435)..(435): n is a, c, g, or t
  misc_feature (450)..(450): n is a, c, g, or t
  misc_feature (501)..(501): n is a, c, g, or t
  misc_feature (726)..(726): n is a, c, g, or t
tatttaaggaacaaatttgacaaaatacatantttatacataaaatagatctctaataataaatatatatnatttgaaaaaatgaaaggngaagnagaaactgctatacaagtatattncactaatatttattttatagcattaaaggattcgggggaggggactnnnatnnggnntcgaaaanacaccattatcggcggcggngtaattgcgacattcntgaaaagcatgtganacgggtataancntcaactcgtgtgcttaattcaganttcnnntnngngcnnctcaaactngnnncngccnanagcatctggccagagactacnaaggaaagggncatttacagagcactataaacatgtctttggacagtaaaacagtatttattcnnctacactcttgantttccaatcatatcttcntcaaggnagntgtttctttggcccnatttgtgcactaaacataaaatttcaaaacacaacttttaacagtgtgatntgaaatgcagtggcagtccctgcttttcgcctgctggcttctttgaaagaaactgcttggctaagggactcagtagagggctgagatctgcctgagtataaagtgctacctgagctatatttacttcttccatcccttggtacaatcaacagcaaatagacaaaatgaagttaccttcctgagatacatggcttactttgtactctgccttttaggagatgaggnagacatatacatagat

SEQ ID NO: 577238 - DNA, 766 bp, Homo sapiens
gcgggagaccggggttcgatgtggcccgaacggggtcactgtagttggaaggaatccagaggtagtgcccgagatggtctcagcacatcgaagtatggagattgtagcatggtagtggtatagcatggaattgttactaattggactggcattactgttgcatgatggcaagcttatataactgatgaattcatgacagaatgggagtgtgttcatcatttttgataagaggagattagatgatggctaaatggtgacacgggtgaaggggtctcgtatctagtaaggagttgccgtgaagcaacatctgtgagtcagagtgcacgacatctatgacgggtgaatagtgagtacgtgaccgtgcgacaatctctcacgaggcgggtggaatggcagcagggtaggccaatttctcgcataagtacatcgaggtctaggggtaggctattaaggggcacactaattggctccaatggtttttcaacttccattggtggccaccgggtttactgggaattaaatggtacccaaataattgtattacattttttctggaaccaagtgcttactttaaatgcaggtatatcgggagaaaaataattgattgggtaaagtgtgcaatggcacgcatggggaaaactggggcacattaaaggaatctgtggaggcaccggggatggggtataaattggttgtgatagggaataagggggtcacgttgggtggccctttattggacccggttgtcgttccggaatctattgaa

SEQ ID NO: 577239 - DNA, 320 bp, Homo sapiens
aaagagctgtggctgtaggtgtatagtaatactgcaggtgacctttattggttgtatagttatagtgccccgtaaattaagccttgagttcggttatcctgcagatggtgctgaagggctggcaggtctcacagggctggctacagattgaattgtaaggacttcctaagtaaatatggattttattctcctcagtagttatcacacttgagctattgctgtttgaacgttgaaactgccatgatgactgccggactgaggagactctgaatatcgcatgctatggaactgatttctgtaggttctgggccatcacgctt

SEQ ID NO: 577240 - DNA, 117 bp, Homo sapiens
ggggatgggataaccccatctctacgaaaaatacaagaggtagctgggtatggtggggagcgcctgtggtcacagctacttgggaggctgagctgggaggattgcttgaacctggga

SEQ ID NO: 577241 - DNA, 312 bp, Homo sapiens
gccaagttttacaacaagaaatagtgcaaacaggataactgatgccatcctatcaacgcttgggcctcctccggcccaaccgcagcgcggcggtgaggctacgcgcccccgcccttccccagctacccagctccgggctgctttcccaaggtgtggcaacccagcgccgcgccctgctatggccccttctcgggccctctcctcccgaaaagaacagaaaataaaccccaggaaaggcaccggctgaatgcggggcgtcagcccagtcccattcccaccaacatacaatgcaggccccctctccaggaggtt

SEQ ID NO: 577242 - DNA, 376 bp, Homo sapiens
cccccccccccccccccaaagccttaaagaacccaccactaaaatcaaaattcctagccgcatacaaagcaacaaatcccataatagtcgccaagagaaagctgcgacgcaagcccacatacaccattgaaggtaaagaggataagtaaaggagagtcttagccggaacgccgaccatacctacgtagtccttctccgacccaaatatctacgatataccgaacgaaactactacacgggaaacctataatattccgtcgagtagcactttgctcctggtcgctcgcaagagtttctagcccgatgtagtaggtgacgcagctgctgaaggcgactcccttaccggcgtcgcactgccccgtaaccgcctatgttc

SEQ ID NO: 577243 - DNA, 118 bp, Homo sapiens
taacatgtgtcgtgcacattttctacatgtgtatattcttcacaatatttcaaataaatgaagcaagcaactatgtgttagcagatagaaaaatgataaagtaatagatctaatacct

SEQ ID NO: 577244 - DNA, 1044 bp, Homo sapiens
  misc_feature (999)..(999): n is a, c, g, or t
ggtgcccttacacaagccgggattgggatcccggaggaatagagtttaccggtaatacaaggattattctttcctgggagaaaattgccctccctacccagcctgggttagatatttaccgcgtattctccccaatgcgggagaggctaatctgcgtcaatcgtttcacattccctgaggcacagcgagtcttgcttcctcctagcgctgctgtatagtcccaaactgattagcaagtgttacacaaagcatgtattcccaaggacgtaagacatatggtgtaacaaatgtaagagtaatttacgcctttgttctcgcttctgcaagtacacttcatgcaacacgtaactcccaacacaaactgcttaaaaggtgattgatccctttgttcggggctcagactttctggaccctagtccgactgagccggtgatcaccttaataataaaggctctcctgaactctgctcggtctctcccgtctatgatttgtcccgcaacaccagttgcctgcggaacacctctacctagagagctaacactcatccccggtcagtaaatccaaaatcttaacccgttgcctcctcatgaccaagaaccatgtccctggccgtaatataagcctctgatgaagtatatagagcatacctatctagttagcatcagcatagtggccctctaccatggttacatctaatcagtgatcagatcgctataattctaccaccggaagagtttcaccgtttcttctgtccagtcacgagaaggctcgagcgcccgtgtaatcccagcaatcattagggatggtcagatcgcgggatggagtcactaagacggatcaagagttcgagagccagccgtcacgacaaccaagagtaaaaccgtgcgtctcctagctaaaagaagtaacggaaagtagtgtatgccgggacgtggttgggcagacgccttgtgtgaatattcccagcatactcgggagggtagaggcagggagaatcantcttcgacacctgggacgataaaccaaggttggcagttcacccta

SEQ ID NO: 577245 - DNA, 122 bp, Homo sapiens
atgaatcagctcggtaccccaagtgtatctgtctaacgtgaagagagaaaccgtgaccagcaaaccgcagaagcgctacaagcatttacccaacgttattgtgaggcgtggcagcagcagcg

SEQ ID NO: 577246 - DNA, 120 bp, Homo sapiens
agctaaaacacgggtgagaggcagtcagtcaccttatcccatttcaaacatgttactaagaaactgcctagtcatattacttatgttgctctgtcacttatggttttgcactgtgtggca

SEQ ID NO: 577247 - DNA, 390 bp, Homo sapiens
  misc_feature (42)..(43): n is a, c, g, or t
  misc_feature (297)..(297): n is a, c, g, or t
  misc_feature (311)..(311): n is a, c, g, or t
  misc_feature (315)..(315): n is a, c, g, or t
  misc_feature (390)..(390): n is a, c, g, or t
ctatcgtttatgcctggataaatgacgaaaaaacgcaacgannggaaggggataaaaacgatccatatgttcttttcgcaaaaggtttggaacgcggccagcctccagattgctttgttgcgttgctccaagcgtctgaagagctagatctgtaataatgggtgaaacaacgttgactagtctctcccgtccacatataagttgtagcgatcgccacgcaaaaaaccgattagagtcattttgcattctcttgccaggtcgatagccagactagagggtgctcctactgcggctatnactcttataccggnctgncaagccttttgtacgagcttaaaacttgctcgaccactcaccaataaaacatgcttcgttgagtggtctttgcan

SEQ ID NO: 577248 - DNA, 129 bp, Homo sapiens
aaaatcatcagtcggtccgcgcagctcgtgcggcagaggctgggcgcacagttgcatcatgatgatgcggtgtgccagtattcgtcccccgcttctgcgccgacaccccttccttttcttcatccagca

SEQ ID NO: 577249 - DNA, 1806 bp, Homo sapiens
  misc_feature (282)..(282): n is a, c, g, or t
  misc_feature (1432)..(1432): n is a, c, g, or t
ggctgcatacctacacatcacgcacactctgaaggcatgcgaagcttactgcgtacctgactgctaacccacggctgacactagtgctgagcattattacgacactgcactgcattggtactcacactgcactactagattagctgcaccaacactgtcgagacgctcacgaggctaaggcattcattcgcagctagagcactgcgcgcgcatatcgcactacgcgtcacgactagtcactctcacgtcgcactcacgagttactacgtcactgcctgtaancagctaagatacacgccgcttagggcacacttatgagtatttacacacgtacgcagcagcgcctaggtggctgtcacatcagccacaccgactcgcgccacacacagagagtcacacacactccatgctcgcaggcactgcgctcgacatcacgcgcaagctgcctacagccctgccacccagcatgcgactgcactcgaatcggcgtactcccttagatcgaggacagcttctcatttatttacactacggccattctctccacggcccacttaccgtgcgcaacaccgacttccacactatcacgtacttcaaccctaggcctctcccaccgcacgcctaaccccaacaaccgctccccacctggcacctcacaccaccgaccacgcggccaccaccaccacacgtctgctgccgcacccacacaccgaccaccccacacaccccactctttccacccaaacctgggcttaccccaccacgcggcccaatttatatccggctggacacacaggcgacatcacttcacgcgcacacacgcctcccacactccccacacgtcaacgcttctccaacacgacggcgatattccacgcccttcccccaagcaaggcaacttcggaacctcccccttatcgacattcctctggacactctggcgggtctcccccaaaccacacattcctactcacggcgcgcacatcggcgggcactcacagacaccctcaacaacggacaaatcttccaacactaccctcacgttctggcgccactcaggcgtcatctccccggcaacctgccgttcgcaaccctcgcacaagcgccgcaccacccctttctcaacacccaccacaaccgccgacacggctgtcacccccaggatgcgcaaaccccgcagcgcatctggctccacccccacacgtcaaacccgcgcgacgcacaacgcgcgcaccccacgcacacccaacggccaaacgttaacacgaggaccggtcctccattggagcaaagcgaaacagattctcatgacgagggcgccacacccacagcccgagagcgcataacacatcacgttggcgtcacacccacgcgactgcagcacacaacacacaaacacacgactcttcggcacacactcctacccacccantctctccacgcgcacagatctctcagggaaccaaaccattcaagccccacacacctcccgaccaaccactctactctacgagcgctacatccacatcttccacaaagccacgcacccattatctaaactagtcactctctaacctacgataacaagatctcacctatcaattcattacacaccactacaaacaacaacaaccaaattatacaagacccacgaacacaactctctcaccactacactcaaccaactacccttcgcgctcaacacaccaccacaacctatatttacgctgcacctcactcacctggtacaatcaatacaccacaccatctatatactcaccctcctatgcaacatactcatatacc

SEQ ID NO: 577250 - DNA, 782 bp, Homo sapiens
  misc_feature (18)..(18): n is a, c, g, or t
  misc_feature (63)..(63): n is a, c, g, or t
  misc_feature (85)..(85): n is a, c, g, or t
  misc_feature (90)..(90): n is a, c, g, or t
  misc_feature (113)..(113): n is a, c, g, or t
  misc_feature (116)..(116): n is a, c, g, or t
  misc_feature (124)..(124): n is a, c, g, or t
  misc_feature (131)..(131): n is a, c, g, or t
  misc_feature (148)..(148): n is a, c, g, or t
  misc_feature (167)..(169): n is a, c, g, or t
  misc_feature (174)..(175): n is a, c, g, or t
  misc_feature (192)..(192): n is a, c, g, or t
  misc_feature (214)..(214): n is a, c, g, or t
  misc_feature (704)..(704): n is a, c, g, or t
  misc_feature (758)..(758): n is a, c, g, or t
ttggggaatttctttgtnctagggtgccccattcttatgcctttccggcccttttggaacccntttcctgcgtcctttgcctggntggcntccttgagcattggcgggacttntgntgcaggtntggcacntgatacagcaccttgtnggagggtggagtctgtgtnnngaggnnggtacactggggtcatngctggtgagactagtgtttttnttgtttttttttttgagtccttggggaacagggccgaaggaagtgagaatccactggggttgggacaggggtggctggagagtcctttagggccacctggggcggtggtggaagagtccactgggtctgggctggaggagaggaaacctagggaggacacctaggtacactcaccgcttgggcccagccagcataaggtccccacaggctccggaaaaagtttcccagttccttgttggtctgggggctcggtcccttcgcctgggacgtggtagggtgccagctgtagtcacgttgggcaatgtgccacatatggacatccacgggcacagcctgggggcttgtctagggccatcaggcagatgcagtcagccaccttggtgcccactccaggcaggatgcagagggccttgtgggcctcctcatatgaggactctcgtagctgctgcagccaggctagcccgccctgttcttccaggatggctcgggnactggcactcacgtaacgggcacgatagcccaggcccagcttcctgagatgagnctccacctactggccagccagggc

SEQ ID NO: 577251 - DNA, 102 bp, Homo sapiens
tctacacggatcccaatctcgatgctcccagccttctatctgacgccccagtctagcaggatgcatttagagcggtcgtcggccaagctccccgagaactag

SEQ ID NO: 577252 - DNA, 539 bp, Homo sapiens
  misc_feature (326)..(326): n is a, c, g, or t
ctgtgggctcgactcagggtatggtcttgccatgtgagtgtcttcatcgaagatttgcatcccagcctctgagacggagtaccaggtgcaaggtggactctctctggatgttgtagtcaggacagggtatgaccatcttccagctgttttccggcgaagatcaacctctgtctgatcatgaggaatgccttccttatcttgtgatctttgccttgactgttctcaatggtgtcactcggctccacctcgagagtgatggtcttatcagtcagtgtcttcacgccgatctgcatcccacctctgatacggagcaccatgtgcgaggntagactctctctggatgttgtagtcagacagggtgcgcccatcttccagctgctttccggcaaagatcaacctctgctggtcaggaggaatgccttccttgtcctggatctttgctttgacgttctcgatggttgtcctgggatcctcttcagtcgtgctgctctcgtgcgtgcttgtctatgcccgtatttgcatcacgtctctgatgcgaa

SEQ ID NO: 577253 - DNA, 326 bp, Homo sapiens
tgtttacgggaaaaaaagtttattaggggtaacgggataaaatctattcccgatatctgaggttacaaactttagggcccttgaaatatgcaggatccttggatgtaactgggataaaccccattttttgagctctcttaattgcttttgggatttctttctggtttttcccacaaaaacctgtaatgggccttccataaatgcatcccagtaaatggagaaacaaacggggacaaaagctggacattcttataatctacatgctttccacacaagataccttttttaaaagggtctttataaggattttccattgaaatgggcag

SEQ ID NO: 577254 - DNA, 774 bp, Homo sapiens
  misc_feature (165)..(165): n is a, c, g, or t
  misc_feature (385)..(385): n is a, c, g, or t
cccccccccccgggtggtaggcccccccccccgttttttttttagaagaggtcccctgccggtggtttatctccccgggtgcccccccgggccccaagtgtggttggggtttgccccgggccccccccaaagttttttttgggattgggggcttttcccttaaanaatgtctgtttgggggcaattccctctttttttaaggccattggtaggggtgccccttctcccggttgtgggaggaggccgggggctttgcgccttatccccccctttcctcccttctggggacccttttttttttttaaaaccccagggggcgggaagcgcccccttggccccctttgtggttcccgcccaatttttttatgggtaggacccggggccncgccccaaaaggggggtgggttttcccggaatttttttccccgcgccccgcccccccaaacccttttttaaaaaacacccccccccaggttttttgttggggggggccccccccaaggttttgggggtcccggttttttattgggcccccggggtttttgggccccaggccccttttttcccctttttaaaaaaccccgggggcccccccggccgccccgtttttgggacccggggggggggggggaccccccttttttttttcccaaaggggggcccccttttttggggggggtttgggggggggggttttccccttttttttttggggccttttttgggggtttttttcccttgcccccccccggttttttaaaaaaagggggggga

SEQ ID NO: 577255 - DNA, 610 bp, Homo sapiens
actcatatgtgtttagtagagatatttctaattgctgggcctcccaaactagaaacagttatacaaaaggtagtacaccgagttgtatgaattcttgtagatgctaaagttctggttgcctgggattcctggtcatcatgcatctctcatgcccgctccttctcaagccgtgcacgtaaatagcactacgaactctggaggcaatatgaggttagcattgtgtgaacgtcttggcgtctgtggatcttgatgcagacaaaaaaggaaaggaagacctccagacgaatagctttccagttcttcttacccagggcttagaaagtaacgattttgaaatgctaaataaagtacttcaaactaggaatgtaaaccttataaagaagactgtattaaggatgcccctgcatactattattccgttgttacaagagcttacaaagaggttacaaggacatcctaatagtgctgtgctaatggttcagtggctaaaatgtgtgttaacagttcatgcatcatacctgtccacgttgcctgacctggtaccccagctggggacactctaccagttaatggaaagcagagtcaaaacttttcagaaactttcacacct

SEQ ID NO: 577256 - DNA, 192 bp, Homo sapiens
  misc_feature (32)..(32): n is a, c, g, or t
cgcttatgaggcacagagcttcaatgtctccncgaaagggctgactgctggtggtcagcaaacacacacacacacacacacacacacacacacacacacacgagtccatcacttttaagtgtgaaccagggtgcagttacattatcacctaaaagcacaccatccatgcctgcaagagacctcgttaagctt

SEQ ID NO: 577257 - DNA, 168 bp, Homo sapiens
ccttggcatgtgcagttgggggtccctggttcttgctctgccagcaggagttaaggcagtgggctggataggggtccgtggtgcacgggcatcagccagtgcagttcagccagcgacggcaacgccgaaacttaaaccgattaccgccccgagtaatgcaggacggct

SEQ ID NO: 577258 - DNA, 238 bp, Homo sapiens
  misc_feature (85)..(85): n is a, c, g, or t
  misc_feature (149)..(149): n is a, c, g, or t
  misc_feature (232)..(232): n is a, c, g, or t
tgaaaaactttcccacgggtcctaaaaattgcctcccattttataaatttgaggtgttgccatgggaattcctaaggctgacccnccatgatgtaaaagttccacaatatggttccaaatgtaacagtgccagaaattgaatatggagnccatgccataaccttccccttagaaaaatggcaggtgttgtaatttccaaatttttgtgccaattagattaaatcataatgcnacagtc

SEQ ID NO: 577259 - DNA, 279 bp, Homo sapiens
agctcacaaagatattgcattatttgactaatgctaatattcctgcctaatctgtattaaaatatttgactgtaaaatattttggccaggtgtagtggctcacaccatgataatcccaacactttgggagaccaaggcaggaggatcgcttgagcccaggagttggagaccagactgaccaacatgatgagacctcgtctcgtcagaaaacaaaaatggaaaatttttcaataaacaggccgccgcatggtggctcacacgctgtaatcccagcacttt

SEQ ID NO: 577260 - DNA, 374 bp, Homo sapiens
cttatttccggtgtccttagccttcatcactcattatctgtaatcactccctaggtgacaccatctagtgtcattcattagtttatataccatttaaaagctggtagctctaaaacccatgtccccatcctatactactcccctgaactcaaaatctatatatctgtttatttgatatccccacttgagtgcctaataagtcccattaattcatcatgttccaaactgaattcagatttttctaccccacccctatctcccttcactgactctctttttggactcagcccgcctgcacccaagtgaaataaacagccatgttgctcacacaaagcctgtttggtggtctcttcataaggacaccggaaatcagg

SEQ ID NO: 577261 - DNA, 455 bp, Homo sapiens
  misc_feature (19)..(19): n is a, c, g, or t
  misc_feature (39)..(39): n is a, c, g, or t
  misc_feature (93)..(93): n is a, c, g, or t
  misc_feature (170)..(170): n is a, c, g, or t
  misc_feature (187)..(187): n is a, c, g, or t
  misc_feature (434)..(434): n is a, c, g, or t
caaggggcattgaaaaaancttgaaaaaattctgatttnagagaaaaggagaaacccttttttagtggcttaaaggattccaattgtcaattnttaccagatggggtaaaacttccttgccccctgggggaccccccttcttctgggggaagactgggaagaggcaaaanctttcagccttctaaangaagggtagctcagccaggcacaagtgtctcacgcctgtaatcccagcactttgggaggccaaggcaggcagatcatgaggtcaggagttccagaccagcctgaccaacatggtacaaccccatctctactaaaaatacaaaaattagccggacatggtggtgggagcctgttgtcccagctacttgggaggctgaggcaggagaatcgcttgaccttgggaggtggaggttgcagtgagccgagantcgtgctattgcactccagcc

SEQ ID NO: 577262 - DNA, 385 bp, Homo sapiens
  misc_feature (309)..(309): n is a, c, g, or t
tcggtgtgacgtaatggccaactttccactttctactaccgagcctatgactcgaccctgtcgctgtgcctggcggccgaggcctgctggcaggaagaacgggcccagtgggacaagcacttcattcaaacccagcattggacccatcaacatcgcggcttcagcgccggcgaagcgctcaagcaaaatctactgagcatgagtaacgcctacgtcacccacaacgaacgtttgctggagatcactaaaaccgtgtcgctgcgccatctgcacagccaagacccgatggccacgcgcgacatgccctgngccgcgcttaaagccgacctggtaaaaaccggcaccttgacctttgaactgaccctcaagctgtttgacgacgact

SEQ ID NO: 577263 - DNA, 775 bp, Homo sapiens
cacagtgcacatctgtaatcccagcactttgggaggcagaggtgggtggatcacctgaggtcaggagttcgagatcagtatggccaacatggggaaaccccgtctctattcaaaatacaaaacttagcggggcgtggtggcgggtgcctgtaatcccagctactgaggaggctaaggcagaagaaccatttgaatcagagaggcggaggttgcagtgagccgagattgtgccaccgcactccagcctgggtgagagagtaagattctgtctcaaaaaaagaaattgtcacagtgggtttttaacaaaaatagagccaactatatgctatctattttacaaaactccacgtttacaaagacagacacaggttagaagtcacggtatgggaaaaacataccatgccaacactaatcaaaagaacagctagcagtagctatgtcaattaccgacaaagcagttttcaacaatacggaaaccattaaaaaccacttcagaaccaaagattaagagttgcagttacaccaaaatatgtgaaagcaaaaatttgaactccaaagagtaacagacaaatccactattattactgggagacctcacacctcttactaggtagcctgacacaccccagcaagttagaaatccaataacatagtcgagcttgaacaggcatcaacatcaacattggatctgacattattagtatatttccatccaacaacagcacaataacatactcttttcaaattcacaaggaaccattcccaagtaagacag

SEQ ID NO: 577264 - DNA, 404 bp, Homo sapiens
tgtaaccatcggtatactcgcatcaggagtatcaatcacgctgagctcaccatagtctaatagaaaacaaccgaaaccaaatatttcaggcacggcatataacaatttaacggggtctctattttaccctcctacaagcctcagagtacttcgagtctcccttcaccatttccgagggcttctacggctcaacatttttggtagccacgggctcccagggactccacgtcatatatgggctcaacttccctcactatcggctccatcggccacctaatattccactttacatccaaacatcacttgggcttcgaagccgccgccggatacgggcttttggtagatgtggttggacttccggtatggttgcaaaaaaaaaaacaaaaggggggcccccctagagt

SEQ ID NO: 577265 - DNA, 183 bp, Homo sapiens
accgctctagcgcgcgtaggcttatgcctactcgtaatgctgataggcacgcccataggacgtctgctcattcaacgtacaaccagagtgcctatcacgggcgagatgctaatcggcgttcattgcagtgtccaacgcacctggacgtgctctattggcttgactcctattctgctgctcact

SEQ ID NO: 577266 - DNA, 363 bp, Homo sapiens
agggttgtaccccacaaaacgaagaaggaagcaggaacacaaagcccaggcaggtttggcggcaagttcttgctctgcccccatctacagcgtgggggattgccaggcgaggcaggcaccccttcaccaagcccagggctcatttgataggggttcagacctgcagaggctctccaggggcctgaagaagttcttgccaggtctccacccaaccctcgctttgcctaaaaaggaccccacttgtcgccggccttggctctgccttgcacttggaaattgggctcttgccagtttctgccatggtttaagttttggtttaggacctttgtcctggaaaattgtcgggagtcgccctttgtcgtc

SEQ ID NO: 577267 - DNA, 1192 bp, Homo sapiens
  misc_feature (984)..(984): n is a, c, g, or t
  misc_feature (1151)..(1151): n is a, c, g, or t
ccaacattgggcggggctggcgcgtgccggtggaagcgtgatgaaggcctacgagtgcggcgcggcctgaaggggcacgcgggggacctgcaaatgctagtgaggtggcggggcaggcggcgcggtgggggctgggcctgagccctggaggccacgatgagctggacacatgcacccactgcgctggtggccaatgcatggtgtgcctatgaactggtaatgtgccctgcaaatgaggctggtgacagacttgcgtgctaagtgaacttcctcgaagttacgtgaacctggagtccctcctccgtttccagtgctgttgtgctgaagtgcctgcaacctggccttctccaggggctgtgcttcagttgaagctccaagggagagctgacgaacatggacatattcaaggccctgagaagccaagttacttcagtgacctagtgaacttccgtccaaccattcgatatgcttttgctcgtcagggtggccatgtagcgtttccatgtgcaagtgtgctatcatgcgctccatctgtggggccccacaactgtgacaagcccccgtgcccgtcctggggttgacaagcggtctggatcgtctggccgccagacacaggtgtgtgagctttaccaggtcaaggttcgcgtggtgagacgacgcctattgagtgcgtcgcggcatacgtgtgaggcgaccctagagttcttgcacccgttgcacgcttggagctacttggctctgtgacgcgctgttcatcttgctcgaaggttgaccacatacgcgttcaggtgttcgtggcttgtgacggccatggctaggcttcgtgtagcgaccgctcgcgcaggcggggccgcacttatcgtttcgcaattcaccgaagaaccatatgtgcactagtcactagtcgttgacaagctgcgacagttattccaactcgacagacacctattggggtggaccctaaagctatcatggaaggatgtnggcgattccgtcaggatcgcacacgagttgcgttatggaccagccaagcgcagtcgcaagggcacgggacagcgtgggcacagaaagcgtagggacgtccgcttagtaagctccagcgggagccatccttcaacactggccctagtcggcagtagcatctgtgcgcnaccacatctcgcgcggacgcgtccagtggtttcgccattgc

SEQ ID NO: 577268 - DNA, 261 bp, Homo sapiens
  misc_feature (8)..(8): n is a, c, g, or t
tgctcggnacccctttagttgcacccatatttgggcattcccgtcaatttgtaaaactgaatatgggttatccaatctactttaattcacaacgtagtgtgaatgagctaggtattcaatatcacgatattcgtgaaagtgtatgtgaacatttccagcaattgcttgatgatgggattgtgaaaaaatatatttaacaataaaaagcctattcaaccacatcggtttgaataggcttttttcttatactttcaagtatta

SEQ ID NO: 577269 - DNA, 164 bp, Homo sapiens
ctgtccgtgggacgaccaaaactgacttggaactggacaaacgacgacaaacttacttttctgaacgacctggacttaaacttgacgccacctgtacttgttgttggactacgctgacgactactactttacttacaccttacccactatactcgacatgtcac

SEQ ID NO: 577270 - DNA, 409 bp, Homo sapiens
tctagaggatctcgaacagcttaatagtggtataggccttatatttaacttttgtttattttttgtttgagaacaaagccacactcggtctccttggctggagtgtggtggcacagtctcagctcacgtgcaaccatctgcctcccagttcaagcaattcttctgcctcagcctcccaagtagctgggattacaggcacccgccaccacgcccagctaattttggtatttttgtagagatggggttcacgatgttggccaggctggtctcaaacttctgacctcaagtgatctgcccaccttggcctcccaaaggtgctgggattacaggtgtgtaagccacgtgcgcccggtcctttttaacctttacaacattgtttttagaatttccaccttaaaggtatcaaaat

SEQ ID NO: 577271 - DNA, 252 bp, Homo sapiens
ggtcgactctcgatctcctgacctcatgatccaccagcctcggcctcccaaagtgctgggattacaggcgtgacactagtgcctggcctaaacattgtcttcttttccccggtcccccagcccttggaaacctctattctattttctgtctctatgaatttgcctattctgggtaccttttctttttcctttggtgtctggcttattttacttggtataatgttttcaaggtcccttcatattgtagcctgt

SEQ ID NO: 577272 - DNA, 124 bp, Homo sapiens
ttatctgtccacaacccaatgcatttgtacataatcttcttcatagtaatatccatcataatcggaggcttaggacactgactcagtcccctaataatcggatgcccccgcatatggcgttacc

SEQ ID NO: 577273 - DNA, 798 bp, Homo sapiens
  misc_feature (28)..(30): n is a, c, g, or t
  misc_feature (208)..(208): n is a, c, g, or t
acgcacgccccgagacaatggactggannnaagaggaatgtgtgaatgttgtctgacagatgaagtgaggagtccggctccttcacagggaagtgaaggcgcaggggctcccctgctacagaacatgtactgaatgcttcccgatgccaggccctttgctgagagtctcacatgcatcatcttcctggcagtcctggagacgggtggnactggtctctccattttacgtgtgaggaaatgggttcagtgacaacaccaggccaccctagtaagtggtgcctccagaacttgaactgaagttcaagttgtctgactccagcacttgtgctcttaagctctgtgcagtagggatggaggaagtcctccctggggaagtgaggcagctcctcagctgctctgtggctctgttaggggacccgagccgtctggcagatgaatgcagatttaagccctcaacttcccccgttcacttgccaagtgtaagcgggcggtacctctcacatgcacagttcaccgtatctgtgctcacctactatgggtcaggcttgctgttatgtgctgttaacacaaaggaaacccattgtccagcctttgagaattttgtaatgtggttgttttcatctgcaacagtgcctttaatttctcttgctttctctctcacaacctcagtcccccaagttctccagccccttgccactacactagtcttatgaacattggggccatggaagcagaagtgtgattcgtcattgaatcttgtttagaacctattcattgcttgaattccttcacggggca

SEQ ID NO: 577274 - DNA, 386 bp, Homo sapiens
cttcggcaacttcgcggcccgcgacggcagcctgtggaggtaccgcgccggcctggccgcctcactcgcgggcccgcactccatggtgggccgggccgtggtcttccacgctggcgaggacgacctgcgccgcggaggcaaccaggccagcgtggataacgggaacgcggtccggcggctggcctgctgcgtggcgggcgagtgcgggcccgggctctgggagcaccaggcgcgggagcactaaaagcgcaagaagcggtggcgcgagagcgagtgcaaggccgcctgagcgcggcctgtacccggcggcggccagggacctgctaggcccctctctgccttagagcttctgctctgctccaacagacaccttacactctgaggtc

SEQ ID NO: 577275 - DNA, 842 bp, Homo sapiens
gggaggcaaaatctgtcatcaaatggagtattattggggcgacttcaattggccacgggacaagtttctaaaggaacagataaaactgatgaaggctggtacctttgagataatgataaaattcaacaggttgaaccgtctaacaacagatttaatgtaatggtggaagcattgagcaaatccaggcagaactcatggaaatcagtgaagataaaattaaaatcagaaggtctccaagcaaacccctacctgaagttgactgatgagtataaaattgatgtaaaaaacagatctgtttatattaaaggcttcccaattgatgcaatcttgatgacataaaagaatggttagaagataaaggtcacagtactaaatattcagatgagaagaacatggcataaagcatttaagggatcaatttggtgggtgtggatagcatgtgaatctgctaagaaattgtgtagagacccctggcagaagtacaaagaaacagacctgtaaatactttcaaggaccgattacttgtgcaaaaaaaatgagaaagaaaacacaataaggtggaagctaaataaggagctaaacaggagcaagaagcaaaaccaaagttagaagaagatgctgaaatgaatctctagagaaaagatgcgtgcgtgcgcactccgggggtagatgacagactggagaagtttcacatacttctccaacccgggcccaacgggcagcccgcagagggccaaggggaccctttagaaagccgacctggaacccagctactggccccaccgccacagcccgcgcccaacgcgcgcccgcgaacaccccaccacagcgcgccccgggag

SEQ ID NO: 577276 - DNA, 222 bp, Homo sapiens
cacgagggctcagaccccatgtgacataactggggccagtgcactgccatgaagaactacgagattaacctgtatattaacttgtcttctatagaaaatatttcatgttccattcttctgcaatggttaattcacacagaagaccaatgtttatcactcacagaggattttaccgcttaacagccatcttgccccaattatgaatttgttctcagttctcag

SEQ ID NO: 577277 - DNA, 245 bp, Homo sapiens
gaccaagtagaggagtattatatgtggcaggataagggatcggtgtacttgctatatggacaaaatgttaggaagtggaagaaagctggaggcttcgtctggcagctgcgagccgtcacaggagaataggaaggaaggcagtgagtgtgcaaaggagcatggcttattttgaggtcctgaaggccagtgagtgtgcaaaggagcatggcttattttgaggtcctgctgattgcaggccaacaaaa

SEQ ID NO: 577278 - DNA, 365 bp, Homo sapiens
cagatcacacttgctgcacccgagccacaccaggctcttgctactgcccttcctcctacactgctttaagtcttcgtcaaaacttaaaccttcagagtgagacccttcctggccatcctggctacaattccaatcctcctcatccttggaccaaatcaccatcccccaggagccacgcacttcgctgctaatgctggtctcatgtctagaacgttagctaccccagggcaatggttttcatctatgttgttacttctctagtcctagtgtctagaacaatgcctaacacatatctgacagtcagtaacaaacagtgtattgaattaatgactatcagaacagaaactgtattacacatggtccag

SEQ ID NO: 577279 - DNA, 292 bp, Homo sapiens
ccggtacctacaccatagaatgtgtataatctgtattttttaagtagtaaaattaaaatatttttaaaagataaaaaacaggctgggtgtggtggctcatgcctgtaatcccagcactttaggaggccaagccaggtgaatcacttgaggtcaggagtttgagaccagcctgggcaacatggtgaaaccccgtctgtactaaaaaacaacaaattagccgggggtggtggcgggcacctgtagtcccagctactcgggaagctgaggcaggagaatggcataaacctgggag

SEQ ID NO: 577280 - DNA, 271 bp, Homo sapiens
  misc_feature (102)..(102): n is a, c, g, or t
  misc_feature (104)..(104): n is a, c, g, or t
  misc_feature (151)..(151): n is a, c, g, or t
  misc_feature (157)..(157): n is a, c, g, or t
  misc_feature (188)..(188): n is a, c, g, or t
  misc_feature (217)..(217): n is a, c, g, or t
  misc_feature (255)..(255): n is a, c, g, or t
tggcaggagcgcggtgcagcgccagctgcagggctacagtgtggagtaccagctgctgaacggcggtgactgcatcggctcaacatccccaaccctgcccangnctcgttggtggtggaagacctcctgcccaaccactcctacgtgttcngcgtgnggcccaagagccaggaaggctgggggccgangatcgtgagggtgtcatcaccatttgaantcccaaggtgcacccgcaagatcccacttgtgtccccntgccaaggctccgcct

SEQ ID NO: 577281 - DNA, 534 bp, Homo sapiens
gatctagaggaccccgcggggattgggtgctgaaacaaagagagcccagttagaagtgcccctgcacgagctgtgtgtgctcgatggtaccagataacgtaggatagggagagtgagcgatgattgatgcaaaaataaaactccagatgagagctggcaaagagcttagccatcttctagaccacgcttctagccagaacaccccctatactgacgaggccttggtgaatatccagagagggtgcatggcccatcctatccacacggagcactcacgccccaccattgtccaccagtgaacagctcagatccctaagaaagagctttctgttgagtaatatctggtactcacaatgcgggcttgaattctttaattccagatctaagatcctgcaaagcttgggaaacttctgagagctgctgcctggcacacctctggataggtgtgtaagcctccagaaatgacatgcagagattcaagacatccagaagacagggatggacacgcaaatcttgactgcacaaaatcccggg

SEQ ID NO: 577282 - DNA, 264 bp, Homo sapiens
  misc_feature (254)..(254): n is a, c, g, or t
aagctgtcctaccacatgtgtaaagaggaaggaatcttacagattacacatgctgtcgtggacgatctccgtgtccagttcattcttttttctggagacggagtctcgctctgtcgcccagggtggaatgcagtggcacgatctcagctcactgcctcctctgtctcccgggttcaagcgattctactgcacgcagcctcctgagtagctgggattacaggcgcccgccaccacgcctgggcaacagagtgagnacctgtcttt

SEQ ID NO: 577283 - DNA, 300 bp, Homo sapiens
  misc_feature (165)..(165): n is a, c, g, or t
  misc_feature (170)..(170): n is a, c, g, or t
  misc_feature (202)..(202): n is a, c, g, or t
  misc_feature (211)..(211): n is a, c, g, or t
  misc_feature (235)..(235): n is a, c, g, or t
  misc_feature (257)..(257): n is a, c, g, or t
  misc_feature (262)..(262): n is a, c, g, or t
  misc_feature (289)..(289): n is a, c, g, or t
gtgggggaggttgttccccttaggaaatttttataaaccctctccagcctctcccaaaggaagggttggcagcaaagggaaatgatgccctttccccccttcctgtgagtgaaaaaaggaagcagccccagggaccaattttcccaattgacctcttttttcctntttcnccatgtgaggcagggagccctgagcccttcanctgcctgcncaacccctgacattgggtggtggngactcaatttgccaaatggggngcagntggttttttcccaattacagcaagacngtcagcctcca

SEQ ID NO: 577284 - DNA, 185 bp, Homo sapiens
ggagccttaacctcgggagccttaacctcgggagccttaacctcggagccttaaacctacggcagaggacatggcaggcccaggagtatgagtttcttctcagtgccatgtgaagccactgaaagagtttaactgagaacaagggacataagtcaggctcctattttacggagggtgggcttctg

SEQ ID NO: 577285 - DNA, 450 bp, Homo sapiens
  misc_feature (98)..(98): n is a, c, g, or t
  misc_feature (397)..(397): n is a, c, g, or t
  misc_feature (415)..(415): n is a, c, g, or t
  misc_feature (428)..(428): n is a, c, g, or t
  misc_feature (441)..(441): n is a, c, g, or t
gatgaggttctcactgttgtccaggctggtctcaaactccttggctgaagtgatcctgtcgtctcggcttccgcaagtgctgggattacaggcgtganagccaccatgcctggcttccattgtctttgtgtgtgtgtgtgtgtgatggggttttgctcttgttgcccaggctggagtgcaatagcgcaatctcagctcactgcaacctctgcctccagagttcaagcaattctccttcctcagcctcccaagtagctgggactacaggcacccaccacctccattgtctttttacttgcccaagttaaaatcctgtggactgtgtactgggatctgggcctggcggttgttcatatttattggatcttgagtccagggcagtgtttttaaagtgatntgagttagtagtggaaanttgaaaagggtantttaacaaccaantacaggttt

SEQ ID NO: 577286 - DNA, 215 bp, Homo sapiens
agataggccattagagagtgggtgactacaaaatcactctcaagctcatggataaccagaataaaaaccaagtgaccaccttagaggtcagcgtgtgtgactgtgcaggggccgccggcgtctgtaggaaggcacagcctgtcgaagcaggattgcaacttcctgccattctggggcttctctggaggactacttgcttagctaattctgatgct

SEQ ID NO: 577287 - DNA, 1003 bp, Homo sapiens
  misc_feature (1003)..(1003): n is a, c, g, or t
gccccgagagcacagagcctcgccatttgccgatccgcacgaccgtccacacccgccgaccagctacaccatggatgatgatatcgccgcgactcgatcagtcgacaacgagatccggcatgtgcaaggccggcgttacgcgggacgacgatgcctccccgggccagtcttcccctccatcgtggggcgccccaggcaccaggacgtgatggtgggcatgggtcagaaggattcctatgtgggacgagaggaccaaagcaagagaggcatcctcaccctgaagtaccccatcgagcacggcatcgtcaccaactgggacgacatggagaaaatctggcaccacaccttctacaatgagctgcgatgtggactcccgaggagcaccccgagctgactgaaccgaggacccccctgaaccccaaggacaaccgcgagaagatgacccagatacatgttatgagaccttcaagactcccagacatgtaacagtagctatccaggctgagctatccctgtacgcctctggacggaccacatggcatcgtagataggactccggtagacgagggtcacccaaaatagtgacccaatctaacgacgggtattgacatacccgcacatgcaatcctagcgtctaggaacctgactggaccgagacctgacttgactacctcattgaagatactacaccgaggcgcgggtacagattccaccacccagggccgagccgggcaactcgtggcgtgaacatttaagggagaagcctgtgactacgatgcccatggacttcgacgacacagaaatggcaagaggatgcttccagatccatacctgaaaagaggcatagaagcttgccatgacggccagggcacacaaccaatgacaatgagcggaatccagatgccgggaggacacttcccagactatacatacaggagcatggagatcactgtgacatcaacgaagctaccttcaatccatcttgcagtgtagccgtgcacan

SEQ ID NO: 577288 - DNA, 230 bp, Homo sapiens
ctcgtgccgctcaggccgcggcccagaccaactccaacgcggcaggcaaacagctgcgcaaggagtccagaagaccgcaggacccctttgccccccaagcgttggggttggttacaaggaaaggggggaggaagccgcccttggcgttttaggaaagagggattagaacggggttggaggaggccctcttcaccaccttaagggtggggggaaattatttattagaggcc

SEQ ID NO: 577289 - DNA, 246 bp, Homo sapiens
gatggatctggtgaagaatcatctgatgtatgctgtgagagaggaggtggagattcctgaaggagcagattccgagaatctggttggagaaggacctcccagcttagagcgttaagaacacccttgtttgaggacccttggcaagcccagagcaagcttggagaggttccagtccgtgtctgagcccgtgaggagccagcttcccgattccacacacgtgcccgaggcccctggtggtctctgcgg

SEQ ID NO: 577290 - DNA, 353 bp, Homo sapiens
acgatgcctgcagctggactctctcctgtctctaggcaggatgagacgaacaggtcttggaggagctgggttttcttggtgctctagcctgtctccacctggacagcagaccactggttcgagattactcgcaggttgtctgggcactgtggaatctgcagagcgcggtgcatgtcaagtgcgccagggatgaaccctcctatctcatctacacacccgcagtgcccaagtcccagcgtgtgactgcacagtgctcccaacttccaaccgccatccaactgtggcatagtcaggggcccagacgccacagggcggctgctccagccgagtcgtccggggccccagcggcgtct

SEQ ID NO: 577291 - DNA, 786 bp, Homo sapiens
  misc_feature (241)..(241): n is a, c, g, or t
  misc_feature (276)..(276): n is a, c, g, or t
gagactgaggcaggggaattgcttgaaccagggaggtggaggttgcagtgagctgagatggcaccactgcactccagcttggggacagagcaagaatccatctcaaaaaaaaaaaaaagttgcttcctgcttgcctatcagagtaattcagtccaaaagtcattacgtggggctgagcaaggcaggcatctggggaaggtgggggcgagagaaaggctggcaaggtagtagcccagcaggngatactggagcccaaatgcagtgagggcctctggnggtagggacttgtgcacagcagcagcctagcaggggatgaggagggcatcctattagggtgaaggaaatggtggcacaggtttttggaatgggaacaaaaggtgagccttacccaggagggaggaaatggtgcagtgtaagttgcttgagcccaagaagggtaggttgggggaaagggggaagagaagaccatgcatgtgggatggtggcagtggcactctggcattaggtggcagagctcagagagtagagtgtgtgcgccgaatggtgacagcaagaggattttgattacatagtgagagaaggggtgatgattataaaaagtaaatttattaaggacaagtgggaaccagacttctcactgttcagcaagagtattaaacccatgtaaagaggggaaatgaaaataaaccctgtagtattggaattgaatgttaggtagcagattatatggagattaatataaaagtcatacacacatacaacaactaaatccgtatgtatatacac

SEQ ID NO: 577292 - DNA, 936 bp, Homo sapiens
ccaccgtgattctgaggcctccccagccatgtggaactgtaagtccaattaaacctctttttctttccagtctcgggtatgtctttatcagcagcgtgaaaacggactaatatactaaataggtagcagtagagtggagcactgctgaaaagacacccgaaaatgtggaagcgactttggaagtgggtaacaggcagagggttggaacagtttggagggctcagaagaagacaggaaaatgtgggaaagttggaacttcctagaaccttattgaatggctttgccaaaatgctgataacaatatgaacagtaaggtccaggctgaggtggtctcagatggagatgaggaacttgctgggaactggagcaaaggtgactcttgttatgcttgaggcaaaagagactggtgacatttgcccccgcgcccagagattgtggaatttgaacgttgacagtcatgatttagggtatctggtggaagagatttctaagcagaaaggagcgcaagaggtgacttggatactataaaaggcattcagtttataagggaaaagataaaagttcagaaaatggcaggccgatgatgcagtcgagaagaaaaaccatttttgaggaaaattcacgccagtgcgaaaattgcagaagtagcagaagctaatgtaatcccagaacatagggaaatatctgcggcagtcagagaccttcaagaggcccccccatcacagcagacgccagagaacaaggtcacgggcaggcgggccatgcgggtgacagaactgggctgatcacgccccgctgtgaaggcaggaaacggggggctcagtgaccagcggcaacaggacccagcgaaagaaatggggaccccacaggacgacggcagatgacaccacaactgcgagctgacccgcgacaacacagggtacgcgactggcgacc

SEQ ID NO: 577293 - DNA, 416 bp, Homo sapiens
agagttgagagacatactttttccacccagaatccttgaagagtgaatgaatataccacatggaccgcattagcccagcacatgagcaggtgtactatattccttaggtcaacagcaagttcaaatgtaagtcttcaccacaaaggccatggaatgagccctttgtacggacaaagatgatgagagtctaattaagtcaagcactcgctgctgggcaatggacctgtggcgacagatcccactgtcaacacagtacgtgataccctgttaaccctggtttgtgagagctccccttcaccaataaccatggcccttactgaaggatctggagccctcataaaggaatccattctggtataagaaggatctgcatatagtgaccctcagtctatagtgaacagtgatttgtgtcgccc

SEQ ID NO: 577294 - DNA, 483 bp, Homo sapiens
ggccgggcgcggtggctcacgcctgtaatcccagctctcagggaggctaagaggcgggaggatagcttgagcccaggagttcgagacctgcctgggcaatatagcgagaccccgttctccagaaaaaggaaaaaaaaaaaaacaaaggacaaaaaaaaaaaaaaaaaaaaaaaaaaacttgtgtgggggcgcgcgccggggcccgggaaaaggttttaaaacccttcgcggtgggggcgcgcgggggccccctgttgggtgcagtggaacctggggccaaaagcggtggtcccagagggagaacccggggccagagaacaagggggggggtttccccccatttaaaaaagccccgggggggagaaccccgagaggtgtgtctgggaacaaattcccagaggggaggtgtccgggagggccatacgggggatttttaacaaaggggggtgcccaagggagggcccagattccaattaacccagg

SEQ ID NO: 577295 - DNA, 176 bp, Homo sapiens
aggcattgttctggaactctggggaatggtgtaactcaacaatgtccccatcctatgaagggctacgcttttgccccaatgcccaatcaatgcggtcttggaatcttggctggtcggggacctcaacttgacttaccttcaatgaaagatccacaactgagcgtgctactcctttg

SEQ ID NO: 577296 - DNA, 542 bp, Homo sapiens
gggggtcaggtacattggcgggtgctgtggatttgagccctaccacatcagggcaatgcagaggagctggccccaggaaaggggctttattgccaccagcttcagaaaaacatggcagcgtggggaagatggtttggacatgcgcaccaaaccctgggttagagcaagggccaggaaggaatactgggcagtaatcttcggatagcctcatgccggacgatacaaaaccttcaatgtcgaaagccagatggctggtgagtgaccaaaggaacagccgagctgatgcaggagaaagaagccacaagtgagacagctgctgatagagctcttggataaaacaaaaattcaagctcacagtatgcctctgatagaaggtatttatgatgaattgcataggtgttcggggtcacagttcctaacaaattactggatgaagggggttaaaatatgcagtgtcttacagtgaagtgccgatcgtacactagtatgattgctagttaccttgagactaaaattagaattataaattagggacgttgata

SEQ ID NO: 577297 - DNA, 899 bp, Homo sapiens
cccccaccggggcccaagaatgccccccacaccgggggcggcggtcccccgaggcccccgctgcatgtaccactccttccggggcaaccactcggccgtggcccaacaaattctcggggagaaatgcgcccccggaaagccgccggaaccgcccactgatgtgcctcgtcccatgataacaaggtatcaaaacaggtcgtgtcacaccaccgaagtggctctctaacacgcaccacgcatcgcggcgcacaaagcgaaggcccacacacacgatgcctctctccttcagagaacacaattgggggacacccacgtttttcgtcgcacatatcacccaaacaataacttgtcccaacttttgacccaccaacctgggtcctccccccacttagactccccctcatcgaaaaagaagtgcagtgccgacacactagccaattgcttgtcccacccacaaacactgtctggtctcagtgtgacacccaccactctgagcgtgccgccaaccaacagaccacttttttgtgtctctgccagtccatggccagagcccccccacttcttttccgctcttttgctccctcactgtccccgcgcgtcttttccccgcagagtggcgggtctacactgcgcccatgttagttttcccccccacgaagatgatatctcaagtatgctggctcgttcccacccccccgcgtggtgccgctctcctctcccctcactgggtagagagcaccactaagtacccttttgttcccccccccaacacgcgctggtgaccccacattccctcgctattccggtgggtgtcccccctactaccagaaggaagacttaaagagtgcgttgttcaccaccccccaccttctttttatgaacagacccacaaagacaaa

SEQ ID NO: 577298 - DNA, 143 bp, Homo sapiens
cgactgcaatctgtgctcccaagatagttggaacttcagtgcacaccaccatgctcagctaattcttgtattttttgtagagatggggtttcgccatgttgcccaggctgatctccaactcctgcgctcaggtgactctcctg

SEQ ID NO: 577299 - DNA, 101 bp, Homo sapiens
gaaggcctgtgggccgttgaggtagaggggaaggaaatctcctctttggtacccaactacttagtgtcgtatagtcggctgcgcaagtacaaacactaccg

SEQ ID NO: 577300 - DNA, 495 bp, Homo sapiens
  misc_feature (1)..(1): n is a, c, g, or t
  misc_feature (12)..(12): n is a, c, g, or t
ntctagaggatncccacagaaggcctaagcacaagagctaaaactgtaaaactcttagcaggaaacaggggaaaaacttcgaggcactggatttggcaattatttattggatatgacctcaagtgcacagaaaacaacaataacaagataaagaagttggacttcatcaaaattaaaaacttttgtgtatcaaaggagactatcaacagagtagaaaggcaacaccacagaatgggataaaatatttccaaatcctatatccactaagggcttaatatccagaataaagaattcctacaactcaataaaaacaaagaaacattaaaaatgggcaaagagcttgaataaacatttccccaaaaagatacacaaatgatcaataagctcatgaaaaaaaagctcaacatcactaacccttaagaaaatgaaaatcaaaaggacagtaagataccacttcacacccataagaatggctatgattaaaaagaagacaaa

SEQ ID NO: 577301 - DNA, 81 bp, Homo sapiens
aaatcttgcaaaactgaaactctgttcattaaacaataactctctattcttccccttctgtcgtcttctaacagccgtata

SEQ ID NO: 577302 - DNA, 320 bp, Homo sapiens
aagggggagcagtatgctttacacagcgtatggttcatttcatccagaaacattctcacagacacacagaataacatttaaacagatatctgtgcaccccatggaccagtcaagttaacacataaaattaacagttacaacaatcttggagccagtcattcagcccaccacatcattctctcatggccctctgtttcttttcttgtagtatttataatttgatatttgagttgtatgcctactggactgtcagcctggatgacaagcaagaccttgtctctacctaaataatcaacccagtactttcttacccttaggca

SEQ ID NO: 577303 - DNA, 779 bp, Homo sapiens
ctattgtccccttagcgcctattttatggtgccgcctatttgcacacggcgttgtggcccacagaagcacaggggccttggtttacccgcgtcccggaatttccccgggattatctggctgggcccaccgcggttctcccgaagcaagttgtgttctctggccggtcccccttatggcccggctgggccgtccccagtgcatgccttccatcatccttgaggacccttctcgggccccggggcgagcgctcccctgttggtcccgccttcttcgaaggtgtcaaattcccccgaggccccttctcatatgcgacgccgcgatatgttctctaaagacgatccctgaggtctaccccccttggcccaggagattgttttgcccagacacccaggtcgcacgcgagacccacgaccaccctgccgcatggttgtgaacgagagcgtgctattgagatcggtcctcaccggggccatagtggccaggctcttcttccctcggcgcactttgcccaagcccgcccgttggcaggtcgaccttctgggagacccgagttcttttattgtgatatcgacactttggccctgcggtggttgcgctggagaggattcccactcgtgcagacacgcgtccccgctcggtttttggtgcaaacaattctatcttttcctggcacaaccaactcctcggtaaagatctttttccaatagaacccccgtccttgttaaacagaatcatggtccaaaatcattatttgttttcacggaaaggaaaaaattca

SEQ ID NO: 577304 - DNA, 900 bp, Homo sapiens
  misc_feature (316)..(316): n is a, c, g, or t
  misc_feature (497)..(497): n is a, c, g, or t
  misc_feature (502)..(502): n is a, c, g, or t
  misc_feature (505)..(506): n is a, c, g, or t
  misc_feature (512)..(513): n is a, c, g, or t
  misc_feature (521)..(521): n is a, c, g, or t
  misc_feature (523)..(524): n is a, c, g, or t
  misc_feature (526)..(526): n is a, c, g, or t
  misc_feature (528)..(528): n is a, c, g, or t
  misc_feature (541)..(541): n is a, c, g, or t
  misc_feature (558)..(558): n is a, c, g, or t
  misc_feature (568)..(568): n is a, c, g, or t
actgctgcggtggcaggcgtgctggacggcagtggagagccgccaggctctatcacggggctggtgtactccagcaacttccagaacgtgaagcagctgtacgcgctggtgtgcgaaacgcagcgctactccgacgtgactggatgccagtgatctccagctgccgtgcctcctcagtgctgaagaagctgacagacgcacctggccaaggtgtattggtgcggggcggggaagtgaaccccgactggtcagtggctttgtcatctggtttcagccccgatgctgtgcactgtggggactggagcaagtcgctcanctgaaatgagtatgagcagaccttccctgggttacgaattgagatgggatgaaaatgctttaacttcgagtgttttgaaggattaaataaccgaagtacaaagtagtagtagcggagacagtaaggaagtcgggcgtggcggcgcgcacctgtggtcccagctactcggaaggctgaggcnggagnatnncttgannccaggagncnnangntgcagtgagctgngattgcgcactgcactncagcctgggngaccagatctacgaacccccatttctaaacacaaaacacaaaaacccaacaccagaccgcaggaaacagggtacatgtggcaagaagctgggctgccagcgcgtctactgcgtgcaccatctgctggaaacacggcgctaaggctgggaaccgaagcacgccaagggatccgcctacatgatagatgtagtcaacatccttgcatgtggaccctgacgatacgggatacccacacctcaactctgaaacccgacttcgtcagagtgcaactctttacgccatccaaaagagccgggagtcacatccgcataaggccacacgcctaacaacac

SEQ ID NO: 577305 - DNA, 2048 bp, Homo sapiens
  misc_feature (1)..(1): n is a, c, g, or t
  misc_feature (242)..(242): n is a, c, g, or t
  misc_feature (1806)..(1806): n is a, c, g, or t
ngggtgggctgtgtggtgttttgctcacttggtggtgtgcgctgttcggtgtttcgctcgtggggtgtttgctggttgcggcgcgtggtggcggctcgttgggttgttggtgacgcactggacgtagggggtcgcgggtggtggggttctgtgcgtggttgttgtggacggtactggtgtgcggcgtttgtgggtgggctatgctgttgtggtggttgggcccgctgtgtggtgttggggtnatactcgtgtgggtgtgtgggttgttggtagtctacatgggggcgtcgtcgggttccagactgggggtggtgtgcagtcccggtgtgggggttttggtcgttccgacgggtgtgttgtgtgtgcgtggggtgtgtggtctagcacttggtggtcgtgggggtccaccgtgtgtgtgtactcgtgcggaggtggggtgtggtgtgtggtcgctcagcacgtgtggtggtggagcgggggggggtgggtgtgtcgcggctgtgttgatgggtggggtgttggtgcgatcacacgggtgggagcgactgcttgctggcttgctgggttgtgtctggaatggcgatgagagggaggtgtgtgggggtggaggttgttgtggtggtgtcctgctggtggggggggctgtcggctcgtcatcttgtggtgtcgtttgtgtttggtgacgtcgtggtgtttggctcagccgacttgtggaggcgacggtctgggtgggggctggtgaggtggtgttggtgtggggttcgccggcggtggttgtggttagtgttggtgttaggaccgtcgtgttgttgtatgtgtggtgtgtggtgctgcccctccttcggcggtctagtgtgttggtggtggtggtgcgtcgcgggcggtggggtgggtgttttatgctggtttgattgctgcggcagcctcgttgtgccggcggcggggggtggtcttcttgggtggtggaggtgtagagtgagcagtggttgtgggtggtaggagaccacgccgctgttttggtggtggggggcgcgtggttgtgttgtcttcgtcttctccaccgctgtggggtaggtgcgccacttcgtgctctctcgggggggtgagtgagtggctgctctacgacggcgccgtcaggtagatgcatgcggcgcgtcagtcagtgttgtttgtgtgcgtcgcggcagcttcgtaggtgaggggtgtgggtgttgtatgtttggtgtggttcctccttctcttctggttggtaggggatggagagtgggttgcggcagcacgcgtcgactgctcatcgcatctccgtctcgtggtgcctcctcgtagagtgacgtcggcgcggcgcctggtgtgatgatgagtggcatcacgttgttgttgtgtgggtggtgtgtgttcgccctcgctcgttgtgtgtggtgggtgggggccaccacgctgtggtggtgtgtgggcgcgacgtgaggggtgtgtgtgtgggaggtgccccgctcacgcgggacgagagaggggcgctctgtcactctctcaacagtggtgtcacagtcgggggcggcccacacgtgtgtgttgtctctctgatgatgaagagagtctgtctgagagagagagtgtatgtgtgtgttgtgtttcgtgtttcacacctctctgtgtcacactctgagagagagtggtggggacacagaggatatataagagtggtgggcgatgtgtgggagagcgtctggagatatctgaggagatgtgggtgtgtggagaggtcacacacaggcgccacactctctgcgggctgtgttcaccctgctnttagggggacgcacacacacacaggggacccctcttgcacagaagatcctctgcactctgtacacagagagccacaagtctgtggggagagaacacgcagaggggctcccttccacccgcgtgtacacctctctatcttctcccatataagtttggttataaaaaccccttttgttaacacttttctcagaacaatttaaaattatataatattttctcctaacaccaagaaataaataaat

SEQ ID NO: 577306 - DNA, 776 bp, Homo sapiens
ctcagccagcacggaggcggcgtgaagcaaagcttatagaaacctccaggatactgctgtcatggcagagaagcccaagctgactacttcttgcacggggcagaatggagtccacccggtggctcctggctgtagctggagtatagtttgaagagaaatttataaaatctgcagacgagccggtcaagttaacaaatgatggatatttgatgttccagcacgtgccaatggttgaaattgatgggatgaagctggtgcataccagagacattctcaactacatcgccaggagatacaacctctatgggaaagacataaaggacagagccttgcttgatctgtctatagaatgtatagcacatttgggtgaaatgatcctccttctgcccgtatgtgcacctgacgaaaaagatgccaagcttgccttgatcaaagagaaaataaaaaatcgctacttgcctgcctctgaaaaagcctcaaagagccatggacaagactaccttgttggcaacaagatgagcctggctgacattatctggtggaacttctatactacgtcgaggagctttgctccagaagtatctccagctgtcctcatgctgagggcctgaaaaccagagaaagctcctgtccacagtgtataaagttctacaaaccggctggccaaggaaggcttccttgatgagaaaactttataggagccaggaggatttcacggttaataacgcaggcttggaggcaagaattccatagcaaggactgaaggtttcacaata

SEQ ID NO: 577307 - DNA, 564 bp, Homo sapiens
  misc_feature (3)..(3): n is a, c, g, or t
  misc_feature (65)..(65): n is a, c, g, or t
  misc_feature (72)..(72): n is a, c, g, or t
  misc_feature (110)..(111): n is a, c, g, or t
  misc_feature (221)..(221): n is a, c, g, or t
  misc_feature (262)..(262): n is a, c, g, or t
  misc_feature (303)..(303): n is a, c, g, or t
  misc_feature (346)..(346): n is a, c, g, or t
  misc_feature (355)..(355): n is a, c, g, or t
  misc_feature (364)..(364): n is a, c, g, or t
  misc_feature (369)..(369): n is a, c, g, or t
  misc_feature (471)..(471): n is a, c, g, or t
  misc_feature (497)..(497): n is a, c, g, or t
  misc_feature (518)..(518): n is a, c, g, or t
cangctcattcagtgaaaacttgtggggtatagaaatggaatggagaatatcaaaaagctttgcngaaactntactttggactccagacttcactgtccttaggcattgnnaccatcacctggtttgcattcttcatgactggggttaacttaaaacaaaaatggtagggaagctttcctatgcttcgggtaagggacaaatttgcttttgtaggcttggnggctgagacaggcagacagggcctgattaaaggaggcattngtcaccactagccaccaagttaagttgtggcacccaaaggngacggccatggtaacgtagatcatcagctctgctaagtggttnggggggggnacatattcnttccngtctcccaatgggttcctgtggttaccgtgaatgaccactcctgctttttttttcctggggttgccgggggtaacatggcacttatactggtgggcagatgnccagatggacatcatcatccccaggntttgggaccaccgtgcttgcntcaataggtttttccctgttatgtgggccttcctgccatccattgg

SEQ ID NO: 577308 - DNA, 285 bp, Homo sapiens
tccggggccccggggcccaggttttttttttttaaaatggctttaaaccccccaaattaaagggggtttttttaaggttaggggccccccccccccccccccccaaaggggtggggttccggggttgaaggttaaccttttttttccttttatttttgaaccaaaaatttttttggggtttgaacccggcccctttgggaccaaacccgcccttttaatttggcccggccccattttgtttttgggtggccgggtttttaaaaaaaaaaaggtttttccccttta

SEQ ID NO: 577309 - DNA, 486 bp, Homo sapiens
  misc_feature (15)..(15): n is a, c, g, or t
  misc_feature (94)..(94): n is a, c, g, or t
  misc_feature (188)..(188): n is a, c, g, or t
  misc_feature (194)..(194): n is a, c, g, or t
  misc_feature (323)..(323): n is a, c, g, or t
  misc_feature (328)..(328): n is a, c, g, or t
  misc_feature (337)..(337): n is a, c, g, or t
  misc_feature (344)..(344): n is a, c, g, or t
  misc_feature (359)..(359): n is a, c, g, or t
  misc_feature (372)..(372): n is a, c, g, or t
  misc_feature (387)..(387): n is a, c, g, or t
  misc_feature (401)..(402): n is a, c, g, or t
gtgttcctgcagatntccccgctgatttttttagggcagcttgatgcgcagttgagtaacagcgaatcgctgtcagctcctgtgcatgttcagngctagtctctcgagaatggcaggtgagcccggcgcaactggctttgcccaccgaacggcttgaggggctgggtgcgccgctcaatacaatcggnccgacnggtaatctgtccttgagctggaatcatctgcactttagccgtgataaccgtatgctgctgtgccgccgggcaattacaattgcatcttgacggaaatcgcttcgcgcctgtcaccaatccggcccttangcagntactttatnaatttcnatcttcagtgagcantatgccagcttgnatctgatgaccgatnggccctatgatgcnnagcggcagcggtgacatcaccaatggacattttcagttttccggtaaagcctgggcacagcaagggcaggaagcaaaattggca

SEQ ID NO: 577310 - DNA, 342 bp, Homo sapiens
  misc_feature (26)..(26): n is a, c, g, or t
  misc_feature (35)..(35): n is a, c, g, or t
tttttcccaagccgcctttttccagntggccagantaaactccaaccccagaccagggcaggggacaggtttcaagtccttcccagcatacacacagggaacaaacacataccccaaaccggtaatgggacctgtcaccccccttgtttcctccttgggccctacagggtacacatttacctttggccccgggttttggaaaaattccgggttcctgacccaggtttagttttttccccccatttttatttcaaacattttcaaacatttaacttgtaaaatagactgggatattattacaaaaggtaattaaaaaaatgaattaaaaaattcctccagtca

SEQ ID NO: 577311 - DNA, 114 bp, Homo sapiens
acgctaagaccgaagtggcttctggaaaactgaggaagggtttaggtgcctttgaacgctcaatcttgactcagatcgaccatattctgatgcgacaaagagagattacttcga

SEQ ID NO: 577312 - DNA, 547 bp, Homo sapiens
  misc_feature (368)..(368): n is a, c, g, or t
  misc_feature (376)..(376): n is a, c, g, or t
  misc_feature (380)..(380): n is a, c, g, or t
  misc_feature (496)..(496): n is a, c, g, or t
  misc_feature (519)..(519): n is a, c, g, or t
  misc_feature (546)..(546): n is a, c, g, or t
ataatttttgacgatctgttgcaggtagttggcggcaatttgcgcactgttggagttacgcccgtcgaggatcaactgcaaaggcgcggtctggaaggtatccagtttgcgcgagaagtcagccgggaaacgcaccagtagtaacgccttttgtgtgtcgatggttgggcggatctcctgtgggcttttcagcagcagcacatgagtaaaggcgctggcgcgggcaaaacgttgggtcagctccaccgaatgctcgccgttatcttcatcgtagatggcgatggtggcgttagtcacttccagcgtggcggcgaacgggaacaggatcacctgaattagcacgggtaaatcagaatcgcgcgggtttncggttcgngcanaacgactgcaactctttgcggattaacgtccataagcgatgaaacatgctcttctccctaatccagccgacgtttggttttcagccacgtcaggccgataaacatcaccgccgagngatcaaaaacagcacgtttaccnccagcaccactggaatattcccggcgng

SEQ ID NO: 577313 - DNA, 624 bp, Homo sapiens
atacgagagttgctactgggattcccgtcgtacaccttaaagggacacagctttcacattgtccggagcccttgatgtcctggcgaaatgaaggatggaggatgtccttaagtgccttgcagtaggaacccacttatggtggacgaccaagtctctgagcgttgccacgatgggaacgagctcacagtactactataacacgtgcaacaacgatgatgcgcagtctagtatcactacagatctcaagaggacctgggagaagcttctgctggcagcctcgtgcagattgttgccattgaaaaccctggctgatgtcaggtgttatagtcctccaggagatactggccagagggctgtgctgaagttcgctgctgccactggagccactccatattgctggccgctgtcacgtccctggaactcttcagctaaccagcatccacggcagccttccgcggagccacggcgttctctgctgcgttcactgagccccagggctgaccaccagcctctcatcggaggcctcttactgttaagcctacgctaccattgcgctgtgtgacacgtgattctcctctgcgctatgtggacgttgccatcccatgcaacaacccgggagctcac

SEQ ID NO: 577314 - DNA, 845 bp, Homo sapiens
cgccttcggctgacttcgcttgaagtgtctgccgagtgtggaagcgagcctcttcttgcctggctttctcgatctcgcaccaaagccacaacagtactgtgccccccgtattgatcgtcccctactcgtcctcgctacttccgagaccttacaggacagagtctggagctccctcgcctctctgcactggccgcggaagtgaggtcactaggggcaggctcctcttggccagctgcatcgtgtgcttgcgtttctatcttgctgctttttgtcgtggttccctcctggccgtaactcgaacgtgctgtgctctggtctctcccatgtgggaagtaattccatccgatcgacctgcaagaggcgttgccttcgctagtcctggccctcctccttcccgatctccactggagacggtgtccttccaggtcgccaaatcatcttgttccagtaaagtgcatcctattttctgatatcagaagcacgaaatacaagagcctgacgtcctacccttccgggataatcactattactgtgtgttaggtgtacttgtctgccctctacagacattttgagtgttacttgatatacgataagtacaggtataatgtttgcagaacgtgacaacagccggattttcagagtaaagctgactttaggatgcagtctttcctactcctccacaggttaccgggttacacttaggtccaattacttgtatccactgttagcgctcgtgtaaactacagagaaaagacgcggccctccttgtcccctatcgttgaaggcaggcgaaattttccgtcattttgccctcattgtgccgtaatgttactttttcttcccgg

SEQ ID NO: 577315 - DNA, 149 bp, Homo sapiens
attttgaggagggaacggacactcgagacgcagacttcaatggaaccaaggccagcgaataagcaactttctacagtttagcaccacgggtggggagccaaaaaccaaaacaaacaaacaaaaaaaacccaacaacaacttagaacaaa

SEQ ID NO: 577316 - DNA, 435 bp, Homo sapiens
tttccatggaaaccttcgtgggtttcgcatgcaagcagggctccaccccgtgattcatatgcttaagatccccctctaagctggtagcatcactttgaatcacaaaggagccccataagcatcttgcccagagagtttgatccttcttgaccgggcccttctttcctgtccagtaggctatcccggaaatgggcttaaggtgttagggtccaggggtcctttgttttggagccacatggttccatggagagaagtcctcttcttcaatcattggtctccagaaatgtgcatgcagaccacctgttcccttcaagatccaaattaactttccagtcatgagtaaaaacgttagtattacaaagactgttaaacttctgtgctgctcctgtcaattgccaaaatttgtcccctgttgtaagttaaaatctagccatt

SEQ ID NO: 577317 - DNA, 195 bp, Homo sapiens
gtctttatacacctactccgaaggttcttcctctagtttctgtaggagtaggtcatactggcctgggacgaccatcgactgggagcagcgacgctcaggtttttcaaacctccgggaccacgggcgcgagcgatggtctttaggatggctattcgggtagcacatgagttttgagtgaacatattatttgtcaaa

SEQ ID NO: 577318 - DNA, 417 bp, Homo sapiens
ccgcttcgtgaactgcggctgagcccctggatcggttgccccaacttgaccgaaccttcatcagcaataacaccggcaagcgggtatgcctgacgatgctgggcaagctggatttagtggctggcatgaccctgacgccaaaggatgcgacggctttcgcgaaacgcttgaagccttggatcgctgaattgtataggggggaagatccagaggttggccgttgcctgccgctcgatgatttcttggcgtgggaggaaaacctatcttcgcgcgcccgcgattcgtattgaaacctgacgcgattgctaactgaacatgcatgaaatcgcggactccaggctccaaatcatagactgggcgtatctgtattgtggaaagcaacgcgtcaaggggagtaccaacactgggttacgtctg

SEQ ID NO: 577319 - DNA, 226 bp, Homo sapiens
ccctattggataagtagatatgctatggaacctcctaaaccaagggcggagtgtgggtcccttttcctaatgggtggaaaatacccgggtagtgatcagaaacttacgatgctatggaacttcctaaaactaggcctagtttaagaagttccattagcaccagcttccacaaattcattccagccacttttctatcattccccccagggtgtaagactaccatggg

SEQ ID NO: 577320 - DNA, 356 bp, Homo sapiens
agcaggtgagacaacactgaggacgtttggcagtagtgcgtcatggaggaggagtgttcctagtggcccccagtgcccaattcaggccctgtgcacaatgcctgagtccagccctccaggtgctcagagagaatagggccccgagatgcttgagggggaccctgtggtccagcgtggcacagccacaattctgaggaagctttggaggcctcaccccaagtgctgctggtaccgtgaccccgccttggaatgggtggggtcagccatggcaagggtgaggtgccagaggccagaccgaggctgataatgctacacaaaggagcccagacgggtggcagggcccaggacagctcaag

SEQ ID NO: 577321 - DNA, 803 bp, Homo sapiens
  misc_feature (9)..(9): n is a, c, g, or t
  misc_feature (47)..(47): n is a, c, g, or t
  misc_feature (135)..(135): n is a, c, g, or t
  misc_feature (162)..(162): n is a, c, g, or t
  misc_feature (167)..(167): n is a, c, g, or t
  misc_feature (170)..(170): n is a, c, g, or t
  misc_feature (179)..(179): n is a, c, g, or t
  misc_feature (192)..(192): n is a, c, g, or t
  misc_feature (194)..(194): n is a, c, g, or t
  misc_feature (409)..(409): n is a, c, g, or t
  misc_feature (443)..(443): n is a, c, g, or t
  misc_feature (452)..(453): n is a, c, g, or t
  misc_feature (456)..(456): n is a, c, g, or t
  misc_feature (479)..(479): n is a, c, g, or t
  misc_feature (586)..(586): n is a, c, g, or t
  misc_feature (588)..(588): n is a, c, g, or t
  misc_feature (591)..(591): n is a, c, g, or t
tgttcagtntccccgagacatgatatggattttgctggaaacgtganaaagagatcaataggagctaaggactaacacattagatgaagattcagaaggtagtgatgatgaacttggtaacctggagacgagganaaagaaaaagaggggtttgttttttcnccttnttntaaaggaangtatggatgatgnanatttgctgaagttgatgaagatggaggaacattcatggatgtgttagatgatgaaagtgagagcgttccagaacttgaagtccactccaaagtcagtactaagaaaagcaagagaaaaggtacagatgattttgactttgctggctcatttcaagggccaagaaaaaagaaaagaaacttaaatgattccagcctatttgtatctgctgaagagnttggccatctattggatgaaaatatgggatccangtttgatannatnggcatgaatgccatggctaacanagataatgcaagtctcaaacagcttagatgggaggctgaacgtgatgactggctacacaacagagatgcaaaaagtatcatcaagaaaaagaaacattttaaaaagnanagnattaaaaccactcaaaaaactaaaaaacaaaggaagatgaggttattatatgtaaatttatagagttaaaattactacattacatactaatttcttgctgttcaacccatgtttgtatgatctaagctctactgattaccatacattctcagacttttctagtggatttgtaataaactataaataaaaatagctctcatttataaagtcaa

SEQ ID NO: 577322 - DNA, 395 bp, Homo sapiens
agaaatgatatagaattgaagtagagtgtataaaaaatttgatataaggagggagagtggagtataggtatatgaatgttaaattagggaatgaaaaatatataaagtatagtttaaataaagttggttattaaaaatagggtgagaagatttgaattagaagtatagaagggtagaataaaggttggatatcttaaaaatttaagaagaagagaattattagtagaatagagaagggctgaaattttagtaacgattgaagactatgagcttgattgttagaaaaagagattatataagttgtggagtaggaatgaattatagggttcgttgccctcacgtttgtgttgtgccgcggagtagaagtatcaatactagtgggatattggctacag

SEQ ID NO: 577323 - DNA, 442 bp, Homo sapiens
acagcttcgaatacctgcaagtcgagtatgtgccagatgtcactgcagactagtccttatatgatagaaataaaataatttacatttaattttcatgtaaatgtgacagcagcagcaataacataggcattcagtaactattctttggagctaggccagatcctaaatatcctgaaagaaacatgacatgtcactatctactccttcaagacaaagataatccttatttccttctcttcacttcagtaagctggtctacaaggatggacttttatttatgcaacaatttcagtactgtccaacatatggggctttatatcctctcccggaaagtagaatctgatttggaaatctagtagtgtactgtcacgttgccacgctgttcaattaaggtacccttttcacattaataagacagggtacgaagttctctgaataccat

SEQ ID NO: 577324 - DNA, 418 bp, Homo sapiens
tgcagataagtcataatcatgtcattgcactcctgcctgggcatcagagaaagaccttgtagtcagaaaacaaacaaacaaacacgcaaacaaaagagacaagacaaaccacaaaaaaacatacagacacacagagacccccccacacacacgttggccctacaaaacaaaacactaaaaataatgttcaattagtaatactaggaatagcatagaagtactaaatactaccgtaaataggagtaatcaggttacaatattcaaaagttgccttattgattcagaaaagtgtaaaggtattaacttaccatgtagttacattaaatttgggttctataataatctaagttagccactaaacagatagaactaaaggtataacttacaaaccatcagaaatgagatagttgacagggga

SEQ ID NO: 577325 - DNA, 449 bp, Homo sapiens
ttgcgggccgcgtcgactttaaaacttggtataatgaataaaaatagtaaaagaaggtgacataaaaatgattttagataatgtgaacccaaatgatttatttccaacagaaaagaaaggacttagtgtattgggtacgatagagtattctgtacaaggttctacagaatttgaaggtgcgtttattgctacaaacgaacgcattattttaaatgtagatatgaatggggaattctattatagaagtataggttatgatgaagtagagaaaattacatacgaagacggtcgcattcatttcacatttaatattggaccaatgccgatgaaagatatacaaaaaggtgatgcagaagcgtttgtacaatttgtaaaggacaaaataaacattcaataagaagatagtgtttaagagaatttgcctttaccatgtttaggatggtcgacgc

SEQ ID NO: 577326 - DNA, 403 bp, Homo sapiens
tcagtgaggctaaatcttaacctaacgtcgttacgttgagtacttgcgcttgttacgtaaccttcatcagagtttgctgcacgatgtcggtatataggctgagcaagaggtggtgaggttgatcggggtttatcgattacagaacaggctcctctagagggatatgacgcaccgccaggtcctttgagatataaagctgtggctcatttcagtgctggcgagcagttaagtatgatttaactgttgaggttaagggctaagcatagtgtggtatctaatcccagtttgggtcttagctattgtgtgttcagatatgttcaagccacttacgtagtctattttgtgtcaactggagttttacacaactcaggtgagtattagctttattggggagggggtgatt

SEQ ID NO: 577327 - DNA, 154 bp, Homo sapiens
acctctgtaccgagttcaacatggcgtttgcagatgctcgacagcattgcactgggctgcttgtctctagtgttctgtgcaccagtagcttgtggccccagtatacactgtctcgagttccgcaacaaggtgcttactgggcctgagtgggcag

SEQ ID NO: 577328 - DNA, 1137 bp, Homo sapiens
tggtttttgggctgtaagttaattcaatgcaaaaaaatcctctccaatttatactgagggtggctgaccacgttccacgaaccaaattccgcctctaaacgtggaattcggtgtgctgacccagccccagcctcggctttctggttcggcaccagggtggcacagcacctccgtcgtgtaggtatctcgtgtcagcttctccccttcttggtgtgagttcctcgccaggttcgacctcacccttccagaacctttatagtgccgaggccgtgccagatctcgtggagcggctatacgaggcgatagggtgtggacaggacacaattctcggcgggggcagaagtgagaggtaatcacggagaatacgtggaataccctcagtgggataaggttaccagtatagaaagtgtcctccaggcaaacgtggttcctttcagcgttagccttcgggaccttgagaaggacgtgcagtggcctttcagtgacattgaaggtggggcacatttctgtgagtctgccagcctccggggtgctataggcattgtggacattccttcatgggccaccattgacatcccttcctttaaaaggggagtacaataaagggccaatccggttcttctaaggacatcaaaatctctgcggcctcaagaaatccattctagtccttaaaattgcctatacaggtgtagacgctccttggaccagaaccttgaagcatagctctgaaggttggcagagaacgcgctggaactttgggaccctgggctccaaaggctgaacccgagttatgggaccccccaaaatatctggagaagtcctggcaacaaggcatcaggctcgtgacactcccgagggcaacccacagagagctggtaagggcatagaacatgggcagatgcgggacctaggaagaacaggacaggagaacgagaccctaaaccggatgccataccgacgggaaatacagggggacagagctgcaaaacagggcgagaatatcaaaggaggagcaaggcaacaaaaggttggagaacatacatagacacggggtagaaaaaagaagaaaaaaacacaacaaaaacacaaaaaaggaacaaacacaacagaaacacaaaagaccccacggagtaagac

SEQ ID NO: 577329 - DNA, 546 bp, Homo sapiens
  misc_feature (351)..(351): n is a, c, g, or t
gcggataatcataaaagctgtctaccctacccacggttagaaacacctatacgggaagagatacaggcacacatgagagagacacagcttggagattgtgttcatgggccaacaaaatacttgtcagcatgttactctgagtacgtggaaattttttggacaatgaggttaatgtgagtcttctgacacgtgacaaactgttgtttgcgatcatcttataatcatatatgtcattttcatgcttttctgagtattcccagtttatagctgatgatagcttttaccaaaaactaatgaattgtaggaagtttatgtcgcatacataaagaaaggaaacaaacacttcttatngctcttggaagatgtatttaattcaaattttacaatttggattcagcatgaatagcaataaatggatcttcggcagagttactaatagaaaactgagctgtgccatcactggaaacatagactttaattcctgtacaactgtcaccaactttatctccgcgagggaaaagggaccgagctcgaatcggatcccgg

SEQ ID NO: 577330 - DNA, 311 bp, Homo sapiens
gcccccacccggccttttagttcaggtcccccatgggggacggcccagggtgggtgggggtgccaaagggtcccgagtgggggccgtgcctttgcccaaaccctgcacttttaaccaggccagtccggttttggggagcaggggcctccccggcaacagccccaggggccctttagggtttgaggtcccagccctgttgccaagtgcccttgtccccagctccctcctccccgggtggtgtgagtgggggggggtttgggccgagctttttttttattttgcaaatataaataaaggaaggcggttttcga

SEQ ID NO: 577331 - DNA, 327 bp, Homo sapiens
tgagcacaatcacatctttgaagcgccccggtcgctgtcttccagtagcagcacgacatcgtgaataacgtaattgcgcctcagaagttcctctcgtccaaagtggcccttgtcaggcactgatgtttgtgccctatgttacatgcggttgtatatctcctgcagacgggtcgctttctccagctgatatataacctcgtccacattgtgacagcagatcctttactaaccccagtgctgtggtcagggtctggcgctcctcctcgatcccgtgtgaattctgcatggattcgggctgattagtaaaggggtaaaattgtaaaattc

SEQ ID NO: 577332 - DNA, 276 bp, Homo sapiens
gcttcctcctttctgcttcgctctggtcgccggctatcctgtcattcgttcaccgacctatgattcagattgctgccttgagaagtcttgagatagtcgtccccagtgctcgtagcgattgagagcgggcgctctcgctccctgagtgctcctgacgggagtcgccgccgagagtgaggtccctcgggcctggactctctatcgtctgcctctaaagcagctgggcctccctgcctcgagctcgagtcagctgctcggggcggtgacagttgagcc

SEQ ID NO: 577333 - DNA, 103 bp, Homo sapiens
ggtcggtacctcagatcggctaacggcagagggagtgagcagggagaaatagcagaggggcttggagggtcacatagtattgtggtgtgttgaattcaatacg

SEQ ID NO: 577334 - DNA, 198 bp, Homo sapiens
gccttaatcctaagggatctgcttatattacacaactcgatatcaaatgtaactaatgaccacgaagtactgtctaccttaactggccgtatattacattgtttagccctcatatcatataaacttaatacttaaaaattgattaatgacactttaaacattttgtagtgtgttttacttgctcatacgcttaggatt

SEQ ID NO: 577335 - DNA, 266 bp, Homo sapiens
atccttacaaacaccatgggtgtctaatgtatacccaaacttaggggcatcagactttttttttggagacggagtctggccctggtcgcccaggcgggagttcaagggcgcaatctccacttacggcaacctcggcttcccgggttcaagcgattctccggcccgagcctcgggagtagctaagactacgggcatgtgccaccacgcccagctaattttttttcttttcttttctttttttttttgggtggtagggatgtcggtgg

SEQ ID NO: 577336 - DNA, 574 bp, Homo sapiens
  misc_feature (199)..(199): n is a, c, g, or t
  misc_feature (205)..(205): n is a, c, g, or t
  misc_feature (404)..(404): n is a, c, g, or t
  misc_feature (537)..(537): n is a, c, g, or t
gtaatctcagtactttaatgaaataacatctctacaaaaaacagaaaaaattagctgggtgtggcggcttgtgcctttagtcccagctactctgtaggctgaggcaggaggatcgaggatcacctgagcccggggaggttgaggctgcagtgagccatgatcacaccactgcactccagcctggacgacagagtgagangctgtntcaaaaacaaaaacaaaaaaccaaaaaacggacagggtataggcaattgttattcttcataataaccctgtcaagacttgacagctaagcccttcaagaggcaagttcaaaccaagactatgaaagaaaattaattaattgtgcccccaggtggaatgccagtgaataatgaatttgggtgagtagagacttgcaagtnaagaaagaatttttggtgtacaagacacaatctgaagaacagccaatctctacagagattgccaacaaactaccacctagttttcaaggcacaacagtttaacttatcccttcattactttgtgaagtaaggnaagcacttttacttccacctatgaggaactgggggtc

SEQ ID NO: 577337 - DNA, 313 bp, Homo sapiens
acgctcgctgtaatcgacaacctgagtctacgatctgtccgcactcaagacctgaccgacgcgtggaactctattgcggtgcacctggacacgctggagcgtctgaaagaattacgtcaagaaacgaaggcgtcagcggcgctaatggcggcgcgcttgccccaggcctggtcagcacaatcaaggaagaccagaactggcacgacacctgggcctacgccgtttgtacttcgtaccagctcaccaagcaagtggtactgcgtaccggcctgacattcgaaccgtcggctaccaacaaaacgggatcgctcac

SEQ ID NO: 577338 - DNA, 133 bp, Homo sapiens
atgctcaacatcccacttcgcacccttcaagtttccatcaagggctcatcgtcagttttctaggggtcagcacacatgtagccccatttcttgcccaactccagtgggcatcctctcagcagtctgaccgtgc

SEQ ID NO: 577339 - DNA, 111 bp, Homo sapiens
  misc_feature (111)..(111): n is a, c, g, or t
ggccgcgccgaagccttccgcagctgccgcttcagtccgaagagggaagggaaccaacccactttttcggcgccgcggctcttttctaaaagttgttgaaagcagctgttn

SEQ ID NO: 577340 - DNA, 912 bp, Homo sapiens
gcacctggtcatcgagcgagacagcccctcatgttcaggagcgacgcctaccttaccctgaccacttccgaactgcagcccactgtgggaaggagaactgacagcgcgaggcccgcagagctgaagggtgagctctactgcctgccctgccatgacaagatggtgcgtccccatctgcggggcctgtcgccgagcccactcgagggccgagtgtgtcaagcggcgctgggcaatgcaggtgcgcacgtggatgcacgtttgtctgtgccaatgtgtgagcaagccattcctgggtgcaccgagcactatgatgcaagaagggcctggccgtacgtgacgagagtcatctacagagccagctcgttcggggactgtctgctacgagacgtgcgagccgagtgtgatttgagacggcgaatgtggtgtcaggcgccgtcgaacagagggccttggtgtgtgagcatgcttcgtcctgctccgacctgcaacgagcgaagctctaccctgaagaacaagtctgtggagtacggacgatgaagcccgtgtgtaagaggtgctacgagaagttcccgctggagctgaagaagcggctgaagaagctgtcggagctgacgctcgccggaaggcccagtccgaggccacagtagctcaactctggctgagaggcccgtcttagcgcagggtgccttctcgggcccgtccagcgttcattctatccaacccatgcctggtgccgtatatatggggtccctaccttagtaccgacaagtccaagcgtgatgacgctcacaacagaaggttaacccatcgcatatagtgaaacacggacagtaggaactggctccacttcccttgtcccattcattctcaggcttcacagaggggtcggcccacaccattggcaggggcata

SEQ ID NO: 577341 - DNA, 320 bp, Homo sapiens
cataaggaaggtcccagcgttggggagagccccaaagttgagaacaagtaagtgaaccaattgttgtactgaagccacttgttacggaaacagctggatcatcaaacgacctgtgtgtaatatgtattctcctacaaacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 577342 - DNA, 407 bp, Homo sapiens
aataaataagaattttcagtggtgttaaagaaaaaaaattagaacgaactaaagaaaagaaccaacatataaaaagattcacgctcgttcaatagagagatgaaagagatatcaaaatcttgaactgttagcacgaaatgtgtccaaatagcaactgatgctgagattagaagcgcctgcacagaggctggtatgtttgccattagagcacggcgaaaaattgctaccgagaaggatttcttggaagctgttaatacggtcattaagtcttatgccaaattcagtgctactcctcgctacatgacatacaactgaaccctgtcggctttcaagtgatggctttaaactggtatcctaaccttatatagactcgttaataaccaattcataagcacacaaatggcttc

SEQ ID NO: 577343 - DNA, 242 bp, Homo sapiens
gccgcaccaggcgcactctggcgcacttctcaaaagaagacatttatgcggccaacaaacatataaaaagaagctcaacatcactgatcattagagaaatgcaaatcaaaaccacaacacaagataccacaacacacccactaggatggctaaaatttaaaaagacagataatagcaagtgctggtgaggtagtgcagaaatgggaaccttcataccctgctggtagaagtgcgcctgggtg

SEQ ID NO: 577344 - DNA, 127 bp, Homo sapiens
ctcagccaacaccatggacctcctatacctactatcaagcaggcggtggcagccaccaggcacggcggtgagtggccgctagattacctgcacgctggctctagcacctgctggacgaggaagctgc

SEQ ID NO: 577345 - DNA, 370 bp, Homo sapiens
caaaatgagcaaggtgcggtgggtcattgctgcaatctcagcactttgggaggctgaggcggacggatcacgaggtcaagagatcgagaccatcctggccaacatggtgaaacggtgccttgtctctaggtaaagatacaaaaattagccgggcatggtggaagccatctggaatctcagctacttgggaggctgaggcaggagactgcttggacccaggaagcagaagttgcagtgaaccgagctagcaccgaggccgtccagcctagagtgacagagtgagatccgtctgaaaaagaaaaaaaagaaaagaaaaggaaagaaaaagtgggagaccacttaggaggcgatggtaacgcagataagagcg

SEQ ID NO: 577346 - DNA, 1108 bp, Homo sapiens
  misc_feature (341)..(341): n is a, c, g, or t
  misc_feature (364)..(364): n is a, c, g, or t
  misc_feature (959)..(959): n is a, c, g, or t
agcgggcactccgaccgccagcgcacctagttcgcgtctgcattgctcgtgacgggtgtctagggcgccatggcgtccccgaggcaaggaagcataatgtgctgaggcctgtcgtgctgggtctgccttgtagccgagaaccgacagtaagctgtgcagtaactgggggcggcgcaggtgcatactggacggatggcgcatgcggttgcttatacgcaagcacttggcacgttagccttgacagcggtctacttgggacgtcacagcgccggaaggcccctgagcccagggcggtcgggctgactctcgaggaatgcgggcgcctcagtatggcttatcangtaaatagggttgaacacgcgangcaaaagactcgcaacggaagtggtggcaatggtttcgacggtggaacaggcttgacttgtgacaccgagaacgggcatatagtagtcggatggctcttgtggacgttgtggattgggaaaaaggggcaccttgtgacaatatcaatatggctctgcagactcacagaggttggttggaataggagttgaaggaaggtactgtgatagctgagtgtgagatgtatgtgctgtctgatgtaccacgtggctggatgtctgaggaaggatttgaaatagagtgggaaacagtgggggcaacatctataaaggtgaaatagtacttacttgcaatgactcgatttgagttttctacgtgtatacgctttgagcaagaaaaattgtataggggtttgcgaaagtttggggttgaaagtgcctacaccacctttcctgagtattagaagggctagtgggtcaaaagaaagtatacgtggtaaattaggggtaattagaggattggaggttttgcacacacataagagggattattaattttgaacaattttgacatacttttggaaggtgttggaaggacaatggtttgcgccttgtganaagagtggcttgagttgcatttaaccgagtgggggcgaggcggtcactggttgaaacccaatgttttggggcctccctatttgaaggtaacgcgggagtgcacatttgttaaattgcgttttgaggttttgagaaccttttgggtacaa

SEQ ID NO: 577347 - DNA, 127 bp, Homo sapiens
tcactggagggcaaggtagctggctggcctgaggccccagcatgttgagagggttaggaagagcagcaccagcacgaattcccttagcaccagcacgaattcccttagcaccagcacgaattccctt

SEQ ID NO: 577348 - DNA, 205 bp, Homo sapiens
  misc_feature (186)..(186): n is a, c, g, or t
cctaggggatccttattaaaaatgcacattggccaggtgtagtggctcacgtctataatcccagttctttgggcagctgaggctgaaggattgcttgagctcaggattttgagaccagcctgggcgatacagcaagattccattgcaaaaaagaaaaaaagaaaaagatttttaataaggatcccnctaggtccagctcgattct

SEQ ID NO: 577349 - DNA, 151 bp, Homo sapiens
  misc_feature (34)..(34): n is a, c, g, or t
cggcacgagggactttcctccagagcctgaaacnttcgccccgcggagacaagcttttcggccctgacttaaaacttgtgccccccatggaggaggattacccccagtttggcagccccaagtgaggggccgtggctgtggcatccagagt

SEQ ID NO: 577350 - DNA, 867 bp, Homo sapiens
  misc_feature (648)..(648): n is a, c, g, or t
agcggggcgggaccaagaggcggcggtggagcaggctgcgcgctcggcgccgacgggtgcgcgccgcggcttgggggagagttgagcgcttttcccccctctttttttttttttctcctcttcttctttaaacaaaccacaaacgggattgtgagggaagggaaggggtgttctctttaacctccttgagcccagacaccttcactcgtggtccgtcataagctggtttggctgaacacttttttttaaaaaagggaaaacagaaaagggatgttggcttggatggtgagaagatgtggaattgggactgtaagattttattccactcttccaggcccagccggccgttggcgcccgaggtctccctggtctggggacctttctccctgcctgtggacccctatactatattggcaacaagtttgtgacgggtgaagaacctgtttattattgagcatgtgacagagagccgagccaggacttagtggtgccacgccagccagttccataccctgtggttccaagccgtggaaaggttgaaagacttctcaacattttccaccaattatacttccttcctttcccttcccgagaacacattcgcggggtgcacctgtgaatgtgaaagttgtgagctcgggtttaccnattcttcgtggtgtcaccccatggaaaccattatgtggccgtgcttaaccattttacattccacgaaaactgtggacctcccgtgaaatcacagttctccaattatgctgggccaggattggaccacggctttctaattccatttctggtgatgccagattatacgaaacccagagggaactcaggtacagttccatcctcagatggcagccatgagac

SEQ ID NO: 577351 - DNA, 319 bp, Homo sapiens
  misc_feature (21)..(21): n is a, c, g, or t
  misc_feature (38)..(38): n is a, c, g, or t
  misc_feature (60)..(60): n is a, c, g, or t
  misc_feature (64)..(64): n is a, c, g, or t
  misc_feature (70)..(71): n is a, c, g, or t
  misc_feature (75)..(75): n is a, c, g, or t
  misc_feature (251)..(251): n is a, c, g, or t
gccactctccgcattctcagngtcgcacactccatcancaagaagctctcgaacgtcgcntgcncgcgtnncgtnaagcttcggcacctctcagagcggcccgcctcactcactcactcactcgagaaattctggatcctcccctcctatcttctggtctagtcatactcctattcaccagtctcaactagtcataaatgcccagctcttgtttacactgctggtttacactgtttctccaagccatcacngctgatatctcttggtgctatccccaaaccaccactcttaactcttaaagtaaataatctttgctggc

SEQ ID NO: 577352 - DNA, 154 bp, Homo sapiens
  misc_feature (7)..(7): n is a, c, g, or t
  misc_feature (12)..(12): n is a, c, g, or t
  misc_feature (26)..(26): n is a, c, g, or t
  misc_feature (149)..(149): n is a, c, g, or t
aaactgncttgntgggtttaatctgnatggctcaaatgaaaacactttgacctgtatttctaggtatggcaagaagagaaagaaaagcctaaattggaatgagatccaagtctaaacgcaagagctagaattagcccgccattaagganttctt

SEQ ID NO: 577353 - DNA, 1160 bp, Homo sapiens
  misc_feature (1)..(1): n is a, c, g, or t
nttttctgtcgtctgcgtgctcgtgcgctggcgtattgccgggtggtgtgggtgctgtgtcttggttgatgggtagtggtgcggtgtggggggtgttgggtgtttttgtctgtgtggttgagttggtattggtgcggggttgtgctggtggggggggatggggggagtggatgggtccctctgtgtatgggaagtggagtggggagtggatgctgcctgtggtgtgtggttgtagtggatggtgtggtttagtgtgtgtgggtgacgtataagagagacacacataaaccttgggaacaaagtggggcacctgaactcgagaaccaacagggtcaaaaacggggtgtaaccccccccgtgtgttcggcctctagtgcgacaccggggggcaattttccaaaaaggggctgtggaaaggggggctgtgtaggggcccggggggccccccggagtgtgcacaaactaaaggacccacatagtggggggtgcacctgtggacaaaccgtcgtggactgttgttggcccccctcaggggtgtcgattgtctgggataccccccgagtgttgtggaaagggtgtgctgtccaagaacacagggggcaccgtggcgaaggttcacgagaggggatgtgccaagggtgtgcacagcacacacaacaatgggggtggaccaccacaaagggggggcgcccccaaaaaagagggtgtagtgttgtgctggcccaacaatgtggtgtacccccgaggaagttgtggtttatcattatgaggtgtttagggatgagtttgtggggccgctgggagaatgtccgagatgggacacagaccgctgtgatgatgtgctccgcgggtctcacgaagtgtcggtgtgggggtgaacacaaaacacgaggagtgtgtcgctggccccacgtgaggagtgaccgtgtcggggagtaagagactcatgggtgtctgaaacaaccaaaaaaaaggtttccccccaaaaaaaaaattttcccccaaaaaaatttaaaaccacaaaaattttgcccccggcgaaagttccccctctttaaaaaaagttattttataaagaaaaaaaaaataaacccaaaaaaaataataaacaaaaataaaatactcgagcattattcggtcgaaaagtatgtcccactctt

SEQ ID NO: 577354 - DNA, 154 bp, Homo sapiens
  misc_feature (144)..(144): n is a, c, g, or t
gagctggagaagagaatgtgctgaggtagaagccagaaatgccagcagttggatggaggcagatttacaggaggaagagcagaaaaaaagagggagctgggcagggttaggagagagaactgtgtgcataagtgcaaatccaantacgcaatgt

SEQ ID NO: 577355 - DNA, 580 bp, Homo sapiens
  misc_feature (379)..(379): n is a, c, g, or t
  misc_feature (578)..(578): n is a, c, g, or t
taaggatccccggtcatctagatattcgtagcagtggctttctctacagatctctacttctttgatctgcccagacttcaagcggcctgaatatatttaaaggtgcacatctggggtccgggctaaagttaacaagggatcccagaaaaataaaagagaccttcaaaactcttgaaagattcaaaaagttcaatcagagactgagttgacagtggtccatgatattaagaagccacctgaacacaattctgcagattctgacggttgttggcagacagcttggttctgagacttcctagggagtcttctactgataaggacccaaagtatttgattaaccactcaggtttaagacgatgggtgtgaaccactgcgcgtnttatatcatttaattcagtgaaaggtcctattgcacgctgcagtaggccagccttttcacacagttgagcaatatgagcccggtcatattgtgtgaccttctgtttgcctagaatagcatctgcaacttgaggcgcttgcttaaggttcatctcaagtacccgcgtctgtaaaggaccttcaaatgggcgataatcctnca

SEQ ID NO: 577356 - DNA, 615 bp, Homo sapiens
  misc_feature (112)..(113): n is a, c, g, or t
  misc_feature (134)..(134): n is a, c, g, or t
  misc_feature (244)..(244): n is a, c, g, or t
  misc_feature (312)..(312): n is a, c, g, or t
  misc_feature (344)..(344): n is a, c, g, or t
  misc_feature (346)..(346): n is a, c, g, or t
tttgaaaaccatggcgtgggtaccagcggagccgcagtggaagagttgatgcctcggctattgcggtagagccttgcgacttgacggaaggtttcgatccctcggtaccccnnaggacgcctcaggaatacctnaggcgggtccagatcgagcagctcaatgtccagatgttgtggtagctcaaattgacccaagagttgaaaggagcaagtgtgatattctcttcaggatgccacccgccctnaggttattcccacacttcatggcacagcacagtggcaattttcactgttcgcaaatgtgacaacatgnagtactggaatcaacagtggtagtatgtgacnangaccgtgtactaaaaacaatcaaaaccatatcatcaatctgggaacaaatgtcgaaaccaatgaaaataacagacggggctgtttggaccagccacaaatgaaagtcctggaatagattatgtacaaataggttttcctcccttgcttagtattgtagcagaatgaatcaggcaacagtaactagtgtcttggaatatctgagtaatctggttggacacagagactttactccagaattgggaccatggctttatgcttattggcttgc

SEQ ID NO: 577357 - DNA, 248 bp, Homo sapiens
tcgtcagcggatcctgttggtcgatcactgtactcgccagaagttagaaaaacaaaatgtgtagtttttccatttaagagaatgcccacctgacatcccagcccccagcaaaacttactatagcctccactaacaaccacaccctgagctaccaaggaaactgactgtgtttacagttgaagaaaccatacagagactacactactgcatgcatccagaatcataaccaaagtacagtgatcgaccaa

SEQ ID NO: 577358 - DNA, 160 bp, Homo sapiens
taaactggagaagctataaaatgttacttactatgggctaggcgtggtcgctcatacctgtaatcctagcacttggtggagctgagtgggcagatcacttgagctcaccagttcacgaccagcctgggcaacatggcgaaatttgtctctaccaaaaaaa

SEQ ID NO: 577359 - DNA, 218 bp, Homo sapiens
  misc_feature (9)..(9): n is a, c, g, or t
  misc_feature (77)..(77): n is a, c, g, or t
cgcttgtcntggcctcggcaaaggagggggctgaaaactggaagagccccctggggaaggctctttgtggccccagntgggcaagcgggggaggggtgggctcttgttcccggccctcatcctagcgttcagcagactggccccacaccacaggtttccattttcacccttgggttaagagaaaagcagaaataaaaagtttactaatgttaaaaaaa

SEQ ID NO: 577360 - DNA, 215 bp, Homo sapiens
tggcatgcagtattcagtcaagctatagtcagcagactgcaccccaacaactcgagcagttccagtgcatattagcagacaacaacttcccagtgcaccagctcctgccttttctggtcagcctcaacaactgcctgctcagccgccacagcagtaccaggcgagcaattatcctgcacaaacttacactgcccaaacttctcagcctactaatt

SEQ ID NO: 577361 - DNA, 745 bp, Homo sapiens
agaatagttggaggatctttctccagaatccttctgttctgtagtacaagtattactcattatagactagcacgaaaaatcaagtgaaatgcgaacttaagagtttaaaaagaataaatggtgcttttctggcctattagtaataaattaaataaaaataattttaatttgtaagtaatgaatgctaatctacatgtattaattgggcttaaccagagagttttgtttacatacattaggcaaacaaacaataggaatgaggatttttaataaagaaggaagccagaaacacacacacacaagcacacacacacacacacacacacacacacacacacaccaagtaagagaatactaaaagatcagagaaaatgtaattatacttatcaaaatgtttaatgcagtggcctatgagttcagaatataaaatttattgcgatgtgttgagcaacttggagcttattttttaatccttacagataataggaacttgaaacatacttgggtgtgtataagatatatgtgatatcagaacacctcatatatatctgtaaatatatattcaaatatattactaacgcaaaaatatatttacatgtatatatcacatgatgcaattaataagtgttctcacatcaaaaaaaaaaccaccaaccaaacaaaaaaaaccaaaaaaacaacaaaaccaaaaacaacacccaaaaaacacccacaacacaacggggacaaacaacaccccccagaa

SEQ ID NO: 577362 - DNA, 1015 bp, Homo sapiens
gggaggtaagccatcccccgtggagaccttgctgctgaccatcctagtgctgggctggccccagcctcacccccaccccaggtgccctgaggccccagtgcatgctgctgcctccactatcgatgcctcctgactgcacactgaggactgggactggggttgagttctgtctggctttcgttcgccattatatggtaacgggatggctggaaaagcacacccaacgacgctattacagagactggcagtcaggagcagagcaggaggccctcatgtgcaccagggaaccaggaccacaccggccacttgcaggagggccaggagcagtcctccctctgactggctgcagatgttaatgtatcaccagccatgtccccttacgagagaggccttgcggagacgtttaaggcacctgcatggttccaaggaaactcgcattacccatctgtactatgaatgcaatgccatcttcaaaccggttttcattacatcgaacgtggtactgatacacgcctagcggcgctgccacatgcagtggagcagttggcatgactcacatgccatcgctctactacgtaattgcttatacaagacagcatacagactaagcacagcccaggagcccaccaacatcctaccacacaagcaacgacaggccagcatgccatgacacagagtggctccaaaacgcggacacaagccggcagcccgcaacgcaaggacaaaggcagaaggctaacacccccacaacacgagcaaactacacccacccaccgcccacccccaacacaccccatcaacaacacaccaccgcacacccacacgacgccacaggatcaaccccccaacaccgccgcaatcgcccccagcccagaccccacaccaacacccacgcacacacccccccccccccccgacacccgcaccaccctgcgaccccaagccccccccaacccacaccacgaccacccaccacgcccgcaacgccagcagcgaccacagacaccaccactcg

SEQ ID NO: 577363 - DNA, 1138 bp, Homo sapiens
ggcggcggccgacggcgggatgctgggagccagcgacctgcctcgccgaccgcacctcgcatgccatgaccactaccgattcttggcccgatatctccgacaccgatgcagaaggcggcggagcatgggagagaggagacggacagccaagacacagaggtatccacagcacgactaggggaagacaccctaaggacgcgccagagagggaccagggctaacgaagacggcctggagaaaaactggatgacatccatagtatagccagacaagtaaataccaagacatgtatcactagtggggagacactaaggacagaggcgcgtatacccgttggcccttccacaggtgcaaacggcaatggaccactgcaagcaggactggacgtggaagtccaaggtattgtggagcgattaattaattgtcaccgtacacccaaagaacaaaaaacgggcaaacagtagaagcgaggacgaccaagcgaaccaaaggaatagcgaaaaacgcgaagcgagagaaagcccacagaatgggagagtagatgggctaccgaagacaaggaggccaacaaggaacagcctcagatgtagagacacacgatgggaagagcgagcaacgacacagtatgggaccagaggcaaccttgcaccacagaagacgcgtacggcgagcgcgaaaggcacacacaggcaccgcacgatttacacggggacacgcacgacacgtgtcacaccagaaacgaagcggcgacacagtcatggcacaacgaagggcagtggcaacaacacagggcacaacggaaagcagcaaggagaaacaaagggcaaaagaagtatccggctgccgcagacgaggcgagccgggaaaggtatcccgatggggacataccaaagtgcggtaccagcaattgggaggcaccaccggatggaacccacgatagaataccggcgacgagcgagcacgaccacccgactcggcacagagcgacagcgttacccgagcagcacaaagacgagggacaatagttacagaccccatgaggggcaagccgcaccgccagcgggcagcacactaccagagggagcggacccgataagggaaaaccacgcgaccccgacatgtggtgagacagcaacca

SEQ ID NO: 577364 - DNA, 594 bp, Homo sapiens
ttttcctgttcaaggggacaacataactcattaaagtaacctacatgaaatcccacagtgggtttcattgtgtatttgacatttatgaacgctacaaggcttacgggaatgacatcacttgataaaggagttgtttaccaatttatttccctaagacccagcccgacataagatgttccctcacagccgtaacagaactctgtccttcataagacacttaaatctcagttactagaaagtcacgaaaacatattcctggagttctttgcttcttagtgaaaacatggttggatagacaggcctccataaacgggcttggggtgtgaaatgtcaacaggaattaggggtatgggctgacttatgaacatgggcgggcggtctatcttcgggttagatctggatttcgactgtactgccgagagaccgagcccccttattcccctgacatgatgggagagtgcgcatgtagatccaatcatttgcttactgggacgatagggcatatgatcccaccttttcaacttacctgttgataaacaggggggtgggcatatggctcatctaagcgctgctcaggcacatatgtgctagtct

SEQ ID NO: 577365 - DNA, 1179 bp, Homo sapiens
attcatggaatcacttcgctctccaagaatgccaagcctcctcaacgaccgggtgctgcgcggccaggctgaaggcggaggagaccttgcgtcgcccttcggatgtcctactttcaaattgtgatgcagaaggacggtccgtgccggtccatgcggagagatcgtggtccaccttggatgactggtaggtctgcgatggaacagagagctgcgacggcaggaggtcttcccgactgagaccatgaagctacctggaaccggcttcctgatcagctaggagcccggtgaaacaagagaccgcctgcaggctgctaggggtgccagcattggcatgattcagtggacctcgtaacgatgaagagtaagacctatcctctccatggaaggcgcgaggaacgcttgtgcactctatcgaccggacgaatcttcctataccgtgactcggatgggagcgtgcctgtccaaactggtagcctgcatcctggtgtaacaaggctcaagctgggaacactgggccgcgagatgaccccgtgacgaatgtggcatcgaacacttcctctccagaatgccaggaggcggaaggagcaagcgaaacaggatcgatccgcaaacacgcgcagaccttcgtacgccctcagtgccacagagtggtgaagttcaattaccaatccggccaccatggatggcagacggggcagcagaggtgggcgcacagagcaagggctggaacctaacggaggcccacaacaacatatctggactactaaccggacacaacacgacgaaactccaccagagggatcacgtgagaccaacagtagactcggtaccagccaggaaacagaacggaacccagcaggaagatcaaccagggcagggccaggagaacaggcacccccagagaacgcgaaagaaaagagaaaagcgaaaacagaaagaggaaagagacttggaaaacaaggagaacagaagaagacaaaataggagacaggagggagagagaaaaagagaaagacaaaagacagaggtgaaccaacaacacaagactgcaacaaagagaaacaaaacagggcacaaagaaaagagagagagaaaaaaaaaaacgacgagacggagaagaacagcagtggaagaaagagaaataaagaaaagagcacacaaacaacacacgagagcaag

SEQ ID NO: 577366 - DNA, 167 bp, Homo sapiens
tcctctacacgatcccttatatttttcttgtgaagcaggtaggtcggaaaggcacaggaagatgacaagtacataccagcttcggttgtggaagagttgtacgaagaaggcaactgaaattggaccttctggctgcctagagttcaaccctttcaggagggcaccta

SEQ ID NO: 577367 - DNA, 174 bp, Homo sapiens
ctaatagaggagtgggtatatagtcggggatgcagaagccgcagacgactccccttcctccagggagactacaggcaagagcatgtaaacccctttaccattgccccgccaaacacagcgcgccctgagagggcagggccagcagtggacaaccaagagaggctgaccggcgcc

SEQ ID NO: 577368 - DNA, 560 bp, Homo sapiens
tgccgctctgtttgccaaccgtccagtcccgcctaccagtgccgggcgctccccacccctcccccggatcacccggtgtcgacatggcaaagctagattttctcttcaagtgcatgcacgattacggcggactcgcgcggtgggcaacgacctgcctgattcccttcgccttgcacgagtgaccaacttacaacaaacactattaccatctccaccaatcggacatagaatatcccaacgactccgcaactgagcgactctcccgacggggaccagacagactcaacgactaccacagtctggggacaccggcgggccacagcacgcgagttcccacgcacaggaccaactgacacggcatcactcaccgaggaagcaccacgggacaatcatcgccagtcataacgaccatccccgcgactgagcaaatctctgcagacgacatatatacgagcgaggcatggcgaagagccatccagggagaactgcgcaacggtgcgggtgaagcagcctacggacgcggaaccaaatgtgaccctggcacgcgccacacggaccgc

SEQ ID NO: 577369 - DNA, 92 bp, Homo sapiens
tgagacagagtcttgctctgttgcccaggctggagtgcagtggcgagatctccccacaacctgtgcctcccaggttcaagcgaccctcccgc

SEQ ID NO: 577370 - DNA, 822 bp, Homo sapiens
gactacaccggtgtatcatgggagcgagcccgggtctacacgttcataaacactaaggggagtcgcgcgaagctgaacttgagcgctcgatgcggggccagatagccgccctagagcgcgcggagccgtagaaggcgtagctggatttacaacgcgatgcatctcggtaggtccaagtctactggattgaggtagaagaagtgacatgatggtgagctcgaatggcggcaggctccggaaggcccggaggatcatagggcaggcggaaacgcgtcagggacccaagctcaagagattaccagacacccgcgtcgtattgctaggcaagatagtacgttggcgaacggagttttgatacgtgtacgatggcgtacaaggcataacgtagtcggtggtcgatagacgggttgagtgccagcatagagttctctcggtatgcacacctctgcgatagtcgctcgcgcccagcaggaagacgtggctcctgatagagtgcccccattggtacaggtattatagctgggtcacagagtccgaacggtaaggggatagccacgccatgcctggtctgagaacgagggtaggggaacgacacatggctttgctgagtatgaagaggtagagatagacactgtgtgaattcgccgcacttaggtaaggccgctacaagagggcgggactccaaaattaggggaagaggcgataaagcaagaggtatcagggcaggaccaactgaacctacgggaaaattccccaagacactactaaaaactgaacttctcttcagatcccgaaatttggagctgcaattgctagttcacc

SEQ ID NO: 577371 - DNA, 426 bp, Homo sapiens
  misc_feature (6)..(6): n is a, c, g, or t
  misc_feature (14)..(14): n is a, c, g, or t
  misc_feature (65)..(65): n is a, c, g, or t
  misc_feature (76)..(76): n is a, c, g, or t
  misc_feature (157)..(157): n is a, c, g, or t
  misc_feature (168)..(168): n is a, c, g, or t
  misc_feature (184)..(184): n is a, c, g, or t
  misc_feature (192)..(192): n is a, c, g, or t
  misc_feature (226)..(226): n is a, c, g, or t
  misc_feature (237)..(237): n is a, c, g, or t
  misc_feature (255)..(255): n is a, c, g, or t
tccgcnctcacccntaaggctggccaatggtgctgcgtggcgtcagggttgtggagcctggcagnctggcccgggncgtttctgcggaatggtcctggcggacttcggcgccgaggtggtgcgcgtgaaccggctgggctccacgggcgagaatttnctggcccgagnaagcgcatcgctagcngtggaccntgaagcgctctcagggagtcacggtgttgcggcncatgtgcacangcggacgtgttgctgganccttccgctgcggtgtcatggagaaactccagcttgggccagagactctactgcaggacaatccaaagctcatctatgccaaggctgagcggatttggccaatcgggaattttctccaaagtagctggccatgacatcaactatttggctttatcaggcgttctgtcaaag

SEQ ID NO: 577372 - DNA, 429 bp, Homo sapiens
catcaggccggtagccgcccagactgcacaggctttgaacatctggaattgccaatgggacaattggaacgacttagcaacaagaagactcaaccttggacagcccagaaagtcacaccaaggaatccttaattattacattgaaaattaccccaagttcaggatttcggcacaatccctgttttgttaaattaattgacccttgaagaccagattggcttggacaagggcaaactgttctccaagagtccttaatgacgggcaggagtcccagggaagagagaccatgccatgctgaaaaagaccgaattgaagaagaaatgtagcccccagccggtacccaccaaaggagagaagaagcaatagccgaggaactctgcggggatggcgaatggttcctgcccgggcccaaggggtgcacagggcact

SEQ ID NO: 577373 - DNA, 809 bp, Homo sapiens
  misc_feature (659)..(659): n is a, c, g, or t
  misc_feature (671)..(671): n is a, c, g, or t
  misc_feature (678)..(679): n is a, c, g, or t
  misc_feature (685)..(686): n is a, c, g, or t
  misc_feature (792)..(792): n is a, c, g, or t
cggcgtctcgaggatcccgacggctcaacggaactttgagacagaatattatgaacttcaaattacttgtaactaacagagatatctgtggagctcatatcttaaccttgtatggtgttgagagcgggtacgttctgatgagactgtataaaaaaagaagaaaatgaagaataggaactaagaattgatggagcaaagagaaaatcaccaacagaaagagagtcatactcttaagtgcaacattactgaaaataagtccaggatgtggtatgtcagactactggctacagggaaggtacttgaaagtatgcccaacgtttgtagtctctgaaaatcagtttcttgggagtagtaaaagaagaggagaggagaggcactcttcagagactatggcataaacagaaagaagaaagtaagagggagaattttaagggtcctgcagaagtaaaagaaatgtacaaaatcagagatgaaccaaatcctccccctgctaccagaaaaagaaaaaaaagctattcatgaagaaaactgcacttcactatgctgacgtggatactcatgaaagagaaatcctgaagccactacagaatgcttactgcagatagctgttatggagggttttctagtttagaaatttcacaatatgtgtagaaaaaatntatgtatgcaangttcctnnaagccnnaatagaaaatgaaaataaagtctgtgaattgatgaccgttcctcctcaaaccaccataacatggaagaagattgacttagcagtatactttaattgatatttaacnatcgttttcagatataa

SEQ ID NO: 577374 - DNA, 438 bp, Homo sapiens
agtcggtaccggctgtggaagacgggggattggaaagaaagattgcttagaaaaaaaactctagtatcagattaacctttgattcttgggaagccgcagggacacccgatggtgtgcagctgcccacgacgcccctcctcagcatgaagcagcgagacggatgcgtggcctgattcctcatgattgaggaattgacgaatgggggggaagggtgttgaaacgggcccaattgtcccatagaactgatgtctatggtttcttttaaataaacatagaaattgacccttccattctttaaaacttgggaacgttacatttgtcttatctgagctccttcctcaggaaaccaaccagcagtcctcctaaatagtatcaaggaacagagactcactagatcacagcatctggacagtgagaccctagacccgtcttccacag

SEQ ID NO: 577375 - DNA, 1264 bp, Homo sapiens
  misc_feature (660)..(660): n is a, c, g, or t
  misc_feature (673)..(673): n is a, c, g, or t
agcgggctggtgggctctgccggcgccgcggcgtcctggctcccgctgggtggggcttcctgggcggaggcgccgcccctgggcggtgccggatccagtccgcttgaccttattccctagctgctgtctccggccccctgaacccgtacagggttggggaagtgggggtggctggaggaagcgcgcgcggggcaagccagtggggctgaggaggctcccgggcccggccccgcccagtctccgccccagccaggcccgaccctgccctccgaatgtcttacagctgcccgccccagagtaaggcccggtcggttcccgcgcgctcccagctccgtgcccgcgagcagagactggaagggctgtccttgctcagcggcttttggtgatctcatccgccctagaagagggccacctaaaagcggggtgcgagaggagagtgggagggcctcctcttggtgtcccaggcacctcagcccggcagaggtggcggaaaagcagacttgatgctttaacacgtccatagcaatcgctttttactggaaaggaagttctgtatttagcgctgtgtaattctgtggaaacgtgcattcttgtctttgcgggaaagctgttctctgtgggcggagaccttcagtcccaccctccccaggaggcgcctgnggacccttccaanctgcagtcaagttgaccaagaactgactgcaaggtgctggtggctctgggatgagagccttttggtacttacagggaatatgactcttcccttagatatcaaatggacccaatatctagggagcagcttcttctccatccatctgaccgttccgttgtgagaatgctggcccaataacatactctttttttttcccctaaaggaataaaaaaatctgtatttttaagatgtcaaatctccagagtttttagatgttagcaactgaatcagatgtttttaaacttcatgagctgattaaaccacacagatgagctgtcagtttacgacccctggcttggcttggaggaaagagtgaagagaaattccatggccaaatcctggggcactccaatattgggagggtaatggagaaggagtctgaaaggcagcatctaggaagtcatgaaagctagcgctgagttgtggaatccctgggcagagaaggtttcaggtaggaggcatcagctgagcggtgtgataaacttgggccagagatgtggctattggattgggtcacttgcaagtcactggagaatgtcactgatggccttg

SEQ ID NO: 577376 - DNA, 133 bp, Homo sapiens
cgtagtgtaacaagtggaggaggaggagggggtgagaacagctttcctccagccctgtgacacactccttctatgtgtgtacagtgtccataggcatcacaccttcttcattaaaaacccagtttcctggtca

SEQ ID NO: 577377 - DNA, 165 bp, Homo sapiens
tggtaccatgcgcgatgcttcatcaagagtactacaatcttcccatgcacaatgatgataatacagatcttagcagaatcttgaaaagcccagagatccaaatgatgcccttctgatgcacacactgcaatgaatgatccactcgcatgaatcacatgtttgggg

SEQ ID NO: 577378 - DNA, 406 bp, Homo sapiens
ccatatgtccaaatacagtcacattctggggtgctagaggttcacctccaccctccaaatatgtaggggccccatgtccacagttacacttttgtcaaagtaaaatgtaaattagccctagtgttgggggcggtggttcatgcctgttataccagcactttgggaggatgaggtggtgagatcacctgaggttggaagttcctgggctagcatggccaacatagatatatccagtctatactcactctcacgaacttggctgggcatggtggcgcatggttgtactcctaactgtgtggggtgaggcggtagaatggtttcttcccggcaagtgtaggtggtggtgatccgagatgaccccgtcgctgtccagcatgggcggcaagagatcaagtccgtgtcaaat

SEQ ID NO: 577379 - DNA, 381 bp, Homo sapiens
ctgcatgtgagctcaccatcttactcatatgtgtgttccaacacgtgtcacatgatcagcactttgcacagtgtgcaagacaggcatgcttcatctgcacagaaggaactgatactcacgacagcgtgtttattcacagaatacaatgcccgctattggtaaagtgtcccagatactgtgccaacgtctggatattgttatgtgttttccctagaacttcgatcccttattgagtgtctcggctcatatgttaactcagttccgatgtgacctctggccgagcccattcatagcttgtatgataggtgacacatcatgtagatttatgattgtgacagctccatgtctggtttttagatctagcagtgtgtggtaaacttg

SEQ ID NO: 577380 - DNA, 158 bp, Homo sapiens
  misc_feature (20)..(21): n is a, c, g, or t
  misc_feature (71)..(71): n is a, c, g, or t
tggggcaggcgtacgcaggnngctcttggtagtactccaggaaggcgcggcccacactctgcgccaccggnctcatggactcctgggagacaaagacgtggcaggcgaagggctcagcagggggtgtttggtgatgaagccgaaatagcagctgttgc

SEQ ID NO: 577381 - DNA, 205 bp, Homo sapiens
gggtttttaaattttgattcaaaagtagtcccagctcaaaggggttcaaactgtttacacccagaacatttgtcaggctctcggtcagctttcatggacaaagggaaaaaaacccatggagttaggcccttcctggattttttttttaagaaaaaaaaccggtatttaaaatgtaaaataaacttttaaaaagccggccctaata

SEQ ID NO: 577382 - DNA, 316 bp, Homo sapiens
acactgtcgcatatctctatataaaatatcaataattgtttaatttcaggacaaaggacatggttaaaaacgtttagttcaggttggttaaagaaagtcaacctagaactagtggatattactttatatctgacagtagatcattatttcttttcaaaaaggatatgccagtgatgattattgtcttttacagcagtatcttgtgagagtcttaaaatgtttcttcttttataattcattctacgttttaaacacatgaattataatgtatgcaaagtgtactttttcaagtcagtgtagaatattcgacagtagt

SEQ ID NO: 577383 - DNA, 642 bp, Homo sapiens
  misc_feature (515)..(515): n is a, c, g, or t
attgaggatgggaacacatccgtagtgcctgaccaggagaaggagattgagcggttgaccagcctccacaccatgctcgagggctcacacactgaaatctgtaaggatttatctgagcgaggtgacgctgcgactaaagcagccaggcagctcccaagtgacggattatcgttagttgtggcacgagctggatgaggcagattaccgctgcattcgtttgatggcaatgtagacctgcaatgcttatgctgggctatatgacatcattctgacgaacttcgagaagttcacgaagcccaggatagaatcactggctatgacctattgagagccttctttcccatagtgcgacgagtacagtatagtccttactgtttattactgctgactcgagagtctctccagacttgcttatgatgagatatggccgtaaccttgcctgtcagtcacactatcattaggcatacgactagtaacaccaacaccaacctctgcctcataggaatgaaagggangcaacgcgctacggcctcagcctaattggcttttagcatggagcgagttaatgcaggcgaccgagattccgaatgtactgggcccattaggcctgtagagccgtttaacgttgatggccggtggctt

SEQ ID NO: 577384 - DNA, 233 bp, Homo sapiens
  misc_feature (22)..(22): n is a, c, g, or t
  misc_feature (120)..(120): n is a, c, g, or t
  misc_feature (141)..(141): n is a, c, g, or t
  misc_feature (194)..(194): n is a, c, g, or t
  misc_feature (228)..(228): n is a, c, g, or t
cgaagtatctctgtttgcagangatatgattctatatctaggaaaaccccatgatctttggcccaaaagctcctagatctgataaacaactttcagctaacttttcaggagacaaaatcnattataccaaatatggtagcnttttatacaccaacggcattccaagctgagagccaaattccaggaatgcaatnctaattcaccaattgccacaggattttcctggantacgc

SEQ ID NO: 577385 - DNA, 1967 bp, Homo sapiens
ttttttgggcccctaaaagggtcaagtttccgggggaggtgtttgggaaatcccccccttaaggccctccatttaagatgccgggttatttggcccaaaaaggggcctttttccccaggtttgtttttttttttttggcccaaaaaaaaaaagggggccttggcccaaatttgggggattcaacctttccagaatatttcccaaacccttttttttttttttttttttttttttaagcaagcccccaacaccatagaaaattcttgatttgctcggaggataattggatgaaggattattttcttctttgtttatgtgcaagaaatgaaaataaggaattgctttgatcagacaacttcttatctttgtggtagaaacagaactgcccttcttggagtggctctgcctctgagatcactacaggggagacagcatgccctgttcagctggctgaatatttggcaacaatctcctgaagcagctggaattgacaagaagtactggagattagctcgggccaaacccttacatctggcctgactactgctgcagtctgcctcaacttacccctaaagctggggagatgccacccacccacatctttgctacacatgccatcatgagctagagttcaccctttctccttaaagccctatttacttttctacttcaactttaaaacaaaattaaaatgtgaggatatccctgaattttaaaaagcatgaagtaaaaatgcaaattagtatagtttgtttaatacattacatatagacctaaagaaagttcatcagggttaatcatttgtcacatcattctatacccagggctatcagctatcaattttcctttttttttttttttttttttaattcaggatccagctctgtcacccaggctggagtgcagtatcaaagtatcatttctcttacttcaaattattacattttattctgtacattgattctgaactcctaatataatatttatgtcctgtatttgcaggccattggtttttttaaagtcataaatcaaaatgatgccagaaaatcaaagatgcccaagatgttgggcttctcttttgccagccacattggtagcactctcctgccctggcctccaagctggtggggatctgtgatgtttgtgaaaatgggcttatgccaggcgcagtggctcacgcctataatcccagcactttgggaggccgaggcgggcagatcggttcaggtcaggagatcgagaccagcctggccaacatggtgaaaccccatctctactaaaaatacaaaaaattagccaggtgtggtggcacatgcctgtaatcccagctactcaggaggctgaggcaggagaatcacttgaaacctgggaggcggaggttgcagtgagcagagatcgtgccattacactccagcctggggtacagagtgagaactctgtgtccaaaaaaaaaaaagaaagaaaatgggcttgtgtggtagcaggtaagaaattgaatctctgttgtacagcagctagctgtactgcatgatcacttcccattccccagctgacagtggctgtctctggaactcctaccacagtcttcaattggtaggccagccctggtgccagtgattttatctgggcatggaaaatgccacttgcttctgtggaagagacacttaaaagatctggcagtcggccgggtgcggtggctcacgcctataatcccaacactctgggaggtcaaggcaggcggatcacgaggtcaggagatggagaccatcctggctaacacggtgaaaccctgtctctactaaaaaaaaaaataaaaaattagctgggcgaggtggcgggcgcctgtagtcccagctactctggaggctgaggcaggagaatggcgtgaacccaggaggcggagcttgcagtgatccgagatcacaccactgcactgcagtctgggcaacagagcgagactccatctc

SEQ ID NO: 577386 - DNA, 156 bp, Homo sapiens
  misc_feature (86)..(86): n is a, c, g, or t
tcaccaggctctcagcctaattacacacgaccaaagggctgtgtgcaggtcccatctccttagatgaggttaacaattcccacttnggcattttcctttcaggctatgcctaccttcacatgtggctttttttcttcttcttttctttgagacaga

SEQ ID NO: 577387 - DNA, 419 bp, Homo sapiens
  misc_feature (42)..(42): n is a, c, g, or t
  misc_feature (91)..(91): n is a, c, g, or t
  misc_feature (130)..(130): n is a, c, g, or t
  misc_feature (186)..(186): n is a, c, g, or t
  misc_feature (217)..(217): n is a, c, g, or t
  misc_feature (345)..(345): n is a, c, g, or t
  misc_feature (393)..(393): n is a, c, g, or t
gaggatcactgagggagtctgtccatacgagtcaaggaagcnaggcattgcaggactctgcttggtggggctagtacaggccccaactctncacttcgaggccttcctctagattcttgaggagtaggtntctcggaaaggatagtcactagtagaacacctcctccaccaggcaaacctcctagncaccgaccggatccaggttgtcttggaggtncccctgccagtcctacaggtagatctggctcaggctgaggttttgctgaagggactgtagtggttcctgctctaagagtagacgctccaggaggactcggtgtgacaataccagcatatggccctcgnggatcccgtctaaggtatagtagattgggtatcagtcactatggctancttctagagagtcatctgactgcaaa

SEQ ID NO: 577388 - DNA, 334 bp, Homo sapiens
tttgccatccccctccctccctggggccggccctggacccgtcaggggcctgtccccagccccaaccccactcatgccccgtggtcctcccagacaaatgaaaccccgctgggcttccgatgcccccgcttgccgggtaatggttcagctaatcccatggcgaaatgggggctccctccggaggaggagccaggcagcagggccttcttgaccaacagccaggtttgtccttccccccaggaaacacatgttcttttggggggtcatgtatagcccccagaacggaagatagggcggtatataattgtaataaaaacccgttgcccctttttta

SEQ ID NO: 577389 - DNA, 266 bp, Homo sapiens
tgtgtcacctctgaaagcaccaccctggaggccccgtgatttataaggacagtagttaatagtttctgtcatcagagaggtcagtgtgttctgttcccatattgttcagttcaataggcctattacttggaaatcaagacgcattatacctatgattacaaacatgtctggggatgatgacattgtagataactctccaaccacaaagtgcaagaaagtttcccaagctagagttttttcattaaatgtgcacatttatttgcaaa

SEQ ID NO: 577390 - DNA, 163 bp, Homo sapiens
gcttatacctgagccataagctcctcgagaaaagggtgtgatagaattcctttgcccctcagagctggaagatcatcattgataggatcctgatgttaggtatgcccatcaattacgatgaaagttctttcctggtttgaacttgcggataaaagactattac

SEQ ID NO: 577391 - DNA, 266 bp, Homo sapiens
agattacatgccttttacaacccctatactgtaccaggcaaggatagtggctattgaaagaaccaccaggacaggcttatctagagacacattttgtagagtgttaactatacaaaaaaaagacactgttcagtttaaaaacaaatcttacacagccttacatttcaatttgtttctttaaaaggagctatggtgtgacaggggacctaaatgctttatagacatgaaaaaaaataactctcttggaaccaacttatccatcatca

SEQ ID NO: 577392 - DNA, 340 bp, Homo sapiens
gtggactgtatttcagctatgtctcatgttttatatgattaaattatcattgtttgtcctttatgtattctcttctacagtacaacacattgaaactgtattaacttgttatgttgtaatatttggctgctgaatttggggctactaatattctgcagaaaattaattgaatacctattcaagagatagttgtaaagatattgtatctcctctaatatactcctaaaaaatgtatttggatagcttgtttagggaaagaaaatgctgccccgaaaattttccacttaaataggggaggggccctatcccacaaaagctccatttcatatcaagtacattt

SEQ ID NO: 577393 - DNA, 225 bp, Homo sapiens
gcttagacatgaaacaaaaaaatccattctgtgaattgaacataaaaggtatcttgcttactaaaaaagtgtacttcaatatataagtcttttgataaggaatacagcacaagactttcttcactattttgtttacacatcaggctcagtctcactgaagagaggaatgaatcatgacattaccttacccagccacaggcaggcaactaaatgtgcatggatatt

SEQ ID NO: 577394 - DNA, 371 bp, Homo sapiens
gtaggattgtaagagtcattaagaatttaaaagacattaagaacaaagtagtcttgatctgcgactacatagtattttaagaccaaaagtctatatacaatttagtatatgctactaaatagtcttttaagatactacgacatagtctgtattgaaaacatcctatgtgtcaacatgtatctgcttttgcagggtgtcagggcaggcagtggttgtagtttccacgaggttacaaccctgttcaaatttagaatcaatgtcagtagggtgtcaaggcaccattgtgacagttacaggagagaggactcatggtgaaagttaccctgggtgaagactcctgccttgagttcatcgtccaggtggcaagagag

SEQ ID NO: 577395 - DNA, 154 bp, Homo sapiens
acactcaactgcaggagcgtgttaggaggggtcggggagaaatcaggctctcgaagctcataaaattcaacgtgaggagcatgaacaagtacgcccgaagcacagtggacggtcataaaggagcggaggtgtcgcagatactccttccagggta

SEQ ID NO: 577396 - DNA, 402 bp, Homo sapiens
  misc_feature (233)..(233): n is a, c, g, or t
  misc_feature (253)..(253): n is a, c, g, or t
  misc_feature (294)..(294): n is a, c, g, or t
  misc_feature (298)..(298): n is a, c, g, or t
  misc_feature (303)..(303): n is a, c, g, or t
acagagcgatgtaagttctggaggcctcgctccgcaaccgacccgaggccacagtgcctccgagatagaccgaacttgtgagacgggctccgatctcccgagatatggaaggtactaagacgtacatcaacagcaccatgcaagagagctacgtgagccagcgctgcagtcagcccctgaaactgaacacgagttttaagattctgtaccgagacaccatccaggaactcacngctccattacttaccacagnccaggcgaaaccaggagagacccaggaggaagagactaacncagnagagnagccatttattgaaactcctcgccaggatgatgtctctcgcagattcatccccccagtcaggatgatgtccacaggtgcccagcttcactctgttgggg

SEQ ID NO: 577397 - DNA, 1157 bp, Homo sapiens
gcagtgtggagcagggggcagtgacggggcgaagtctagtcgggtgtgggagagagacagtaggttgtgacgtcggtagggtggcacgacggtaatgatctgggctacacgtcagagcagcagggttgagcggcgggttagaagaaccaatcaggtgctgggtcgtcgatgttaacagaaaggcggtggtttttccccgcgctctggggggggggtcgtctcgaagtagtgggggggcaccaccctgctggtcgtcgcggaggagaagtgtctctcgcggcgtcccctttacacgcccgggaatgagcgctctcctgtttaagagccgtgtggcgcccctgttgtgagagacacaaaaaatgcgggagacacccgggtgggaagacgctagtcgcgcctgtgccccggggtttcaccggctcttagagggacccccgcgcagataagtgcgccaccttggggaacgggcccccgcccagaaaggaggtggccccaggttcctcacaggcattccagcaattcagacctataacctgtacttccgcctgtgtcaaaccagtttccctggagatcccggtatttggcgcaaaagtaggtctcctgtgcccaaccccccaagctccaagtatccggagttcgattcctgatacccaggcccagtctatcaccaggattctctccacgccagttcaccagaagtatctttgcaccaacatcttgtgaactttgtggacacttacccccgaagtccccacgccctccccaggggccacacccccacaatggacctggaaatggccactttcgactttctttccctcttcacaagatggcacttcacgccacgaggagtatttctctcccaaaatgctccacgttcttctcccactcctctatccctcgtgcctccttactaactctggagttctcccaccctatgagacctattgtgaaagaaaagaaaataatccacgatttcacgtttcccccatgagaaacttctgaggcagccaccttatcttggctaaatagaacctcaccctgctcatgaccacgagaccactttaggataataagatgaccctaactgaaggaatcccttgtatatgaaaggagttattttagaaaagccatacccaactattttattcatcata

SEQ ID NO: 577398 - DNA, 311 bp, Homo sapiens
  misc_feature (56)..(56): n is a, c, g, or t
  misc_feature (65)..(65): n is a, c, g, or t
cgttcttcccctcccccaaatcaacaacctcaaaatgttctcttcccgtgatttgnagatccatnaaatatatgtataacacaaactttttgaaaaccacctctatgttatccacaaacgtttctttttctttaaatttccactcctcattctacaaaaaaatcattaaaatttcggttattgattgacttttatgctccttattgatccacaccccccttcactgaacccttttatgtttggttatcatcacgatatatacattttatttctcattcgagaagaatgaatgaatctcattcggtactatt

SEQ ID NO: 577399 - DNA, 253 bp, Homo sapiens
tccataatagtcaccgcaccagcagaatcaatatttaaagcattttgttaacgtaaagtgagccaagatcatgcgattgcgctccagcctgaacgacagagcgagactcttatcaccaaaaaaaaaaagaaaaaaagcagttgaggacttaaaaacgggttttaaaattttttccccaattagaattccttagcccggtgagtgagcgtagggtcattgggttaaaggcgccgccgtgaaaggcttttctcaa

SEQ ID NO: 577400 - DNA, 214 bp, Homo sapiens
ccccattttttttcctgccctaattaaaattttttggcgggaagggtattatgggttcccaaaaacaaaaagccccaccctttggcctgggctgtgctgaaaatgcttaaggaaaaaagaattttctgctaaaatttttttttgggggggagtttcctctgtgaggggcttgcagctatccctcctggggaaacaaaaacagtattttccatga

SEQ ID NO: 577401 - DNA, 856 bp, Homo sapiens
  misc_feature (419)..(419): n is a, c, g, or t
  misc_feature (559)..(559): n is a, c, g, or t
aacataatagtagctctaatgggaagatatcgcttcgatattcctgcatgtatcaccagtgtatctgcattgatcagagaaggctgctcatatttgcaaatatcaggttaccatctcaatctaaaattagtagctctaagtgtgttgcttcgtatagaggggacagtacgtgagtcactgttgagtaactaccgtctacactagtgataaacccacatccccaatagattagccagtcaatcctgtacggaaggtactgtatgatcgaccatgtttgaactcgatataaatagagatgtaaatgtctcactgaggcactgtgccctagtgtggtactcgagaaaagtggcttcgtgtaatttccagtgcaattccacgtgtcgacatggctggccccgcttctgttgatgcatcgctgnctgtgagacaggggacacgctggagtgtcagtggagagaggcaacagcatcacacacggtggcactgcttacgtccaaaaaacgttacggttgtgaatgtaatgcccttaacagcaaaattccaacactctttatcatgncctctctttgctaatacagggatctcttcttaactgtgcatacctgctagcgactgaaagacctttcactgacctattatgccgaaacaagggtaaactaactaaaacaaatgcccacttcttcaatcttcaactccttggaaggttatatcctagggtctgatcgacaagtacgttggtggtcaccaggtttaggggtgacatagtattcggacaatatgctaatggctccctacttttcaaccatgaactcccatagaacccttttccctttgcgcggttcacataccctatgtt

SEQ ID NO: 577402 - DNA, 379 bp, Homo sapiens
tcaaaataggggggttgggcgcccggggcccagttttttaaacccctggtaacccgacccggggggtctgggccccggttccccccccaggtttgggggtcccccggttttcccttttttggtttcaaaagcaaagggttattttagggccaaaaagggggccccgggaaaaaatcgggcctgggttttcccccccctttttttttcaggggcggaatttaaagggaggataaagccccggggttggggggggttttggggggggggggaaccctggggaaaggggggtgggaaccatccccccccccggccttggggaaaccccttggggggctttaagggttaggccggggaaaaattaaaaatttttttttttcca

SEQ ID NO: 577403 - DNA, 224 bp, Homo sapiens
acaatgctataagacgacagaaggaagaggtgcgcagtattttaatgaccgatatcacaagaactcactattgcaagaatggcactaaggggaaatcacccccatgattcaatcacctcccatctgggtccatctccaacattggggattacaaattcaacatgagattggaacggggacagggaaccaaaccatattacatacaaaaaagggtatatgccaag

SEQ ID NO: 577404 - DNA, 951 bp, Homo sapiens
agttttgcacagactccggataaatgtgacggctgccaatctgagtagtactcgaatgtgacgaactgctggtctaggctgttttttccattagattcagcgtgatcatattgatcagatagtataaacgtaaatagcttcaacattttgagaaaatgctggaactcgcacgatgcttgtgttcgacagtatcaaacaatgtcagtgctttatctctaataagttctcttctgtatcatggcattggtctacttgccttattcacgatatgtcaatctatgcatttgtagattgtcacatgtagatatgccagttatttggccagtcggtcatctatataggctatggacctcaacggtgcattattagaaagacatgaaattctaggtctacccacctaagtttgctatcagatatgttactctaatgcacttaacagtaagttgtagaacaatagagagctgctaagtctctacgctgcgtcgtctgtgcactgtcagagtgccatgaaatgtaacaacttaactggtgatttcctcatagcatttgtgagtagctagcttgctacctgtgatgtctgtgtgtacgaaaagacatttggtgagagtcttgtactcccttgtgtattttggacagtaccaattaattgtacatacttggtctatattacttgtaggaagatgcgttagaccaatgtacttaccgtttatgcttgctcacgaattccagttagtcacggaagctgtggaccattacagtaacctcataaggggtaggaaaacacaagctcactgcctgggcttgtgccgctgacgttgggaccaacaattaaaggtcgtcctggcccagtgaatactggtagcctggcatgtggacctttccagcaaagctccctggaccttaaacagcttgagaagaccagctccgcgatagtgccataatatttcaaaa

SEQ ID NO: 577405 - DNA, 537 bp, Homo sapiens
tgctggtaatcccagacttggggaggcgaggggggtggatcaccttgagatcagaagtccgagaccagcctgggccaacatagtgaaacccctgactctactaaaaatacaaaaataagccgggtgtgggggtgagcgcctgtaatcccagctactcaagagactgaggcaggagaatcacttgaacacgggaggtggaggttgcagtgtgccaagatcatgccactgcactccagcctgagcaagtgtgagactctgtttcaaaaaaaaaaaaattcttctggccttaacccagggctgcctgcttgccgggagggggaaagaggctgagggaaaagagggggccggggtgtgccccaagaccgggtgcctcaacttggcgggggctacctgatccctaggtatggctcccagtatcttcctggaccgggcgcgggcgctcatgcctgtcaccccagcacttgggcagcgcgaggggttgctcccctgagatcagaggtccgagaccggccgggccaatatagtgagcccccgtct

SEQ ID NO: 577406 - DNA, 410 bp, Homo sapiens
agatagtgtgttagaagtgctgtttggttcaagaagtccatctcttttcttcatgacgacgccagctaatgatttatagggggacacttgggattccatcttgagctgagttggatagctcaaataaatcacttataaggagcaaagggcctcttcagataccagcacataatactttctatacagctttccaatttgaaaaggaaattgatgaggtggtacataaggctacctttaggcattaggagttttctgtttatgaggcataaaggaggctggacggcgaggttcataccaacatcccaatggcatcatgaggtgggaggagaggcattcctctcctcccacctcaaagacacccagagcctgatcttagagaagcatcaatgcaggcgtggtggataaactgc

SEQ ID NO: 577407 - DNA, 1108 bp, Homo sapiens
  misc_feature (646)..(647): n is a, c, g, or t
  misc_feature (694)..(695): n is a, c, g, or t
  misc_feature (737)..(737): n is a, c, g, or t
  misc_feature (786)..(786): n is a, c, g, or t
  misc_feature (790)..(790): n is a, c, g, or t
  misc_feature (796)..(796): n is a, c, g, or t
  misc_feature (826)..(826): n is a, c, g, or t
  misc_feature (833)..(833): n is a, c, g, or t
  misc_feature (835)..(835): n is a, c, g, or t
gggttgtggggacgccgggagggcggcgcggtactttccagaaggttccgcaccggaagcgcctgccgaggccggaggctgggtgcaggggcggagacgcggagaacttgggatcctggtttaagggagctgggaagctgccgcaggtttgtttaaacgatatttttttggtggcggaacacgaagtaaagttttccgtcggcgcagttcctgcgtgtgctgttcaagcggcctgaagtgcgttcaggttcggccgggctgtccctcctcctggtcccgacccctcaaaccccgggccgaacaccgccctctcctgcgggacagtctttctatggccggcgcgtttcgcctagcagggtcctcagagggaccgcgttagagcctgggtttccttccagggggaccagcgctccctgggtggaccgaccccaccgcttacccattgctggacgcctgcgtgcaccgaccccaccgttacccattgctggacgcttgccctgttgccatctcctcgctagcgtgaacagtgctgcgtgcagatctctctttcattgatgtttgcgtctgtacccagaagtgggattgctggaccatctctgcccattttaaaatgggaaatgacatgatctgatttaagctatttaannaatcacttgggcctgggctcggtggctcacgcgtgtaatcacaacannttgggaagccgagacaggcggatcacctgaggtcagacgttngagaccagcctggccaacatggtgaaacccggtctctactaaaaattcnaaanttagcngggcaggtggtccagctgtaataccagtantcaggangntgagcaggcaagtgttgaaacacgaagcggaggttgccgtgagctgagatgctcactgcatcagctgggcacagagtgagatctgtccaacaacaccgacgcaaaaaacactgtggggcgcgcccccaaactcccaaccgtcgggccgggccgtgtaggacggccaccggcccagcgccgccacgggggtcccaacaaccggaccgcggacaccggcggcgaccacgccgcgaaaacacgaaagacaccgcgaacaccaacaccccccccgcg

SEQ ID NO: 577408 - DNA, 1002 bp, Homo sapiens
tataaaatttttaatataaaaggggaaataggtaggactaccgtggtaagggcaaaaagtgtggggagaaatggggtgggttggttttttccacaactgccattaatcattttataccgtatgtaaatattgggagagctagtggtagatctcgaggtgggcatgtaacataaacgcgctgtaggtaaacagtaagaagtgttaaaggagggtagataggggcgcaactagatcgagcggcggcgactagatagacgcgctatcggtctaaggcgagaaatctctccagataaatggcgcccacttgggcgcaaaaaaacgcccgtgataacgccgaggagagcaagcagccctccctaggcgagaaggaagcgacgagagtagcgatcggaaaatcaacagcggggttgtaaaagccacgtgtcaccgcttagtttccaagtgtcgccgcaaactactatcacaaaacggcgccagaaggaccgacggaagttcaacagtctgtggcaaacttaagcagagcgaaaaatggacggcataagtcaagctctgaggccactaacctctattacaactttagtgtttaacttctttacgaagcaaagtggggtttactgtctacagcggagttttggtaacccggcttcaaacacgtgcctcatttattacccaactccccttaagtggggggcgaaacatcgcgacagcgaagcaaatcggcctaacagaaattagcgcggccgataccccaaggcgtatttgaggggtatataatcacacacccctacaaaatggccccgtgactaatacatgcgggcacacaccatctgtcgagcatacatcggtcacgagccaacacaagcgcatcacacctactaaacacgacgcgacaacaacatctacgagtaacacattactaacgaaaacatcggcagcccatacgattctcgactattttgaagaaaccaacacgacgcccgcgaattgataacaaaagagacc

SEQ ID NO: 577409 - DNA, 1364 bp, Homo sapiens
aattatagatcatagtctcactctgttcctcggacgttgtgcatacaggagagtaagacctatgtacattttacctagaaatgtgtggtgcgcaacgtgatacatcattagtgttgcgagttccggtcagaaccgtgccaatgtcagtgcctgaatcagagacccgtgtgcgattctaaggcagtatatgacaagcctcttagctagatgacaatcgtcgcatctggagcatagccagaacaaatctcatcgctctgcgtatgcagaatacttagttgaatggtagccaatcacttgcattagcaatcattagcacaaatattttcttcagagaacgaccagccattttgcaatatcacttgagtattggataacaatttccatactcaaagcgcttaatgcgccttacgtctgtcatattgggaagaatcatgacacacgcagaagccttagtaacactgtcaacgagactgatggaaaactatcgtgtcagccaacaagttaaaattccctcaaatcattcgaatgaaccaattatgtaactggggacgaagaaatcctctgtgaaactggtggcgaatccgcgttccgatatcaggattgtcagcacacaatcaagtcccaggccagaaacaactttagcagtgagggaagaatccgcgcttattggtccttggtacaggctcaatgtgggagacagagtcctaacagggcacaacacaagatcaaaaatcctcaacattgaaggacgatgcagccatcttgcccgcaccgcagaacgaaaaagagccgtttgagaaaagtggtgccacgaaggtggtgggaaacaaggcccttataagcccaacaacaggccagggcactagaccagttcagaaacaattcaatggaagtcggaccccctaacgtgcgaccgaagacaagatttatccgacagttgtcaaattggcactggtcgggcacaactcacattgtaggccaacgaaatggataagaacattccagataaccggcacccacagaaaagaactttagccacacctcgtgacgaaccacaccgcttttcgcacatgagagaacccgcactggggcagagcaaaagaccaaccacagccgagaaaagcatcaagcctctaaaccagacaacccggagaagagaccaccacccaggtcacaacagccacatgaattcgaacacggggccgcacaacaccgacagaaggagaacatcgcaaccaacaaaaacagacgaacaccctaaagaggaaaacagagaacaacgaagagcgagacaccaacaacagtcgacagaaaaaaaccacaacactgacgaaccacgacgcatacaccaccacgagagcggt

SEQ ID NO: 577410 - DNA, 539 bp, Homo sapiens
  misc_feature (70)..(70): n is a, c, g, or t
  misc_feature (124)..(124): n is a, c, g, or t
  misc_feature (213)..(213): n is a, c, g, or t
  misc_feature (226)..(226): n is a, c, g, or t
  misc_feature (286)..(286): n is a, c, g, or t
  misc_feature (325)..(325): n is a, c, g, or t
  misc_feature (327)..(327): n is a, c, g, or t
gggggggccgccttaaaccggggggttaacgggaaatttaaaaagggggtttttagaattcgggcccatnggggcccgtgggggggttttttgtattataacacattttccccgggaaaatttngggttaaaaccaaaaatggggtgggtggatttccccgcaaacccaaggaagggggggggggggatgggtttattttccggggttttaangggaaaaaaaaantgccccccggggggggccccccccaagtttttttttcccttttccctagggggaaaattnccggggggggccccatgcccaaagtaacccccgggttcnangggattcccctccccgttccctttgagttggggggcccgtttggggggcccaaaatgtgaaaattttattgggtttcccccaaaaaaaacctttggccgggggccccccccctggggggcccaggggtggggctccccccccccccgggggttttttttaaaaaattttttttttttttttttaaaaaaaatttaaaagccccccccgttta

SEQ ID NO: 577411 - DNA, 101 bp, Homo sapiens
  misc_feature (1)..(1): n is a, c, g, or t
nctcttggggaactgtggtatcctagggtgggactaaacccccgggataaactcctcttggggaaccaaccacctggcctttcccgggccccaataaactc

SEQ ID NO: 577412 - DNA, 844 bp, Homo sapiens
ttctgcgcgatttttttccgttcatgtatgcccctatttccatggctggctatcaaccactaccaacctagcgtttctctaagatggatccttcttctctattggacgggatgatgactctctctgtttttttttctcctccggacataagttcttttttttttcctcacgcgcaagtttttttttggtatgccactccttctttccacgcacctctcccgccttttctacccctttccctccccccctgtgtgggggcgcatgttgcgcccccccacccgctcgggttggctctcccgcgcgcttactacctccttaggtcatccgcccttctcctttacaacacaccacctggctttattcgcgtccgctcctgggtgaggctccaccttcccctccgggcgccccccactttgttctttgatgaatgacacacccccgctgacgcccactcctattttgttgtacccacgccttcgttctctcctcccaacacattttttctgtggtctgtgttttattttttcacccccccactccaccccacgctgcgtggggctctatgtgatgtctctccccctccaccattttcgccggagtattattcggggtcgtcgcactttttgttgttgtgcaccgcgttcttcccgtggctgttttttgtcctgtttggggcggaacatttcttctctcctatgtattggtccttcaccccccctcagttttctttcctgtttcaccccgcccgaagctcttgggtgtgtggcaccccccccattggcgctttttttaagagatgggttttattttttttttttcccccttttttggtggggggttttta

SEQ ID NO: 577413 - DNA, 189 bp, Homo sapiens
  misc_feature (150)..(150): n is a, c, g, or t
cccagtgtcaggtctaggaaattaagggctattcttccccagatacattctggcttatttgagatacatgattctcttagaatcctgtcccttggttcaggaaagtagcttggaaaaggagtaggggtatagcttggtcccttttcctgncaagcgcatggggcagaatataataaatattctgagtga

SEQ ID NO: 577414 - DNA, 100 bp, Homo sapiens
tccccgcataacaaagctcatgtctagaaaataggtatcaatgccatatataaatgtataggtaatcattgtagtagggcgttaatcttacctaccagtt

SEQ ID NO: 577415 - DNA, 272 bp, Homo sapiens
acaaaaaattagctgggtgtggtgacatgggcttgtcccagctactcaggaggctgaggcaggagaattgcttgaacctgggaggcggaggttgtagtgagcctagattgtgccactgcactccagcctgggtgacagagtgggactatgtctcaaaaaaaaaaaaagggaccctttaaaaaaaacctaggcggggttgcaggggctcactctgtgttaaccccagcactttggggaggctgaggtggccaaattaggtggtggtgtcggta

SEQ ID NO: 577416 - DNA, 184 bp, Homo sapiens
cgactgttttgttttgtttttaagtttcagacaagcatgcagagtacattcagtgtgttagatatgaatccacgttctacggtgggtgggtgatcatgtagatcagtgccttgaagtccaggtcgtcacctacatacatggagaaaggctgtagcatgtggtgctccccttctgtcgtcttctc

SEQ ID NO: 577417 - DNA, 363 bp, Homo sapiens
ggtttagaaggttggaaactctttttttgtagaatctatgagaggaaactgagaccattgagtcctatggtaaaaaattgattatctctcgataaaaactagaaaaaaagctgtctgtgaaaatgccttgtgatgtgtggattcatcatctacagagttaaagcttttctttttttttttgattcagctgattggaaacattctttttgtagaatctgtgagggtacattttagagcccaatgaggcctatagcaaaatgctgaataacctgtaataaagactagaaaaaagctgtctatcaatcaaaatgctttgcaatgtatggattcatctcattgagttaaactttcctgaatatccag

SEQ ID NO: 577418 - DNA, 426 bp, Homo sapiens
  misc_feature (27)..(27): n is a, c, g, or t
  misc_feature (33)..(33): n is a, c, g, or t
  misc_feature (182)..(182): n is a, c, g, or t
  misc_feature (249)..(249): n is a, c, g, or t
  misc_feature (350)..(350): n is a, c, g, or t
cgttatcattaggaggtcacacacttntaaatnagcagatcacaagaactcactcactattgtgaggacagtaccaagaggatgatgctaagcgattcatgaaaaatccacccccatgagccaatcacctcccaccaggccccacttctaacattggggattacatttgaatatgagatttnggtggagacacacatccaaactttatcggttggtttccaaatatttggagatttactagatatgttncttttattaatttttaacttagttccattatggttcaagaagattgtcaggcctctgagcccaagccaagccatcgcatcccctgtgacttgcacttatangcccagatggcctgaagtaactgaagaatcacaaaagaagtgaaaatgccctgccccgccttaactgatgacattc

SEQ ID NO: 577419 - DNA, 269 bp, Homo sapiens
ttccccccctggggggggggaaagggggggggctttccccttccccaaaaaggggggcccccccctttggggggggcttttgggcccccgggcctttttaacgggggggtgggggttgttttaagggaaacccccccccctttttccccgggggggggggggccccggggttggggggtttttccccccccccccgtttttccggggttttttttttccccccgggtttggcccccggggcccaaaaaggttttttttttcccccccca

SEQ ID NO: 577420 - DNA, 389 bp, Homo sapiens
  misc_feature (119)..(119): n is a, c, g, or t
gaatcctataatgcttaaatattcagcaaagtgacatcacctggaaatgttgattaatactgattatgaaacctgggaattttctcagaaggaaccagatactacttatttatacatantatgccactcaatacgttcacttattgagatcattcaggcactgtgtaaggtactgaagaaatatagtgtggagtagaaagggaggcaacagatacatgttacctaaataaaaccttaggacccacatagctaagtctactttgtgggaaacccagtatagtaaccacatgctaatttaaaatatactttcaatatttataaagctaactcaagaatatcaaagggagtctcaattcaatctgtcataatttgagactttgattaccgag

SEQ ID NO: 577421 - DNA, 609 bp, Homo sapiens
  misc_feature (323)..(323): n is a, c, g, or t
  misc_feature (380)..(380): n is a, c, g, or t
  misc_feature (406)..(406): n is a, c, g, or t
  misc_feature (424)..(424): n is a, c, g, or t
  misc_feature (437)..(437): n is a, c, g, or t
  misc_feature (458)..(458): n is a, c, g, or t
  misc_feature (490)..(490): n is a, c, g, or t
  misc_feature (492)..(492): n is a, c, g, or t
  misc_feature (494)..(494): n is a, c, g, or t
  misc_feature (520)..(520): n is a, c, g, or t
  misc_feature (565)..(565): n is a, c, g, or t
agttggtctaataccttgtttagcttgaaatccttgttttcagtgtgtcgagtcaaaatgtgtttatttagcctgtcattgtgggaacccaatttctttgtcatatacctggttatgaactagtaacatgtttgggaagtcctactgatgttcctttgaaagaaaaaatctcctggttttaacaactgtgcttttgctatgtatggtatccaagttagttgaaatccacaccctgagatctgtttgagtttagggtcatttttagaaaggggcagtttaaagcacaatgtctcacatggacaaagttccaaaatgccaaattnttattttttaaaaagctagttctataaaatctggtattatgggtggggaggaaatanaattgagtcaattgaaagactatccnacttacataaacttgtcnccatagaagcttnctgcccaggatgctctatatntatatatatatatgtgtgtgtgtgtgtgtgtntntntatatatatatatatatatatatatntgtgtgtgtatatatatatgtgtatatatatatgtatatcatatntgtatatatacgcacatatatatatgtatttaaaaaaatcaaat

SEQ ID NO: 577422 - DNA, 637 bp, Homo sapiens
  misc_feature (323)..(323): n is a, c, g, or t
  misc_feature (380)..(380): n is a, c, g, or t
  misc_feature (406)..(406): n is a, c, g, or t
  misc_feature (424)..(424): n is a, c, g, or t
  misc_feature (437)..(437): n is a, c, g, or t
  misc_feature (458)..(458): n is a, c, g, or t
  misc_feature (518)..(518): n is a, c, g, or t
  misc_feature (520)..(520): n is a, c, g, or t
  misc_feature (522)..(522): n is a, c, g, or t
  misc_feature (548)..(548): n is a, c, g, or t
  misc_feature (593)..(593): n is a, c, g, or t
agttggtctaataccttgtttagcttgaaatccttgttttcagtgtgtcgagtcaaaatgtgtttatttagcctgtcattgtgggaacccaatttctttgtcatatacctggttatgaactagtaacatgtttgggaagtcctactgatgttcctttgaaagaaaaaatctcctggttttaacaactgtgcttttgctatgtatggtatccaagttagttgaaatccacaccctgagatctgtttgagtttagggtcatttttagaaaggggcagtttaaagcacaatgtctcacatggacaaagttccaaaatgccaaattnttattttttaaaaagctagttctataaaatctggtattatgggtggggaggaaatanaattgagtcaattgaaagactatccnacttacataaacttgtcnccatagaagcttnctgcccaggatgctctatatntatatatatatatatatatatatatatatatatatatatatgtgtgtgtgtgtgtgtgtntntntatatatatatatatatatatatatntgtgtgtgtatatatatatgtgtatatatatatgtatatcatatntgtatatatacgcacatatatatatgtatttaaaaaaatcaaat

SEQ ID NO: 577423 - DNA, 405 bp, Homo sapiens
ctgaccatcttatagtggcacttctggcttgtctcttccctggcacagtggctcatacctgtaatcccagcactttgggacggccaaggaaggtggatcacctgagttcaggagttccagaccagcctgaccaacatggtgaaaccccgtctctactacaaatactaaattagccaggcgtggtgctgtgtgcctgttatcccagctacttgggaggctgaggaaggagaattgcttgaaccttggaggcggaggctgcagtgagttgagatcgcgccactccgctcgagcctgggtgacagagcaagactccatctcggggggaccaaaaaggggttgcatcagagcttgactccatctcgcggggtcagaacataccggtgggtccgaacataaggggtaccg

SEQ ID NO: 577424 - DNA, 875 bp, Homo sapiens
gccctcgctgtgtcctctgaagcaatctcagttgtcattaaccacctcttctgtgtttctggtagctattaacctgtatttaatctgtacttcctatgccagcctcaagttatatttgattcttaaaattattctcttctaaccaactgaagtgtttgtcagccatgcccccacagcttgctctttagtgctccctttggcacataactttctatccagaaacacaggagcattctccgggcactcgccgcatttgccagactgataccaaccttatagcaactgcactgtacttctacgggcacacctacccaactcatgctggcgatacgcacacgcaccgcacacaaccttcaccattggccactcccacacctaactccaccgctccactccacacctgtcaccagcggacccaggaagccagcgcgcggcggcggcacgatatgccctcgcatctgcgcctggcccgctccacaccacggcgcaacgtcacaactcactggccaacactccacacagaccgcgcggacacggccacgttaaagaccaacagaacacttcccccacccggcaatacggtacaccgccaacatcacacgacatcagacaatccggacgctacgggcacctgcagccatcgccaggcacacaccgtcaactaatcccaaccagtgttctcctaacaacgccatcaccagaaccacgcccctcacccatgccaaggggacgcaaacacacgaaaaccctcccacacagacagtaacgactaacacacactccacaaacacacccaaccaccaggccaaaacgagaccccgcgcacgacacacttacaagcaaaacacgcacctaaaccgcaaagacctacaaca

SEQ ID NO: 577425 - DNA, 229 bp, Homo sapiens
taatttcctgtttttatacaattaaatatttagatttgcttaccattcccttttacttctcagcccttacttcttagtttaatttaatttgaaatttgtattcaaaattttattggttttaaacttttgattttgcacaaaaggcttttgttgttaaatttatgggatctttttgtctgaaaatgtctctattttgtccttattcttacaaaagtgctttgatacagaa

SEQ ID NO: 577426 - DNA, 658 bp, Homo sapiens
ttggccaaacttttggttttttgtcccaaagtggattgttcccgacctaatttccctagaaaaaaacctcgtttcccggtaaaggcccggtttttcttgttcttgaggaagttttctccaaagtgaaacaggggggtttaaacccctaggaacaaaggggcgcttcgggattgttatagaccctgctggacaccatcttccaaataacccaaaatgtgttccctcttttccggtgcccaaataaggaaggagacctttgtttcttccttccaattacatccaaaatatccacacacctcctaatatttggaacctttgatcctttggggtaagaatccaaaaggaattcttataaatggttggaaggccattaaggaaggccaatccaaaggttgtggaaccattggccacacttggattaccagctggtgtttccagggatacttgaagcaaagatgagtaaggggaaaaagtaaaaaccgcatatgcttatagggcatgctccaatagtgctcatgacctcaggtggcctctccacagtctaaactggagctgggatctccaaagagcctcttcgttcccaagactttaattataatctgtatatgcaggtgactccctaatccatattccagcccagtctttcttggaattaaaa

SEQ ID NO: 577427 - DNA, 274 bp, Homo sapiens
ggctcgaatttcttggcctctgccaacagagaaggttagggcgtgcgcagtaaaagcggcccggatttgaccggcatccgatatcatatcatcgagatcgtctaactgcagaacacgcactaaagcgctttgaggcgtttcccaatgctgcccattaaattgtgcgccgtaatgtacgagatcattgcgcgcccgatttaatacagacaattgagtgagtgcgttgattagaaaggtttctggctttttttcaccagcccgccagatcgctctc

SEQ ID NO: 577428 - DNA, 258 bp, Homo sapiens
tatgcatcctaaacagccttcactagctgttgtgtgaatgtttgtatttgggttgagtcagggtttcgcagatatggcactattggcatcttgggctggataattttctgttgtcaggagctgtcctgtgcagtgtaggatgtatagcagcatctctggactctgcctgtcagatgtcagtggcacctttcctcagtatgacaaccaaaaatatcttcagacgttgccaaatgtcccttgcaggggaaaaagtcaccc

SEQ ID NO: 577429 - DNA, 165 bp, Homo sapiens
  misc_feature (6)..(6): n is a, c, g, or t
  misc_feature (13)..(13): n is a, c, g, or t
  misc_feature (148)..(148): n is a, c, g, or t
taatanaactacnatatacaaatagtaagcacattgaaagccaatagagaaattggtaacattggtttttttctggaggagaattgggtgcctgaggtaaaggggtgggaaattatcaatgtatacttttaagtttttagaaattggnaaatatattacctattc

SEQ ID NO: 577430 - DNA, 262 bp, Homo sapiens
  misc_feature (3)..(3): n is a, c, g, or t
  misc_feature (23)..(23): n is a, c, g, or t
  misc_feature (26)..(26): n is a, c, g, or t
  misc_feature (32)..(33): n is a, c, g, or t
  misc_feature (41)..(41): n is a, c, g, or t
  misc_feature (44)..(44): n is a, c, g, or t
  misc_feature (53)..(53): n is a, c, g, or t
  misc_feature (74)..(75): n is a, c, g, or t
  misc_feature (77)..(77): n is a, c, g, or t
  misc_feature (83)..(83): n is a, c, g, or t
  misc_feature (86)..(86): n is a, c, g, or t
  misc_feature (105)..(106): n is a, c, g, or t
  misc_feature (111)..(112): n is a, c, g, or t
  misc_feature (137)..(137): n is a, c, g, or t
  misc_feature (142)..(142): n is a, c, g, or t
  misc_feature (214)..(214): n is a, c, g, or t
  misc_feature (246)..(246): n is a, c, g, or t
ggntgtttcctccctcccttccnaanatatgnngttccgangantaaaatatnagagcaatatttaaatcctcnngnaatggnctnatactcttgagaatgaatnnagttnnaatcaagtttacattatgttgcttntttanatagaaattattctttatcttgcaaagaattgaaaccacatgaaatgacttatgggggatggtgagctgtgntgctttgctgaccattttggatgtcattgtanataaaggtttctattt

SEQ ID NO: 577431 - DNA, 243 bp, Homo sapiens
gaaacagggtctccctttttcgcccaattggagtgcaggggcccaattatggctccctacacccccaccctattggggtcaagtaatcctttcatttgggcttcctgaggaggtgggactaaaaatgtggccccccatgcccggcccatttttttattttttttataaagccaaggcaatgtaacttttaccccaattttcttttgaaaattcttgggtccttaaagtataccttgctgccca

SEQ ID NO: 577432 - DNA, 939 bp, Homo sapiens
  misc_feature (426)..(426): n is a, c, g, or t
  misc_feature (572)..(572): n is a, c, g, or t
  misc_feature (912)..(912): n is a, c, g, or t
tgggataaaactatgcttttctgaaatcagtttggacatctgggtcctttttcctaagtcgaaagcagaaaaagttgggagcttatctccttcttcacgaggggaatatgtggtgacattgtccgtgtccccactacatccattttccctctatcatccgtgaaattctcgtagaatgggtggctctctcgtgattatacgtggtttccttaatgtagccataaataaccccaatatcacaaatattctccgtgaagagctgtgtttgggtgaaagaaatactcaaatctttcgagaagtttctccttgtgtgcctcgtgtgtgaagtgaatttttatctgtggaacaccctcaacacgtcttgggtttgagcgcacccgagcttttcgagaatatacggtatagaattctcttctcattgtgacnctctctatagggaagaacatatctcatatattctcccaaaatatagatctctgtggaaatatgtgacgtgcaggtgaacttttctcttgtctcccatgtgtgagattttctctctcctttttcaaagccgtggtggtgttttatanaaaacccttctccacatgtgtgcagaaacacgtgtgtgtctctgtgtgtgtttacccccactgggtttgaccatgtgaaacacacattatatcttttctttctctcacaattctcgtggggggctcctcaatatttctcagaatgtggccttgtggtgtgataccctcgaggatacccttttcactatattccactgtggggccggtatttgtggcaagaaaccatttttctctcggtgggaaagttctaccgtgaccatttttggggccccaccgggtttttccggggggattcctcagttgcaaagaaaacgttgtgggggcttgcgaccccttacancaactgaagggcctgtggggaaaattg

SEQ ID NO: 577433 - DNA, 1205 bp, Homo sapiens
tttctggattcattgggaggaaggggatgaaatcctgggaactcagagttaaattaagaacaaggcatcccacagaacctaatctgaacaatccccgatgattccctctgctttttgaatgcttccaagacttatcatgaaaactgtcaatggataatcatttcctgctgactttgcacgccaaggaatgctactagggattgtttccgtttttgtttgttttttctaatatttggtacttcccagaatggtgtaaatacttcttttcaatgttgtgaccaagtattgtcactcagccaacaacttttccacacctgggggttggtggctgttcttactgtccaaatgaagctaaaaagaaaggcatctttcttcccttttaaaattgtgtaaactgcaaattataatataatttgaatttatgattattttccagaagaaatcttgtaaacctgtggatactcattaattcttttgttaatatttatttccatgatagcatcattccagccagacttgctgaaaatctactggtgaggcaaatataatatatataaatatgctacatatatatttataaaatttctagtgggagttctatataaatgtttctttggtattcttcagcctgtgatttaaagttttacaaaaagcagagctttttcctaagttacttttcagttaggtaactgtgtgatccagttcttccagctgcttctataatgaggcacatattaatacagtttttatatggtatctatgaaagagttcacttcatagagaataatacttgagcaaatgtatccaagaaagcaagcaaatgaaaagaaacctatttatggaataaactccagatctgaaattcagtattttagaaaaatgccagctcttcttactgtatttattaaaacttgtaataatgtgatttttttcaaggatattagttcaaattgaaatggtttcacgccacacggaaatctttaagttatttgttgaggtaccatatatttagggtgctaggggcagtaatgttaatatgtgcaataggactactgttgatgtgtaatggtgatctctctgagtccttggcaacatccagcaaaacctactgcttattctccaaagaatatgggagctctcaatcctcggtgatatgggaacagagaactgagttattcgccctatgactgagcctttctactagg

SEQ ID NO: 577434 - DNA, 919 bp, Homo sapiens
  misc_feature (861)..(861): n is a, c, g, or t
  misc_feature (863)..(863): n is a, c, g, or t
  misc_feature (873)..(873): n is a, c, g, or t
  misc_feature (877)..(878): n is a, c, g, or t
  misc_feature (881)..(881): n is a, c, g, or t
  misc_feature (884)..(884): n is a, c, g, or t
  misc_feature (887)..(887): n is a, c, g, or t
  misc_feature (889)..(889): n is a, c, g, or t
tttctggattcattgggaggaaggggatgaaatcctgggaactcagagttaaattaagaacaaggcatcccacagaacctaatctgaacaatccccgatgattccctctgctttttgaatgcttccaagacttatcatgaaaactgtcaatggataatcatttcctgctgactttgcacgccaaggaatgctactagggattgtttccgtttttgtttgttttttctaatatttggtacttcccagaatggtgtaaatacttcttttcaatgttgtgaccaagtattgtcactcagccaacaacttttccacacctgggggttggtggctgttcttactgtccaaatgaagctaaaaagaaaggcatctttcttcccttttaaaattgtgtaaactgcaaattataatataatttgaatttatgattattttccagaagaaatcttgtaaacctgtggatactcattaattcttttgttaatatttatttccatgatagcatcattccagccagacttgctgaaaatctactggtgaggcaaatataatatatataaatatgctacatatatatttataaaatttctagtgggagttctatataaatgtttctttggtattcttcagcctgtgatttaaagttttacaaaaagcagagctttttcctaagttacttttcagttaggtaactgtgtgatccagttcttccagctgcttctataatgaggcacatattaatacagtttttatatggtatctatgaaagagttcacttcatagagaataatacttgagcaaatgtatccaagaaagcaagcaaatgaaaagaaacctatttatggaataaactccagatcggantncggtttgaanatgnnggnctntangnttttaactgtaaaggggtgaggataacaga

SEQ ID NO: 577435 - DNA, 922 bp, Homo sapiens
  misc_feature (49)..(49): n is a, c, g, or t
  misc_feature (65)..(65): n is a, c, g, or t
  misc_feature (83)..(83): n is a, c, g, or t
  misc_feature (100)..(100): n is a, c, g, or t
  misc_feature (113)..(113): n is a, c, g, or t
  misc_feature (125)..(125): n is a, c, g, or t
  misc_feature (132)..(132): n is a, c, g, or t
  misc_feature (134)..(134): n is a, c, g, or t
  misc_feature (136)..(136): n is a, c, g, or t
  misc_feature (143)..(143): n is a, c, g, or t
  misc_feature (158)..(158): n is a, c, g, or t
  misc_feature (165)..(165): n is a, c, g, or t
  misc_feature (206)..(206): n is a, c, g, or t
  misc_feature (227)..(227): n is a, c, g, or t
  misc_feature (229)..(229): n is a, c, g, or t
  misc_feature (231)..(231): n is a, c, g, or t
  misc_feature (235)..(235): n is a, c, g, or t
cgtctggatccaaatgttcagaaatgggatgtaacagtattagaacgcngctagcacaaagcgtnatttggatagaccagtgntcttacggttttggganacattggacaggnacatggtaaagnataaatngnanttgagantctgaattatttggntcctccntttctggaaattgagactcaagctttatgaatttatcaagnacttaaaaatgaagaaggtcncngnttgntcttttataagaccttattgatgctttgtgcttcaaggagatgatacctgtcatccatataagcaaacttatttggctttacagactattttgttaatattagccttactagtctgtaatggacatggtgtatttggatgagaatgttcttgtattctccatgggttaaattaccatatacttgaaagattgtgttgtctttagacagtataaatgcacgcgttataaatgtgtgtatatcccggagatctataaggctctctggagcccatcttctagatgatctgcattgcaactataattctttgtactgacagaatactatgttatggaatggtcattaacatcttctcacgtactctggaacatccaaaaccaagcaacgggatgtgactattccgaatgagtcagaatgtgccgaacttgtatgtccgctatatctacactttagtcattgattttagaaacagaactagatgggaacaatgctaggatcaatccttcgaattggatccgaagctgtgtgcagccttctgcaagatttctcttatgttatccacctgattgacctttaatatgaatgtaccttcttctcactgagtttggtgatttttggaagctagaatgatgtgtctctatctggaatatccttgccattcgtaataaatctccaaactgagatgatac

SEQ ID NO: 577436 - DNA, 621 bp, Homo sapiens
  misc_feature (608)..(608): n is a, c, g, or t
tttctggattcattgggaggaaggggatgaaatcctgggaactcagagttaaattaagaacaaggcatcccacagaacctaatctgaacaatccccgatgattccctctgctttttgaatgcttccaagacttatcatgaaaactgtcaatggataatcatttcctgctgactttgcacgccaaggaatgctactagggattgtttccgtttttgtttgttttttctaatatttggtacttcccagaatggtgtaaatacttcttttcaatgttgtgaccaagtattgtcactcagccaacaacttttccacacctgggggttggtggctgttcttactgtccaaatgaagctaaaaagaaaggcatctttcttcccttttaaaattgtgtaaactgcaaattataatataatttgaatttatgattattttccagaagaaatcttgtaaacctgtggatactcattaattcttttgttaatatttatttccatgatagcatcattccagccagacttgctgaaaatctactggtgaggcaaatataatatatataaatatgctacatatatatttataaaatttccgtgtggagaccgtgtggaggngatcctctagagt

SEQ ID NO: 577437 - DNA, 590 bp, Homo sapiens
  misc_feature (451)..(451): n is a, c, g, or t
tccccttccacactgtgggaggtttgttcttttgctctttgcaataaagcttgctgctgctcactctttgggtccagactgtctttatgagctataacactcaccgggaaggtctgcagcttcactcctgaagccaaggagaccacgaacccaccgggaggaaggaacaactacagacacgccggcttaagagctgtagcactcactgcgaaggtccgcagcttcactcttgagccagagagaccacgaacccaccagaaggaagaaactccaaacacatccgaacatcagaaggaaaaaactccagacacgccgcctttaagaactgcaacactgcgagggtccgcggcttcattcttgaagtcagtgagaccaagaacccaccaattccagacacactaccaaaagcagaagggaagctctagacaaaaatattttgcttacaaatggnacatatccaagcttttgtgaaccttggggaagaaaccaagaatatgaagccctaatggaagtgtccagaaatgggtcgcttgccgacaagggaaccacaacccgggccacgagagggccgactatccacctccctctgc

SEQ ID NO: 577438 - DNA, 234 bp, Homo sapiens
aaaaagaaaggggtttttttttccccccggggaaacccccccttttggggggggggtggggattttttcccaaacggggggtggtggcccccccataggggggggttttcccccccggggcctccccccggggtcccggggtccctttttttcccccccccccccccccccgggggtttttggcccccttgggttttggccctttttttttaaaaaaaatttttttttttttta

SEQ ID NO: 577439 - DNA, 385 bp, Homo sapiens
ggaagttgggaagtccaagatctaggggctgcatctgatgagggccttcttgctacatcatcgcatggtggaagtgcaagggcaagagagcaagtgattgaacttgcagcctcaagcccttttataatctgcattgctccattcatgaaggtggagtcctcatcactcttattaataaatgcctcgtattaggctccacctcctaacactgttgcattggggattaagtttccaatacatgaactttggggaacacattcaaaccatagcactgggtttggtattaaggttagagactgcagttttatactggccccagcattcagattattcttgtatttgggtttgagtgtgcaatattttgtcaatacactcagttgttttg

SEQ ID NO: 577440 - DNA, 230 bp, Homo sapiens
aaagaagggaggatcccggtgacaggagtcagtctggtggtcctaagctggagtgcaagggtgtgatcatagcttactggcatcctcaaactcctaggctcaagcaatgctcctacctcagcctcccaggtagctgggaccacaggcacacaacaccacactcgcctttctttctttcattttttttttttttttttttttttttttttttttttttatttttttttttt

SEQ ID NO: 577441 - DNA, 234 bp, Homo sapiens
  misc_feature (3)..(3): n is a, c, g, or t
ganggtcctctttttactgaaggggaaaaacattgaaaatatgaaactgcagaaagcaaggtgttgcatgttctacttcttatctgtgtggttgttgcccctttgggttctaacctgtcacaatttctctggtcttaaaactaggagctgatcactggctctttcacagttaaaataaacaaaccatgcccccaaatatcatctctgttctagtttccttgtttagttaatact

SEQ ID NO: 577442 - DNA, 324 bp, Homo sapiens
aaggtccctgtggaatatagacccataattgccaaaactttgaacgaggctgactgtgccactgtccccccagccattcactcctactgatgagacaagatgtggtgatgccagaaacagctttggtaattaggtataatagctcaggcatgggtcaatgtcataactgtctttatacgcttctgccctccggggaaaaaggagtccattgaagggggattggcccccagtggccggggagcatggcccttacctttgtcccttgcttcattcttgtgacaagataaaactgggcccagctgttaaataaaatataaatggcca

SEQ ID NO: 577443 - DNA, 455 bp, Homo sapiens
  misc_feature (6)..(6): n is a, c, g, or t
  misc_feature (38)..(38): n is a, c, g, or t
  misc_feature (349)..(350): n is a, c, g, or t
  misc_feature (373)..(373): n is a, c, g, or t
  misc_feature (401)..(402): n is a, c, g, or t
  misc_feature (424)..(424): n is a, c, g, or t
tctccngtgattaccttcatctggcccccaggagattngtgcctgccaccccctacgcctgtagcctgtccatgagactggcaggcccctcggtcctaaaggttctggaggtgtgagcgcaccctgcgagtacttcacaagaagggtgtaggctgaccagaagatcaccttacagaactggatgtgtctgtcgccaccgtgggtgccgcacaaagaaaagccgaggggctgtggtgcatgggctcacgcaatccagaatctccacgtttcagaaggcgagatttgggtctgtggactgtgtgtcacgccaccctcagataaaatctggagaagagatttcttttgcatnntgaaataaaacttacacgccaanaaaaaaacaaaaaagggcgcgccgctcnntagagtataccataagaggggncccaaggcttacgcggtacccagctttcttg

SEQ ID NO: 577444 - DNA, 350 bp, Homo sapiens
  misc_feature (38)..(38): n is a, c, g, or t
  misc_feature (70)..(70): n is a, c, g, or t
  misc_feature (86)..(86): n is a, c, g, or t
  misc_feature (197)..(197): n is a, c, g, or t
  misc_feature (205)..(205): n is a, c, g, or t
aagtcctgggttccaggttccccagctctgagccttgncgagacacacacaggctggtgctgtgggatgncttggtacgggtgctnacgcctgtattcccagcgctttgggaggccgaggtgggcagatcacctgaggtcaggagttcgagaccaggctgcccaacgtggtgaaaccctgtctctaccaaaaatatnaaaattanccaggcatggtggcacgtgcctgtaatcccagctacttgggaggttgaggcaggaaaattgcttgaacccaggaggtggaggtttcagtgagccaagatcgtgccactgcaccccagtttggatgaaagagtgagactccgtttc

SEQ ID NO: 577445 - DNA, 244 bp, Homo sapiens
tcctgggggcaaatgaccctcctgcctcagcctcctgagtagctgggaccacagacaagccccgctccgcctggttcattttttttctttcttcttcttcttcttttcttttgggtagaatgtggtctatgtggcccaggctagtcttgaactccgggccttaactgatcctcccaactccaaagtatggggagccactgcacccgacctctaagcagatggctaagcacctgggaaaggctaa

SEQ ID NO: 577446 - DNA, 802 bp, Homo sapiens
cagaccgcaacctcaacagcaccttcttgcgaccccgccggagagaggagaccccattctataccaacacctattctgatttttacggtcaccctgaagtttatattcttatcctaccaggcttcggaagtaatctcccatatgtgtaacttactactccggaacaagaaagaaccatttgggatacataggtagtggtctgagtctatgatcatcaagtatggtcttcctaggggttgtactcgatgtgagactacaccgatatatttagcagtaggaatagacgtagacacacgagcatgttctcacccgtccggctagcctatcaagtcgatcgtcttatacccctcatcgcggactgctcaacagtgagtttcagctagactcgccacaactccagggggaagcggagtatcgaaagtgatcttgctgcaggtgctctggagccgctaggattcatctgttctttgtcaccggtgaggtggcctggagtggctatagtgatttagccgaactcatcgactagacatcgtacgtacaacgaccaggtactatcgttgtagactcactgtccactatgtcctatcaagaggagctgtatgtggcatcataggaggcttcattcagctgatttcccctatgctcaggctacaggcctagagcaaagcttgcgccgaaaatccagtttcactatcatattcatcggcgtgcctctagctttcttcccataacactttctcggctatcggaatgccccgacgttgctcggactaacccgatggatagcacatgaaacatccta

SEQ ID NO: 577447 - DNA, 295 bp, Homo sapiens
agacactaacggacctgcacagcagctggggtagatcaattcaaagcaatatgaaaagggcatttggggagctttcaccttacatgtgttattttccaatgtgtttgggaagcctgaagtgtccttggaaagtgacatgaattgactaggcgggtactccaggatcagagtactccaggaacagaactgttctcaaactttgtttgaaggatcagtccccaggaaagcttgttaaaaatgcagattaatgggtttcatcccagaaattaggtctagctgggttaggtctacctgg

SEQ ID NO: 577448 - DNA, 1311 bp, Homo sapiens
  misc_feature (1090)..(1090): n is a, c, g, or t
ctctctcggagttgctgctccctcgctgttttcttattcgtgcgtttctgtttggggctttcttctatgatgtcttcttttctccgtgcgcctcccataacatgggggtctctctcgtgctgtgtgtgtccacgggttcttcacccccgtgggaagtcgggtttttattccaggggggcacccaagggtttattttttgcccgcccttggtgtgggcccccccatgtcgcttcatggggttgtcacccctggggagtgtgtttgccccctccctttctaatttcttcgtcgcatagccttccctgcgcaccacccaacggcttggcaaacccctggccacaggtttatccccaggaccaagcttgggttttcctggaaaggacctcatggacccaccaagtccaataccattcactgtcccctccacgtaggacctgtggggatggcccccctcccgggggaaactcttggccttggatgggccccgggcttctcccaggaccatctatccctgccttctactgggcggccttcccaaggctgtggggcaagagtctatcccctgagctgtaaccgggaagctctacatggcactgcgcccttcccagtgtcccccccacatgccacaacgtggtacacactgcgtggagcctcgagacctgccgccttctatgaggaaaacctcgcccacaaatattgaatgagcacttcacagaacaggtgtgtgtaataccacgggcgcttcgcgaagggcccccctctcaacagggcgactctctctcgggggctacacacccttggggccaaccccacgcgttcgggttctctcctctctcgagactttcacacacacgtcgagacacacccacacttctctctccacccctctttgagacgccttggggggctcggcgcactgtgtcccttctcacaacgaccccacactctcttgtgtcaaagctctacattttcctcggtatatgagcacaccgagaatttgtgcgtaacaagcacaacacagggtcgtgtgtgagccctcactgtgcgccacacacatggcgctcccacacaggagagtatagagaccccntggagccacccaagcccccacgccacgagcacccagaggaagagagagaccctcacctgctggggagttccctgccaccacactcacgtcccccacccaccacctgaatctcccctcccttcaaacgttgccactgtagagacccctctgaagaaggggaaggggcctagggaaccgccccttgtcatgtaccatccattaagtaccctgtgctcaaccca

SEQ ID NO: 577449 - DNA, 115 bp, Homo sapiens
agtctgatctcactttatcaattcttctccattcttcagtaagtcaacttcaatgtcggatggatgaaacccagacacatagcaattcaggaaatctgatatgccattcttgctg

SEQ ID NO: 577450 - DNA, 575 bp, Homo sapiens
  misc_feature (473)..(473): n is a, c, g, or t
  misc_feature (479)..(479): n is a, c, g, or t
  misc_feature (482)..(482): n is a, c, g, or t
  misc_feature (538)..(538): n is a, c, g, or t
  misc_feature (544)..(544): n is a, c, g, or t
tttcctctgctgctctactatgctctaatctgcccttgttacgatcttcaaagcagaatccaatgataatattagttctcaggttaacacacttgcctcttacccctttttgcaatactcacttcacgttcattataccatgtgcccttgcatccctcagacctcactggttctcacatctctagtttttcctaactactttttgggtgatcttgtcccatctcatggtgctaaatacttcataacttctacttttatgtcttcagccctctcctccctgctgcttctgtgagagtccatttgcgtacctaataggcccctcaaatgtcacatgtcctgacctaggctcctgagccttctctctccaagcattctttcctattgcttgctcagtagattctgtcttgcagttgctcaggccccaaactctagggacatccttgcttccttcttttctttcacacctcccttcnaatctnacntccagtctagttggcctcactatcagtatatgtatcgtcagtactccctctgcccnatttcntggaaagtggcgacggatcctcagaccaccg

SEQ ID NO: 577451 - DNA, 217 bp, Homo sapiens
  misc_feature (7)..(7): n is a, c, g, or t
  misc_feature (14)..(16): n is a, c, g, or t
  misc_feature (25)..(25): n is a, c, g, or t
  misc_feature (39)..(40): n is a, c, g, or t
  misc_feature (55)..(56): n is a, c, g, or t
  misc_feature (80)..(80): n is a, c, g, or t
  misc_feature (91)..(91): n is a, c, g, or t
  misc_feature (97)..(97): n is a, c, g, or t
  misc_feature (100)..(100): n is a, c, g, or t
  misc_feature (107)..(107): n is a, c, g, or t
  misc_feature (117)..(117): n is a, c, g, or t
  misc_feature (125)..(125): n is a, c, g, or t
  misc_feature (128)..(128): n is a, c, g, or t
  misc_feature (138)..(138): n is a, c, g, or t
  misc_feature (201)..(201): n is a, c, g, or t
  misc_feature (203)..(204): n is a, c, g, or t
  misc_feature (211)..(212): n is a, c, g, or t
cagaagncattgcnnngtcaccaanggaattggcattgnnaatatccattatttnnatgatgggctgtggcatatgaggncatataaatgngcctcnganggaatgnccttgggctnaatatggntantgtgctgtanctgtgtttgtgtctgtgtgtgacagcatgaagataatgcctgtggttatgctgaataaattcncnngatgctnnaattc

SEQ ID NO: 577452 - DNA, 320 bp, Homo sapiens
cgatgtcatggtacactggaagctaaattgggaagatgtctgttggacggtgagatgtcagtccgcatgtgaataaatctgacctagctcctcttcacatccagatacttcaccatcaaactcagccatcatctaatctgatttcgcactcacctgggagctactacaactgacatcatctgcacttagcatatcatcaaccatgtgcccatcgtgttggtggtgatggtggtggtggtggtggtgctgctgtggaccaataaattgtcgacaattaaatccttcattcccaatagtctccccaaggaggccacagtgct

SEQ ID NO: 577453 - DNA, 143 bp, Homo sapiens
gatgcttttagaaaaggaagtgctcggcaggacatggtgtcgcatgcctgtaatcccagcattgtgggagggtgaggaggagaatcacttaagcccaagaggtcgagtcaaaccaaggcaacacagggagacctgtgactacc

SEQ ID NO: 577454 - DNA, 251 bp, Homo sapiens
  misc_feature (15)..(15): n is a, c, g, or t
  misc_feature (50)..(50): n is a, c, g, or t
  misc_feature (55)..(55): n is a, c, g, or t
ccaggcgagagagtncacacaactgctgagcttgagattgggagtgaggnctatnactgcaggactgctggagggcctgggtggtgagagcttacactgctgctgctgctggtagaatggggaagagcattaatgctggaggccacaggttggactcgccctgaagttggaggcttaatccagctgaaagaagcctttgggaatggatatgagaagattggggcttggtatattggcattgggaccaggag

SEQ ID NO: 577455 - DNA, 156 bp, Homo sapiens
tagttcggtaccgacgctctctctgtgggggaacatcttgagtagtgtttagagattgaggaagcctggcagaagcgctggtccagtcttcagtggtcactggctgatacagtgagtttaagctggcctgtgtgactccaaagcctagcttctgca

SEQ ID NO: 577456 - DNA, 716 bp, Homo sapiens
tcatggaggaccttgtggaccacagtaaggacttggattttattctctgtgcagtgggaagctatggaggttcttaaacaggggactgatatggtctgattgcatttcaaaagtttactctgggcgtgtggggaataggggaccagtgcgctcaccaaagtagagtatgtggtttaaaaaaaaaatttaattgcggccggtcgtggtggctcatgcctgtaaacccaggactttgggaggccgaggtgagcggatcacgaggtcgggagattgaggtcatcctggccaacatggtgaaaccccatctctgctaaaaatacaaaaattagctgggtatggtggcacgtgcctgtggtctcagctacttgagaggctgaggcaggaggatcacttgaatcctggagttggaggttgcagtgagccgagattgcaccactgcagtccagcctggcaacagagggagacggccatcccaaaaaaaaaaatgaaaacaaaaaacttttgtggggcggccgcgggcccctgaaaaagttttaaaaccacccgcgttggggggcgggggcccaatgttagtgtcacacgtggcccaaagcggtccccaggagactccgggccgaaccgggcggggttccccccataaaaaggcgggggaccggggttctggaacaaccaaggggtcggggctacgggccttaccgggccagggacgataatgg

SEQ ID NO: 577457 - DNA, 1846 bp, Homo sapiens
ttttatttgttattattttttttttggtttttaaaattatgttaattaagcatttgtccccataaaaaaaaaatggcccctcggaaaccctcccagcaaaaaacagtgcccaaacccaaggatatagtggtggacgggaggggccccggaccccaagttatagcagcagtggaacgagtgcaacccgtgggaagatcgacaagccccagactacgaggaaaagaaggcgtggacaagtgaagtggctccagagagggcgggagagatcccgcggagccggagggcgcctataaaaaataagacggtggcgcccaatagcacaagaggactcgggataaacggccctcaaagagataagtacaccgcagggagagacacaagagcaccgatgtgagagagagactcgcagaacatcaatcacacacaagagagaaaaacagggaaaaaatgccccatcgaaaacacattcacacaagtgaccaacaagaactctcaaagaaaacaaaataacgcggaaaaactagagaacagaaaaaaaaagaggggactacacaaaaggagggcgacaagagcagagatgacgaccaaaacaagagaagactccccaatagggggaaaaagatgaggaccaaacagagaagggaaaaaaccagagcagaggagtattatcaccaaaaacataatacagagaagaagtaatagcaaacaccaaacaacagctgaagaagacatatcaacaacaaacaacgtatgggaggaagaacaaacaacccccggtggagacccgaggagcagcacaagtaaagagacaagtagaagctacaccaacgaagacaacagcggaggtgaataaaaatagcacccccaaagaagacaaccaaatcatgaaggagacaacaaagcagaactatacaacacacagaaggaagtaggagaaggcgagaagaaaaatatataccacacacacaaaagaacaaacgacgaactcacaagaggagagcaagtattaccaccaagagaaaaccaccacagccaacccgtcgggagcacaaaaacaacacaccagagggcggtgagtaagaaaaaaaccaagcactacgcacaaaaaatacacactagcaataaatcaagatcaagaacaaaaactcactacacacccgggagatagatgggccaacactaggtagacgaggaaaggagaacacaacgaatggaaaaccccccacgagatgtaaagaaagactaacaccgacccagaaacgagaacgacacaatagaaggagagaatgacaagacaaaggaggagatcaaatgaacaggaagaaccaacgaacggacagagacgagacacaactacacaacccattatgaacacgaccccgccgtagagagaaagacgtaacaagaaacaacaataaacgcagccggtgggagacacacacaaagtagaacgagttaaggggagacacacccagcaaagagcttgtagtaacgaacaaagaccccaaaaacgaaaacacacaaagagaagagaacagacacaggaaacgacaaacaagaaccgaaaaacacgaagcaaaaaccacaaaaaagaaagagggagagacgacgcaacaacacaccgaagcataaaccaaatcacgccagcagaagagagagactggccaacactgatagttaacacgaacaccacaccgacagtgaaacgtaaagacaacaaaagaagggaggacccaactgacagaaaagagagaataagaaatacataatcgcaacgaacagcggagcagtcggaagtagaatagcaacaaaccagcaggccagcagatcgagggcgagacaaatg

SEQ ID NO: 577458 - DNA, 254 bp, Homo sapiens
  misc_feature (72)..(72): n is a, c, g, or t
  misc_feature (172)..(172): n is a, c, g, or t
  misc_feature (229)..(229): n is a, c, g, or t
  misc_feature (254)..(254): n is a, c, g, or t
acatttagtaacacatatctggctacttaatccccattctgcccccgcggttacgctttcttatctattctntcaatcagcacttcacccaattcatccttaattctaataactggctattgcgccttacctcgtgttttgtctttttttcattaccaatgtgtgcatgtgnggaacaatatggcactgcaaaatgagaaaaatagtcgttatcttttgcgcgactggnaaccagaaaatccggccttctgggn

SEQ ID NO: 577459 - DNA, 175 bp, Homo sapiens
ggggcaatgatctgaagaactctggggtcttagctcctgggaggcacacatgcttggtggcaccctgcctgtcacggtgcctcccaaagctcccaatgatcaggggcctttcttttttttcttagacagggtctcactctttgccaggctgcagtggcgggatcttggcctcgtg

SEQ ID NO: 577460 - DNA, 210 bp, Homo sapiens
gttcatttctacacaatgtagcgggtagtagtaacagtcaaattgggtttgaattccagttctgtcacttcttagctttgtaatcttctgcaagttcggttgacagaaggattaaatgaaataatttacctaaagtacaaagcacaaatgttgttacagagtaagcaattgataaatattagacattagtgtggtgataaatggccctgg

SEQ ID NO: 577461 - DNA, 300 bp, Homo sapiens
catcgctctggtcctcgaagcgcacctggtagcccaccagcgagcccaggggcgtggccagctcttcggcgacccggctggccacgctgcgggcggcaatccgccggggctgggtatggccgatcaggccatgttggccacgaccgatttccaggcagatcttcggcaactgggtggtcttgcccgagccggtctcgccggcaatgatcagcacctgatgcttgagcagcgcctccttgatctcgtcgcgcttggcggcaatgggcaggctgtcgtcatagcggatctgcggcacgctct

SEQ ID NO: 577462 - DNA, 271 bp, Homo sapiens
ttagccacagccaatataaggaatgttgtggtggtggatggtagtcgcactccatttagcttgtctggcacttcatataaagacctgatgccacgtgatttggctagagcagcgcttacgggtttgtagcatcggaccagtgtcacctaaggaagtagttgcttctctcatctttggtacagttattcaggaagtgaaaccaagcacctgtggctcgagaggctgcccttggagctggcttctctgacaagattcctgctcacactgtcaa

SEQ ID NO: 577463 - DNA, 525 bp, Homo sapiens
ctttccacactcggtccctcaggtgactaggttcaagagacattgcttttggtggcccacaaacatttcctttgagggcccatagtgaatattaaagtgtgctggacatggtggctcatgcctgtaatcccagcactttcagaggctgaggtgggcagattgcttgagctgaggagtttgagaccagcctgggcaacatagcaagatcccttcccttaaaaaaaaaaaaaattgggcggggcatgggggctcaggcctgtaatcccagcaatgtaggcagccaagacaggtggatcacttgagtccaggagtccgagactagcctgagcaacagggcgaaacctggtctctactaaaaatacaggttagcgggctgtgggggaatgagcctgcggtcccagctgtccaagaggctgaggtggcagggtggcctgagcctggcagttgaagttggcagtgagctgtgatcatgccactgtattccagccggggcaacagaactgacaccctgttaaaacacacaca

SEQ ID NO: 577464 - DNA, 889 bp, Homo sapiens
agcactgcctggctccacgtgcctcctggtctcagatatgtgcgctgtccatgggttcttacagtcctgagcctccatacctctgcgtggaagccgcagagtcccagttgtgtgccaaccgtagtagcggtgcccatcactcaagcgccaacctggaccggatcactggacaagtggtttatatatcgcgatcgggcttatcgaaacgagggagtgactatgagagtcggtgtgcaggagatccaagcaaccttctgtttacttcaccaccggaacaagacgagaggacacgatgctttctcagagagttaccatgacccgacagtgaccagtgcttctataagaccaactacctgaatgtccagcgggaaaactgggaccatctccagatactgtgggaggccatagagtcattatcgctacactatgctgaatcctcagggaactaccatgaacctagcatgcattgcgttgagcagtgacacgatggaagaaggaagctggggggcgtgttcgtgatctatagctgtacaagccccagagacgaccaacggcagcagaactgggacgagatgctacggaaagctcatcgactgcattgttgcatttcgccaagtcagatgtcgtgtacaccgagtgtgaagagaaggctagagtgtgagccagttgggagcacagcagccacgaaaaaggagaaggagaccacggagtcagggggcaatcctagcaggatcacaagtcgtggatcacggcacaggagcacttgggggggccaatcctggcccttccgaagcaccgaacagtgtggtaccttcagctttatccctcaaattggcattcattaaacgctccgtgtgttggtaagaagactaaaaaagaaaggacaaaa

SEQ ID NO: 577465 - DNA, 128 bp, Homo sapiens
tagtgttggctcgaagaagatataaatacagccatttaggtacagacattaggtaacagcatttaggtaacagccatttatgggtaacagccatttaggtaacagccatttaggtgacagccatttag

SEQ ID NO: 577466 - DNA, 707 bp, Homo sapiens
agcggaggtgcgggggggccatgctggcctcggccgcgtcccgtccctctagctgggggtcactgcgagccgcctcgctcggcggccgctcggtcatcctgtgggcagacagacaagcggatgcccgctctgacgaccgccccatgagccgacgacgtgggctgggggtaaaggggagaagggcagagagaggaactcacgcaccgagacgtgaggaagaggcagacaaagttagcgccacgtggggctacgggcgggaggccggcttgggcgctagcggtgggacgggacaccgagggtctctggcatgggcgaagggaggggtgcctgggagacacagagacctgagggccaaaaggaccagagatggaggaagcacgaccagagacatcggcacagacaacaggactacacgccagcgacagtaacacacagcaacgggcgaacatcaggaggacaggaaatgtacaaggagcgtgtgctgcgggctcttccatcacctggcttcatccagcatagagctgggccaccaggcaagaaacagaaaacaggaaaacactcaggaggattcaaggggcaagagtttggtgacgtagtgacgtggtaccatagtatgataaaccagccatcattaagcttgtttcacaataagcgttactgggtcttctggaaatcatataaattggagtatgtaaaaagacgacaac

SEQ ID NO: 577467 - DNA, 705 bp, Homo sapiens
gctcacccagcacagcgagatattttctgtgtggacccaccttctgtggtaagagcacgctacggtattgtgcgctacacatctcgtcgtggtacaatccgtcagtacaacacataataaggggtgttacgcacaagatagggtgggtgactttcaccgccgccgggggcaggatgggagggcgtgcagacatcatgcggtgacggatgctgtcgtgcgcgccgtgttcacccccctccccaggtcgtagcagcagggaggagtatgaggaaaacaattaggtgtcgcccccaccaccatttctgtcgccggtttcgattgtgcagaggacacccttcggtagttgcagagcgcggcgcacatttctatgggtgctcccgcccgggagtattgtttccctgagaggccgcactatgtggacgaggggggccccgtgtccctgccgctgatgtgtctcttcccacggagaggctttgggctgcagtgccgcgccttctgggggagggctgtctccgcccggccccgcgcttgtctcccttgttgggacgtttcctctcggttctacgagtaccgccattgttggctccacttaatgggcgaattttctctccacatctcggcggccctttctctcgactcctctcatattctatggggcgcccactttggtaacacagcgggacgactccaaagcccgacattgtc

SEQ ID NO: 577468 - DNA, 446 bp, Homo sapiens
  misc_feature (3)..(3): n is a, c, g, or t
  misc_feature (41)..(41): n is a, c, g, or t
  misc_feature (94)..(94): n is a, c, g, or t
  misc_feature (109)..(109): n is a, c, g, or t
  misc_feature (143)..(143): n is a, c, g, or t
  misc_feature (162)..(162): n is a, c, g, or t
  misc_feature (173)..(173): n is a, c, g, or t
  misc_feature (193)..(193): n is a, c, g, or t
  misc_feature (197)..(197): n is a, c, g, or t
canagcgacgctatgtcgtcgattactatttgtcaaaaagntaagttgttgtggactagtgacctgcccgaaagacctggcacacttggtatantaaggtgatgaaccnctagcaagaggtgtgacactgctagagtaaaatngatatgatttctttaaaantttagttcccnccgggagcatggctctgccntaancctagcatttgggaggtggtggtgggcagatcacccaggtcaggagttcagaccagcctggccaacatggtgataactcatctctactaaaatacaaaaattagctgggcgtggtggtgggcacctgtaatccccactgctagggaggctgaggcattagaatcgcttgaacccgggaggcagaggttgcagtgagccaagatcgtgccactgcactccaacctgcgcaactgagcgagactccgtctc

SEQ ID NO: 577469 - DNA, 111 bp, Homo sapiens
tgtctccaggcataaggggggctgaggtaggggcccagtgatcaggcacctgatccctaatgtgggccttgcgttctttactcctgcgtctgggagtctccatgcagaagt

SEQ ID NO: 577470 - DNA, 550 bp, Homo sapiens
tggccggcggatttgacggcatgtacacctactttgcctacaatggtttatcctttggttcttcccatcaaaactggaaagctgttaagaacttttgtgatgccaacatcctcatgttcatacccagtgtggggcctggctacatagacaccagcattcagccctggaacaaccacaatacgcgcaacagggtcaatggcaagtactatgagacgggcctgcaagcggacctgacagtgaggcccgagatcggttccattacctccttcaatgagtggcacgagggcacccagattgagaaagccattccgaagaagacacccacccgcctgtatttggactacctggctcatcagtccaacctgtgcctggaactgacaccgccgttgggcggagcattttataaagaaaaagaacaatggcttatgtgaggggcccttaaatgggcgtgaaggcctgatgtcctgccttttttgaagaagtcccactgggggttcaactgggggtgttaccacatacttcttcccagggaaaaggtttacaaaggggt

SEQ ID NO: 577471 - DNA, 348 bp, Homo sapiens
tcctaagttttttaaacccccccccaaaattgggctttgttttgttttttcttaaaaaccccttggtaaaagactccagggacctttgtatgaaaccagaagggggggggcaaaacccccttcctgagggtagggtgtttaaccggccctagggctcggtttttaaaaacagggtagcaaccccctgcgcccagggtaaaaacccccgttggtaaggggggtttttgcccctttgcttttttttgaaaaaccctaaaagcccccccaaaactgttcccccaagggacccataaagcttggggggccttttttttttacccgtttccaataaagcgggttttctcccca

SEQ ID NO: 577472 - DNA, 109 bp, Homo sapiens
  misc_feature (50)..(50): n is a, c, g, or t
aggatcctttctgcccacgactcgcacaagtacttaaatacaaagtcatntagtatacattatactccccatcgtaattccagattggtacagtatctttttcatttcc

SEQ ID NO: 577473 - DNA, 2089 bp, Homo sapiens
gacaacatacgacttgatctcgtgcccagagcttcaaccgaatggagtacatcgtatagcagaccgcggtgcactagtccgcacttgtctgaatgcggtagagatctgatgggcttgtaagtgtcgttataaagctagtcgtgtcatactcgaagtctgacgtgccagttctcgtcgtgaccttcatgaatacccatgttgttagtgttaagtatcttgacaatgcgtaggccttacactggcaactggtagatcttctagtggttggctagagataatcgagatgccggtatctgcacagctatgtcaaaaagagctatgtcaaggagtcccactggttgtgctgtccccgttgcaaggcacgacatcaggatctcggaatcacggctcccagggagccatggccagtgccctatgtgtctgatgagcgtcccagttctgccagaatgtctctaacctgggtgatgcagtgtcattaaagtcatagatatgaaatattacttttatatagacctcttgagattgtcgtcttgtcactagtaggcactgcactgatgagcgtcacaacaggtagtgcctggaacttcagagaggtgacccaaatgcagctttacaagaaaaccagagacaagggaattcccaacattggacttaacattgatactattccagactgcatcggccataggtaggcgctacgagggggcaggcggcgactttgatgctccggcacggagcgcggtaaaagacagactcacaaacgcagaacggacagggaagcgggcaatcaaaattccgtaaatgtgaccagaaaaactgagcccggctaccgtacacgaggcccacagagagctaataagaagcgagaccgaatataacggagtaaggcacacgacaggcagcgtaacgacaaacaggtgaatgggcaccacgacaaagggacaacagatatgagaaagtatgaaaagaaaaaaacgcatatcgtaggcttcttccttagcccgacagcaaaaaagagagaaagagagacaagagaagaaaggagagaaaagagaagagaaaagaacgagagagagcagggagggaaaagaaaagagcagaaggaaggaagaagagaaaagcgaagaagagagacaaaacaagacaaaagacgagcgaaagaagaagagaaaagaaacgaaaggagaagaaagaaaagagaaaaaaaaaggaaaagaaaaaaaaaacgagagacacaaaaggacgaagcagagaaaaacagagagagaaaaaaaaggaacaaaagacaagaaaaaagagaagcaggaaagaagcaaaagacaaagcagaaagagacacaagaaaaaagaaaaagacaaaaaggagacgaacggaaacaggagaaaaagcagaaaagaaggaacacagaaaggaaaagaaggcgaagaaacacaacgagacagaatacaacgacagacgagcaaagcgccgaagagaaccaaagaagaaagcaaacaaggacgacagagagggagaaagagagaacaaaagacagacagacagcagaaagaaatagagaagagcgagaagagaacgaaacagaaaagagagcccacagacggagaacagcaaggtaaacgagaaagaacgaaagaaagcgagagcaacgaaaccgagaacagacagcgaaaaagcgcggagaaagaaacacagacacaaaagtaagaagacgaagagagaaatagaacacgaacgcagaaagaaaggagagaaagaaagaacgagaagcaaagagaagaaaggacgcagaacgacggaacgagtgaagcaaacagacgaaagaacgaaaggaaaagaagaagaagagaagaagcgaggcgaaccagcaacagagaaagaaagaaaagagaagaaggcacgaaacacaaacgcagaagaagaacaatagacagacagagaggaacaacagagagagggaacaaataagacaaaaaaacaggcgaaacaatagagggaaagagcgaccaaagacagcacggagagagcacagaggagcaaagaagacgaagcaaggaaggaagcaagcaagaaagagagagagagcaagaag

SEQ ID NO: 577474 - DNA, 287 bp, Homo sapiens
cagggcagcctgcctggaggcaacagtttactaccatcaagttcagtgctttgactttgatcaactgactgggtttatccaaagtacagtactttgaagatgtcatcccattgtcttctgacctctataattgccactgagagatctgctgtcagtctgcttatccttccacggactcaagtttcttcaatctgaagatacatgtctttctccagggacatgtggaaaaaaaaaagatgttatacaaccatcaaagtggcaaaaataaaaaaaatcaagtaatagca

SEQ ID NO: 577475 - DNA, 367 bp, Homo sapiens
ctggacaacaggagccgcgctgtgttcctggactcacgcgctacagcccggccgtgggctgcacgccgccgtcacgtgcgcctcgatgttacgccggccgccgcgccctggccgccctcagcgtccgcccctgttgcgtgctgcgcctcagcgcgggcctctcgctgcctctgctcacctcggtgtgcctgctgctgttcgccgtgcacttcgccgtgccgaggcccgtacttggcacagggaagggctggcgcgtgctgcgctcggagcctgggcgcggtggctgctggtggcgctgacggcgccacggcactggtacgcctcgccagctgggtgccgtgaccgccagtggacccgtttcgtgcgg

SEQ ID NO: 577476 - DNA, 423 bp, Homo sapiens
agagaaaattattgtaatccatagaaaaaacaactggtttatttaataatgactgtcagtgtagccctgttcctggaattgaatctcccgcaatactaaacctagtacttcttattcaagtaattactcttgagggtcaggcgcggtggtggctcacgtctgtaatcccagcactttgggaggctgaggcaggccgatcgcctgaggtcagcagtttgagaccagaatggccaacatggtgaaacaccgtctctactaaaaatagaaaaattggccgggcgtggtggcaggtgcctgtaatcccagttactccggaggctgaggcaggagaatcgcctgaacctgagaggcggaggttgcagtgagccgagattgcgccactgcactccagcctgggtgacaagagcaagattccgtctcaaa

SEQ ID NO: 577477 - DNA, 315 bp, Homo sapiens
tgtgctgcggtgctccagaggatcccgggagtagtccaacaagaagcataacttatttatgatagaaacagtacaaatatcaaaccaagctgcagttactcctttgagacaccaaaaaaagtgcttcccatatggttacattgttaaattccataatcgcatttacaatatcattactgttgttctatcagggctcggactgcctattgctctacgacacatattgcttggtgaccatgacccaattcaatgtcccttaaacttctacacctgtttcatcgacctcttcctcttcactctcctactaggacttac

SEQ ID NO: 577478 - DNA, 126 bp, Homo sapiens
ttattcgtgttgcacccccgacacctcacctttcgctgtttgttgtttcatatatttatttaaaaaaaaatttatgtgaagaagggcagcaatactaacattttctgaactatggggtgcaacacg

SEQ ID NO: 577479 - DNA, 282 bp, Homo sapiens
atgaaccataaacaatactaccaatcaatactcatcattaataatcataatggatatagcaataaaactaggaatagccccctttcacttctgagtcccagaagttacccaaggacacccctctgtacatccggacctgcttcttctacacatgtacaataaactacgcccccagtctcaatcaatataccaaactctctccactcactaatacgtaagaccttcatcctcactctctacaatcttatccactcataacagagcagatgagagtggactaaa

SEQ ID NO: 577480 - DNA, 386 bp, Homo sapiens
gcttccttggccaggggacgccagtcggaggcaagttatcgttcaaagtctacgtgctatctagcctggccagtcaatgtctaaagtcgagagtctcctgataagagcctcgagatagcctgaatgaagagcttgtagtgtgagggttgagtcttttgacacactaatctgatggagatgcctgagagagccagtgtagaggcaaatggggagatactgctcctacggggagcctggtgattggctaaattggccgcaagaatgcactgaaagctatctcaaaagacagccttcaccagtggcgacctaccagggcgtcttgtcggttctaacctatttcattgccactaaatttgggccgggggaaggcggcatggcgcctggga

SEQ ID NO: 577481 - DNA, 730 bp, Homo sapiens
  misc_feature (52)..(52): n is a, c, g, or t
  misc_feature (59)..(59): n is a, c, g, or t
  misc_feature (72)..(72): n is a, c, g, or t
  misc_feature (87)..(87): n is a, c, g, or t
  misc_feature (95)..(95): n is a, c, g, or t
  misc_feature (454)..(454): n is a, c, g, or t
  misc_feature (458)..(458): n is a, c, g, or t
  misc_feature (468)..(468): n is a, c, g, or t
  misc_feature (509)..(509): n is a, c, g, or t
  misc_feature (530)..(530): n is a, c, g, or t
  misc_feature (548)..(548): n is a, c, g, or t
  misc_feature (578)..(578): n is a, c, g, or t
  misc_feature (592)..(592): n is a, c, g, or t
  misc_feature (610)..(610): n is a, c, g, or t
  misc_feature (618)..(618): n is a, c, g, or t
  misc_feature (622)..(622): n is a, c, g, or t
  misc_feature (631)..(631): n is a, c, g, or t
  misc_feature (637)..(637): n is a, c, g, or t
  misc_feature (650)..(650): n is a, c, g, or t
  misc_feature (695)..(695): n is a, c, g, or t
  misc_feature (705)..(706): n is a, c, g, or t
  misc_feature (711)..(712): n is a, c, g, or t
  misc_feature (728)..(728): n is a, c, g, or t
tctttattttctgtggaagcgaatagcagtaatagccagaaaaatgagaaanctctganaaatatccaaaantgtatggcagaaaanagagaaanagtgttgatagagaatcagctgaaagcatgtgcctcttttatacgaaccaggcttctgcttcagtttaccccaaccctccagcaacaaatcgtttgcctttggagaggaaccttaaggacctacagcaggaaattgaagataaaatgaaagggttcagccttccacacacgacagacacacctttgcctgttgactacgcctgaggtgagtgtatcccactccgggtttatgtgaaacagaacgccactccactacgactacttttccacactggcctcctgaatacgccacttttttactaacacgcacggggccaacactcttaactcctacctgaaacggacctatgtcctccccncccncctggtgttncccttctttgaatcacctccacgcacactcacccacacggncggccctcctttgactccggncacttcccccctgccacnccgttgccggggaccccgcacggggccctnggtggttttcactngtacctttgttcacgctncctttgtntacncacccctcnccctcnccctgacaccacncactcacactcgcccacactacactttgtttttgttttcacgttncttgaactannactgnnactgacactgacactngc

SEQ ID NO: 577482 - DNA, 168 bp, Homo sapiens
tctcaacctcccacgttggctgagactacaggtgctggccactatgcccaactaatattgggaatctacgtatacgtggattccagaggggtgacagtgaaaggtgggaccatccagtggcaggaaaacaagcttaagacgcccactgattctacatcatgctcctac

SEQ ID NO: 577483 - DNA, 358 bp, Homo sapiens
aatcggttatgacgggtctaagaaatgtacaggagtgtacggaacttagtggtgtatacgtatcctcagggatccatgccaatcaagaaatgagggtgctcgggatcagaggttcagagccgggttatacatatagagcactcagggagctttggaacaataaagattggtcagccctatctcaaacgtgaatcaaaatttctggggtatgggccttcggcgtgtgcagcaacaacttcgtccatcccgacctgtccatacggatcttccatactgatctttctgcgaagtgtggttactcggcgtgtgcagcaacaagttcgtccatcaggacatgtatggattttcggcgtgtgca

SEQ ID NO: 577484 - DNA, 247 bp, Homo sapiens
gtctctacaggatcccccaccctaacagctgggaataattctacagtcctgcatcactctgcatttaggtggaaagttgaacctcagagataattattaatacctgttaaataaatttcatgacaattttcaagattctgcatttccacaactactgatcagtgactgtttagcttgcttaagtaaaggaaggcaaacattgtgggttagagaacctctccatagctctccagaaggagccgaagtg

SEQ ID NO: 577485 - DNA, 258 bp, Homo sapiens
ggtttttaaaacccccctttttttttttccccccttgcgggggatttattcccccggaagggaaaagggggggggggcgccctcccccttttgtttttttcccccccccccccctttttcggggcctttcccccaaatttttttttttccttccctccctttaaaaatgggccggggggggggaagcccaccccttgggggggtggtttttgggtttcccggggggggtttttttttttttaaacccttcccggccca

SEQ ID NO: 577486 - DNA, 675 bp, Homo sapiens
gggttattctttattttttttcggaagtcttcctaaattaatgggcactgaaatagaacagggatggagcataaacccctccaaaaacaattttgaaaaaacccaaaaagtacacaaaaaaccccgtaaatacaaaatctaaccttttcccccagacctccctagagggtaagtaacgtgactttaagggcagctatataaatagaatgtggccccacaatttccgagggttatcaattatagccaactatgaggaaaatatcaccaaggtgagcataattcacagcaatgcacacaagatcctcaaggtcaggcacagagtggggggtggtggccaggggaatgagggaggctctaagctaggggcactgctggtgggacaggatgcccttgaggactgaaccctggggagaagacaaacgtaataataaaaacaaataacaagtattaagaatgtgttgacctatagtgaagatgaatataatatgaaagttcttatatatattgggaaaaggtatttggaattgtattgttccaggtgtggggtggaaagtatgaggcaatatctgccaagatatatctctaaggtgatagcagaggcagaatatatagattagagagtctattgtgaagagagagcctgaaaaaacgggatgctggttgaacaggtgttta

SEQ ID NO: 577487 - DNA, 421 bp, Homo sapiens
ctcagcttcctgagtagctgggaccacaggtgtgtgccaccacgcctggctaattaaaaaaaaactttttttagagatagggtctcaccgtgttgttcaggctggtcttgaactctgggctcaagtgatccccccacctcggcctcccaaagtgctgggattacaggtgtgaaccaacatgtctggcccctcttttttttttttttttttgcgatggagtctcgctctttcacccaggctggagtgcaatggcgcagtctcggcgcactacaacctctgcctcccaggttcaagctatccttgtgcctcagcctcccgtgtagctggaattaataggtgtgtgccaccacgcctggctctttggttttttttttattatttttagtagagactgggcaacacagcgagatctcttgggggt

SEQ ID NO: 577488 - DNA, 833 bp, Homo sapiens
gtgataatctgtgctttgttgggctcatcttccatgcattgagcctccacgggcgcgtcgttcctgtatgcctgaatgggcaaatgtcgcaagtgctggaattaacggtcatcatgtttcacaggagaccatccaatcacaagtctaaagctaatttgccaaaggtgtgggtccgatcatctcagaacgtgccaatgacctaccgtgggaggtactattgctgcccgtctcaacatcccagttagccaggtgaacctactaaggatgcccaagcctgcgtacgtacactggcaagtcatctaaatggacatgagctccgagcagctggatgacattttgaagtaccacactgagatagtgtttgccaggacctcccctcagcagtaagctcatcattgtggaaggctgccaaagacagggtgctatcgtggctgtgactggtgacggtgtgaatgactctccagctttgaagaaagcacacattggggttgctatggggattgctggctcagatgtgtccaagcaagctgctgatcatgattcttctggatgacaactttgcctcaattgtgactggagtagagcgaaggtcgtctgagtcttgtgactaactttgagagaaatccgattgcttataccttagatccagtaatcatcccccgagatcaccccgtaacctgatagtatattattgcaaacatacccagtacactggggactgtgaccattcgtctgcattgacttgggtcacttgaaacatggttcctgcgatctccctggctttatgagcaggtgagagtgaacatcatgaagaggacaggcccagaaattcc

SEQ ID NO: 577489 - DNA, 1177 bp, Homo sapiens
gcggcttttgtctctacagtaggtccccccgtttttccccttgtcagaagttttctctgggggaatttaccgcgtgtcgtatggggtcccgggggcgtctggcccctcctgatcactcgtgtggttatcctctagggctctttctttgttatacacccgggggtctttttttttctctgcaggatcctgggggggccctttgtgggccctcctttgcgcccggggaccccttttgggcggtgtgtgtcggggccccaccccgaagtattgttgggcgccccccacgggtgtttttttgtgtcccggccgattttctgttgggggtgttcatcccacagctcgtcttttttgcccgctggggggcactcccccatgcggcctttgttgcgccacaatttcctcccacgggcacgtttcactctggtggggggccctcattagggggtggttgttttatctggccctccccccccctccccccctcttttgggggcgcgccacccccccaccccaccgctgtatttattagtgtcctctatttgctacacacgtcttctcgagaggcttctctttttgggcgcattttccccctttgcccgagtggccactgtgtccctcagttttgtcacggccccagcgcctctccgcgccccttattttgtcttgtggcacttgagccacactcttttatgcgccacacttcgcaggacacgcgtgtttgtcctccccggcccctcgtgtggggtggcccccctgttcctcttgccacaataccacgatttggggacaaatggttacaccacgcacagacatgtggttttctccagatctatctcactcttttggcgcgccccaatgtgacacaccccagagggtttggaatcacacgaccccctgtgagatcctcttggtttcacccaccacgcgtctccctggtgcgcagaatccaccccacccgggaaattgggcgtttgccaggtacaccagcccgacactggcgcctatgggtctcccctttattctcccaccccacgccccggacaccccgggtttttcccccagtgggcccactccagattataatttttctcaccccccaccccccccccccattttgtgggtgaggggattccccgtgggttttcccggccccattaaattttccctcccccctgta

SEQ ID NO: 577490 - DNA, 738 bp, Homo sapiens
gagatcacaccactgcactccagcctgggcgacagagcgagactccgtctcaaaaaaaaaaaaaaaaaaaaaaaaaaaaaccaaagcagttgtggttgggggaccccaaataaaggggggttctatttcttgtggttttgttgacccccccccactattttccccgtgtgccatttattctggggaacagcagaacaccgggttgtgggcttcaacggaattttctctttctccccccattcttattggcgggcgtgctagcgggggctcttgtgccgtgtcttctctctccgagggggcagggaatctctgtgaccgctataacaaacaacctgggggggttctcgcgcgatatccttttatacccacaactctgtgggtctccccaaggagatcccgggacaaggagaacaccagggaaatatttcaccccctgtgaagaatttttgggcgcccctttcctatatgtgcttctctcaattctctctatatgtgtcatattgtgcatcatttgcgcgcaccgcaagcactactattgccgcgacaaaaataaaacaaaaaaacacgaaggaggggtggttttataactactacctaataccaccaggaggggggtggaaacaccaaagagcgagcaaagttgtcggaaacaaacacaggttggttggggaagataaagttgggtcgtctccttccttttctatataatacagtccccccccaaagtgaaacaaaccc

SEQ ID NO: 577491 - DNA, 307 bp, Homo sapiens
  misc_feature (79)..(79): n is a, c, g, or t
  misc_feature (94)..(94): n is a, c, g, or t
  misc_feature (97)..(97): n is a, c, g, or t
  misc_feature (104)..(104): n is a, c, g, or t
agtgacatgatgagtgcatttaatctacaatctacaaaactatacaaattaccaattatacatataaaccattcctccngaagctgtttgaggnggnactgaanaaacactgaggttttttattcccaacaatggaacaaggctcacgccccagcagcacattcccaccttttagtctagcatcacaacacttcccctgggatttgtacttatttatatattatctaagtcctaggacgttggtaccctaatttttaagtcactcggatactgagttaatcactcccctaaacctattctaatccat

SEQ ID NO: 577492 - DNA, 1728 bp, Homo sapiens
  misc_feature (379)..(379): n is a, c, g, or t
ggcacgtctccggaagcgcacgtcggcggtcggttccctcgttgagcgtagtcaccgagctgctctcgcgagtctgatgagtttgcaaacatgtcgcgtttctatccacacggctgcagcgcgtagggaactatgcgtggtacctggtaagacagggaagcgcggatcagtacatgagagatcagattgtcacatgttcgcttatgcagatgaaacagaacgcgatgcatcagcgaagaccataaccaaggacgggagttcataggtgcctgactggctcgccaaatggcaatgcgacaaagtattcctcgctatgggatcccattcgcgagggcacacatgtcctgggacacgttcctatatgatgccaggctacgancctgcgcactgtgatgcgtgtgatgacctgcactgagcgctgaaggaaaggatatatgtaccgtatacggaagaccccgtgttgacgtgatacccagaggcatacaacgagtttcttcctgaactgagggggcaatgggcaagtgttctactgctttcgcttggaaaacgcgtagctaggtgcatacagtgacacccaacgtagacgcatttggacacggaaactagggctcgattgcttgccgcccgaaaacccctcccatggtctggaacgtagtgggactcctggattgctaatcctcatgggcaatagttccagggaacacacgttcgcagcattttaaccactgttttgtgacggtggccaaaagaacaacgcgggcaacacgtggtgggacgaaacaacggcactgggcgttgtaccttgggggcaacgagccacagggggaccgtgtaaccacagagcccggtgaaaagtcgcaatgaccgccagagaaccacgtaaggaacctggccgctgtgtgccacaggaaggaccttctattgccggaaaagtggttgcccaccaggaagaaccgcataaggagggcgacacacactgtggtcctttgcgtgtgacttcccaaaacgattacgaagcagtagcgggatccacccattggcagcgagacggggtggcccacaggaaagggaaaagcattgaggcccgacgacgatcgccccaggcacaacagaagctgggacaatggggaaacataacgaaagagacttgggacaccaatatggcggaaagagaagcgccgggcagcaatgggacacgttggaacaacgggacgggacagagagcacacaccggggacaaaggtagggactgggcgatataagagcacgagacgagaggagaccagcgtgatgccacacagaagattgcgagcacgcgcttcgaaaaagaccacggttgacacgcgcgagaatgcccttggtagcacacatggtgaccgtgagggagtcaaacggagagggcgcctcaccaaagactggggcgcactatgcaaagggagaatccctacgggcgccccaagtgcacatggagggcataaaacgcatggcgagcacaacaggtagcagaaatggaggaccaccaagtagacgcaagatgagccacggggagcaaacaactatcgggagaacaacaagacaactaaggcgtgcatagaaggacaccgcagagaccacatagggcgcctgacgagacgattgctgcagaaggcgcgaccacaagaggagaacgaaacaaacgagggggcgacaggagatagagccacaagaaggacgtagtacgacacgaca

SEQ ID NO: 577493 - DNA, 372 bp, Homo sapiens
aatctattttgctataaacgactaaggtgctctagtatatatctgagactgagtgatacaagaatagctaccattcactgtgtacttattagaattgaacatggaacatggaccttcatcattcttctaacggcatacaatctaataagaggagttaagaacaaattgcttcacaaattataaaaatcagtccactcacaaggttgggcatcctgtagttaataagtgctcatccatcttggctacagaaatctaaaattcccatggtttctaaggtgcttgatataaaaggggtacttttgactgtccaggaataaataattttatttcacagacagaagacttatttatgtagaatcagggctgctggat

SEQ ID NO: 577494 - DNA, 755 bp, Homo sapiens
atttttctttctcccaaagaagattcatggatagtcagactgaactgtgtgcaacaggaaaagtcaaaagggaaaaggtagctgatgaggttacatggttacatgttctacatcatgcatagtagcttgaaatctagtctggagaaaactggatcaagattctagcccactggagttgcaaggaatgagaggcaaaaattctaaagatttgggttatctctcccccccctcgcgcgggcccgcagagagagtggagagcaggaacttacagttccaacaagacatcactgatagtctggtagtcacacgacattagattcaagtagagagagcaggtctttactgtttagctgagtccagttcaatacaaacatgtacatagaaacgttagtcctttgagactgacagtgattaactgatccagttgtcgggtgggacactggatggtaggttcatctgctacgacgaaggcgacttgcagaggctcccttttagtcgcctgctgttctttttagcacactgagcctcacgtgtgaccctgactgcacgtccctttgcgtcctgattattgcgagaggccccctttgattttggggatttactttccgccactggccgtttacgaatgagacagattttggcccctggttgtgccagcccgggagaggacctcggttggccaatcctagcgttagctgttccagaacgtcatggtttggtgagcccacgcgtttggacctttctccttacttttg

SEQ ID NO: 577495 - DNA, 200 bp, Homo sapiens
cccgaatcttcgtcccatcagcagccagactgactctggacaatcatgataagtgtgacaatcatcactccctagaagtagtaccatgggtaaggaggccaccagggtcatgcttacaagccccaagtaatcgtccatcatgggagcctctatcagcattgttattcttgtccagacgggtcctgatgagagcaagatgg

SEQ ID NO: 577496 - DNA, 592 bp, Homo sapiens
atcacttcacagagttgtgcaacctgaccatgacttattcttaaaacgttcgcaccaccgccaaacgaaattccacatccattaatcattcatatctctttcccgtgcaaagcccccaggtatctagatacctactaatctgctttctgtctctatagatttgcctattctagactttcatagaaatggaatcctacaatatgtagtaggaagattttaaataatagattccattgcatcagtaggcataagactataaagattttctactcttcttgtatctattttgataagttgcatttttcaataattttgtcaatttcctctaagttgtcaatattattggcataaagttgtaaataatattttatgtttttaatttctgtataatgttttgtgatgtcctcttttacattcatgatattgatcattcatatttatcttcttttttcctggtctttttttttctttttttgagacggggtaccattctgtcacccaggctgtagtgcagttgcgcggtctcggctcactgcaatctccgccgctcagggtcaaatgattctcccacctcagcctcctgggtggctgc

SEQ ID NO: 577497 - DNA, 521 bp, Homo sapiens
cagtcaattgaatcactgggtgaaaagtatggagagggaaaggccaggagataaggactatgtgttcagcaggaggcccaccctggcagagccatggagtttgaggttcatcctccctagggtgaggaccaagtttttcttcagaacagagatcccagctgggcaacagagcaagaccctgtctctacaaaatatttaaaaattagctgtgcgtgggctgggcgctgtggctcgtgcctgtaatcccaagactttggaaggccaatcacctgaggtcaggatcacctgaaggcggatcacctgaggccaggagttcgagactagcctggccaacatgaagaaaccccatctctactaaaaatacaaaaaaattagcagggcatggtggtgggcacctgtaatcccagctactcgggaggctgaggcaggagaatcacttgaacccaggaggtggaggttgtagtgagctgagattgcaccactgcactccagcctgggcgataagagtgaaactccatctc

SEQ ID NO: 577498 - DNA, 453 bp, Homo sapiens
ttcagcgatgcatactagagtaacactcgtacacatatatctaagaaggtatataagcacagcaataatctttctaactaccggatttacatcaggtaatatattcacaggtctcctaccttgtaatcagtgacccaaataaaaattctctcatttcccagttcatctgcatgttgttattgggccactgcaataagcagcccgaccctcagtttggtctgggaacatttctgctgaggaggcaactactcttactacttgggtatattttcttccagggcttttcaggggcagttatcggtgtataatcctgacagattgctctcaagcttcaccactccacacttccaacatataatggcgtgtgccttccccatcactggttctttattgtctataaagtgaggcccaattttaaatcttatgaaattctgtgtctgtgtcagagattta

SEQ ID NO: 577499 - DNA, 284 bp, Homo sapiens
tgtcctgtgccacgaaagtgatgctggcaaaacgtggatatctaagtgcctagatgttgatctaagactctatataacacgagacagaacgagtaactcagagtgcaccatacacctaattgtcagagctagaactcaccaaatgtatcaagcatatctttgtgaccttgggttaggcaaagacctcttagatgtgacaccagtggcacaagccataaaagaaattcattgatgaattggcttcattaaaatgtaaaacttttgcatttcaaaatacgttatta

SEQ ID NO: 577500 - DNA, 346 bp, Homo sapiens
taatctagaggatcccttggcattctggactcagatgtagttttctctgcgcgtgtcgtattcctcctcccaaagcgtgcattgtgtcacagcaggtctgcctgtgccacaggagagggcagcagtcaccagtgtacctgctgctgcctgtgaatctaggatcggacagctgtggagagcatgctgtgacagccacagcctgcagcatgggctgcctcacagttctgcctgggctcactttaaagcaccttttggtttccctcctctcttgttttgatccacaacacagaagctctcgtgtcatggtcactgtggtagggggtaccgaggctcgcaaacggtaatc

SEQ ID NO: 577501 - DNA, 919 bp, Homo sapiens
taaatcacagctgttgaaggcttgagttcgagctttgtgttgctgtcttttaaatccagtttcttataacataacctaaggcctatttgcatcacaccactcacgtctttattgtgcttatggaatgctgataatctgaagctttttttcaaaggttagaagaggttctcaagagcatcttttaacaggtgtatataaggcaagtacgtatcatgaacaaagtttcggtattcgttttattataaataaaaaccttaggtgtgatcaacaatgacaaaaaagcaacacgaaaacaagcagcaggagcaaaactgaagattccctacctgagacagagaagaactaagacatatatagcagcacattgcaagatacctatatggtagaagatctcccttagattaatgtggcgtttagtacctttgttgtactggaccggaatgcagccacatttttattacaaaaataaggagctgttcgggttgtacttttagtctcaccattgcgaaaggtcactccaataaagatgatagagcataaaataaactctgtgctaaatagagctaacattctaattacaagttacttggaaacctttattctgataagggagaccctggctcctactttgccactggctgggcagaactactacagagagtgaacgcacgggcaccgctgctgacgactctccgtatcatactcagcaacttccagttgttccgggttgaagccacacgagacataaacaacacatgtgggccggccaaatttaaactgtgcggcgcgccaggaaaaggatacgtgcaggaacgcgcaggggtgtccacaaacaccggccgctgaccaggggggcgggtacagcgacacacccggcgcgagtgaggccgcccgccgacgcacgcacaaacagtcgcga

SEQ ID NO: 577502 - DNA, 267 bp, Homo sapiens
  misc_feature (58)..(58): n is a, c, g, or t
gcctttggggcccccttggggttggacaaccccccctttaaattcctttgttttttcnaccgggataatttttggccatgttcttttttttttaggttcagggcagttttgcccccccgcccccctcctggtggttccccagcccttttccctggccctgggttggaaaatttgttttccatttcccctgattgcccccttgctggccagcccaggggccttttccatgttttttccccccccgtaaataaacttccttccccccca

SEQ ID NO: 577503 - DNA, 310 bp, Homo sapiens
  misc_feature (178)..(179): n is a, c, g, or t
gaaaatgttggtgaaaagtgagtctcgaagtggtagctcacacttgtaataccagcactttcggaggctgagacggggatcgctcgaggccaggagttcaagaccagcctgggcaacataacgagacccccatctctaccaaaaatttaaaaattagccgggcatggtggcgcactgnnttgtcccagttactcctgagactaaggcaagaggatcccttgagttcaggagttcaaggctgcagtgagctatgattgagccactgcactccagcctgggtgacagagcaagactcttatctacctgtggg

SEQ ID NO: 577504 - DNA, 442 bp, Homo sapiens
gggtaccctatctttccctttctttcttctattacatctatagtatatctattcttctgaatcatctttcaattatatacatctctcaggactctctatttcactagcagaattaaatatgaatactttatagttcaaatccacatattttgaaaaatccgtaggattaaaaagctttaaaaataccagagtatttatttatcctagtgattattttttcctccattattcatttaatcaacagcgatatgctagtatttttagaagttcatattttcttccccaagttggcttcacttgtcattttttttaatcaactctgcaatttgtcagttattttccattcctgttctatcatcagagggataacgatacctttcttatctggaatcagctgtacataaatacacacatattcataattcctctttctttgaaaaga

SEQ ID NO: 577505 - DNA, 167 bp, Homo sapiens
agttcaagagcgcgtgttcaacctgatggccgattataaaatcgagcccaagttaactgacccactaacagcgtgcccgctttcaggaagtgaaaaaggcgtttgtttcagatgctaaagctaaagtagaggcaaagaataaagaaactccttctgagacagtgaat

SEQ ID NO: 577506 - DNA, 414 bp, Homo sapiens
  misc_feature (7)..(7): n is a, c, g, or t
  misc_feature (98)..(98): n is a, c, g, or t
  misc_feature (208)..(208): n is a, c, g, or t
  misc_feature (255)..(255): n is a, c, g, or t
  misc_feature (261)..(261): n is a, c, g, or t
  misc_feature (266)..(266): n is a, c, g, or t
  misc_feature (272)..(272): n is a, c, g, or t
  misc_feature (279)..(280): n is a, c, g, or t
  misc_feature (413)..(413): n is a, c, g, or t
gtttgcnaattggggggttgtcggtgttgctcggggacgtgccttacttttactctgaaattcactttaactgcttgacatataatttaatacttaanaataatatagctaagttgtttaatagtatttatagaatgctacttttctgggtagacatgtttcacaaaacagttttcaattaatgctgggcattcatttgataattgtnatcataatttgattcactgattaatggattaataatttattcaatantttggntgccntaaggncccctgnnagggataatctgatggttgctcattgtgcaatcctgcctattagtcatcctccgcccagcctctgctcgctttccccctctgttgacttacatgtttccctgtgtgtgattttggtcaacaacaaaccatcgnt

SEQ ID NO: 577507 - DNA, 255 bp, Homo sapiens
cagtggcagctgtagacagaagaacacgaggacagagttgctgcccggctctagcagcacccatctctctgcacgcacagacttaactgtgtgttgtcttctctttatctccttcggaatacaaacagaaccttgcacagtacccaggtccgccaggaactgaaatcccatattcagagcttgccagacctctcactgactgtccaatgtcacatgcgctgtcttagacccccctttccctctggctgggcgacc

SEQ ID NO: 577508 - DNA, 179 bp, Homo sapiens
cctgaagaagaccatcttcaagactgatcattgtagatggagaattcaacataaatacagcaagaaaatgtgtttgggcttatgaagagatgactgcttaccttaacatgataactttttagaacttaaactgtataggatgatggtgaaattcttaagaaataataatgaaatcaaaa

SEQ ID NO: 577509 - DNA, 1008 bp, Homo sapiens
ggagccgcccagctcaccagatgagcctagttcctggccatggattgccccggtaaccatgatgcccagtcaatcagcgccccggactgcaccagagccatggtcgcgcagaagagcactgatcgtactgtgctcactcagcagaggcacgtccttcaacttatgccatgcaaggaggcttgctgcgagcggcttcttgacagcaagacacaggcatgggagtgctggtgcgaggtcggcacctcgtatgcctatgtacacgttcaatccctatcaattgccaagaaacggacatccacaggtaaaaccgtgaaggaccctgtcgacactctcagtgatacctggccagagtctggtcctgggcttcatcatagagcaaggcccattctgagacccagataatttgtcggccgtcgcacaccaaacacgtaagctctggatagcctgctgagacacctttgctcgatgattcccgatggttaccccctcttgccaagatggtattagagagtacccctggccaattgcgtgaaacggctaggctgctgacgcggagtctgtccataaggacgagtcttgctattacacatttcacagctggccatgtcatgaaccgaaggaacccttccaggagataaccgacaggcgagctgcgtttccagtcaagcacattggttgcgccagtgggctccatagtactcgtctgcaaggggattccacggcggacatgacatgtcattctctggccaattcagcagtggcattctgccattgtctgtggctatccaagtcttagaacctcaagctgaccattatagcatttgggcacactccaggcagagggcccggaattccaaatcctggaaaggaatggcaagaaacgcctggagaaatatttggcgcatgagacaaccactgtaataataggtcccgaagcagcctctttggagctaaacttaccgggcaggattcttaattgaaacacagaggtaccggatgcggagaaaa

SEQ ID NO: 577510 - DNA, 893 bp, Homo sapiens
cgggctctgccccagctcagacactcctatgccttggtgcagctgccgggcgagtcagcggagtagcggccagcgggcgatggagacagagagacaccctgacgagaggagtgcggggtgggggaggcggggagagtgcgtggggcgtgaggctggcatgggttggctgctggaagcttggatgctgtgtcctgtgctgctcccctgctgccctgatggtgttgcagtgagtgctcgtgaagctgtgcttgcttgcacctgctggtggcccagtgctggctgggcttgggtgtggcttggtgtggtgctgcttgcctgcctgccgcctgcctgggtgtgcgtcgcttggcctctggcccctttgttctcgcgcgctccccctctgcctgcccactcccctgctgtctgcgctggcggcggctggtggcggcggcggctcctccctgcccgaggcagtcggggctcggctgcctgggggcgggaggggggcggggggagcactgccatgccgccgagagtggggggcgattggcgaagctccgggtggcttacgagtacacggaagccgaggacaagagcatccggctcggcttgtttctcatcatctccggcgtcgtgtcgctcttcatcttcggcttcttgctggctgagtcccgcgcttgcaggatctgcaagccacggaggccaattgcacggatgctgtcggtgcagcagatcggcgaggtgtcggagtgcaccttcaccttttggcgccgacttgcaggggcagcttcgcggtaccccttgcgtccaggtctacgttaagcaagtcttgagtccaagtctagggcgctggtgcacagggaagagcaccaggttccttgacgaacccgaaggtgctcctatattcctcc

SEQ ID NO: 577511 - DNA, 178 bp, Homo sapiens
agtagggctcagagctggtggctctggttctcttcacctgggtagagacttcaccgtcctggcaggagctcgggggagcccttccccaaggtgctgggattaccggtgtgagccactgtgaccagccttcactaatacctcttcatgtgtgccgagcatcccaataaagaaggaaaat

SEQ ID NO: 577512 - DNA, 108 bp, Homo sapiens
tagagctcggcctgcttttgagggttcagcagctcctgcccaagtcctacactttactgacatgacccacattcacagtactctcctgaaactttgcttgttccgctg

SEQ ID NO: 577513 - DNA, 127 bp, Homo sapiens
gtgttcgttatcggtcggctcagtgtcagtacgcgatactaacttcttggtctaggcacatgaatattgtagtggaggaagagactgatactacaggtggatgcggcaatggattattacactcatg

SEQ ID NO: 577514 - DNA, 379 bp, Homo sapiens
cttattctgaggactgtagaatgagtaggagttagatgaagaggaagtaagacgtgtttcacgagtgcaatggaagtcggcgcgtggcttttacctgttatccctgcgctttggaaggccggggtttcacgggttagccaggatggtctcgatctcctgacctcgtgatctgcctgcctcgacctccaaagtgctggaattacaggtgtgagcactgcgcctggccagtctgtgtctttagtacttacagtgtagcagttgccacagccacaaaatcacatattactgcctggtgtgatagatgcatagtaaagtatgagcaaggcacagtggtggttagtgtgtgagaacaaatgttcaactttccctttggccctaa

SEQ ID NO: 577515 - DNA, 523 bp, Homo sapiens
tttcatgtctcaagccaatttctcttcctcttcattttcgctgtgccataccgattccgcatctgttggttcaacatcgccggtaataaattctcttctcttgtcaaagagaggctggtatagcgctgcatactttctttccaagtcatgtactacttcatagaacttggtttcaatgtgagcacatctcactggaagttgtttcaaggcattaattcttctattgagggcttaggaaaactttaaatgataccgagaggggagataagtgacattgccagttcgtcacggaaaagctgccagaactggaggattctgcatcacctgatctgtgagcttttctgtgttacttgcatttttagcagcttccacggaatctgaaggaaccccatctgaaaaactgtgatctgccatctgaatgtttttatccccttaaaaacgggaagcctgaacaatccggcgcgcccggccgtgtaaccgccacagacacagcacgcggggcgggctgcccaaggggagatat

SEQ ID NO: 577516 - DNA, 548 bp, Homo sapiens
taacttcttagtctcctaaaactagacatttaaaccatcatttgtatatatgtgtgttcttttcttggtggaaaggtttatgtagacacaaattatagttatcatgataacacctgtagttatactaaactgtttcatttttattgtaaaaattttttcagtatcagacctttaaaacaaaaattatacagtagcatgagtttgtgctaaatggttttccaaaataattgaaccttcagtagggaacccatcctttaagcctatgttttcttccttgagtctcctagagcttccagttcactacacctaaacccgggcatgcaccattggaggatcaacagagtccttatcagcggcggcagttggtaatatttttgtcggtgtgcttatcagctttgactgggattagtcctgtcttacatggagtataataattccatgagaatagagatgtggcctctaattcctttataattcctaaaagtactcagaactatgttataatccacacactgtggggaccaaataaactttttttgttgaccaaa

SEQ ID NO: 577517 - DNA, 104 bp, Homo sapiens
  misc_feature (32)..(32): n is a, c, g, or t
tagaggatcccaggctgatgtggagtgagcangaaaaaaaaaataaaactctcatgattggtgtggctaattataattcagcgtcatttaagcacataaagacc

SEQ ID NO: 577518 - DNA, 476 bp, Homo sapiens
tagccactaagttgtagagcggctccaagaaatgcatgagctaggatagtgaggtaaggcatgggttagagattgtgctgcactgcacgctaactcgtgataatacttctgggtaatgttttctctgtattcttgcctgtatctttcactgtgtatagagtccagaattctcagtataagtctcccatgtgtctcccttgtagtccttcaagacctgtgtcaccccaatctgtcctggcttcctataattccccaattcccaaccaatttcatgttttgcttctggcccttctcatctgtaggaatctttgcccacctcctcatagctctggattcttgggctctaagcctgagggcccaggccctcaaggagagtccagagatacaggcacagaggccctgacctcctcacatcttggaaccgtttacatactggcactagccgaaagagttactggcaagatacatggagcctt

SEQ ID NO: 577519 - DNA, 129 bp, Homo sapiens
ttctccttgcatgtgatgatctagtaggcacgtcggtcaacaggacacatgcctcctctgactataacctcttaatagtgtgtataatgaaaactgtaaactttgttaaataaacgtgtatataccttg

SEQ ID NO: 577520 - DNA, 148 bp, Homo sapiens
  misc_feature (111)..(111): n is a, c, g, or t
gggtatggacatccaccagatccactacttcaaagttttgcttggtctctggagtgggcgggctcgggcggtcaagaaaagccttcacccagtagtctacacacccatatnttcctgggagggatgtccccagaggcccttgaaggga

SEQ ID NO: 577521 - DNA, 293 bp, Homo sapiens
  misc_feature (136)..(136): n is a, c, g, or t
  misc_feature (146)..(146): n is a, c, g, or t
  misc_feature (196)..(196): n is a, c, g, or t
  misc_feature (244)..(244): n is a, c, g, or t
  misc_feature (257)..(257): n is a, c, g, or t
  misc_feature (266)..(266): n is a, c, g, or t
  misc_feature (279)..(279): n is a, c, g, or t
  misc_feature (282)..(282): n is a, c, g, or t
  misc_feature (284)..(284): n is a, c, g, or t
  misc_feature (288)..(288): n is a, c, g, or t
gtttcagtggagcgtatgagcgtcaagtcctgctttttcagtagccccattgcggggcccccccattcatcctgtttgaaggtcctgggtttggtgtgaccccttggcggctggtgggtggggttttcaaatgggngacggcgctntccggcaaccggggatggccgtgtccgcactgaccaggcctgtggaaagnggtcggcctaaccttagaacacatttggaactgaaaacagggttttcnatttggacagaanagttagaanattttattaaagnggngnaacnttgga

SEQ ID NO: 577522 - DNA, 526 bp, Homo sapiens
  misc_feature (526)..(526): n is a, c, g, or t
tcttttttaaaaagagacaggtcttactctgttatccatgctggagtgcagtggcgccatcatagctcattgcagctttgaacaccatggctcaagtgagcctcctgcctcagcctcctgagaagttgggattatgggcgtgagccactacataccaaattttctctgtcctctcacctgtcgataggcacttaggttgattccctatctgggctactgtataattctgcagtgagcatggagcgcaggcatctctctgagatcccgatttcaattcctttggatacatacccagaatgggggactgttagatcatatggtagctccatttttaactttttcgggcacctccatgttttccataatggctgtattaatttacattcccaccaacagtgcacaagggtccctttctccacaccctcaccaactcttgctgtctccagagttttcggttaacagccatgatatctcattgtgattttgatttgcatttccctgataattagtgctgtttctagttctn

SEQ ID NO: 577523 - DNA, 110 bp, Homo sapiens
ccacaaatggaagcgccccaaatgcatcccccaccactgcaagccagccatgggcaacagagcactgaccctgtactcacaaaaaaaaaaacactaaacagggggaaaag

SEQ ID NO: 577524 - DNA, 202 bp, Homo sapiens
ttgccaaaaaaaaaaaaaaaaaaaaaaacctggccatattttaacatgggtcccatccctgctgaaaatgggattttcccccctttctgccttttgctattggaaaaatgttttttagatccaaaaccttaaaggaaaaaatgttggatttataaatgctatttttttttttacttttataataaaagggaaagccaattta

SEQ ID NO: 577525 - DNA, 422 bp, Homo sapiens
  misc_feature (377)..(377): n is a, c, g, or t
  misc_feature (393)..(393): n is a, c, g, or t
ctgagacagagtctctctctcgtcacccaggctggagtgcagtggtgggatcttggctcactgcaacctccacctcccgggttcaggcgattctcctgcctcagcctctaagtagctaggattataggcataagccaccgcacatggccacaataatgcaattctgtgggttttagtgtatttacaaaattgtatgatcatcaccatgatctaactccggcctgggtgacagagtgagaatctatttcaaaaaaaaaaaagaagctgggggagcttggattgaaagggaggaaaagatggtattacatttttctcctggtttttctagtgaagttattctccccaacctcaggaagtaccaagcttttttggtgtantcatgccagattcccncctttccatgattaaggaatatcgggaat

SEQ ID NO: 577526 - DNA, 110 bp, Homo sapiens
ctcgatcgttaccagcaagcttgcggggtaacctgatgccccctctcctccccttcctcaagcacgggacgtttatataattataggcagggatgagatgtgcacctagt

SEQ ID NO: 577527 - DNA, 817 bp, Homo sapiens
  misc_feature (283)..(283): n is a, c, g, or t
  misc_feature (643)..(643): n is a, c, g, or t
acactgataataatagggcatttttttcggcacaccctccccggtcaggtcggctcccccccctcgtttgtgccgccccctcgtcggtcggattcgagaaccctctgtacgaggcatacttgtttttgcgcccctcttcgcaactgtttaccattgggccacaacacatttgcgcgtgacattggttgctcccacaactcgcggttcggtgaaaacctctgggcctcaggagtgacacccactctcacactggccgcgtagttgtggtcgcccacgcaagganaagccccaagaccaaaatttttttctttcctccccgcaccacactagacatgtgtagacctcctctgggtggcctctcttattcaggctggcccacacagcccgattcgcctggctggccacaccccactctcaggcagcccacaaaaaaccctctctctttccgcacagaaatgttgttttttattgtcacagcacaccaggcgtacacattcaaccccataccgcctctttcacagagagttcccacagaccccaccgatatttgatttgagtgcgtttctctcacaccacacgaagcccacatgcccctcttctatctcacacacagaggggtgtgtcgagagaagaacaccccgcnctcttctatgtctcctctctgcggaagtgagaatgcgccccttagagtgggcgactatttggtgccaggcgatgcatggtctctgtaacatcaaatggtcactatggtagaggccaacccccgataacctttgtctttatgacttggacttaaaacctgcaccatgaatgcaaa

SEQ ID NO: 577528 - DNA, 175 bp, Homo sapiens
attaatagtcagtcctggttatagcagtaacatcgagtgatatagccccctctatcagttctaagtcccagagggttgcctcgaggcaccccgtctgacatccggcctgcttcttctcacatgacaaaaactagcccccatctcaatcatataccaaatctgggtaccgagctcg

SEQ ID NO: 577529 - DNA, 272 bp, Homo sapiens
aagaggtcccctaggcttcctcctacagtttgaattccgttagcttgagggtgtgtacagccaggacgggtggaggggctagagaggaggcgagccaccactgaccagtgtgaaggggtagggggtgacgctggaccggggcaggtgctgggtggcaggtgggggagtgagagccagagctctcaaccaagcctctgagaggccgcagggcttgagaatcgcagacccagaggctaatccctgctcaggccaagaggctgtagccagaaggt

SEQ ID NO: 577530 - DNA, 706 bp, Homo sapiens
tatgacactcttagatagaaactgggtaactcttcatgaacttggggttggcgaagcattctaagatatgactttaaatatctcatgcagcacaagaagacaatttggacttcattgaaatttaaagcttttgtgctttgacaggataccatcacgaacggtgaagagacaccctacagaataggagaaactatccggtgaatcataatcttatagagactccgaaataactttcaaaactggacataggatctgagttacacacttttcccaaatatatgtacatggcccataagctcatggaaaagatgcttgacatcattaatcatctagggaaatgctacgcaaaatcaaccatgagatatcacttcacacccagtaaattggcgttagaataaaccagatcgtcacaagtgttgacccagagattgtagagagagttggaagccacagatactgctggtgaaaatgtcaaaggggtgcagccactttatgcagttgcaacttctcaaactgatttatggccgagctagcctatgacctagaaattcctctcctaggtatattaccaagtgaaaggacacttatgttcacacagaaacttgtactgaatctcttcaacctagttctaattacccaatttgaacgctcactatcgtcaaagggactggattccctgcgtcactatacgctgttagcccacacc

SEQ ID NO: 577531 - DNA, 1671 bp, Homo sapiens
gcctctccttcagtagcgtaatcattcagcacccgcaccaaggacgtgtagtacgtatgtacggaccgtcacgagcactcgagtagtgcctccctctcacttattgccatagagataggaggtgatcacataagtacccccgagtggagtctactgaccatgccgtaccttgataagagccctgcaaaggccacgcaacacctctgcctaaaaacgtagcactttgtgccctcacttggtcccttgtaacctcctctcagccccgcctttcgcctaacactcgtggccacgcgtggccccaccgctcgcatcagacacaccacgcactcgtccacccccatctccagtgcgtgccgatacacacgtcccacaaccataacacccgtgaatcctctagcgcctatcaggcctgacacacggagcgccgagcgcgccagccacaccatgagggagtcccccctatctcccccctgtccccggctcagagccaagcccacacacaagaccccttccagagggacacagcgggacaaagcccaagcgaccatgccgcgacagcgagaccccgacaccgctacaactgtgagtcaacgcctcctacccttcgccaacccagagcctattaccctagccatggcgcaggcggcacgagaccatgtcgcacagcaccagccctcacaccccgaaaccctctgaacgaccaatgtaccgccgagctcccccagcccctggacaccacaatagccgaccacagcaaacccgaccccccacaaaaccgcacaacaccccacactaaagcgccacacagctcagccacccgcctaataccccacaacaaaacatcccgcaccgccaccgcaaggaccaccgcacaccgccacctcgccgatgaacaacgacggcgcagcaaccgccggcgaaccaccccaagacacccccagccgcacagcgcacatcccgaccatcccaccctggacagccacaccacctcgcaccctagcagccccctccccgacgcacacaccacacacacagcctactcccgccacaccaacaacgcccctcccctactcaacccgcctacacgcgcccaatctacgcaccccgccccccgcacctccaccccttcccccaaccactgcccccacctgccccccccttcccacactccctcccacccacaggcaacctcgtaccaagcaaccgcgcacctccggccacttgcccccgcccgccactgacacgcgcacaacccacccccacccaggacccgcaccccgaaagcagaccagcgcccgcacactcacacccccccaacaagaccccacacagcccacaaccctacaggatcccccctatcagccacccggctcgtcaccaagcggcacaccacggacaacgggcaaccaccccccagaccgagccacacaccaccggcacccaagacacacacgaagccacaccaccaacctacgccaccccacacgaccgcgccacaacgacgaccacagagcacgccacgcacccctgcacggccagccaaccaactcaccaaactcgagactcacaccacagccgcccaacaacacgtccaagtcccgcaccgagaccaccgcgaagcacgcacagcaccacccaccataccacacaccccagacaaccccactcgca

SEQ ID NO: 577532 - DNA, 115 bp, Homo sapiens
ttggccttgagttacattcatggctatctatgcatacgggtgctgctaatcttttctactgattagtagatgaatgtttactataggacggatctacaataacaactatcgtcta

SEQ ID NO: 577533 - DNA, 787 bp, Homo sapiens
ggaatgctgtggctggtttgatctcctattcagatcattacattttcctgcatgtcagcaataaggctgtttttctttcttatctatcatgtttctctggagtagcacttttaatttccttcaagaacatttcctttgcattcacaagttgggtaactggtgtaaatgatagagctttggcctgtctcagcttttgacatgccttcctcactaagtttaatcatttctagcttttgatttcaagtgagaaatgtgtgactcttcctttcacctgaacatttacagttccttgtagggttattaattagccaaatttcaatattgttgaaatctcagggaatagggaggccctaagggagggagagagatgggagggtgtcagtcagtggagcagtcagaacacacaacatttattaagttcactgtcttatatgggtgtggttcgtggcaccaaaacaattacagtagtaacaccaagattactgaccacaagccaggcatggtggtgcatgctgtggccccagccactcaggaggctgagttgggaggattgcttgaacccaggaatttgaatacaacctctgcaacatagtgagacacctgtctctaaaatttctttttttttttaatttaagaaaggaacacaaggccagggcagtggctcactcctgtaatccctcctaatggatatccctccccttgtccccattccccgagaggcctggtgtgtgatgttcccctctctgtgtcatgtattctcattgttcactcccactggtgcgtgaga

SEQ ID NO: 577534 - DNA, 183 bp, Homo sapiens
tttgaggacggcggccaggatctaatcccacagtgcctgcgggccacaaggccaagaccaggatctaggtaagtagacgatatagggaggctggtcctagaggtgcaagagggagtgccacgggacagagagggcaccggggtgactaacagtccctaccagactacacatactaacccgcac

SEQ ID NO: 577535 - DNA, 171 bp, Homo sapiens
ttcgacctcagtagcggagcagtacggagcatcagtacagcgagcaagtacagcggagcgtcacgcctgctgggggtatgttgtgttgctccgcctgctgggggtatgttgtgttgctctgttgctccgcttactgacgcttactgatgctcgcttactgatgctccgtta

SEQ ID NO: 577536 - DNA, 874 bp, Homo sapiens
ctgccggcccgggacccgctcgctgcagacttctcgggcggactgtaggacgccgccgctcggggccgcccctgtgctcgccttcagcgcccgctcagcccgccgtccgcgccccggtggcgggcccgacgcccgcattccgccctgtgtcagtgcgcagagctccctgcaccctgggtgagccttccttgtgcctgtctgtgctggtgccccgctggcccgctgcgctcggcgccctgctcgccgtggcagaggggaaggcggctggcctggctggggatgggcggcccggcttgcgccgaggggcgcctgtggaggctccgtcgcgctgctgctggcgctggtggtcgcggggatccccgcggggcgccttacaacctcgaccccgcagcgccccgtgcacttccagggccccgctgactcgttcttcggctacgcagttctggagcatttccacgacaacacgcgctgggtccttgtgggcgcaccaaaggcagattccaaatacagcccttcagtgaagtctcctggggctgtgtttaagtgccgtgttcacaccaaccctgaccggagatgcaccgaaactgtacatggctcgaggggaagaatcgggggcacgtccttgcggaaagaccttgccgggaagaccgcgatgatgagtggatgccggtgagcctggcccgacagcccaaaggcttgattgggccgtgtgttgtgccttgtgctcattcgctggaacagaacattctactatgaaaggccgaccagattcgtaaccccatggcttcaggctacatcattcccttccaagcttccaggccaaagggcagggacggctgaatccccttgcttatgacacgagtaatacgaagaa

SEQ ID NO: 577537 - DNA, 137 bp, Homo sapiens
gtaaaccaggacgacctgtaccaggccttgccaagtgggtaagattgccagcctcctggactggatgtgacgagcccagagccactgcctacaaaccaccctctccttaccctcaaggacctgtgtgattcgtgccc

SEQ ID NO: 577538 - DNA, 117 bp, Homo sapiens
gaggttctgctgattcggtatacacgactgcgtctggagacagagatcgaggctctcaaggaggagctgctcttcatgaaggacgaacacgaagaggaagtaaaagggctacaagcc

SEQ ID NO: 577539 - DNA, 352 bp, Homo sapiens
ccatagtttacatgaagattcactctggtgttgtacattgtatgggcttagacaaatgtatgatgatatctacaattatggaatcatacagaatagtttcactgccctaaaacttctctatgcttcacctgttcatccctttcttccctaatcccctggcaaccactttaaaaaaaaaattaggttcagggggtacatgtgcaggtaaactcgtgacaagggggtttgttatacagattatttagtgacccacgtactaagcctagtacccaatagttacttttctggtcctgtcccttttcccaccctccaccctcaggtaggccccagtatgttactcctttgtgtccat

SEQ ID NO: 577540 - DNA, 1178 bp, Homo sapiens
gccttaacagcaggactggatggctggaacgcggtgcccagatggtcagttctgcacctgtggcctgctgcctggaccccgtgagtgagccagctacagctgctgccgtacccttctggacaaatggccacaacactgagcaggcatctggtgtggccccatgccaggttgatgcccactgctcatgccggacactcctgcatctattaccagtctcagggcacttccagattgctgacccattcccagaggccgtggcctgctggggatggccatcacatagcatgcccactggggcattccactgacagatgcagactgggcgatcctgcattccaaagatcaggataacaacatcctgtgggtgccatccagatgccctgatagatcagtatcgaatgcccggacttctcacacagtagctgatgttcatggtacgactggctcctggagggatgctgaccccatgcccccgggcctatacctgctagtgacagaccaggggtcgcacttggctgtaccgccacggtgaccttctagcgcaccttggtaacaaaagcccggactgcacatcaacacccacggagacacccagcccacatggacaacagacagctcccatgccacagcaggcctaaacaggggacagaaggcctaggcacagactcgggcacagtgtccgcgacgccacaggcccagggtgcccctgatggtacataaccatgcatcgagagcatgacccagtggggcacagaagggcatgacagccacacagagccacaggcccacctgcaagatcacacacaacggccacagggaggacgcacaaagacacagagagaagacaggagccagcagaaggtgccacacaccggagaacgcccaaggacacccaaagacagaagcacgacaaccaaagagggacacagacaggtcacagcaagacagacgccgcgcaggccaaaccaagaggaccggaaccaccacgccgcccacaggccacgtcacacatccccgcgcaccagagagagccaagaagatagaccacacgaatagcgtacgcaaaacagcacagagtacgcgcgccaacaccaccgagaacagacgcaacacacactgagccgcaagcagagcgcaccagccacaaagcaacgtaacaagcacaacaggagccgccc

SEQ ID NO: 577541 - DNA, 1685 bp, Homo sapiens
  misc_feature (239)..(239): n is a, c, g, or t
  misc_feature (296)..(296): n is a, c, g, or t
  misc_feature (351)..(351): n is a, c, g, or t
  misc_feature (415)..(415): n is a, c, g, or t
  misc_feature (431)..(431): n is a, c, g, or t
ggctagcgtgcgctgcaaatgcgcgcggacctatcacagacgaggagagcctgttagttggactcgcgcacttgatccctggcgtggccgtgacctgaagctatgctatacatgcgcgtaagacgtcgcagtaacatgaatggcttacaatcagtgaggctgagaccaggtgacgcacctgtacgaggcaatcacagggcccctaccagtcaatatatgtgtgaaggctaagcagcaancgggagcatgtggtgcttagcgtcgtatacattgcgatggagcaggcactcttgggnacagatgtgtagatgggtttcagctcttgacgagatcatcgattctggcctcttnccatgagcgcgagacggtaggtctgaactgctcttatcgctcgcaagaacgtgttggggaagcntttacgtacgcgtcantaagtcgataagaacgggtgagagcgctcgcacgtgcgcatgtgtttatttcgtagaatgtgtgtacgtaaccatttgcgcatgcacgttgcatgtggtgaattctttgcggttgcctcgctagaggaatgggtgttcgttcgcttgcatttgttgtgcgctaaacgcttgcgaggttgtatcccaattcgattcgcggtagacacgcttggcgttgtccccacattagaaggcgccactcggcaatagagacgaattgccgccttagtcctggttcggtaagaggcgaatcaaggatgtcacggagggcagacggggacaaggagggaccggacgccataggagagaagacccattcttgttgagagagaatgccgggcccggtcaatacgcgggcgcagaacactcgtagtgactgagaattaggcacggtgggtagacccccagtgcttttaccccggtccaccatcattgaccttttgcccacctttgttgcgcctttgatttggaacgccccaaacgttggggatatgggctctttaccctggtgtggtttggggttcgcggtagggccccctttgtcaaccctggtttgaaaccgtatctgattggcttagccccccattgggggttgggagcccttgggctgggcccgcctttggaggccaccccgggcgccttggtggcagaccccaggtcgcaaccttgctcgaagtatccacggagcccctcccatgtgggaatggcgtttaatatgcccgcgcaaccacaagacgtcttagcaaagaggccttgccaccggcacttgagttgcttccgcagaaaacccggggagaaagccttgggaggtgagcccctggtagattccagaaaacagtgggccaagcatgagggctacacaaaggcgagcatagagactagaggagcccccacatagagtcgtagatggccgcagtggtgtgcctccaacatgagccccaattcacagaaagattagccccgaatttttaagagccccggtataacgggggttcacacataataacgccctgggtgcacacaggcccggcgcacacaggcgacaagaggaccgaaggagaccaaaactacgggcggggcacaaacccatagaaggagcagggcactcaccacgacaggaagagcagacagaaggtagactatcacccagtgagtatgagtaagcacccaccccaaagagctcgtgaacacatgagggggagaactccactagtt

SEQ ID NO: 577542 - DNA, 257 bp, Homo sapiens
caggcgctgttggcacacatcatcattctgaacacatcgcaaatttgccaattcactggtctggggttcaacagcagcttcaggccattcaacacttaccgcactgtgtgagaaaccacccaaatttactgagaaggggaccttggcagtgctgctctaaaacattcagagccagatgcagggccaacaatcagaatggtctacatgccccgggacggggaagctcatctcttgacaccaacaagcgccattggggt

SEQ ID NO: 577543 - DNA, 120 bp, Homo sapiens
caccgcccgcggcaccggtttgccggctttggcatccgccagggcaaataccccgctgcatagcttgctgtcctcaaatgcctggctgtcgccctcttccagctggctgcgaatctgcgg

SEQ ID NO: 577544 - DNA, 244 bp, Homo sapiens
acctttccgttaccccacccccctcagggcacacaatacagccttttggccacgctggaacttctggggaaacttttgttgggcactttggccggaggcctgggtgatgggttggggccacatccctgctttttggtcctggtcaacctttttgcctttcccgttttggacctggacctagcacccagcaccttttttttagctgagtgggtggagtggtcaataaaaccccatgtgcctgtga

SEQ ID NO: 577545 - DNA, 403 bp, Homo sapiens
tttggacccagacatccccccactggtctgctgacaagagtcaccgtcatagtctaccacgaggtggcaccggagcggcagctgtcctcacaacttcttacttcttcaccacagggatgtggcacaacatatggaggattttggctttgtgatcctcagtgtccagtgtcacccagataggccggaagctagcctttgaagccaacgaatgccataagctctttcaactatgagaccccagtctgccccaagctttaccagcactctggtccatgggccatctggagacatatctaccctttgatgccataagcactatggaatagtcagggatggtcgccacatagttaaaaagctgccatggtatgccttgcagaatggagtacctaaagctcgtgtggac

SEQ ID NO: 577546 - DNA, 132 bp, Homo sapiens
ctccccaactattgtacacttcgacaaggctgtgaacttccttcacagcccttgtccatttgtaattgtcattccttggattattcctgggttacagtctatctagactttaatgctttttttttttttttt

SEQ ID NO: 577547 - DNA, 352 bp, Homo sapiens
ctagagctcccacgctataagtaacgcttagttatcacaaggcctgcactcaacctcaaaagcgtaagggtttaggccaggcgcggtagctcatgcctgtaatcccagcactttgtgaggcagaggcgggtggatcacctgaggtcaggagttccgagaccagcctgaccaacatggcaaaaccctgtctctactaaaaatacaaaaattagctgggagtggtggcgcagacctgtagtcccagctactcggaggctgaggcaggagaatggtgtgaacccgggaggcggaccctgaagtgagccgagatggcgccattgcactccagcatgggtgatagagtgagactctg

SEQ ID NO: 577548 - DNA, 219 bp, Homo sapiens
ggctcaagtgatctccactaagctctatcgggaaccaatgaacagtgaaaaccaagaccggcactttaatacaagtacaggcggtggcttctgcctagcgataccaagaggtctccagatctatagggagtcgtcagattatacttggcgaaagaggaaacagacagagctaaaacggtttgatgatccaggtttgatagctcctagggtttcaagccg

SEQ ID NO: 577549 - DNA, 266 bp, Homo sapiens
gcacgttcatgacttggatacaccctggacggtcacacccaaacacatcacacacactcagactcatgcactcacactcgcttaccctcacatcacatgcacactcagacacatgcactgagaaacttgcttacactcacatcacacacactcggactcacatgcactcacacttgcacatcacgtgcagactcatgcgcttacacacatcacacagactcgcactcacactcggtcacatcacacagacacacgcactcaaaaaa

SEQ ID NO: 577550 - DNA, 305 bp, Homo sapiens
cgcgctgtactttcttcatgaattcccactgatcacaaaccccacaccaccgatctcactgacaccatgttcaaccatgtctctttactgttacaaattccagggaactggccttaggaaatccaagtatcagaccaaggttgtggagtattccaccacaggaaggaatgctgaacaactgatttacagacttgttgccccagctagaccaccaggtagcccattactcaaggtaaccattacaaccaaatagtgctaacctgcataccctacccctcacatgcttagccaagccccagctgcgg

SEQ ID NO: 577551 - DNA, 408 bp, Homo sapiens
ctgcaggcatggtgtagagcacggcaggacattgtgtctacctggaaacaacattgtgcctaggtcaccttcccactctttaaagcaatgagtgcaaagatgttggaggaagggggaatgtatttaacaggcagagggtatagtctgtgcaaaggcttctgggctagagagaatatacctcttatttccagaatatatttttgttccacaaagtctgattcaaattagctctaaatttttggattcataatattttttctgatttatccttggtatgttcgttctggctctgaaaatttttgctgttactgttctgtgtgtgttcttatttttttgcttttcgaccaatttttgggtcttcttgttttatattgtcgggttgtttctttcgctgttttttctcttcta

SEQ ID NO: 577552 - DNA, 689 bp, Homo sapiens
  misc_feature (70)..(70): n is a, c, g, or t
  misc_feature (72)..(74): n is a, c, g, or t
cccacaccaaaagcacccacacccctagacccattagaagaccacacccccccccccatgacgccctcgnannncccaactattaaaacacaaaggggattgtcaaagaacagtttctgctacaacggctggcagacggggccatcaacctctatgccatggaggtggttctctcaagggcctcaaaatccctgagtgagggccaccccacagcccagcatgagaaaatgctctaagacacctgcagtatccaggctacaactcaaatccaagagggcatggccaccctgcaatctaacccctgacaacaaaagctctaccacaacttcaaaagcatctccaacgcctaggaggagcggagtggtgaggtcaccagcaacccacttaacttctaaatactcccaaccaaggcctgtcccaagtatataccttccctcaaaccaaagcccaaacccctgtccttaacgccctgattaatccccaacggacctagaattcccatcactagacctactctcaagagcactgactgcctcacaaataataaaaatttctagccacgcaaaaaaaaaaaaaaaaaacccaaggggggacccaagacccaaatcaccctatacaaaatcatataacaattcaactagccccaagttgacaacatggtaaacagtaccaactaacacaaataaccg

SEQ ID NO: 577553 - DNA, 248 bp, Homo sapiens
tgcctgtcgctggagcgttgtgacaacagaggagggaaggcaagctctggagccgctccctcaggctactccaggagtctctaaaccgactcttcccctggggatttagcaggaagttgtcaagatggaacctgaagatgctacagaggaaatccgtggatttctttgagcctacgtgacgaatacacgatgtctggagactgggacgcccgttcacttcggcctccgacgtggtaggcctgacgatt

SEQ ID NO: 577554 - DNA, 201 bp, Homo sapiens
actgggcccctgatcctatgacacacttatatgattgaagatacaatttcggaaacagaagcaggttgctaattacaaggaacatcaatggatagctcccagagaaagattcatcaattttggtgtaattatgaaagtatatatataaacattagcattcccaaatctgccatgattaagattaggtcaaacttttttttt

SEQ ID NO: 577555 - DNA, 136 bp, Homo sapiens
ctcccagggtgagaactcgttcccctccaagcctttcatgaaaaagctgcttcttattaatcatacaaactctccccatgatgtgaagagtttcccaaatctttcaaaataaaaagtaatggcttagaaactgcca

SEQ ID NO: 577556 - DNA, 219 bp, Homo sapiens
gagagaattctgtttaaactaacatcataaatgaccctttttcctttagccccaaggaatttccctagcccgggccccctttcttggtcacattttccccaattttctactctttgcccaaaatcagtgcttaactctgtttcattgggtctttgtttccttttgggggcctcctgtgtcccagaaaacttacattaaatcaatattcttttttcctga

SEQ ID NO: 577557 - DNA, 383 bp, Homo sapiens
gcctcattaggccacaggtggggccaggctgtgagtacacagagcggagtgagaacttacggtgcttttccaggctcacccgtgactgcccatgcaccaagcagcacacactttcctctgaagcccataaaaacccccggactcagccagacttgggcagaagacaggacgacctgcttatggagaatagctgcccactgtgggtctctctgagctgttctgtcactcaatgaagcacctcttcagattgctcaccttccacttgtccacgcacctcattcttcctggacatgggagaagaactcaggacctgctgaatggcaggtctgaaagagctgtaacacaaacagggctgaaacacacccattgtttgccacattgca

SEQ ID NO: 577558 - DNA, 1414 bp, Homo sapiens
ggcgagaagcaactatggccctcatcacttcgctcgccgaaatccccgagcgccgtccagcggggcagagccagagccagggccgaccgcccgaaccatgagtccggcatgcgcctcttcaggccatggtaagtctgcactggcaatgcactcttgcgggacatacagtgaggacaaggtcataggttatatacgcggtctaaccaatcgagacgggacctcctgtacaggggcatccgttggcagcaaaagtcatgccgagtaggcgtgctgcaacagcaagggatatctttgccctccaggaaggcaggtctcacatttagtaagtgaagaagcaaaggtagtgtggaacgattctatctccaagacgtaaaaccatgagttttgccacgctcaatgggtctaaggacctccttagtgtcctagcgtgggcgtcccctgttccaccctcgcaatcgcaggggtccatgcaagtggtgtgcatgaaccccatgtgtcccttctttccaataggaccaggccagaaaatcgctacaccacttgtataagcgaaaaaggagtcggaacaggcacgcggcgtgccacgttcaggacagaaggaggagaccaggggatgcaagggcggaacacagcgcccttgtagaaggccaaggcgaaccttacttttggagttacaacgggttggtgcccccctttcgcgcagaatggcatggacccatgtcgcccctaatatttgccgcaccccaagggttgagccttcacccaagcaaagtgggggggtcttaccttacccggtgggtggccaaagagtccccccggcgaagcgagggtcattgacgatttccgttggaaccaccaaggtgccgcttgggaaccttcaacgacctttggcgcagacccgaaacagtttgacacggaaaaaagaggaccccaacaacggcacacgggaagttacacaagcgaacaacccccttaaaagaagcgacacatgggacacagagcttttcctccggcggcaccaagtgctggtgttgggcgcacacacgggcaaaggtcctttaggtccaatggcccaacggccgggaggaactttccccagaggggctccttagggggggaggcaacaaaggctttcaaaggtgccccgaaggataccccccaagggaccaaacaatcgtaaggcccaagggccgtttatggaaacaaacaagcgcctttagggcacaaaggcggcacacggcgaacggcgtggcccaggccattacgggaaaacacgaaaagggggaacggctttctacaggcacagaggggaaccccttgtgtgggacagggttgtttagggtggacccccgtcccattggtaaggtggcagcccctttttatgtgggcgcggcacacactataggccgggaga

SEQ ID NO: 577559 - DNA, 781 bp, Homo sapiens
ctcgccgccccgcccgtcccaggccgggaagctgggacttgagctggtctgcattcgggcaaggtgcctggcacggttgctgtccaggcttagaggacagaggaagagcccctgagtctgtgcacactctgccaccatggccctgcccacctctggagcccacaggtgcccagcccaggccccttgcttttggctagactcctgccctacggggacccccatgatggccactcaggagatgggcccaggaggacaggggagtgactccaggccatgaccggaaggggcctgtggcccctgttcccagtccccagggagacgggagggtcacacgctgttatgaggaagaggacaccgggctggccctggcccagggtggccagctctggtttcactacttggccccaagcccctgaggcaggtgcaggagccaggcacggtgagcagggcccagtgcccctcaggctctggggaaggggtacagccaggtggcccagagcaaggaggtgctgtagacaggtgtgaccacttccagtctctcccggcctgctggccttcatcctctcccagattccaagggccaccgctgggagcatggggtggacatcgtcccaccagcctcctggatccacatccgtaaagactccaaagtgaagtgaggctggcttcactccagctcacagcagaggagggggcagcctcagggcccagcaacttgctcagagcgcacaggagtgcgctggggccgggccagctggcccagggcctctgactctgcccc

SEQ ID NO: 577560 - DNA, 504 bp, Homo sapiens
gcacgagatggagtggtcttactgtaggctccctcatgcctaagacctcacctagcatctcggtaaccttttcacctgtcagtctgtccagggattaatattttcctctcttcagatttccacaaagtaagggaataacctttaccacaatctggagtcttaccatttttctgctttgctaggcatttgatggaacttaaagccttgtcaaacatttcttaagtattatagcaggcattgagagttatctttctcctgtctattgaaagggaaccctccttacaggccctgatgaacttcgtattaatatgtcgcctgtataaattgtacctgttaggttgctgagctgatgttagagtatttaattctccagcctaaggagtgcagcaggtgctcgtgggagtggtctgtgcctacctttgagcagcatgaagccacagaaccaagcctgacaccatcacaccccgtgccttagtttttaaccactgtccaataaaatggttg

SEQ ID NO: 577561 - DNA, 278 bp, Homo sapiens
  misc_feature (27)..(27): n is a, c, g, or t
  misc_feature (48)..(48): n is a, c, g, or t
  misc_feature (62)..(62): n is a, c, g, or t
  misc_feature (107)..(107): n is a, c, g, or t
  misc_feature (245)..(245): n is a, c, g, or t
aaaagttaacatcccggaacagtgcanaaggcttgggtttcagtttgntagggcccccatancaaaatgccccagaaccaggtggtttaaacagatttattttctcncatttggaggcttcccctgcatggcagccagcctttaagttggcccccaaccatccctgcctttttctattcacacccttgtgtggttccttcccccattgaataggcctgacttgtgtaacccctcccctattgaanaaatgagagtttgacttttgagggtaagtcata

SEQ ID NO: 577562 - DNA, 385 bp, Homo sapiens
aactctgtgaagaaagatgagactactgtgaacatggagtctgaggggggtgcacatgactctgctgaggacggggacctactggatgatgatgataatgaagatccgggggatgaccagatggagttgatctacgatgattaaaaagaggctgacgaaagataggatgacaccgacggcgccgatggccatgatgactctcaggcacatatcggggtgtaaacatattatacgattatttgtttatctaggcgcttgtataacatcacattttgcaccagatactttcccctagtatgttcagcacatgctcattgacctccccatacttgcacttcccatgttcattaattcatattgcccaccgcctagtcccatgatcact

SEQ ID NO: 577563 - DNA, 107 bp, Homo sapiens
tggtaacatcattagtcatttagggaaatgcaaaagaaaactactacacatagagttaaatagcaaaaatgaaaaagatacacaatatcaagtgattgttccccgct

SEQ ID NO: 577564 - DNA, 1005 bp, Homo sapiens
ccgattgcactccttgcagctcttaatgatttgaaggtagctcctgctaagtattcgcgttaggccagtgcacagaatgctacatggtaatgaggctttatgtgtatgtgctgtgaccagttcataaatccatccctactctattaactctgtaaggaaagttacaccgtaggagaccatagtacgtctgaacaaaagggtcttctagttgtacaacaatccaatgttccatgtaatcaaggttgccgcgacagtagatgctctctgctcttgaagtggctatttgctgccagtgattacgcagactgatctgagccttgtgctcatgatgcccggagagtttctatcacttatgcccgggctggaagacggctcagcagggaacaggcaaatgttctccttgacgcatgttccgagagtctgaaaacttgctgaagccgttacacaactgaggtctgtcgctcatgtgaggccacctcgaggctctcattcaccttccgagctccaacgtgaaagattctttgcgcagatacgcattgtgagccatcctattgtacaccgtgcactctcggctttcaggggaaaccacgccaaaggaaggattctgtgctggattacatcttaaccaacacacaggtaattctgcaattttggcgcaattttcacgggaagcattccttatccttctttgacgcctttctcaactgcctactgcaacagggttctcttagcttctcaaacaagggctttccgttaagggatatactttcaacgggtgtctacaacttgcccaacgtttcccctggtcgccaaacgcctttcggcgttgccccaattggtttaaacgctgtggcacaggggtggtcccccacggggggacagccgacctaagcgacttacgtgtgtaacccattcaagtttaaccgacattaattggccattatctgataagttttaaaccagcgcacaacgcggaagctctgtaaactttacaccggactctga

SEQ ID NO: 577565 - DNA, 894 bp, Homo sapiens
gaatatttaattaaatgtattaaatggcagatttgtgtttggggagtgcagcaaggtgaaaaacgaagatcttaatacatacggttagattgtgtagcagagattctgttggaaattctgacaattaatgcgataggatgtgtgccatatagtcatattatgatatggtgttagaatatttctaggctaaaataatatagtatacatatagtgtcacatttggactaggagttataagtatatatatcatcataaactagtaattctggaagtttcgttctgcggttagtaacttaaatgtgttacctggctcgtcgataataatttctataacagtctcgtcggacgtggttaatttgtaacattatttaccgtaataaaggttagtacttattaggacttgagttaggtgttcgctgccaatttcggactggtggcattaatgtgtacgttgtgctttgcacttatggtcttacatgatggaatgcagtttatcattaagatactattctcaagacattaacggttatctgctaaagatgtctcaagtctgaacttggggtctttagcatttcttccgagcatcttcccctagatccatcgaatagtagatgtcaccttatagactattcctgtatttatttctagcattatttctactattatctagttctgctccatgtgaccttatgaaaagttataccagattatccgcctttgtcataaatcagagaagagagctcttatgacggagatcctatcttagggaggaagtaaatactagggaaggaaagtggattctgctgaaagttacttgcatagttctattctcaaatagtaagtatatgacgaaagggttatatggggtgtacgggttcaagcatataagccatg

SEQ ID NO: 577566 - DNA, 328 bp, Homo sapiens
ctgcggccagtctgggcaacgaagagcagactctcaagaaagaaaaaaatttgttttttaaactgagcggggtgtacgggcatgcatctgcggacccagctactgggaaggctgaggtgagaagatcaccttagccggggaattggaggcttcagtcagctatgatggtatcactgcagtccagcctgggcaacaaagaccctgtctctaagaaaaaaaaaatttggaataggcggggtgtggcggctcacgccggtaatcccagcacggtgggaggctgaggtgggagatctctggagcccgggaattcaagaccagtctagtcggg

SEQ ID NO: 577567 - DNA, 373 bp, Homo sapiens
cagaatgcaaagggaggacatgaagtcgcagagttccggtataagacatcatccagccacttgtccagggagcacatcccaatccagttcctgaccagacagggatctgccactctttccagctgggtgacctggtatatgttaaaaagttccagaaggaaggactcactcctgcctggaaaggacctcatactgttatcctcaccatgccaaaagctctgaaagtagacagcattcctgcttggattcatcaccctcacatcaagaagaccaacaaagcccagcaagaaacatgggtccccaagcctggacaggccccttaaaactgtgtctaagtcgactgaagccattaaattaattctttacctctaaa

SEQ ID NO: 577568 - DNA, 245 bp, Homo sapiens
gtgaaaggtaacacagacaaatcaaacatgctggagtttaaattatgtccagatatcttactaaagaatacaaactctgtggaagaacggcaggatgtcaagcctcatcctaggaaggagcaagcccctctgcaagtttcaggattaaaagtacaaagagactggttaactttgttgctacaagaaaggacaagaagacagccagagagagatatgttattaagactctggaggaagcttcagtc

SEQ ID NO: 577569 - DNA, 973 bp, Homo sapiens
  misc_feature (37)..(37): n is a, c, g, or t
  misc_feature (57)..(57): n is a, c, g, or t
  misc_feature (91)..(92): n is a, c, g, or t
  misc_feature (96)..(96): n is a, c, g, or t
  misc_feature (104)..(104): n is a, c, g, or t
  misc_feature (131)..(132): n is a, c, g, or t
  misc_feature (139)..(140): n is a, c, g, or t
  misc_feature (143)..(143): n is a, c, g, or t
  misc_feature (157)..(157): n is a, c, g, or t
  misc_feature (162)..(164): n is a, c, g, or t
  misc_feature (182)..(182): n is a, c, g, or t
  misc_feature (188)..(188): n is a, c, g, or t
  misc_feature (206)..(206): n is a, c, g, or t
  misc_feature (216)..(216): n is a, c, g, or t
  misc_feature (218)..(218): n is a, c, g, or t
  misc_feature (223)..(224): n is a, c, g, or t
  misc_feature (230)..(230): n is a, c, g, or t
  misc_feature (241)..(241): n is a, c, g, or t
  misc_feature (243)..(244): n is a, c, g, or t
  misc_feature (248)..(248): n is a, c, g, or t
  misc_feature (253)..(253): n is a, c, g, or t
  misc_feature (262)..(262): n is a, c, g, or t
  misc_feature (272)..(272): n is a, c, g, or t
  misc_feature (275)..(275): n is a, c, g, or t
  misc_feature (282)..(284): n is a, c, g, or t
  misc_feature (294)..(294): n is a, c, g, or t
  misc_feature (296)..(296): n is a, c, g, or t
  misc_feature (300)..(300): n is a, c, g, or t
  misc_feature (305)..(305): n is a, c, g, or t
  misc_feature (309)..(309): n is a, c, g, or t
  misc_feature (321)..(321): n is a, c, g, or t
  misc_feature (334)..(334): n is a, c, g, or t
  misc_feature (345)..(345): n is a, c, g, or t
  misc_feature (358)..(359): n is a, c, g, or t
  misc_feature (371)..(371): n is a, c, g, or t
  misc_feature (388)..(388): n is a, c, g, or t
  misc_feature (393)..(393): n is a, c, g, or t
  misc_feature (398)..(398): n is a, c, g, or t
  misc_feature (401)..(401): n is a, c, g, or t
  misc_feature (403)..(404): n is a, c, g, or t
  misc_feature (408)..(408): n is a, c, g, or t
  misc_feature (413)..(413): n is a, c, g, or t
  misc_feature (419)..(419): n is a, c, g, or t
  misc_feature (438)..(438): n is a, c, g, or t
  misc_feature (483)..(483): n is a, c, g, or t
  misc_feature (493)..(493): n is a, c, g, or t
  misc_feature (509)..(509): n is a, c, g, or t
  misc_feature (525)..(525): n is a, c, g, or t
  misc_feature (531)..(531): n is a, c, g, or t
  misc_feature (558)..(558): n is a, c, g, or t
  misc_feature (848)..(848): n is a, c, g, or t
  misc_feature (903)..(904): n is a, c, g, or t
  misc_feature (952)..(952): n is a, c, g, or t
tagcggaggggcagtccgaggagggccgggctgtcancccagcggacatgagcgagnaggccccagccgcgaaggagccgggcgcgcaggnnggcntggaggtncgtagttcgtggtccttcgccggtgtnnccggagnncancggctgtggatggnaaaannncagagtagggaataggtnagctgnaggagcaaaaaaaaggtnttctgaaaancntaaanntctccnttaataaaatnanntcgnatttnggggccgcncggaacttgntgnaaaaagnnnaattgaggtnanagcnggctnaacncggatgtggggnacctggtgctaancaccctctgcncggccctccacgnnctggtggcggangggctgaagcctttccngaaanaactnatnanngggnaacgnaaaaanaacccctgaaaaatggtgnaggcgtcggtaaaaccagagctccaacacccgctcccttggaacnctgtataacnaagtcaaccgtataancccgctgaaaaaaacnatagangcttccatgcatttatactgggcctcntcaacaccaagcaattgaagctgtggttttccagtctccaggaagatgcagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggcccgcagaaaatgagaatggagccctaaagtccaggagancatctagctggctgcccccgacagtgagtgtgttggctcttgtgaagcggggggnnctcccgagatgccttctcctcagagcttgaggctcagcaccaagatgngcaacccataggcagtgcggg

SEQ ID NO: 577570 - DNA, 131 bp, Homo sapiens
  misc_feature (41)..(41): n is a, c, g, or t
ctacgggctggcagctaccatgatccaagagggcctgactngggagggcttccagacagctgaaggctgcataccgtaccgtgtgggagcgcctgggtctggccttccagacccagaggcatactgcagca

SEQ ID NO: 577571 - DNA, 233 bp, Homo sapiens
ttagagctagaggatccccctatgtctcgatctgtaagcgtacactctcaggcacttggggatgccgaggctgggtggatcacaatggtcatggagatcgagaaccatcctggctaacacgggtgaaaccccgtctctactaaaaatacaaacaaattagctgggcgtagtggcaggtgccttgtagtcccagctactcaggaggctgaggcaggagaatcgcttgaacccgg

SEQ ID NO: 577572 - DNA, 246 bp, Homo sapiens
catcatcatggcagcaacagcagcaagcatcacagatctcaatcctctcagactgcttccagcaaaccaggcccagccagtcatttctcaggttttcattttccagcttggtttacacccaggtcatgcatccatcaccattatggttaagcacagttcctcactcattcaagcaggtgccatgtggcagtcagggccacaggtcatgcaggtgaaccgtcatttctaccgtcccattcagcattt

SEQ ID NO: 577573 - DNA, 353 bp, Homo sapiens
tgatataatctgatgtattcgccaatgtatagcgtgaaatgtatgcatctagagacgtaatgggtaaggtgctctaatcatgaagaagtattgaaggaagagcatcgctatagttgataaaataatgctgtgaacatgccctgtccactgagttcagcctaagaatagggtgctctgctcagagtttacctggcatgcttccggtgaatgaaatgatgcgatgccccacgggaacctgagagatacttctgggttgtgttcaatatatatttcacaggattaactgtttcaggaacagatataaagcttcgccacggaagagatggacaaagcacaaagacaacatgatacct

SEQ ID NO: 577574 - DNA, 138 bp, Homo sapiens
agatcgcgtgcgatgactttccgataacagtcgagactcattggtactggttgcttaacggatttttcatcttccggatataggcggtttgtgaaatggatcttgtgccctttctagctaatttggtctgtttgctcc

SEQ ID NO: 577575 - DNA, 824 bp, Homo sapiens
  misc_feature (328)..(328): n is a, c, g, or t
  misc_feature (445)..(445): n is a, c, g, or t
gcttaccaaagcatatccgtcctggaaggttacgccgctgatacacccagtgcacggcgcgcctggtcaggagacgctcttggcgcctggccacccggagtgagtagcgccgtacctggccagtgcgccgtgcgaacgttgtgggaagttgcatgcgcggagctctggagctgtggtgccttcctctctccgcgcgacccctttccaatgacgctctgcgataggtcaagcctcgggtgagctctcagacatagagcgctcgagcgcgtatccgcctgcgtcaagtcggtacgggggattcattggagtgtggtgtggtcctttgtcntcgagatctttgtctctcgtagatgccgggagtgtctcgcacctgtaggctcctcagtggcaccctaccataaattgtcagtcccctggggccttaatcgtgaggcgcacgaccaanaagggacttcgccatagtctctccgccgacgacatggaaggaccatggatgaaagcttctgtctctaaatgaccgtctatatgcgatgtggtcccttgtcgagctaatccgacgttgtggacccgaaggacgggttgcggccttctacgcccaattgaagctcctctgcccaagtggcggtccccgtactcattgctctcacgccccgaaagcggttgccatgttttccccccagaaggtttcccccctggggtaccgcctgtggggaaagaccacccttgggcggaaacggacgcaccccttgaggggcgttcttcttacccaagcacaattttcccttccctcttgatgccggcgcggttatcccctttggttgtgc

SEQ ID NO: 577576 - DNA, 290 bp, Homo sapiens
ggtaggcgaactgaggccaatctccccacttttagggctgtgaaactgttctgtatgatacaataatggtggatatgcgtcactatacattcgtccaaatccacagaatgtacaacaccaagagtgaaccctactgtaaactatggactctgagtgacaatgatgcatcaaataggttcatcagttgtactaaatccactgctctggtgcagaatgtcgatgctggaggagccaggcgtccatgcgaatctccctcccctccattccattttgctcacaccaccctaaca

SEQ ID NO: 577577 - DNA, 160 bp, Homo sapiens
gccgaattcagcacttttaaccccgagtctgtacacgggcaccgaaaaagcagtggcggtctgcagcgtggcgcaaacctgccttccccaccccttcaaactccccttctgacagcgactccatccagagcctagctgggactttgactatgacacagag

SEQ ID NO: 577578 - DNA, 495 bp, Homo sapiens
  misc_feature (282)..(283): n is a, c, g, or t
  misc_feature (299)..(300): n is a, c, g, or t
  misc_feature (314)..(314): n is a, c, g, or t
  misc_feature (339)..(339): n is a, c, g, or t
attctgaatggagtgtccaacaccattattgtgggtgattgagactcatccgtatgaactattcaccttcgtacctcccgtttacaactcagcattgctggaagagctgaacagccgcatggatcatttttcaattatagaaaaacaaattctaagcctgagagaaaaagtgcatgagaaagaaagggaggaatatagctgctagcagacaagacatatacttcccagctccaccactgtgactcttaattcaaagagatttttcaattttccagggggggnnttttttgtggggggcnnaaaaagaggggaanaaaatttttttttccctttgggggncccccccctttttcaattcctgtcctaggctcagaaaaagcacaatagtttctttatacatcttttcttttaaaaagctccctggaaaatattgtaaatatgctactatattgaggtttgataataaagggaaaaattttgctctttatacccaaa

SEQ ID NO: 577579 - DNA, 212 bp, Homo sapiens
tatcgccattgttgattggttgctgtcacgcccatttgtgttgagagcttctcagactatccaccttcggcgtcgcttagctgttcgtgatatgaaaccctcgcgtgcggtgggtgtcatcaaagcagtggacaagaaggctgctggagctggcaaggtcaccaagtctgcccagaaagctcagaaggctccaggagaaaaccaggctgcag

SEQ ID NO: 577580 - DNA, 398 bp, Homo sapiens
  misc_feature (141)..(141): n is a, c, g, or t
  misc_feature (145)..(145): n is a, c, g, or t
  misc_feature (169)..(169): n is a, c, g, or t
  misc_feature (175)..(175): n is a, c, g, or t
  misc_feature (187)..(187): n is a, c, g, or t
  misc_feature (194)..(194): n is a, c, g, or t
  misc_feature (237)..(237): n is a, c, g, or t
  misc_feature (270)..(270): n is a, c, g, or t
  misc_feature (274)..(275): n is a, c, g, or t
  misc_feature (290)..(290): n is a, c, g, or t
  misc_feature (294)..(294): n is a, c, g, or t
  misc_feature (296)..(296): n is a, c, g, or t
  misc_feature (302)..(303): n is a, c, g, or t
  misc_feature (305)..(307): n is a, c, g, or t
  misc_feature (315)..(316): n is a, c, g, or t
  misc_feature (318)..(318): n is a, c, g, or t
  misc_feature (323)..(323): n is a, c, g, or t
  misc_feature (327)..(328): n is a, c, g, or t
  misc_feature (331)..(331): n is a, c, g, or t
  misc_feature (336)..(336): n is a, c, g, or t
  misc_feature (338)..(338): n is a, c, g, or t
  misc_feature (343)..(343): n is a, c, g, or t
  misc_feature (348)..(348): n is a, c, g, or t
  misc_feature (351)..(351): n is a, c, g, or t
  misc_feature (365)..(365): n is a, c, g, or t
  misc_feature (368)..(368): n is a, c, g, or t
  misc_feature (373)..(373): n is a, c, g, or t
  misc_feature (378)..(378): n is a, c, g, or t
  misc_feature (381)..(381): n is a, c, g, or t
gaggtccacctctgagtgcccgccctgtcccccggggtcctgcaaggctggactgtgatcttcaatcatcctgcccatctctgtacccctatatcactcctttttttcaagaatacaatacgttgttgttaactatagtcnccangctgtacaagatccctgaacttangcctcntaactgaaattntgtattntttgacacatctgcccagtccctctcctcccagcccatggtanccagcatttgactctttacttgtataagggcancttnnataggttccacatgnaagngngatcanncnnngtttgtcnntntggcntggnntanttcantnagcanaatgngcnccgggttcacccangtnttcanaaatnacnagatttcctcctttttt

SEQ ID NO: 577581 - DNA, 1217 bp, Homo sapiens
tttgtcgtttcttgttttgttctttttctgtctgtttgttgtgttcgctgttgtggtgctttgtgttttgtggtgggtggtgagaggtgtgtgcggcgacgcgaaagtgtgagaaccgtggcttcgtcgcctgccggtgtgtgcggtgacgctagttttacgttgttctctgtgaggtctcgctgagattcgtcggggctcttgtggtgggttgttctctccgccggtgggtttttatgttctgtgcagcatctgtggcccatatttttttgccccggtcatctgtgggtgtctcccacaggtacgctggtggcccgcgccgtttgggcgttttttgtgtgccgcctctttgcgggatactatatgggggcgctctgtggccggagctctgcgggggggttctttttgggaaagttcttccgcgggtgctccccccgctcttggggggttttttgtaggggcgctgttttctcccctctgtggttgctatggccgcctgggtgaaccacctggtgggaccaccagtgtggtgcttttgggcccccgcggtgtttgttgcgaatggggccgcccccccgggttttatgttgtgctttttgtggcccctctccgccggcggtttagcaccggtggttccccctgtttttgtgtgcggaaaaatatggggtgtgtggggaggtatctcttctggggagtgttgctctcgggcggagacctctcgcccctccctgagaaaattataaaaaataacatgggtatttatattgtgttcccccaaatcacgccccgggtgtcttcttttttttgaaatatatttctccagcgcgttatacctctctctttcttttgtgttaataatataagaccgtgcggtctcgcccccccccctcttctatatgtctattattttaaaagcgctcccccctctcgcccacacgaaaagacacacacatacggttccacacacgtgatttaataatttgttgctccctcatattaggcttaacactcgtgaatataaaaatattccgtgtatataccacgccgcgcccccctttttgtagccacacatcacctttctaactccgtttttttctcccttgagtaaatctttctttctcttttatactttcttattatatgtttcctatctgttgtgtattttacaacctatatatatgtgtgtgttatcacctcaccacaacaaaaacaaaaca

SEQ ID NO: 577582 - DNA, 110 bp, Homo sapiens
cctgtatcccagcactctgagagccaaagcagaggatcacttgaggccaggagtttgacaccagcttggtcgacattgtgagatcctgtctctacaggaagaaaatattg

SEQ ID NO: 577583 - DNA, 416 bp, Homo sapiens
  misc_feature (136)..(136): n is a, c, g, or t
  misc_feature (138)..(140): n is a, c, g, or t
  misc_feature (152)..(152): n is a, c, g, or t
  misc_feature (157)..(157): n is a, c, g, or t
  misc_feature (173)..(173): n is a, c, g, or t
  misc_feature (176)..(176): n is a, c, g, or t
  misc_feature (179)..(179): n is a, c, g, or t
  misc_feature (183)..(183): n is a, c, g, or t
  misc_feature (202)..(202): n is a, c, g, or t
actatttgttggctgtttcttatgacttggagaatttctagtgcctgccaagcactagcttatgtgttctttatgacagtactattcaattctgatttagacgatgaagaacaaacacacacaagtaactgtacanannnactggtggcacnatcancggggcagagccagantcnaanctcngcagctaggttggaacacncagtgactgaataaccttgggcaagttacttgacctttctgtgcctcagttttcttacccgttaagtagggatgatattaataactccctcgtaaactttctgtcgaagtctacaagagactatgtaacatgtttgatatatcagtccctcgcatctagtacagtcatctgtgtactatcgactcaagctgccttcatcttctacacatccctg

SEQ ID NO: 577584 - DNA, 386 bp, Homo sapiens
  misc_feature (244)..(244): n is a, c, g, or t
  misc_feature (374)..(374): n is a, c, g, or t
tctgatctgtggaaccgctgagctgaagaaagggaacagaggaaagcctgcaggactcctggtgccactatgtgctacgtaaagtgtgcaagatacatcggatactctctggtgtgggctgctgtcttctgcatcgtagctaatgctttgctctactttcctaatggggagacaaagtatgctacggaggaccacctcagccgtttcgtgtggtattttgccggcattgtaggcggaggctgcntgatgctcctgccagcgtttgtgttcattgggatggatgaagaggactgctgtggttgctgcggctacgaaaactacggcaagcgatgctcgatgctttcttctgtactggctgctctgattggaatcgngggatcctgctt

SEQ ID NO: 577585 - DNA, 535 bp, Homo sapiens
ccatcatctccgacatcaccgatgctggctcctgccagccccatggcctcccccggcgggagcatagacgagagccctcacggacgccagggccacacggacaccgtagggccggcctcccatcccacacccgacaccaccatcacaccccgtgaaaagtgcctcagcagtagcctgcctggacaatttggatcagcaaatccaacagatgtctagggtcgcccgcctcttccccttgcccctcttcacatctcacgcatggccaaaggtccaagccaggagaatagagctcaagtgacacacttggaatgcatatgagactccaaccttgagataaccgtgcagaccatgctgagcagccacggctttcagcgtggacaaccaggtgcacattgatggaccctgttcagcccctcggtgaccagtgcccgacatgagcctgacatgaccttgacagcagcctggccagtatccaaagagctccatgtctcccaaggagcccccaggcctcccgaggcagagaaccagcagcccg

SEQ ID NO: 577586 - DNA, 821 bp, Homo sapiens
ctgtctcaaaaaaaaaaaaaagaagtgggctgggagagagctcggttcccttggagatgagtgataattctgggagccagccagttcttccttaatgcaggggcagttacctaagggtgtcctacagtggtgggcttctatagctctccactcttccggagcctgggggcccagatggcacgacactggccatgacgcagataattggggaactggtggtctggtctccgggtcctaagctcagcacttcctggtcttctctcgaaccctgggggctcactcgcttggacctgctgggtgactttgggacgcttcaactgggctgggcaatttctacatggggtcctctacaacgcagccttggcaggcctcaccacactctgtctgggtgaagaccttcactgcagctgtgcgggcagagctgatccgggccttggggctgggacagactggccgctgcccgtctccggtttcccccaggcatctaggaagacccagacaccagtgacctccagctgggggtgggaaggaaaaacactgggacactggccatctggctgccaaggcctggagggaagcccaaggctactgggaacctcaggacctggaatctgagagggtgggtggcaaaggggagcagagccatctgcactatggcataaacctgagccaagagttggggaccaggacctcttgcttttccatacttaactggtggcctcagcatggggtaagggctgggtgactgggtctagcccctgaatcccaaattctgtttaccccatcaatctgggctcactgctgtctggggacatccccat

SEQ ID NO: 577587 - DNA, 490 bp, Homo sapiens
aactgactttctgaacaggtctgtccatagtaagtgcagatttcctgcttgttggttggttgttttagagacaggatttccctctgttgcccaggctggaatgcaatgatacaatcctagctctcaaaataatcaatattctgagtattgacattggctactttaatgagttccaccaacaggatatggtgcctcaaatccaccagtacttattcaattgctagtcaggctggctcctttacctacaaggacttaaaaaaccaactcgccaggttggtagttcaaggtggcaggtgcagtgtgggctttgcaaaactcaggcagacctgggtcttccacaccagccttgcaaccgagaccatcactgcagagcctgctgagccatctgcagggtcagccagtacgcctacctcaaggggccatttgtgcattcaacctaaaactctacttttaataaggaagacggatcggaggaaagtcagtgcgtatt

SEQ ID NO: 577588 - DNA, 207 bp, Homo sapiens
gttaaaaaagaaaaaatgccgaaaaccccccagttttatttggggaaggcccctggggcttcctggtgaagcccgtagttttggaaaaccccctggggcccaaaccggggctaaagttgaacgagctgatggatatgacccccccgccccaaaatctgtttaaagttccgccttccaaaaggggccaataaaaagggccttttgtga

SEQ ID NO: 577589 - DNA, 336 bp, Homo sapiens
agagcatccccccgtgagacgactttacatttagttaaatataaacattttttattaatacataaaactgctttcaaaaaacagggaataaatgatttagtggcactggttttacttcttggaatccccaagggttaacttttcttagatggaaatcaactgtcccctagggcacttttattttaagttcgtgtcctaataaattcaaacttttaaaagtcccatcacctatggcttaaatatacaaaaaggccaaaaattattcctttttagtgggaccatattttatgctgactttttatagccaataaaccagaaatggtgtccttctgcaaa

SEQ ID NO: 577590 - DNA, 168 bp, Homo sapiens
  misc_feature (138)..(138): n is a, c, g, or t
agcttcactgtgactacattattaatttctgcgtccaggtgctatctctgaggctgagcattataagaaaatgagctctgttccttttcattgcggaacaatagcgcaggggtttatttcagagacaactttccactntactattccactgggcgcgtcgtatggaag

SEQ ID NO: 577591 - DNA, 236 bp, Homo sapiens
acttagctgaaacatgcgcataaggtaaaaacactaagaagtaactataagccaggggttggtgaactcacgcctataatcccagcacttagggaggccgaggtgggcagatcacttgaggtagggagtatgagaccagtctgaccaacatggagaaccctggtctgtactaagaatagaaaataatccgggagtgatagcacatgcctgtaatcccagagtgctggtactaaagg

SEQ ID NO: 577592 - DNA, 182 bp, Homo sapiens
ctcaaggctttatacttactcaagctgtatacttcctcaacgctttatacttcctcaacgctttatacttcgctcaacgctatatacttcctcactcaacgctttatacttcctcaaggctttatactccctcaacgcttctcatttcatttcccggtatgaagtataaagcgtgggggtac

SEQ ID NO: 577593 - DNA, 169 bp, Homo sapiens
aggtaaaggggaaaaatttgggcgccaaccccaaacctagggttttgggtttggggggtgggtaaaaattttggggcctggttttaattttttcttgggatggggtttcccttttggggtattggggttaggggaacctgggcaaaaaaaccccccttttaaaactgga

SEQ ID NO: 577594 - DNA, 446 bp, Homo sapiens
  misc_feature (391)..(391): n is a, c, g, or t
  misc_feature (401)..(401): n is a, c, g, or t
cccacgctgagggaagaatcatgggaaagagtagagacggggttccaccgtgttagccaggatggtctcgatctcctgacctcgtcatcctcccgccttggcctcccaaagtgctgggattacaggcttgagccaccgcgccccgctctttcgtgttccaaaggctttttaaataaacttccactcctgtcctgggattctgctttatgggccctcagtcgaattctttcttctgagggagggcaagggactgaagttgcttctgaccagtacagggagaaaacgaatacaggcaggggatgactttccaccagctccatttttgcagctcttgagggtgttatttaaaaatgacccggggaaggaagttcatggccacggggccaggacntttaacattncttttcgggtttaccccagggggttttcaggacaaagttttcatt

SEQ ID NO: 577595 - DNA, 670 bp, Homo sapiens
tggcgtgtagctggagagtcggaccccagagagccctgagcagcccctaccgtcgccgccggcctagttaccatcacacccctgggaggagcctgcagcgtgcctgcatgcctgtgcccatgtcaccattcacctgcaaccattgagcatgctgatggccgagacccatgctatgcctgcctgctgccccgttggtgtctctgacctcagtgcggtgtatcaatgcgcccggtaccctacccgagtacgaagaccgagggcgatgtgcatgcgagcctagagtcccggctgctgatcccatctcctattctagacgtggggagtacattggcctggacatgtccgtacctaaagcacagctgtcacttcgatcaacaccagacacggcctattcgacggaacgactgagacgtaaaacgcaccattcggttcaccaacgggtgctctccagcgtgcacacctggggaacttcgcttgcgacttactctacgcatccacaggatacgagtaccagctccatccgagcctagtcactcgctgcatgccattggctcacgcttcgttggttaacgaagcacggacatcatttgtcaccatgttagccgagtatgacagacattggtaatcaaccacatccacgtggaagagcgattaagccgattatccgccc

SEQ ID NO: 577596 - DNA, 127 bp, Homo sapiens
caagtagtggcttgaaaggcaggaggtggtgagtgaggagcacatactacagcctgttgcccaggctgtgcagcgcagctggactctgcatcccagcacctgctcctcgtacctttctacctgttta

SEQ ID NO: 577597 - DNA, 843 bp, Homo sapiens
agcggaggtacggccccggggacccgcagtggagagtgagcggggctttccccgacgggccagcccggcgcgctcgcccctggctgggccaggttactcactataaacaatatccagcacaacataagcaaagtttattccatactttgaatgccgtgaacagaagactagacaaatccaaattaaggaaggtgaaatatgaggaaaacagtatattatgggttgcagatacattcttaataaagtacttaaaaggtcaaagtagtaaacaaacgagcaacacactccagggaacggcaacagaatgtcgttacccaaaagaaaccatttttcccacagattgaatgttcattttcacatgacaaacaggcggactggacaacctaacaattccgttgcagaaacgatatgacttgcgagcattacattccacaactagacaacgtcacaacagactgtttaccgtgaaggggcattattgtccacataaccacagaaggtaccaaatgttactacattgacaacgggatggcgcaacaaaccaaccaggaattccacgaagaggtttcaccgatggggacattaacccacactattggggagcgtttcgaacgcaaccataagtctcacttaggctttcacaggattcaccctgagagtacattcacagaagtacaaccacagaagggtgcccaacaacaacttgtcttacggacgcaaggccaggaacaggaacaaaacccataaagtgggggcacacaacaacaaagttaatggtgtcaggaaacaccatatcctggggctaaccctttaacgacttgggttcatgggacaacatacaac

SEQ ID NO: 577598 - DNA, 1061 bp, Homo sapiens
  misc_feature (1)..(1): n is a, c, g, or t
  misc_feature (82)..(82): n is a, c, g, or t
  misc_feature (101)..(101): n is a, c, g, or t
  misc_feature (122)..(123): n is a, c, g, or t
  misc_feature (130)..(130): n is a, c, g, or t
  misc_feature (135)..(136): n is a, c, g, or t
  misc_feature (138)..(138): n is a, c, g, or t
  misc_feature (151)..(151): n is a, c, g, or t
  misc_feature (198)..(198): n is a, c, g, or t
  misc_feature (232)..(232): n is a, c, g, or t
  misc_feature (281)..(281): n is a, c, g, or t
  misc_feature (296)..(296): n is a, c, g, or t
  misc_feature (298)..(298): n is a, c, g, or t
  misc_feature (315)..(315): n is a, c, g, or t
  misc_feature (331)..(331): n is a, c, g, or t
  misc_feature (404)..(404): n is a, c, g, or t
  misc_feature (417)..(417): n is a, c, g, or t
  misc_feature (440)..(440): n is a, c, g, or t
  misc_feature (449)..(449): n is a, c, g, or t
  misc_feature (472)..(472): n is a, c, g, or t
  misc_feature (499)..(500): n is a, c, g, or t
  misc_feature (508)..(508): n is a, c, g, or t
  misc_feature (516)..(516): n is a, c, g, or t
  misc_feature (524)..(524): n is a, c, g, or t
  misc_feature (531)..(531): n is a, c, g, or t
  misc_feature (536)..(536): n is a, c, g, or t
  misc_feature (542)..(542): n is a, c, g, or t
  misc_feature (546)..(546): n is a, c, g, or t
  misc_feature (553)..(553): n is a, c, g, or t
  misc_feature (578)..(578): n is a, c, g, or t
  misc_feature (580)..(580): n is a, c, g, or t
  misc_feature (614)..(614): n is a, c, g, or t
  misc_feature (625)..(625): n is a, c, g, or t
  misc_feature (634)..(634): n is a, c, g, or t
  misc_feature (655)..(655): n is a, c, g, or t
  misc_feature (860)..(860): n is a, c, g, or t
  misc_feature (880)..(880): n is a, c, g, or t
  misc_feature (1009)..(1009): n is a, c, g, or t
ntgagagatgaggaaacaagctcagagcaattaagcgacttcccaaggaacagaactgctgcttggaaagaagcagagaatngcaactactgggcccaggntcctgccctggagcatgtacnnggatgcnctgannanaaccctgcacgtnagcagagcccatcacccaaccactcacctgaccccccggccacaggnctgtgccagtctacacagacacacagcagaaagnggatggccttcaggtttccatttaatggccaagccagcactgccaagangtcctcctgcctganangcccacccacgctggcncccctcagcctcactngcggcatcccagtccagtcctggtgtggggcctcatctcagctccttcagcaagctgttgaaagagcccagcngctcctggaagtngccctcgtcctcaccatcctgcngctccaggntggccagcacctggtactcagcntgcaggctggccagtgtgctgcggggnngggggtcntgagggtnggggtccnggcaggnggtcngggggnggcncagtgtntgcggcaccttctcaggggcatcangntcgggcggcggagggggtgggcggtgatctcgcnccagcgctgtncccacaggnctgggaggaggtgtacctggngatagtgctgcagcttctctggggacatctcctgggtcagctcagcctcctcctcggcgaacatcttctccgtgaccaggtcgtagagcagtgtgaccacgcgcacggcgagcacctccgtgcccttctcctgcaccagggtcctcaggacctgcagccccccgagcttcaggaactgccgctgggcataggggaagtggcgcanaggggagcacagtgcaaacnggaccttcttctttgcagtgagcggctgctccgtggccaggatgaccagcagcttctgcagggctcccccttcgatggcctccacctggaccttggggttgctggaaaggcagcgccagcacaaacgcncatactcttcacgaggggctctgtgctgttcagcccattgatcacacttgaa

SEQ ID NO: 577599 - DNA, 629 bp, Homo sapiens
agcggctgccccctcccccgcccggagccgccgaagcgcctcggtgcgttgcacctgcctggaggctgggcatgctctgcagctgctgctcggcagctggaccccacccgtgcaggcgcaggccaaccgagaccctggatctgtgcggttgccccccctgatcattgcactggcctgagccttcgcccgcccattgccacctgggcctgcggagactgggctgggggacttgcgccttcgcgcctgagtgaccacttggttcccttcgggttggcattttggcttgctcgggggctgcctaaggcccagtaagcccgcctaggacgttcgccaccggagtcggttgcgcctttcccccctgttggaagcccggcttggtcacggtcgggcgccccaaggttggccctggcggtacaagacagaactgtgaagcccagcgaagacccacccggaggcagggaaccgaacaggcccgaacagacgaacaataagggagacacacactcgtagaccaatagtattaaacaccataaggagaaccagccccgacggcccccggcgtggccagaaggagaagccgcagaccatacaacccggaagagaaccaccgcacacgagcaccgagaaat

SEQ ID NO: 577600 - DNA, 189 bp, Homo sapiens
agatactgcagaaacagatgtgagcgtacagtaacaccaaattggttgcagctcggcaggcattggccggtatttgaacatagtttgaacagttagcccttgtattggccaaaacttggtgattggcacaaaagtaggcttcagtctgtttacatcttcatttaggttaaagttcactatgtacagaga

SEQ ID NO: 577601 - DNA, 429 bp, Homo sapiens
aagcgggaatgtgctccgcctccaggtggacgcgcagatcaaccacgccgtgggccccttgctgccggctgcagctggtgccccagcccctctgtacctacgggggcctgcctcagcccatgtccgtccagccctggcccgccgcatactgcgcccgcatgagaaggctggcggtgaaccggtcccccgtctccataactcgctctgtgtaggtccacgggacagtgtgggccagtggctgcccagccgcctaggcctcagccaacgccggcccctggtcaggcccctgcagctgcctcaccccgccccttgtgctcgcctcataggtgtctacctggactccaagctctgcgggtgacagatcatgtttctgaagatggtttaagttatagcttcttaaacgaaagaataaaatactgcaaaatgtta

SEQ ID NO: 577602 - DNA, 387 bp, Homo sapiens
ccagatgtggtggctcatgcctgtaatccagtggtttgtgatgctgttgtgggcgggtcacaaggtcaggagttcgagaccagccaatacggtgaaatcctgtctcaaaaaaacaaaaacattaaggctggtgttgggccagacacggtgcctcatacctgtaatccaagcactttgggaggccgaggcggccatatcacctgaggtcaggagtccgaaaccagcttgaccaacttgtagaacccccgtctctactaaaaatacaaaataaaccgagtatggtggcgcatgcgtgtaatcccagctactcgagaggctgaggcaggagaagggctgtacccaaggaggtagaggttggagtgagccgagatcacgccattgccctcc

SEQ ID NO: 577603 - DNA, 169 bp, Homo sapiens
ggtgggtgacctagaggatccctcgtaatatgtaacaccttcatcaattatcttagatctttccaagtgactgctgcacccttctacttcagcatattctgtttcactttgcacttttatgttatggagacaatgtccttccttaaacctcttgacccagcctctgcta

SEQ ID NO: 577604 - DNA, 604 bp, Homo sapiens
  misc_feature (562)..(562): n is a, c, g, or t
  misc_feature (604)..(604): n is a, c, g, or t
cagacttctgacctgtgcagctataaatctgcattgggtcatgattggtttgtagcaatagaaaattaacacaccactgtaaacagtgggtttaataaacagaggaggtctcagtttattaaagtttttggtatcaaataacagacatatagatatactcaaaattaataaatgttgatattctggtctctgattagagaaaatatcatgatagatttttggtttagtgaatgtcgacctttgtgaatgtgtgccttaatgtatgcatgttatgtagagagacactggaaaatgcttttttagcttaaaaggcatagatttaagaagagaagcttgtgaaaccatccacatccctctgctttatcccctacccctggggggtatggatgtatgtgattatacgtatgtcattgaacatgggcaggggcattgaacgtatgtcattgaacacacacagaaacacatgcatgaccaatccagaccctaagagaggattcttggatctcatgcaagaaataattcagggtgagtccatagagtaaagtgaaagcaagtttattanggtagaggaatcccaacactttgggaggccggtgggcagtcn

SEQ ID NO: 577605 - DNA, 529 bp, Homo sapiens
atttcatgtctataatcgctcggatctttatggacgccttcaagagttgtttggtttggagccaacaataattccacctaagaaagatgatgataaaacacgggaaattggaagaacaagaaccaatcgaaaattgaaagagttaaagtaaaaacagaatcccaagaccccacatcttcatggagatcacttattccagtcataaaggtcaatgtgagcacaggacgtttggcctttggaaatcactaccagccgcaaactctgtgcatcaactttgatgatgctttcttaacttatactacaaaaccaccttcaagtcatcttgaccaattcatgcatattgtgaaaggaaagcttgaaaatgttcgagtcatgcttgttcctagtccaagatatgttggtcttcaaaatgatgaaccaccgagattaatgggagaaggttttgtggtgatgcagtcaaatgatgttgacatctactactacatggatgagccaggacttgttccggaagaaacagaagaaaaaaaaa

SEQ ID NO: 577606 - DNA, 134 bp, Homo sapiens
actctccccagcctgtgctcaggttgccctgaatgttgactctggaagagccagtggcccagaatgccgggggaggcttctgggtggcactcatggaacaccgtccctctgccagtacgggggtaccgagctcg

SEQ ID NO: 577607 - DNA, 105 bp, Homo sapiens
  misc_feature (25)..(25): n is a, c, g, or t
tcatgggtgctcatccccccagctncacatgagtctctctattatgctgacaatcaaacccagcctgtttgccagaccccagctctagtcccaccacctgctcag

SEQ ID NO: 577608 - DNA, 278 bp, Homo sapiens
ccaacccctggcaaccatcattctactctttgcttctgtaattctgactattttagattccactaaagtgagatcacgcaatatttgtccttttgtgactggctcatttcacttggcataatatatttggaattcattcatgttattggaaatggcaggatttctttcttttttaaggctgaataatatttcattgtttaacacggtttatttattcattatccatcaacagacacttcggtgtgccatatctaatgtaagatgatactgcatggtga

SEQ ID NO: 577609 - DNA, 1013 bp, Homo sapiens
gaccttctggagtctcctgccctggaagaataatgttcgaccacaacactggataagtactgttgctgaggagctgaggtccgcgactgttctgcggcaggtgctgactctgtggccaggatcaggtgaggactgtgggcctgcactcgcatgtatgtgtgggatgctcaccgagttcgactgagacagaaatatgagcgaatcgagattctaattatactcgctacacgaacgtctttgcaccatacctgatatttctggttcctttcactacacaagatcgcgcatagtcgcgcattgataggtcatgttaccaatttataccagatggtcattaagcatagggttcctcatcggctctaggagaaaggagcttgcacactggatcgcagtatccagcaagtgcgcatacgggacaccctcctctagagtcactgacccctcggggcgtaggtctataaactgcaaagaatttggggtagcttcatattgtgcataagctgctatgtcttaatggaaacttgcaccagcgccttcagctgtgaaaatggcacgcagaatcctgcaattagaggtaagtgtgtcgattgatgtaggaggaggaagggcatgtataagtctaaagggggagactgaggggcctgaaggagtggtgtaggagggcgtgttatgcagactcggaaggtattccgaagggaagcctgagagacgctccttgcgtcatggggtacaagcacaagggtggattgcaccctggttgggcgcactcacaatgaagtcgcatcattgtactttgaggatttgatacctgcgatactatgcacacctgcggttccccggatcgaagatttgacggcgtggcttacacacctgtgcccaagataggtctttcacccattgagtagggcgcttcgacttttggcaccatatgcgcgaaagcaacgtctatggaggatgttggggccattcaagagataagcaaaacgatcccaagttggtcccgattcttggat

SEQ ID NO: 577610 - DNA, 482 bp, Homo sapiens
gctttcgaattactggttgacaaagccgcatactagagtggtgttccagtggtgatgcaggtgcagctgtagagaaaagaggaggtcacaggccccgtcatcgcccctctcttccctcagaaacgttaagaaggctggtgggtcgtaatcggtgacccccaatccaacagtttgatctcaatcaagaggttaactctgcagcagaaggccaaggtgaagctggactttgtggctcctgtgggcgggagggcacaaccaccccctgtacttcatgagtgacgcttacatgggctgcgatcaggagtacaagttcagcacagaagtgaaggaggctgacagtgaaggagacagtgacagtgattaagcccccagtagacggacggtttgagcccattaactctttttttttatatatatttttggaggaataacgtgactgttaagttcattgtgatttgaataaagatgtccattggagaaca

SEQ ID NO: 577611 - DNA, 246 bp, Homo sapiens
gcctcgggagcgtgtgtcctgagttactcctacgttcaacgtgagtaggagtatgcaggatgacacgacatgtgaatatcctgactcgtgcatggtgctattccacgaagccacgagacggctagtggtacccaggggtgtgagggctccaggttgtatcaccatctccatatcattgagaccaaattggagatgagtcaaagttatagatatagcacgacagacggctcagggcatggcttagtt

SEQ ID NO: 577612 - DNA, 342 bp, Homo sapiens
  misc_feature (48)..(48): n is a, c, g, or t
gtcccgatctttgcaggtgtgatgaccaaaaaaaaaggtaaaacccgntcttactggaaagcagagaggataacaagaaaaaaaaaagataattttaaagatgatagggttttaagtcctggggaggtgacagaaaatatctgggggagccgggcacaatgactcatacctgtaatcccagcactttgggaggccgaggtgggtggatcatcaggtcgggagttcaagaccagcctggctaaggtggtggaaaccccgtctctgctaaaaatacaaaaattagccgggtgtggtgcacgcctgtaatcccagctactcaggaggctgaggcaaagaatcgtg

SEQ ID NO: 577613 - DNA, 254 bp, Homo sapiens
agacgtttggaccggggatgggggaaaagaatttaaaaggctaataattatctgttcataataagtaaaagctaccatataacattttcttttctggtcacactgagttaaatttcttctgaaaagccgcacatatggaccaaatataacaaaaattcctgaactggacaaacagcatactcgacagggttgttaacctaggtcacagttcagtattttagagaatctttcagacatctggaagcctttctatt

SEQ ID NO: 577614 - DNA, 637 bp, Homo sapiens
  misc_feature (328)..(328): n is a, c, g, or t
ggtgaaatagatatggcgaccgaggggatgtggagctggagtgggagagtgagaccagtggaccagagcgggctccggagaagccagggaaatatgaccatgcggtgtccggcggacttgtgagcggtgtcagcgactatgcagaggagaaggagatccagagttccaatctgagagggccatgtgtgtgattggagacagaaggtcccgggagcagaaagccaaacaggagcgggagaaagaactgcaaaagtcactatcaagaaggaagatctggagctaataatgatgagatggagatacctcgagcagcagcagaacgcagttntggggaacacatgggcaaacgtggtagaggcgcttatgtgccgtaacaactgattgcgtgctttcccaaaaaaaagagaaagggagaaaaaaaagtttttgggcggcatgggcccccgggaagaaggtcttaacacccatccggtggggggcgagggccccatgaacaggtgaacggccacacgcgtccagaagacgcggggagcaagaggggcgggtcccccaaaaaaaagggggggacacgcggtttgaacaacccagaggtagaggacgaggccaccggggccaaggacgataatagcggggggat

SEQ ID NO: 577615 - DNA, 197 bp, Homo sapiens
ggggggggggggggttcccccttttttttccccttttggggggggggggggggcctttttttttccccccccaaaaaaaaaaaagggaaaaaaaattttttttttcccaatttttttttggggggggggggggtttttttttaaagcccctttccggggttttgggggggaaaaaaaaccctgggccccccccccca

SEQ ID NO: 577616 - DNA, 329 bp, Homo sapiens
accatagtcagatctcagattggacaacgctcgaatagctggactagctatgaggtactggatttgagtagtacactcttgcatctcttgtacctaggtagctaagtcgcattacaaggatgtttgccctgcgtgcacactcctgctgttgtacgctttagtttttcttcagactctcttaggccagttacatcattagagttcagatctgtgtactatgcactccaaagctatgtcaccatctgcttcatattgtatccatctatagaattaactcatctcttgccatacctttgaagtctgtttccactcaatcgacaccttctaga

SEQ ID NO: 577617 - DNA, 218 bp, Homo sapiens
cggtgctcatcgtgcctggtataattattattttgtttatattaggagatgagttctccctattttgcccaggctggtctgaagtccgggactcaagcgatccaccgtgcctcagcctcccaaacgtgctcaaattataagcttagccatgtgctcagccctaaatgttatatcttaatttccttttataggctttattgatttccaccatagaggat

SEQ ID NO: 577618 - DNA, 833 bp, Homo sapiens
cacctgtgggttctgaaggctagaagcttccacgaatgagccaggaaacaagttctgattggctgggaacagagctctgctccaagattcagggctggcaggattccttctggttctggtggctcgatcttgcatgtgcttgcctctggactggtaagttattccaaacaaaccccaggtgcgtctggaggggaaatgttcgcaatataattaatattggctggcaggaattaccgttgtaaaagatatgtgcttttaagtattgtggttattgtgcgaagatgttgggactacctttgtgggcaatattcttccttcagcgggctcatgtataattttagataaaagtacaaggaaaattatgattccataatcataagtctagtttcagcaatacacgtatcttcagagaatctcagcctccctgcagcatcctcctggtgcacagaaaaactgcggaattctggcaagatactcaaaggattctgacgggtgaccatctcaggccggagatatgcccaacaactggaaaagcagagacagccatggacagatctgctgacgctaaagtttatagacagctgaggtgtcaacccatataatcaccgcagatgttattaggccatgatcattctgtagttaagcggaacctcccttctggtgtttcctctcagctgacagactatcgtggggcactttcaagggccccattgtgttcaaatcacacacaaccaaaggttaaagaaagcccgctgggtaaaatactccctttggggggtcccatgaaccgcgcaaggaataccccagaattctctctgtgtccgatatacttg

SEQ ID NO: 577619 - DNA, 1639 bp, Homo sapiens
  misc_feature (754)..(754): n is a, c, g, or t
  misc_feature (762)..(762): n is a, c, g, or t
tcctggatcctgtagaggactaataacacaagaccctcattgccatcgtttgattatccacctcatagcaaaagacatgggctttgtcggatcttatcgtccaactccgtcgtttatataatcacatgcccgtttccaatgatcctagaagctcattcgcgagtctccgtaaggtagggattggcgtcaagattgttagcgcacatccgagtagtggcacgaatcttctaagtaggctactatgatgacaggagtatcatggataacttgtcgcctatttcggtggccgcagggtgcagaatgtactatgtagccgaatctactgtaaccatgtgtagcaaaatagagaagatacatacaaattctcagggcacaatgggagcgagagtgaagacgtggtccactaggctgaagataatacagacggtacaatacctccagggctctcatataggcgctctcaattacaagatctgagtggctgggcgtcacgtctatactggccgttgggtttgcagatttacaaggtggggttctgggaagaagagccacgcaagtgcatgtcacttagagccacattcggcgggtatgaactcacagagagagtaaggcgatccggggggtcaaaagggcgcctgagcggggggaagcggcgggccaacgctacacatgatagcggcgggagattgtgcatacaccaaaacagtcctgggcatcggatttccccctcaagaggtcgtcaccgcgcgaaatnttacttgnggggccattgtgtgtgtggggcgcaagtggtcacaacgcgtaagaagcatgcaggggaatgcacactcaaacgcgttagcaacgcggggtgtaaacctccattctgagagaacaaattttctacccaaccagtgggggggaggcggcggtggcgaaccaaaggggttcccgcccctgcgggggggtgccccccaaaaagtattaccaccgcacgagatgctcgaccaacagtctcgtctcgtatgttgcaaaccaagcaggggggaggttgggacccccggaaatccaggaagagaacggccacgaaaaaaaatatagaggggcgaagggggcactatgagcacacagagcaagttaatagaaaaaccgcgactctcggtggaacgcgggggcaaacactcctgcggaacagagcaatgagggaacaccatcggagaggaaaagagggagagcccgtatatttcaacaagtgagggggcgcggagagaaggctaaagcaggggggaacaatatcacccacatatcacacaaaatctttaaaacagcggtcaacacaggggatatttagttcaacatttatataacgcgggagtccacgggggtggtaaacctaaaagcggggccaattatgatgtgggggcgctgcataaaaaaaattggggtgtaaacggaggaaaataatggtattgagagcaaactttaccgtagggaggactaatcagtcatataataagatatagagagtatataatataatgattctaaagaaaatatcatcatccaatagaggtattaagtgaggaattataattactattaagcaagaagagagagtctcaataatatgtttttatccagccataattagggagagttc

SEQ ID NO: 577620 - DNA, 373 bp, Homo sapiens
tagacaaggatttttgcaactatcacttaaagtctggtggcacattctttagttaggtccttaaggcaatatatttaatttaatttacaatttgatttgatgttaaagtttttttaaacttcacctcaaaatagatgctcaaaatattgccctcacaatagcctttgtaaaatgtattcagattttggataaaaaataatggtggcttttttttacagtagtgctcattagcaccattataattaagggtctcccaatttcccagcaaaaccacctgtttcttaggagtttcaccttaaaagatcacagtggttttacccagttgggtagcgcacaaaaaagcaatttttatcagttgcgggtgcttttttgg

SEQ ID NO: 577621 - DNA, 142 bp, Homo sapiens
cgagcactcaaccctgacccgatgcctgatgacccgacagtgagagcctagagagcctagttgcagcaggcccatgcgcaagatccttctcccagacccaggcactgcggctcgcatggacctttagagaaggagctgcatg

SEQ ID NO: 577622 - DNA, 222 bp, Homo sapiens
tgccaaagctatacccaagtagctgtgataacaggcgtgcaccgtcatgcctggttgatttttgtatttttagtagagacgaggtttcaccatgttggccaggctggtcttgaactcctgacctcaagtgatgcacccgccttggcctcccaaagggctgggattacaggcgtgagccaccgcacctggcctgctttcattgttgggtactacgctttggca

SEQ ID NO: 577623 - DNA, 325 bp, Homo sapiens
tgacatacacatcctgaaggtgctagacaaggcccgtatcagcaccggagaccagcccatctgactggctgccaggcgctatctgagcactcacttccaagagtcccacatcactgtggctggatggaatgtcctggcagacgtgaggagccctggcttgaagaacgacacactgctctctggagtggtcaagagtggtggactcgctgttgtgtgaggagcatcatgaggaccatggcgtccgactgagagttactgataacatgtgatgggcccgctggaaacctactggacattctgatatctccactggacatacaggagg

SEQ ID NO: 577624 - DNA, 128 bp, Homo sapiens
cacacctgtaatccctgcactttgagaggccaagtgagtgatcacttgagcaggagctgaaacagctggcacatgtgaaacctcttataaatcaaattgcgggtgggtgcgaaccgacccaggggcgg

SEQ ID NO: 577625 - DNA, 175 bp, Homo sapiens
atagccgtctccagaggctccccgaccctgcgaaggggccctgttccttccaggcccccaccactaggactctgaggctcttactgggccaagttcctctagagccctccacagccgcagtctccctctgacctgcacggccaagagcagaggcagcgggttgtggaaagcctct

SEQ ID NO: 577626 - DNA, 376 bp, Homo sapiens
ggtcgaccgtagaaactagtttgtgatgtgtgccttcaactcacagagtttaacctttcttttcatagagcagttgggaaacactctatttgtaaagtctgcaagtggatatttggacctctttgaggccttcgttggaaacgggatttcttcatataacgctagacagaagaattctcagtaacttctttgtgttgtgtgtattcaactcacagtgttgaacatttctttagagggagcagaggtgaaacagtcttcttgtggaatttgctagtgtagatttcaaacgcttcgaagtcagtgatagaaaaggatatatcttcgtattaaaagtagacaaaatcattctcagaaaactctttgtgatgtgtcgacg

SEQ ID NO: 577627 - DNA, 134 bp, Homo sapiens
gatcctaacaggccaattttgtgccccccacccccaccctgggacgtttagcagtgtctgcagacatttttgattgacacagctggggtgagggatgctactggcttctagtgggtagaagcgagggatgctgt

SEQ ID NO: 577628 - DNA, 102 bp, Homo sapiens
tctcctccctccagcagcttccggtaggtggaatctccacatccaggccatcttcacgttgagcaggtcctggtactcgcgcagatgtgcgggccatctcat

SEQ ID NO: 577629 - DNA, 317 bp, Homo sapiens
catctcctaaaaccatacttcatatctgaataaaggcagtaacaaggttatacttctgcttaacatgatacaactatcctgcataaaaccaaaaataactaacacttccccagaagaggatgcaaagtctggatgatgttaatgcttctccctgatatcccataacttaaaaactgatataaagttaacaatatttaaatactctaatataaagtcagtatatcatactgtacatgataaagagatatgaaagggatgaaaacaaagctgtgttgtatacacattcattataaaataaagaagacacattcatgaca

SEQ ID NO: 577630 - DNA, 792 bp, Homo sapiens
  misc_feature (186)..(187): n is a, c, g, or t
  misc_feature (193)..(193): n is a, c, g, or t
  misc_feature (197)..(197): n is a, c, g, or t
  misc_feature (199)..(199): n is a, c, g, or t
  misc_feature (205)..(205): n is a, c, g, or t
  misc_feature (207)..(207): n is a, c, g, or t
  misc_feature (224)..(224): n is a, c, g, or t
  misc_feature (240)..(241): n is a, c, g, or t
  misc_feature (244)..(245): n is a, c, g, or t
  misc_feature (250)..(251): n is a, c, g, or t
  misc_feature (277)..(277): n is a, c, g, or t
agagctgaggaaagaatccctagcttgagaatgtgtcaatagaaacttccaaaactgaaacaggaaagctcaaaaagagtggggaaaaaaagcggaacaacatattcaacttcatatttaatattttgttttgacaatagcaatttttaaattttgtagttgtgggacaactacaaaggctgtcanntacacntaangngaatantngtggtttggggaccagntggaggtggccaggtnngtnntatcnnatggttttactgcctgtgccacatanaactgtttcctcatgatgatgccattttcataagttggagttctgcgtgtggggagacacacgagccattggcatctcacttagattcttcctaattcacacaaacttaaactttagtggtgtttcgtgagcttaagagaaaatgaagaaagcatttcacatacctgttttggggtcctccccatttttcctaactctgcacagaaattagaagcagggagttctttctatatttactaacataacacacatcacttcttttaatttggcatccttcctccctttatgtaattgacgcactgaccagttctgtccttttaacgggactctctctacttaaggagctgctaatttcaaatcacctttggcgtctttctttgagcataatgtgatcctgctggaattcacggcacacctaaaccttattttggtctcaagagaaatactactaccagcaattgatcttagatgtttggatcatcagtaaaaatttccacttatgaaaacaaaaaaaa

SEQ ID NO: 577631 - DNA, 410 bp, Homo sapiens
  misc_feature (396)..(396): n is a, c, g, or t
attttaaaacttcaatttgaatcaaagcttgttgtgaatttcccaagtcttttttagcatcctgaatttttggtgcctaagcctacattaaaatttacccaacatgtaagatctttcagttttgcccttctaaaatgcatcatttgggccctggtgcagtggctcatgcctgtaatcccagcactttgggaggccgaggtgggtggatcacttgaggcccaggagttcaaaatcagcctggccaacatggggaaaccccactctactaaaaatacaaacattagccaggcatggtggtacaagcctgtaatactagctacttgggaggttgaggtgggaggttgaggctgtagtgagccatgatcatgccactgcactccagcctgggagacaganaacagaccctgtct

SEQ ID NO: 577632 - DNA, 649 bp, Homo sapiens
  misc_feature (287)..(287): n is a, c, g, or t
  misc_feature (380)..(380): n is a, c, g, or t
ggccaaccctgcccaaaggaaggggtgggttttccaggccccttttttcgtggacccccccctcaggatgggcaaaaatccccaggtggtcccagcagctcgcttttaaaaagcagtaggtaagaggcctgggcttatgtcaccaacaaaggggtcctaaaagtctggctgctgggatgccccctgccccctccggaaggctctgcagagatgactgggctgggaaacagatgcttgctggccatggagcctcattgcaagttgttcttgaacacctgaggccttcntggtgcccaccaggcactacggcttcctctccagaatgtggctttgcctgagcacagacagagtcagcatggaatgtttttggccaagggtantgggggccctttggccttttgcaggtgatccagaggaacccagagccaacttaccccaccctccccctatggaacagtcacctgtgcacaggttgtcctcaaaccctctcctcacaggaaaaggcggattgaggctgttgggtcacccttgttcgcccaaacaaagcttgtgccggatttggccctgtcaaggggactggggccttgttttcatccctccttcctagttttactgttcaagcttttgaaataaacagggcttgttccca

SEQ ID NO: 577633 - DNA, 228 bp, Homo sapiens
gttatcggatgccacggccaagattctcatttatctgggcaggggcatattccatctctgcagcaaggtaaagcccggggggctagaagttccttcacagaacctaggtgtcagccagtcagggatatggtccgggggcttcccataaagaaagctaaatcttggcttcgtgctactccggagcatgcagtttggattttgggggcatcgataaacaccgggtaccgg

SEQ ID NO: 577634 - DNA, 676 bp, Homo sapiens
agggcaaattaccttcccactggatatttatccactgggaaaagaacaacctattcgtgctgtcctccactagggatatgtgaaagaagtacgccgccgctaataggattgggcctatgacccacttctctcggaacctggtggggccagaaatccctaagaatgaatggacaataaggctttgccagcaccaggctgcaggaggatgtgcgcatgtttattataggaccactcaaactggcgcgtaccaagagcaagttacttgcatgcatcaagggactacgagatctgatacctgcctgatcaataggcactgttaaaatttgctagattcatggtaagatgtcgttagcggcaccgatcgttagccagtgtgttccagttattgccgaatctcagtgatggagagcgcccgcttatgcggagaaagaagagatgctttgcgtacgggcattctcaccttgaggtctgtaactgaagggaatgcctgcagtaagtcactttcagggcccagtgaagtcttgcgacttcaacattctcttctgacctcgcctgaggtagccactttatcttacacattggtcgggtctaggtccattatcggccggattctgcactgttcatgtgatttcagcaatgggttgctcctgtgataacaaaatcatctatccgtgcc

SEQ ID NO: 577635 - DNA, 414 bp, Homo sapiens
aatagaaatttatttctctcagttctggaggctggaagctccaagatccaggtactcgtaggcttagtgtctggtggggaccccgtctctctgccttcaaggtggtgtcttgttgctgcctcttctggaggggacaaatgctgtatcctcacttggcagaaggcggaagggcaaaacggccaaatgctgtgtgaagcctcttttagaaaggccttaagcccccattcaggagggaagagtccgcatgacccagtcacctccttaacactattgcattggagattaagtttcaacatgaattccagaaggacacaaacattcaacccgtagcactcctacttcctctatcagtagaaatttttcaagttcttaatttttatgtaataatagcttattactgtgacggaagtggcc

SEQ ID NO: 577636 - DNA, 189 bp, Homo sapiens
gggagaatggttacttggtcgattagggccttcatgggctggcagtcttacagaggctggagcggtgagaagtgagaggtcagagggaccataggtgttgggcactgtctggccaatgttgcagtttgggaaggctaaagtggggccagtgaagaaggtctggaacggggtaccgaggctcgcagttcg

SEQ ID NO: 577637 - DNA, 891 bp, Homo sapiens
taaagacatcatagtgctgttttacagtcaagggttggcagatctgtttctgtgaagggccagcacagtgaaggtttttagagtctgcagggcagcgcagtcgctgtcgtcagctcctcagcgccaccactgcagctataaatgtatgggcgatggctgggttcctaataaaatttgattcacataaggaacaggcctcatgtgatgggattaggtagggtgggtggaggcgcgtgtagctttgccccagttctggaagcgcgactgtggccaaagtgtacgttgtggaggacgcatgtaggtgaacctgaatagaagagaggcacccaaatccatcgagggcctcagggaaggcttcctggagggggtggcgccgtgaatgagcatgagctggcgaccagtagatgaaggaagcagtctgggtgagccaggagtcagggtctcacaagaacggtgctcagtgatggaacgctcttaattgtggcagcacttgttccttgttgtctgcaggagcctgatcggatcatgcaacaaatcgactttggcacgcatgcatttttggatgcccgtgtcagtaaggaacgctcttcgtgaccctccaggtcagggttcccgaagctcgaggcacagggggctattcagcgaggaatccttccctgggaataaccagggcgcacagctctcgaagggtttgtcaaggatgaaggcggtctggtgaacggccctgacactcatctccgtgtccagggggctcgggttgccacctgtggaggcaagggtctccctctaagaaatgaacagggaaaagccaaagattggcgtgaagccaaaagttagaccttagtggagattctgactttcacttcaaaggaacctctggtattatctggg

SEQ ID NO: 577638 - DNA, 149 bp, Homo sapiens
ctgagaaaaaagagagaagggagaatggtgctgggtgttagcaccccagcactggccagcacaggcgtggcatctgtgcatcagacacggggcgtggatgcacaccccaccaggagacccaggccagtgttcccaaagcctgctcacgg

SEQ ID NO: 577639 - DNA, 434 bp, Homo sapiens
ctataggatacccttcaagtcatgctctattgcccaggctgcagtgcagcagctgtgatctcgtgctcattgtcgagcagtagtcacaatcctgtctctacaaaaaatactaaacaattagctggagtgtggtggcacccacgtgtagtctcagctactctggaggctgatgtgggaggatcactttagcccataagttctagggctgcgatgagccatgaaggtgcctctgcactccctacctgggccgacagagaggagaccctgttgctcttagaataatcctgcgtctgcgggtgccgtgtcggtgccggtgccatcatccctctgttccaagacattgtcccttctcttgcagctatcatagtctcagcccgcatggcccccgaagcgatcatcttggacagagccttcctctctgtggtccggctcac

SEQ ID NO: 577640 - DNA, 323 bp, Homo sapiens
gcacgagattgggcaattctagctaatgaaaatatacttaaaagtatttcttaggccgggcatggtggctcacacctgtaatcccagcactttgggaggccgaggcgggcggatcacctgaagtcaggagtttgagaccagcctgaccaacatgatgaaacctcgattctactaaaaatacaaaaattagccaggtgtggtggcatgtgcctgtaatcccagctactcaggaggctgagacaggagaattgcttgaacctgggaagcagacgctgcagtgagctgagattgtgccattgcattccagcccgggcaacaagagc

SEQ ID NO: 577641 - DNA, 121 bp, Homo sapiens
cgctcactgaagaaatgctaaatagtgtcagagcactccgtactccgcgaatttggagtgtgcttcaagacatataggtcgttccaacagcaagccaggcacttgtcacaacaataacact

SEQ ID NO: 577642 - DNA, 155 bp, Homo sapiens
tgtacctcatcacactggtatacccttcccgtactaattaatcccctggcccaaacctgtcatactatctaccatactttgcaggcacactcatacacagcgctaagctacgcactgataattatacctagagtacggctggggatccatctaga

SEQ ID NO: 577643 - DNA, 563 bp, Homo sapiens
  misc_feature (136)..(136): n is a, c, g, or t
  misc_feature (398)..(398): n is a, c, g, or t
atagggtttaccaggcgtagacatgctcgctttcaaagttgccgttggtattgttgtcacaatagacgggaattttaatatcgtcagattcccagatcttatcaccgggtttggcattgctggtacagcaaacggntgaatcgcttctgatttttctactgcgccaccagatgtaccaaaatagcagttcagcgccattgcagacttcaacggcagaaataacaggcagatgacgagcaacaatcccttgccagcactcatttcgcctccactgcttgtaaacggcattgtccgctgcagttgagcgtcgtcatgcgtaatgcgccgtaatcatccatgtaaccgagataaaactggctgccgctataacttccggtgtttgtgttgaccgtactaanaggtgcaaccatcacggttttgaagcctgggagaacgcctttttcatttctcccagataggccatggctcagataatacgcggtaggatttttcagtgtcagttggttgccctgctggctgacctgtaactgcagttcgaccttttctcctgctttcttgcgtaa

SEQ ID NO: 577644 - DNA, 327 bp, Homo sapiens
  misc_feature (40)..(40): n is a, c, g, or t
  misc_feature (44)..(44): n is a, c, g, or t
  misc_feature (128)..(128): n is a, c, g, or t
  misc_feature (321)..(321): n is a, c, g, or t
attccggtcttgaaagcaatacccaatacatgagcagccntttntggcgaccacttcaagataccaatgtgatggttcaaaaaagctgatatttcgggtgttaaggacggatagcgaccatgtttgtnccgattacactgggctaaatgatgagcctgttgtgcattgtatggtttaattcgacttaactcgtaggaaatagttgcaggagaacgctttaagaaacgggcgacttcacgagttgaatgattaaggttgatcattgtttcaatgacagaacggtcgtgagctgataaactagaggcataagctgcaggtccnttttgg

SEQ ID NO: 577645 - DNA, 861 bp, Homo sapiens
gttttgatgaccgctgtcctgtctagcagatacttgctacggtttacagaatattcggtccctgggtcgtgtcatggaaactggaaagaaagggtcgataaggcatgaagcgcgagttcagtttccagcggtggtgctggccgcctctcccatgcaggagttaagatccccaggatgtaatatatagatcaagggctctataccccgtcaaaccagagagaaaccagagcttggaaagttgagtataaacaaagcgactctgatagacatagtctcgctatttggcaaaactgaacgtaggtggatcatggatcccggaactagtcagacttggtaatattttccagttctgagtaacaatcagggtacccgatgaccacgttaatgacgaaagcattcattcagctagtgtattcgacaactctgtgagttgtgcttacaggaagagatggttatgcacataatgtgtccatgcaaagtctcgtacaagctccctctgttaaaagacttgcctgagactcttcacaatttcttgatggctttcctgtgccccgtcatacaaaacttgcctgactgcaaaggtttgaacgaaggatgttccaagaatctttaaatgaccttgggtatccctcttgcacttattccaacaaggcttccatgtaccgaggggggggctcctcatgacatgggctcacatttggtggcagcctaaggaggtaataaacgggctcaggattcttacggcatggaaagaaagtccaccttattgctgaatgggcggccgggggggagaaccgagaaggatttgcacataagtggtttggcacacctataagccggacgtcttgctgggccaagctg

SEQ ID NO: 577646 - DNA, 399 bp, Homo sapiens
aggctaggtcactacatctctctgagacctcacatatcttatctctaggtcgaaaaataaaataacgtccccatgccaatcagtgcaaggaatctgtgagatcaaacactgaaagtgatatgtggtctcaaatgtgctgaatgaatacaggtaatacattatcatcacagggtttcccttgaccactgttacaacagttctggccccaagatttgcagagagaattaagattttatcccaaaataacctgccaactcatatacatttcccaaacatctgtagataaagcatcatggggtacctgaaccatcgagaaataccgtcttaccaacatcctactgaggactggcaacaaacaaaagggaaccaaatcaccaatagatgtgaaggcagatagag

SEQ ID NO: 577647 - DNA, 787 bp, Homo sapiens
  misc_feature (6)..(6): n is a, c, g, or t
  misc_feature (43)..(43): n is a, c, g, or t
  misc_feature (54)..(54): n is a, c, g, or t
  misc_feature (56)..(56): n is a, c, g, or t
  misc_feature (60)..(61): n is a, c, g, or t
  misc_feature (63)..(65): n is a, c, g, or t
  misc_feature (67)..(67): n is a, c, g, or t
  misc_feature (73)..(73): n is a, c, g, or t
  misc_feature (75)..(76): n is a, c, g, or t
  misc_feature (82)..(82): n is a, c, g, or t
  misc_feature (111)..(111): n is a, c, g, or t
  misc_feature (123)..(123): n is a, c, g, or t
  misc_feature (146)..(146): n is a, c, g, or t
  misc_feature (184)..(184): n is a, c, g, or t
  misc_feature (189)..(192): n is a, c, g, or t
  misc_feature (196)..(196): n is a, c, g, or t
  misc_feature (205)..(205): n is a, c, g, or t
  misc_feature (258)..(258): n is a, c, g, or t
  misc_feature (272)..(272): n is a, c, g, or t
  misc_feature (291)..(291): n is a, c, g, or t
  misc_feature (344)..(344): n is a, c, g, or t
  misc_feature (370)..(370): n is a, c, g, or t
  misc_feature (373)..(373): n is a, c, g, or t
  misc_feature (384)..(384): n is a, c, g, or t
  misc_feature (391)..(391): n is a, c, g, or t
  misc_feature (393)..(393): n is a, c, g, or t
  misc_feature (396)..(396): n is a, c, g, or t
  misc_feature (398)..(398): n is a, c, g, or t
  misc_feature (412)..(412): n is a, c, g, or t
  misc_feature (425)..(425): n is a, c, g, or t
  misc_feature (520)..(520): n is a, c, g, or t
  misc_feature (528)..(528): n is a, c, g, or t
  misc_feature (632)..(632): n is a, c, g, or t
  misc_feature (689)..(689): n is a, c, g, or t
  misc_feature (694)..(694): n is a, c, g, or t
  misc_feature (764)..(764): n is a, c, g, or t
tacttnaacaaaagcccacagagaaataaaaaggtcaaaaatnacattctaatntngggnntnnntncttttngnngttttngctgtgctgtctaaccatccttcagctgnctttcaaaaaanaacaccctaagctcatcaaaatnttcattttccatttgcttttttaaattaaaaataattnttaannnnaggnaaactttangggattcacaatcaattgcctgactcattttgatgtcatgtacagcatatggnggtcaggaaggctntttgcagcacatgtgattnggggctactgatcttcagggtttagctttcttccaaacagtgtaaaatacccncaattcctagtttgaagggacacagncgntctcctttggnaattccncnggncntttcaggcgccccngctgttcttcttngagcgacagtgcttctgtcagtttgacacagttcccctgtgttaaatatttcccatcctgtttcaacactttcattgagaggtcaagaatcagtntgagaaantcccatgtggaatcttcttctggagacgtggagattggaacagctgtcaaatcattaatcacataatcaaattctctcccttctttggcgtacctcttcagtancgggatacagtcttctattagaacctgatagcagtctcctttaagattgtctaaganatcgncacacgtttttcgcatgtatttcttacacccatcaatcaccatttggtcaatctctaccatagtgaccanctttggttttagtttgactattt

SEQ ID NO: 577648 - DNA, 107 bp, Homo sapiens
ccctcttctcctacaggacatttactgcggtacatggaatcgcgttccatcctgttcatggcacccttgcaactgtgggatctgatggtagattcagcttctgggac

SEQ ID NO: 577649 - DNA, 270 bp, Homo sapiens
gctccggagtacgcctgatcaggaagccggatctctttctgcttgtgcgatgccattgccatctggattttccggatttgccgaagaacgtgacgccagtttccagcgcgcgctggatcttggtgtcgtgcggctggtcaccatctgtacgcgcgttcgcaagtttgacggcattatcggcattgccgaacgctatgacagcgtctttgcttcggtcgggacgcacccaaacaatgctcatgaggaactcgatgtcaccgccgctgacct

SEQ ID NO: 577650 - DNA, 251 bp, Homo sapiens
ggggggggggggtgggttggtatccacctgaggtccaggagtatcgagatctagacctgatccaacatggagaaacctcatctctactaagggggagaggggggggggggcgtggtggcacatgcctgtaatgccacctactcggaagatggaggcaggagaatcgcttgaacctgggaggtggaagttgcaatgagccaagatcgcaccactgcactccagcctgggcagtaagagcgaaactccatctc

SEQ ID NO: 577651 - DNA, 1098 bp, Homo sapiens
  misc_feature (382)..(382): n is a, c, g, or t
ctacccacgagtttagttgtaagaagaggcgccccacccctgccctctttgggcccccccaagggtgtgagccacaccaaaagtggggtgtttataaacccgggtcccctcctcctcccggggtggtgtgatagcccccctctttttagtacccccccccgtgtgtcgcccacaaaaaaggggtgttttatgccccaacttagaagtcccaccctcttttggtgctccccctttgagaatttatgggggaaccccctggtatatttggaaagttggggccctcccccccccagagaggagttctcaaactcattggttctgtcctgtaacacttgtttgttaaaaccacacacgggtgtagaaaatttgtgcaccacccctntccccacccgtgtaaaagaagcgccccgggcgcccattgggacccacacacgcccaggcacccgaagaaggcaacccgccctattggggaggcgctttttaaagatgtgtgagatgtaaaaatcgcccaacacacagttacccctgacaccgagacaccccaccaaggtttcctctaaagctatcccgcagaccctcgcgcactgtataaaaattttccgcgttttgggggcgaacctctctcggagctcacgagatcccacaccctctccgagccacgtaccactggctaaaagactctcacccacgtcacaaggcgcgactatctattatccccacttgaatcccactaaccttgaccccaccggagacccaagttacccctagggataaccacgcgccacaatcctattttctagagtccacatatcacacccatagggtttacgaccctccgcatgttggaaccacggacactccccgcatggtgccaccccgcctattataaggttcgctttgttcacaccgattaaagtcctaccgctgattctgagttcagaccggagtaatcccggtcggtttctatctacttccaattcctccctgtacgaaaggacccagagaaataaggcctacttcaccaagcgccttcccccgtaaatgatatcatctccacttagtattatacccccaccccccccagaaccgggtttgtta

SEQ ID NO: 577652 - DNA, 880 bp, Homo sapiens
agggcgcggcggggagtgagggggcggcaggggagagaggagagagcgcaggggatgggccagagcggcgcagaggagcaggtaagcacgagggagcggcggggtggaggacagcggggtgtaggcgggcagacaccgacggtgaggccgcgggccgagacatcatgtttatctgatgagaggccgccggggtggagaaggcaaccccaagagtgtaaaattggtcgggcggcagggacgggtgcgactagttgcgtttcggggccctgctcgtgtgggtcgggtgagagagcgaagcggtcgtgagggagagacgcgtgagggagtggggtgggggaccgcgcaacaggcagaggcgacggaggtgagtgagggggggaaggaggaaggggctgggtgaggggctgtgggcggcgtgaccgccgccgcgcgtgcacggcgcggcgggggcggatacgcgggtctgggggttgcggtgcacgccgcgctggtatgcgagtgaggcacagaagataggaggatcagcgggcgcggccgctaccggcgacgaccatatcggtagtagcgaacccctttcctagctcgccgtccggtgaagatgtaattcgaccgcgcacgagacgacgtgggggtgggggggacttactgcacgccccacgcacgccggtagcagacagctgactccgcgccttcgtcggcctgcggctgcgagcaccctcgtgtcggtggggactaggcccattcacccctcgactgttcttatcgccctcgtccctcctcgtcccgccctaactcgtgtgttggcgctgcggtgtttgtcctcttctgatcccaaagaaaggaaaaaacaaaataagaaaaaaaccaaacggacaaaaca

SEQ ID NO: 577653 - DNA, 919 bp, Homo sapiens
gcttactagaccatgcgtatggctcgcgggcctacgtaggtaatgtgagcatggctcagtagcgtggtctgtccgtagagaagatcctgggtcagtgacataggtgctttggattcgtcaccagaatagaagacaacgcgacgaggcgcggcaagccgatgccgttgtcgtgaaggaaagtccagcagtggagcttcgtgagggtcagtgacgtgggatcgtaatcaaagcagcgacgtaccaacgcgagactcagattacttacaattgatcgctcgccggactcgtgggaagcttaggccgttgggacaagaccaggcattcatcgaagccgcctaaggtccaacccaagctcttactccccaggaattaccggggccaccattcaggggatgggaacctttcagcccctccgaaggtcctcaaactgtgggaaccagcaaggaactcttggttgaccgccttgcaagcatggtgtggaacaatctgcgagggacagaggaagccagatttggggcaaaccatgaacccccgagttatacatacaaaggaaaggctgttgggtagacttttggtaaggtctctagataatagtcacagaaaggttcccgaatattgaagggccaagttcttaaaattggcaaaaagtgaattctggattagtaacagttccattctttcccaaaatggcgcaagggccttatccccttggctgtccctccttgggactaacaaacatggtgaccagaaacacaggaccagttagcccagaaagttccttccccaggggttgggacccaaatttctggcaaagacaacatggccttttgcccggaatgtgtttggaaacctcctgtcaaagggactaacattaaaccatagcagggaagcttgcccgggttacctaaatggagcaaga

SEQ ID NO: 577654 - DNA, 266 bp, Homo sapiens
gctggaggatgcatgcaggacgccacagtgacatgggacatgagccgcgggcccagcagcacaggctgaagttagctgacgcatgctcttggcttttatcccacgggcggccagcggccggacccctgactgcagcctgtcccaagtgagactgcaactgacccattcctcctcacgttcgtcttgtcttctgtacattggcttgactctttgcatcatctgcgccgctattgacagaggctgcctgaccgagcagcgccgactca

SEQ ID NO: 577655 - DNA, 294 bp, Homo sapiens
ccccctccccgggtaccaaaattataggcgtgagccactgcactcaggctaatttcttaaaataatcatatttccttaagaagcgtcaccatataaacagcccacggttcctcttgtgtttagaaaattgtttcttgccaggcgcagaggctcacccctgtaatcccagcactttgggtggccgaggcgggtggatcacctgaggtcaggagttcaagaccagcttggccaacatggtgaaaccccatttctactaaagatgcaaaaattacccggggaggggggggtaccgag

SEQ ID NO: 577656 - DNA, 733 bp, Homo sapiens
  misc_feature (27)..(27): n is a, c, g, or t
  misc_feature (74)..(74): n is a, c, g, or t
  misc_feature (78)..(78): n is a, c, g, or t
  misc_feature (272)..(272): n is a, c, g, or t
  misc_feature (317)..(317): n is a, c, g, or t
  misc_feature (319)..(319): n is a, c, g, or t
  misc_feature (326)..(326): n is a, c, g, or t
  misc_feature (328)..(328): n is a, c, g, or t
  misc_feature (413)..(413): n is a, c, g, or t
  misc_feature (415)..(415): n is a, c, g, or t
  misc_feature (424)..(424): n is a, c, g, or t
  misc_feature (427)..(427): n is a, c, g, or t
  misc_feature (436)..(436): n is a, c, g, or t
  misc_feature (439)..(439): n is a, c, g, or t
  misc_feature (458)..(458): n is a, c, g, or t
  misc_feature (518)..(519): n is a, c, g, or t
  misc_feature (528)..(528): n is a, c, g, or t
  misc_feature (530)..(530): n is a, c, g, or t
  misc_feature (539)..(539): n is a, c, g, or t
  misc_feature (544)..(544): n is a, c, g, or t
  misc_feature (552)..(552): n is a, c, g, or t
  misc_feature (560)..(560): n is a, c, g, or t
  misc_feature (563)..(563): n is a, c, g, or t
  misc_feature (566)..(566): n is a, c, g, or t
  misc_feature (651)..(651): n is a, c, g, or t
  misc_feature (653)..(653): n is a, c, g, or t
  misc_feature (717)..(717): n is a, c, g, or t
tccctttttacatacatatataaacanttttgggcgtaggtgtcagatgggtgggggtcatatgggcagataantttngggagccaagaacacagaacgaaaagccagtcaccaaatcttacaaataatcatctaaacttctctggccattcaatttgatacattatcccaaatattccatgtcacatggtccacaaggttttcttttgggattctgaagcgatcaatagccatacttgtcattaagatgggttctgccatctccactttgnccttcaggtggggcccacacacagtagtctgggtcatcttcaggntntttgggngnaagtgttggtggaagtttgcctggaccaggtgttttctttttcttcaattcacctctgcttttctcatattcattctttgatgcngngggtcctgngcncaatggggnggntttgctacagtcttgatantctttattctgttcttcctcgctaagttgagacatgttttcctgggtttgggtttctttnncatgtgtgngntctgtgggnggccncatttccngcactgcngcntcnggctctatctctggctgtggcctactggggcttccatcctccagttttttcttttcatgctcctccttttctttctcttcttccncntcctcttcctcctcctcttctacttcaggctcatctttcattctcattagagttggagggagtnctggacgcttgggggg

SEQ ID NO: 577657 - DNA, 1229 bp, Homo sapiens
tgaagttagaaaagccctgttcaaagacacgagatggctcagtgcttcatccagaccaaagaggtcgtacactggttactcggcaaacttctggtggtggtcatgcgaggtggtttcgatgtgaatgactacttcccgtcgtgccactgaaacttcagatggtcgtgatggcttcggtggcacccgtgctggctgatgtgcatattggctggcagctgccgtgatgagctatatagtcggatattgcgtaattgactcggaagacagacttgttgccaggtggtaggccacgctatccttgattttcgggaacttacaacaagtcagttcttccaagtttaaggacccgatgaaagggagggaaatgcctggcaggctagtaatgcgtcttggtccgcctagtgcgcgtgtggatggccagagtactttttgcaaatattcgacgaataccaaaggatggtctcactggccggtttcccatgctaggccacgctagcatatgatcattggccagatgcgtccagagacgcaaattttcaaatctatgcgaaaaactagaacgcctttatgaccagtgcacgaagcgacgcatgctcaagtaagagagggtgaacggaaggtaatacgcctaccaggtgttttagcaaccagcactttgtggtgccaaactcccagacccgatagcccaacgaggtgagctgggacaaagcggcccttaagcttggcttcacaagataggcatagagcattgatgtgctcaggaccacacatcactccaatgctgattaatgagcgtctgaaacaaaactcgagggcccttggttagtttctggtagaaccttaaattttgcttagtaaaaccacgaggtttaactttgtatacagattttgttcttgggtctacctggtggggcatcagaaggtggttacaaacgccaatttcgcaaatctacacacgggggtttttcaaaactcggttacacgaacctaattgaatgtcttcattagagaacccccctgaaattggcgtggtatagaaattgacgcttagaacgttggttccacccaaggtgcttgcattcgatggccaccgccttggacactttcaaacagtgtggtccttgttggtcgatccaaattggttgtgcgtgggaggatacaaggatctcaacggacctaaacttccgtgtaacgccccatcccttgggggtacaaacttttccccaccc

SEQ ID NO: 577658 - DNA, 369 bp, Homo sapiens
ctgagtccgctaagattcatccaagtgttttcatggtcgtgagcgccgccccatgtttcccatctctcagctgctccctcgtgccctgtgtgaaatttgttactcgctaagagggggctcagatggtgcggcctgagtgtgcggccggcggcatttgggatacacccgtagggtgggcggggtgtgtcccaggcctaattccatctttccaccatgacagagatgcccttgtgaggctggcctccttggcgcctgtccccacggcccccgcagcgtgagccacgatgctccccataccccacccattcccgatacaccttacttactgtgtgttggcccagccagagtgaggaaggagtttggccctta

SEQ ID NO: 577659 - DNA, 435 bp, Homo sapiens
  misc_feature (164)..(164): n is a, c, g, or t
  misc_feature (175)..(175): n is a, c, g, or t
  misc_feature (200)..(200): n is a, c, g, or t
  misc_feature (205)..(205): n is a, c, g, or t
  misc_feature (246)..(246): n is a, c, g, or t
  misc_feature (263)..(263): n is a, c, g, or t
  misc_feature (293)..(293): n is a, c, g, or t
  misc_feature (300)..(300): n is a, c, g, or t
  misc_feature (347)..(347): n is a, c, g, or t
  misc_feature (366)..(366): n is a, c, g, or t
  misc_feature (379)..(379): n is a, c, g, or t
  misc_feature (396)..(396): n is a, c, g, or t
  misc_feature (428)..(428): n is a, c, g, or t
acgcctcaaaggcccccaaaaggattagctgaagtccttcatcctgcagaagtacatgatggtggatagcgcaaaggatcaaaagattccccggcccatggcttccaaggaggcccccaaaaagctgattcgatacattgacaaccaggtagtgagccccaaangggagcgattnaaaaatgttcggaacccttaggccnagganattaaggccacatacattaacctcaagccagccagaaagtnccgcttccatttaggcncttgccggactttgcccgagccttttaggntcagatnccaaagggatgcaggagccctatacccctacacaggggccccctaantcctgtcccccttttttantcctttggtccanagtgttaacctactttnggagctgcctccatgggcccagtaaaggtggnccaagga

SEQ ID NO: 577660 - DNA, 425 bp, Homo sapiens
  misc_feature (124)..(124): n is a, c, g, or t
  misc_feature (132)..(132): n is a, c, g, or t
  misc_feature (204)..(204): n is a, c, g, or t
  misc_feature (206)..(206): n is a, c, g, or t
  misc_feature (230)..(230): n is a, c, g, or t
  misc_feature (234)..(234): n is a, c, g, or t
  misc_feature (243)..(243): n is a, c, g, or t
  misc_feature (250)..(250): n is a, c, g, or t
  misc_feature (267)..(267): n is a, c, g, or t
  misc_feature (277)..(277): n is a, c, g, or t
  misc_feature (279)..(279): n is a, c, g, or t
  misc_feature (286)..(286): n is a, c, g, or t
  misc_feature (289)..(289): n is a, c, g, or t
  misc_feature (292)..(292): n is a, c, g, or t
  misc_feature (295)..(296): n is a, c, g, or t
  misc_feature (303)..(303): n is a, c, g, or t
  misc_feature (316)..(317): n is a, c, g, or t
  misc_feature (325)..(325): n is a, c, g, or t
  misc_feature (336)..(336): n is a, c, g, or t
  misc_feature (339)..(339): n is a, c, g, or t
  misc_feature (344)..(344): n is a, c, g, or t
  misc_feature (374)..(374): n is a, c, g, or t
  misc_feature (377)..(377): n is a, c, g, or t
  misc_feature (381)..(381): n is a, c, g, or t
  misc_feature (384)..(385): n is a, c, g, or t
  misc_feature (391)..(391): n is a, c, g, or t
  misc_feature (410)..(410): n is a, c, g, or t
  misc_feature (412)..(412): n is a, c, g, or t
agggcggtttctggtcagtaacaaccaaaatgcttcggaatttgctggctttttgtcagattgggcagagggcgataagccctgctttccgcaggcctttttaaaataaagttccggagaagcnaaaactgnttcaggaggatgatgaaattcccctgtatttaaagggtgggggagctgatgccctcctgtataaagcccccntnattttttcagttggtgggacagcntatnccatatatnagctggntgtgggttccttttccnaaaagcaggngnggcttcngtnatnccnnccatcgnttgggtcagtttnnttcagctntttatgggccngtnatttnataaaaaacccagcttttttttgggggtcnatntttnttnncttgtngtaactgccccccataaancngttttttccctga

SEQ ID NO: 577661 - DNA, 416 bp, Homo sapiens
agcgggttccgttgctggtgaggagctgcgttctattggagaagaggcgctctgattttagaattttcggcttaatctgctttgctgcaggtctgttggagtttgctggaggtccactccagaccctgtttgcctgggtatcaccagcggaggctgcagaacatttaatattgcggaatggcagatgttagctgcctgatcgtatcttctggaagcttcgtctcagaggggcacccggctgtatgagggactcaggatgcttccacaaatattagaaggagaagaggagccagtgtctgtagatatcatggtgagagaggaaagaaagggaggaaagaggtgcaagagtataaacaacaaaccagtagatctataagaacatatgagtgaaaactgataaaattccaaagagaatg

SEQ ID NO: 577662 - DNA, 1072 bp, Homo sapiens
aaacatggcaggatcgaggcagggtggtaatcggacgaggatgcaccacggcctcggaagaaggggcggaaatctccctgccatggcgatgaggcccttctttggcatcgtccccgtctcatggatgagaagggcagcgtcgtggagggcagcaacgtctccggggccctgtgcatctcccaggcctggccgggcatggccaggaccatctatggctgaccaccagcgatttgtggacgcctacttacaaggcctacccaggctattacttcactggagactgcgggcttacccgaactgagggcggctattaccagatcacagtggcggatggatgatgtcatcaacatcagttggcccacggtcttggggaaccgcgaggacttagagaggccactctccggacgcacactgctgtagcagcaagagagttgctgtcgagttggctacccccaactgaatcaagaggagaagctgccttcgccttcggttgtggtgaaaagatagtgggggtgacctcacgatgtggtggtgcacggacacctcaagtccatggatggccaccaagatcgccaaatatggctgtgcctgatgagatcctgggtggtgaaactgtcttccaaaaaaccaggtctgggaaggtcatgcggccggctcctgaggaagatcatcacctagtgaggcccaggagcctgggagacaactaccaccttggagggaccccagctatcatcgcaggagatctgagtgtctaccagaaagtgcaggacaagcaggctgtgctaagttgagcttgcaccttgtggggcgtcttggatgggaggggcaccaagcctgggttgtcttccagatgtaccctggggttgggttacctacgtcagaagaggcccaaccaaagatagcacacgcctagttaactggtaggcctttccaaacatgagccaggggaccctgtaggtgaaggaggggaacacaggatgctgaaagtagacatctcccttgcacaaggagcgaaccgcaaaagtaagtaacggtcactgaagatatatttacgcgaggaacaaaagtaggg

SEQ ID NO: 577663 - DNA, 235 bp, Homo sapiens
gtgcatagactcattagagcgctctgtccttggagtgagtctgaatgtatccttagtcatgcttgtagactataacttttatcctccagatcttaagcatactgtcgctctcgtcaacaatttaagagactattaagctgtcatcttcctaaaatctattaaggtatccactcttattaaaaaaattctccaacattgtgattttttaatgattaaagtaatcatcttcgtttag

SEQ ID NO: 577664 - DNA, 101 bp, Homo sapiens
ccggcctgacagctcctgagtagctggaattacagacatgtgccaccacgcctagatattttttttttttcctgtaaagacgggattctctccatgtttgg

SEQ ID NO: 577665 - DNA, 188 bp, Homo sapiens
gttgatgcagattgaagcggttcatccgtgcctcagcctcgcgaggtggctgggaggtggcgcgtgccaccagtgcccggctaagttgatgtattttatcgtggagacggggttttaccagtgttggccaggccgtgtcttgaactcctgtacctcggtgatctgcccgctcttggcctcccaaatgt

SEQ ID NO: 577666 - DNA, 845 bp, Homo sapiens
  misc_feature (55)..(55): n is a, c, g, or t
  misc_feature (66)..(66): n is a, c, g, or t
  misc_feature (95)..(95): n is a, c, g, or t
  misc_feature (120)..(121): n is a, c, g, or t
  misc_feature (123)..(123): n is a, c, g, or t
  misc_feature (192)..(192): n is a, c, g, or t
  misc_feature (244)..(245): n is a, c, g, or t
  misc_feature (252)..(252): n is a, c, g, or t
  misc_feature (255)..(255): n is a, c, g, or t
  misc_feature (296)..(296): n is a, c, g, or t
  misc_feature (302)..(302): n is a, c, g, or t
  misc_feature (323)..(323): n is a, c, g, or t
  misc_feature (328)..(328): n is a, c, g, or t
  misc_feature (356)..(356): n is a, c, g, or t
  misc_feature (565)..(565): n is a, c, g, or t
  misc_feature (642)..(642): n is a, c, g, or t
  misc_feature (647)..(647): n is a, c, g, or t
  misc_feature (656)..(656): n is a, c, g, or t
  misc_feature (671)..(671): n is a, c, g, or t
  misc_feature (764)..(764): n is a, c, g, or t
  misc_feature (766)..(766): n is a, c, g, or t
  misc_feature (827)..(827): n is a, c, g, or t
aatggtaaaaaaaatcaaagtcaggctactggtaacttgaggcagaactgttgtnaagtaggaggnacaaagccaataaaaacatttccctaatngtgcatggaaaataacaaaaaattnngntacccaagcgtataaaaggtaccaggatcacatgtaattgaataaaatgaaaccaaaaacccaattctnctgcaaaaaaaaaccccctggccatcaaccaggtttgtatctaaatcaatgnnctcattnctncattcccccccactacctacataatccagaatttataaatncttttnaaaagcacctatataattctntcggntccctgaataatgggtggagtaaaactntacagcggtccaccaataatctgtctgggattcatggtttgtaaaaatttgggaattgtgttttcaaaccactttctggaaatgaggataaattttccaagaacctccgggctgaattctcaaaaagtgttgaccaaaatgaggaaacgattaattaactaagaggcttgggaaaatcctaaatggtttagaggattaacaactggganagaaggatcaccagtggggacactataccccaggttaccacaggactctatataagatgttttataatgcaggagtnaacancagtcactnaatggcaggggatancgcttctcaacaagaaagggaccacattcacaggaccaggcagggaaaggtgccaaaatcattcagactttatttctttctcaatagtttttnanatttattgaaaatatggaaaatacttttctccagggagtataaaggagttaagcagaaganacaagttattttgttgat

SEQ ID NO: 577667 - DNA, 133 bp, Homo sapiens
ctcgaggccaagaattcttcatttggtaatgtagtataatccacaccagccattaaaattccaccctcaggtttcaagggcactatcccaaggaggtcatggttctcctttgccccatcgaggggtgtttcat

SEQ ID NO: 577668 - DNA, 553 bp, Homo sapiens
cccagacaatgactaatcaaagtaacctcaaaacagatgataaccatacactactattaaggacgaacactgatctcttatactagtatccttaatcattcttattgcaactaactaacctcctcggactcctgcctcactcatttacgaccaaccacccaactatctataaacctagcacatggccatccccttatgagcgggtcgcattgattataggctttcgctctgagatgttgaaatgccctagcccacttcggaccccacaaggcaaacctacaccccttatccccatactagtgattactcgtgaccatcagcctactcactcaaccaatagccctggccgtacgcctagccgcctcacattactgcaggccacctactcactgcacctaattctggaagcgccaccctagcaacttatcaaccattaccttccctctacacttatcatcttcacaattctaattctactgactatcctaaattcgctgtcgcctaatccaagcgaagatacccttcagaacctacctccaacactttttttttc

SEQ ID NO: 577669 - DNA, 837 bp, Homo sapiens
actccccctgtcttcctcagcgcctcctgttcgacagccaagaccactcagccttcagagatggaggaggaagaggcaggacgacttggaaaaaaaggcgggcaggacagttggccagagggatggagactggtggggacgcccccgcctccctgtcgccccgtttcacacactgtgacagcccatcagcctcttttgtgaactgccagaccctgggggtccccagtgatgcatagagatgcaggaaggacacagatgcatcagaaaatatgtgttgccctcaaccaggcaatgaagccggtgaaggctgggttgaggaagaaatcaggaatgtgagaagagtcgatcagtcgctcaccgcctgcccatgtgtgaagcgtccgcgcgattatccatcgaccagtgaccctgtggaaggctccgcgccttactcagtcaagtctctaccacacccttactctgtgtcagcggtggtactaggcgtctgaggaggagtccaatacctatcctcgtgaaagagtcgtggaattctagccctggattgtccaaacataacttataggtccttctctacctaggaacagtttccagtatactctttgttcgcctcagctctgtggcccaagctgcagtgccgtggtgccagtcgtagcctcatgtgggcggctcatactcccagaccccgggatcctcttaagctctcaggagctgggcttcggtgctgctcacacccgtggtgttcgttctgcgggacggagtctgtactgccggcggggactttgtgtagggggttacttctggcctatttccggaccgggttcggattaatggtgggcc

SEQ ID NO: 577670 - DNA, 292 bp, Homo sapiens
cgtggtggcgggcacctgtagtcccagctgctcgggaggctgaggtgggagtagcgggggactgcacgcagggggttgctatcaagtggtgctgcttcacttgctgtatcagccaaggtcatggtagtgctcaaggaggatcaagaaatgcggtagttcatcaaaagtattagccaccttccaactccaagtttcccccacgccatgccaccgttcctgccttgtacaagtgaagcaagcaatctctccgtggtttcgaccctaggaggtggaaggtccctggccctggctc

SEQ ID NO: 577671 - DNA, 320 bp, Homo sapiens
gctgagcatcttccaagtcctgagattcccacaactctggataaaaaggggctaaagtattatgcacatttcactccctttaatatgagggaagtaaagttacattgaggtcctatttgtctgtagttcagagattagtccattacagacccttagaccaactagggaacactaagctagcatttcaagttacctatatgcctgggctcatcagaatatagaaactagccatgtgctagctgatagccattcaatgaggctttctattaatttccttttaaaagcaatggttattattgaaactcctaaatgctaaaatc

SEQ ID NO: 577672 - DNA, 316 bp, Homo sapiens
  misc_feature (308)..(308): n is a, c, g, or t
ttttttccataccacttcacgattttggtgcaaggacctgagattttcttctttatattctgtgatgtttcccatctgctctcacagcaggagcatgaagcccagttggtacaaagcgactggagacagaagacagcccttggggagtcttcagatgagtttatataagcttcctggtagcctgacatgaatacccttttgtaacataggtggatgtggcaggctgggtttgactagagagttggatctatcttaagtccctggctcatttcacttgttgctcttgcgggataccaccacaaggaatncctggaaa

SEQ ID NO: 577673 - DNA, 141 bp, Homo sapiens
gactctagacgatgcttatgacggtgttctggaaatatttcttgattgtattttggagatagagttttgctcttgtccactcaggcggaagtgcagggggggaatctgggctcacggcaaccctccacctttggggttcaa

SEQ ID NO: 577674 - DNA, 392 bp, Homo sapiens
cagataagagaagcttccagaaggctttttttcctctgcatctgttgaagctcatatgcttcagcttaaaagcttaaaataatctttataacaattcagggcttcttttttttttttttttttttggggggcaattttgcctttttaggaaaaaccggatttcctttggttggcctggggggttttgaacccccgcccctaggggaatcgccttccttggtttcccaaaggggtgggattaccgggggggaccctttggccggccaaataaaaatttttgaagggggcctttccagtggaaaaagggaacttttggctttaatccaaaataaaaattattgtttgggtttggcccaagggtgttgcttaggaatctgggaaaaggggcaaat

SEQ ID NO: 577675 - DNA, 709 bp, Homo sapiens
ccacgctgggggcagctggcctccgtcttcgcccacgcaccagcagccgcctccatgccctaggctgggcccctgggggatctgagggcctgttgcccccagggcaagttcccagatcctatgactgtctgttcaccacgagatgggaagaggacaaaatgcggaacgatgccttctgacctaccagcctcgcaaaggtgccagatctatgggatgactcacgggtgctgcaccccaattctaaagtacattgacacctaatgcaagctctacggcaaagacctaacgtactgagctcctagtgtgtatacaagatagcctagaaccacacccagaacggagccactgttagcccgtacgagcacatgacgaacatgattccaaacttggcttattgaaattcaaattcagcgatttttccactcctgacttaggacacacattcaatgggtggaatttacaactacgtcactgagcaaacctcgcatcttatctacataatccccttgtagaagacctcaataccgcattagcaccttacacagagaccatttctatagcccttacacaactatcctccaaattgagaaagcttactatagcttgaaattttaggaattatcactcattcttgagccacaactatattcaaccatcaacgtttcgtcataacctttaacctaaagcatataccctgttggtagctcgt

SEQ ID NO: 577676 - DNA, 528 bp, Homo sapiens
agcgtggaggtgcgccggccgagaaccagagcgcaggcgtggctcagtcctggcgccgggccggccccgccccggggcgcctggagcccgccccattgtcaatgccgccgactttcacaccacgatgatcatgcgcgcataggggaggtgcactcatccggagcaggagccgacatatcggtacgagaacacagagacagcacagacagctcactgtcgagaaggaagcccggagagcaggaatcggcatgcccgatgcatatccagaacaccagagccatgacagaagcagacacggagaattgataccgacatgtagatagccaccggacatcaaagagcacccgccatgaaaaagcaacccacgcccggcgctggatgaagaagcagggcaccataccggggaaccacccgaggggaaccacccgagagccgaggagtatgccccgacccaaaggacggacgagacacatcggtgaagggcagagcatgaagaggactcacaccgaggttcaggtcggtgctccc

SEQ ID NO: 577677 - DNA, 862 bp, Homo sapiens
aaggagctcagtccttcaggcggaggagctgctcccaggtggacgactggtgtatcaggcgcctctacccactggccagagatagtgaggagctctcgactgagcgctgtgttgacccgcagcagtctccggaacgggagtctcgctcagtgcactccaacctcatacgtgcacagaactcttcgcgacaggtatgagacagtgcgtcgcgacgcttccctgtgcgtgtccaaccgcgtgagtactcatctcaagagtattggtgtgaggagatgctgcccaatttgcgaggcttgtgggagttagactgggctgagggccctgaagtccgggccggaggagcagcactcgggacacaagcacagccctgtccctgccctagcctttagcccctgtacccactcacgtggcttctcagcagggcatgacatggaactgtactgcgtagctcacccacaacttactggcttccatttgtcttcactcaacgctcagggtgggggagtgcgtgctggacaaatcacaggagagagcgtgacgttcccagctatttattcctggctgcccttggctataaggtcacagctcctgtacacccttgtcaggcagcacctttcccatgcccctgattcaaggccatggcggaggtaccaggctcacggctgataggtagccgcagacgaagccacagctccacacttgtccaggaagaactcattactcaaacaactgtccctatatgctgagttgcactgcctatttcttgcagggacccatgacctggaatcacggggcctacctactgaccacttttaccaaggccatagtaataccaccggtgcacgggatcagcttgagaccc

SEQ ID NO: 577678 - DNA, 324 bp, Homo sapiens
caacagctaaagggctaattcaaaagaaaaaacacaagaagaaatggccatttcttttccttgttcactcaatgttccttcaacaaattattctatgtgcttggaatatatgaggccctgggttgggtgtggtatgcaacagaaaaataaaacataagaacatagtatgtctcttcccacagggtcatatggtctttcgaaagtcacccttttaatttgaaaccttttgctgcttctttatttttattttttaatttaatttttttgagacagagtcttgctctgtcacccaggctagaatgcagtgacgcaatctcggctcac

SEQ ID NO: 577679 - DNA, 116 bp, Homo sapiens
ctccagctggcccccaagctccatggccccaagctcacactgccacaacatgctgcatgccagtgtgatgtgtggagaaaagaaaagaacgcaggcagaaaccaaatgacgaaacc

SEQ ID NO: 577680 - DNA, 494 bp, Homo sapiens
cccctcaatcaatctcagtggttgaactacccttgatatggttcagctctgtatccccaaccaaatctcatgtccaattgcaattcccagtgttgagggagggacctggtgggagatgattggctcatggcggctgacgtcccccttgctggtctcgtgatagtgagtgagcgctcatgggatctggttgtttagaagcatgcagcacctcctgcttcactctctctgtctctcctgctccaccatggccagaaacgtgcctgcttccccttcgccttctgccgtgattgtcagtttcttgagggctccccagccatgcttcctgtacagcctgcaaaactgtgagtcaattaaacctcttttcttcataaattccccagtttccagtagttcctcatagcagtgtggaaacagactaatggacccttctggttgaaggaatgtagccattctgcttgtttaagtatttcctttctattcagctctactgtccc

SEQ ID NO: 577681 - DNA, 793 bp, Homo sapiens
ccctggggggcccctttttttggggagttactcccctattggcccaggcctggctcccccgcaggggggttattttcgcccccgggggatttcctcccacagaggggggaatcttctctgcccccccccgagaaggagagtgttgttggttgatgggcccgcgtcgcccctcgttgggacgccgcctctgttgtcggcgatcccgcgacatccctcctctccccgcgtgagaatcccccgcgggatattttcttctatgctcccaccgcggtgctctttttattatttggggcccaggaggtttctctatttaccccacggtttggggaccctccccccgtagggggcgttggggcccttcttgtaggggagttgtttggggaccctgttttctcttgtctctccactagttttatctctgagccgtctttttattctctattgtgaagaacaactttcttccccccggactggctccccgccgaggagccactcgcccaactcccctggcgtcaccccccggcccaatgtgaaagaggtttcccgctaaccactttgcccaaatgtgaaaagtcaaattaatatatgagatgttcactggcccccctgcaccccccccacacttgtttaaaattgttttgtgaaccactatggtaagattacccccagtatggttattatgttaaatttattatttttataataataaataaaaaatgttgagtgaattataaacccactaattataattattaaaaaagggcccccccaccttttaaatttttaaaaaaaa

SEQ ID NO: 577682 - DNA, 103 bp, Homo sapiens
ctaagctacgaataccggcgagaacatctttttgagtcacgagttcttggtgcatcgacggcgacctacttcctgcctagcgcgatgctgcgagaacacatcg

SEQ ID NO: 577683 - DNA, 982 bp, Homo sapiens
  misc_feature (485)..(485): n is a, c, g, or t
  misc_feature (531)..(531): n is a, c, g, or t
  misc_feature (602)..(602): n is a, c, g, or t
  misc_feature (613)..(613): n is a, c, g, or t
  misc_feature (617)..(617): n is a, c, g, or t
  misc_feature (626)..(626): n is a, c, g, or t
  misc_feature (654)..(654): n is a, c, g, or t
  misc_feature (657)..(657): n is a, c, g, or t
  misc_feature (660)..(662): n is a, c, g, or t
  misc_feature (666)..(667): n is a, c, g, or t
  misc_feature (679)..(681): n is a, c, g, or t
  misc_feature (685)..(685): n is a, c, g, or t
  misc_feature (697)..(697): n is a, c, g, or t
  misc_feature (700)..(700): n is a, c, g, or t
  misc_feature (713)..(713): n is a, c, g, or t
  misc_feature (743)..(743): n is a, c, g, or t
  misc_feature (749)..(749): n is a, c, g, or t
  misc_feature (761)..(761): n is a, c, g, or t
  misc_feature (763)..(763): n is a, c, g, or t
  misc_feature (768)..(768): n is a, c, g, or t
  misc_feature (915)..(915): n is a, c, g, or t
  misc_feature (925)..(925): n is a, c, g, or t
  misc_feature (927)..(928): n is a, c, g, or t
ctggagggataagccagattttggatttagtaaaggggacacattaccaggtagcctgtcaaaaatactttgagatgatacacaatgtggatgattgtggcttttctttgaatcatcctaatcagttcttttgtgagagccaacgtattctaaatggtggtaaagacataaagaaggaacctatccaaccagaaactcctcaacccaaaccaagtgtccagaaaaccaaggatgcatcatctgctctggcctctttaaattcctctctggaaatggatatggaaggactagaagattactttagtgaagattcttaggcagttttataaccctttttcctcaatagcctgttccctgtttttaagattttgcctttgttgttgaaaaagggtttcactctgtcaccaaggcttagtgcagtgacacaattacagctgattgcagccttgacctccccagcccaagtgacccccctacctcagccncccaagtagttaggaccacaggtgtgcacctcatatccagataatntttttcaatttttttttgtagaggtggggggtccccctatgttgcccaggcagatcccagacccctgggcncaagcgacccncacnccccagcgncccagagtgctgggattacggttgtganccnccnnncccnncctttttttttnnnttancctttttgtttnacntctctcttcactncatcccaacccatctacaggcatgcacacntcaccnggaaaggaggtncnaggtnacaacagagactctcactatattctgctttgacagaaggaaagaggaggagtttctattaaaatctgtcacttgagtgatgtcatttaagtcctattttaggagataaaaacagctttggggactggttaaagtcccccagaaactncaataaagancnncttttgttttaactcttaatcactttgtaattttgactcaatccttttctggac

SEQ ID NO: 577684 - DNA, 153 bp, Homo sapiens
ccccagagaagcctgaggagagaaagaattggcagcaagatggcagatcacagaataccagggaacacctagttccaagaccctgtttgtacatgatggggaaatgtgatgacctgtgagtaggtgaagtgtctgtgccaaaattacatatgt

SEQ ID NO: 577685 - DNA, 257 bp, Homo sapiens
accgaggtaggtgaattgtctgagcaacctggcaaagctccgtctctactaaaaatacaaaaaattagctgggcatactggcgtgtgcctgtcgtcccagctactcgggaggctgaggcaggagaattgcttaagcccgggaagcagaggctgcagtgagctgagatcataccacttcactccagcctgggtaacagagagagacttttgtctccaaaaccagttaaacaaataaacaaaccctaacaacttaaaaa

SEQ ID NO: 577686 - DNA, 142 bp, Homo sapiens
tagtaaatgcgcaagatggtcatgcactgtgtttgcatagttcgatgagcagtggaatgacagagcgtgtacaataagcaatctagaatacaacaggcatgctcgcagatgcttgattcggaggtcagctatttccaggtga

SEQ ID NO: 577687 - DNA, 427 bp, Homo sapiens
actggtaaggcaactgcttgctgtgggtgccacaatgattaccaagtttcttcttaagtaaaagacacttgtttgatcaagactcaagtgagttttctttcccaattttgttcttttgaagcagaaggaaataccttggtctttgatatatataaggaggcaaatatgaaatacagctggtataatctttctaaatcacaagggcaatgaattattcattttctttgaaaatattcaggcctttgaaataattcattttttaaaaataacaagggcttctggaataatttctcaaaaactaggctttccatttttagtacacgatttgggtaaaccattaccacattaaaattaggtattttaggcatttttctttttacccaactaaccactttggcccctccattaaaggggtttagaaggtatg

SEQ ID NO: 577688 - DNA, 188 bp, Homo sapiens
aaacatttctaaaaagccctctgatttgacaaatatagagtcattaatggcccaagatagggcctcacaccttcacaggtgccaaaggaaaggccttcacacctcacagaggcatcatgcaaaggacagcggctttgtcttttccattttccatctttaggcctcgtgagagcacacttatgccctaa

SEQ ID NO: 577689 - DNA, 408 bp, Homo sapiens
  misc_feature (118)..(118): n is a, c, g, or t
  misc_feature (164)..(164): n is a, c, g, or t
  misc_feature (187)..(187): n is a, c, g, or t
  misc_feature (240)..(240): n is a, c, g, or t
  misc_feature (258)..(258): n is a, c, g, or t
  misc_feature (314)..(314): n is a, c, g, or t
  misc_feature (320)..(320): n is a, c, g, or t
  misc_feature (346)..(346): n is a, c, g, or t
  misc_feature (369)..(369): n is a, c, g, or t
  misc_feature (395)..(395): n is a, c, g, or t
gcaagggcaggtcgctggccagagcagccaggcagggtcctagagcttcccaaagtaggcagctgtgctgaggctggagaggggagccgggggagcccgcaaggaccaggttgggctngcagtcccaaaactgagaaggagaagggcagctcctggcgaaactngccaggcgaggccaaggcacggnctcaggagcaggagtctgtgcagcccccaggcccagcaaggccacagagcttnccccagggcaaggggccncagccgccggagccgcaacaagcaggagaagccagcctcctcctttggacgatgtnttcctncccaaggacattggacggggttgagnttgttgagatttacccagagttngaattatttttaagagtttttttttngttttttcaaagc

SEQ ID NO: 577690 - DNA, 162 bp, Homo sapiens
tgactgctgcaggtcgtctctacgacggactcccctgtgggttccgcgggactcacccacggacggacgtcttcacgctgacgaccacgacacccttgtggtcatcgcgtgcactgtccccccacgacacgtgggtcccttacttacttccacggcacggac

SEQ ID NO: 577691 - DNA, 351 bp, Homo sapiens
gagagagagagagagagagagattgccccacacataggggcccttgggctgcacctttaggtgccccgtctccgcatgtgctccactgttatactgcatttccctttgatttctatcttctatgcctccttaatcctttactgaacttcctatcatttacactcattccccctttctcgggtctaatccttcctacagtccccatccatcttgctttctgcccctctatattacattcccgctattatgacctctctacccctattttccaattctgcttcattaccgcttgatctttctgtctccccctattcagtatatttatccctcacccttcgcaccccccgccct

SEQ ID NO: 577692 - DNA, 279 bp, Homo sapiens
  misc_feature (136)..(136): n is a, c, g, or t
  misc_feature (279)..(279): n is a, c, g, or t
gaaaaggaggcaaatataaagaagaaattaaacttctgtcttacaaactgaaagaggctgagacccatgtctgaatttgcagagagaacggttgcaaaactggaaaagacaattaatgacccggagagaaaacttncccaggccacagaagagaacgtggggcttacatataaacacatgggtctcacactaaacgcgctctaactctatatatgcgaaacacaggagtcttttttccacagagactctggggcgccccggggctctctcttctctttn

SEQ ID NO: 577693 - DNA, 336 bp, Homo sapiens
cacttccagagtagcgcatcttcatcaactgaggaaaattcatttcctctttcacttcccaatcactaccaacttcaactgaagagtctcggggcttctgtgatttctgatcccatttctgcctaaccccaaattggttctggaacttttctgcagtcgaatgccttctctctctttctggttggcactcttaagcaagatctgcagggtgaactgcaacatgttccgaccatctttgtctctgcggagggtcctctgggcaaatctcattcgactccgctggtaggccgtcttctgtgtgcgcgctgtatccaccaactggaagctactttcatc

SEQ ID NO: 577694 - DNA, 1439 bp, Homo sapiens
  misc_feature (773)..(773): n is a, c, g, or t
  misc_feature (775)..(775): n is a, c, g, or t
tgatgtcgcatgcgtgcgtgtctctctgtgatgttagctactacgtgctttggttgtctctgtcctcttcttccttgtgggggcgcgtggatggaggctgattttgctccacggtggtggacgacccaccctgtggttgctccctataggaccgccggggctcgtcaccccccggggttttttactttgccccggggggcggatcatcattctcacgcccggggccctggttgcccctgtggccctttttttggcgcccacttgataggcacagggtctgccaccaagaaaaccgcggggttggctcgctcgtctccgggattctccccccgggagtttcgcttgtgaccccacggcgcgccccgccagaccccgctgggtgatgtccgccgtcgcccccagaggggttgggccgccggcgtttgtgtccaaagcgaaccattgtggaggagtctcaacaggcgccccccttcgaggaggaaggaattctctattctctcgtgtcgtccccctcgcgcgcgtactatttgaaggggaattcccaggagagattctccttgtgattttcctttccccgtggggggggcacctcttttctcccacaagagattgaacggtttttcttggaaagaattttatgcccccaagtgcgcccaagaaaagcccaagaccctccgtggccccgggctctcagccgcccaccccagaggtttctaaagagcccatattttgtttggccttattcccggggggacaatccacacaatagggcncncacacgtcgggttcttgtggctgttaaagatggctcctccaaaggagaggtggccccacaccgccacatcccactggggacacaatcaatcactgggccacaagcgtcttcccacatcggtgcccaccgtgcgcgcacagagagagcgtatacatgggggggagaacacaagagatctgcgcacaagcgcccaccacacctggtggccctctgccacaaggttgaccacggccgctcttcggcttctgttgcctggtgacgccctccacttccctcgcacacccacggggcacctcgggcacttcgttcttccgccaccctcgtgcctaaagaaagctggcttcactgatggcctggtaatcgagtgagctgcgtacacctcaagcccggggctgcacctgccacacccctgggcaaacttctgccacaaggccacccctttgaatgccacatttttaaagagcctatcaagctatcctgaccccccgacctctggaaggagactgtattccacccagtcttccctatccaggagttctactgacccacctctgtccagacacccaccacccagagtcttcccgtgcagccggactccaggctcccagctgtggcgtaccacatagggtttttataccagaaaaataaagtgaattaagcgtga

SEQ ID NO: 577695 - DNA, 617 bp, Homo sapiens
gtttcttttagcagtttcataattgaggtcttagatttaagtctttaatccatttttacttgattttgtatatggcaaaagatacgggtctgtttcattcttctgcatacaggtatctagtttttccagcaccattttttgaagagactgtccttttcccaatgtatgttcttggcacctttgttgaaaatgagctcactgtaatatatggatttgtttctgagttctctattgtgtttcattggtctatgtgtgtttttttttttttttaaaggccagtaccaggatgtttgggttactatagggcttgggtaggtgtaattggaagtcacataagggttgatccttccagtttgggtgggtattggcttaggtccttttctcttttacttttcttttcttatttattttttttggaaagcggctctctctgttgttgtgcccagggcggagttgcaggggccaaattctcagctcaggggaaccttcaaccctcccggggtcaggcaatccgggggccatcaagcctccggagtaagggggataacggggtggggtgccccagaggccacagacaaattgggagatcacaagcagagaagggggtcacacatatg

SEQ ID NO: 577696 - DNA, 111 bp, Homo sapiens
aggcagtcagcttggctggggacctgagcatcagctcccatttagaatcagactatctcccttccctgcagatgtctacaactaccaaattgctccccaacagttagctca

SEQ ID NO: 577697 - DNA, 142 bp, Homo sapiens
  misc_feature (4)..(4): n is a, c, g, or t
aagntggggggggggggggggtaaggagggggtgggttttttttaatgttttggtttttttttggccggaacggcccggtggggggttttttggaaacttccctctgggtggattaggaaattaaaatttttgaacctggga

SEQ ID NO: 577698 - DNA, 241 bp, Homo sapiens
gtcaggggaggaaggtaattatatcatggggcagtttcccccatgctgttttcatgaaagtgagtgagttttcaggagatttgatggttttataagtgttggaagttcctccttcattcactttttttttccggcccccttgtgaaaaaggtttttgtttccccttttgccatgaaagcaagtttcttgaggcctccccagccatgtggaactgtgagctaattaaaccttttttttacat

SEQ ID NO: 577699 - DNA, 430 bp, Homo sapiens
gactgggaaagcactttcagcgaattccatgacgctgatgagcaaaactctcatggctactgcttcgaaatccttgaccgtcgcgcctgattttcaggctgacgcgtaaagcaaaaaggcacctttcaggggtgccttttgacttttgtcccgcccaaaaactacaacgctttcggcagctcagattgctctttttctttatgacggttcgacggctgggtgaaataggttttatcttcccagcgcagcatcgttaaatccccgccccagcaacaaccggtgtccagggcgtagatgccttccggtgcgccttttccttccagcgatgcccagtgaccaaacgcaatgctgtaacctgcttcctgcaccggacccggaatatcaaaccagggtttgaggggtcttggtgcgttctcgggcacatctttgc

SEQ ID NO: 577700 - DNA, 237 bp, Homo sapiens
aatggctgttgccataagcgggctccgggttgatagtgttgaccagcttccgtgcttgctgaactgcatgaggctctcacgcaggttgtttgagcgtgcctccaccaggagcttctgtccttatagtagttcagcaggtggttccagagcgggtgctttgataagtgccttcgggtttgccccaatgattacgccataccttgctctggtcaggggccccgttcaagacggcctggg

SEQ ID NO: 577701 - DNA, 427 bp, Homo sapiens
tgagactgtacatacccaataacagctgtcttgtgccagttctgtggagacaccacgcggatgcagcttaccctatgctgtatctgtcagctgacgtaaacaaatatctttctgtattaagcttccctgtggaagacaaacactgtgtagtgtcacccactgctcacgtcagtctataatgtgacctacagacatcactatactgtaatatcatctgcaatacactgtgcaacatctgcctgtcttcacacacacattggcacactccatgcagggcacagtcacagactcaagtcacgaggcaaagttattctgtgcatactttcatctccattcatgctttttttatattacggcattgttcctctccaggtaaggcttacaccgggacatgatcgtgcttaattcactcaaaggaaaccaagac

SEQ ID NO: 577702 - DNA, 110 bp, Homo sapiens
ccctgcgcatggcttatcttgatcctaatattcatctgtgtttcttaagccggtagcattttaaagttggagtaggccgggtggggtggctcaggcctgtaattccagca

SEQ ID NO: 577703 - DNA, 296 bp, Homo sapiens
  misc_feature (2)..(3): n is a, c, g, or t
  misc_feature (69)..(69): n is a, c, g, or t
  misc_feature (289)..(289): n is a, c, g, or t
anncgggcgtggtggtgtgcatctttagtcccagcaacttgggaggctgaggcaggagaatcgcttgantccgggaggcagaggctgcagtgagccgagatcacgctattgcactccagcctgggtaacagagcaagactagatgaggtcttgctgtgttgcccagaactcttgggttcaagcaagccacctcaactggctaatacatatggctggtctcgaacttttgacgacctcagatgatccactcacgtcagcctcccaaagtgctgggattataggcctgagncaccacg

SEQ ID NO: 577704 - DNA, 111 bp, Homo sapiens
aaagtcattggtgacttgaagctagacagtcatcctcagacgtgtgagaccttgtccaggtagatgatgagggtgctcctatcggagaaggctttgtccagctcatacttg

SEQ ID NO: 577705 - DNA, 204 bp, Homo sapiens
  misc_feature (56)..(56): n is a, c, g, or t
  misc_feature (58)..(58): n is a, c, g, or t
  misc_feature (99)..(99): n is a, c, g, or t
  misc_feature (140)..(140): n is a, c, g, or t
  misc_feature (173)..(173): n is a, c, g, or t
tagtatatctcaaggttgactacttgatatcattaagtatttaaatcacaaaccantncatgtaattctatgctaaaaatccctaaatgccttcccatngtatatgaacaaaacagaaaaccctaatacttaaaggcttntctgaaagcttattctctaccagtctccatgtnccagtggaactgaagacaaggtagagccgag

SEQ ID NO: 577706 - DNA, 145 bp, Homo sapiens
ttatctcgcggtcacacggttcaagtcggcagacgcactggacgcatcgggactttagcgcgatggagtcgcctcttttttcagcgcacgcataaactcgtctaacgcgtcgattttgtcggggtccgggcaaaaaaacggattt

SEQ ID NO: 577707 - DNA, 416 bp, Homo sapiens
cggcaaaaaaaaagaaaaaaagaagttttccccggccccttaaaagggaaggaggaaaccggggggggccccccaaaaaaaaaaaaacaaaaccttggttgggaaaccccccccccccccccgggaaaggggggggttccctttccttaaaaaaacccaccgggggggaaaagaaaaaaaaaaaattttggccccgccaaaaataaaacagagggggggccccgtggacaaaacaaaaaagagggggggttcccccccccgggggggtaaaaaccccccccccccaaggggggggttttattttccgtcccccaaaacccctttttttttttttaaaaaccaggggggcaaggggagctttcccaaaaaaagccttttttttttttctaggctccccccacagaagtggtcgccgc

SEQ ID NO: 577708 - DNA, 391 bp, Homo sapiens
aacattgaccagacaactcaagaggctgttttaaagacaaatatatgcaaacaactgccaaatttgtatctccacccctgagctttttccatatatccttttggatgtcttaacatgtccaagactgaacctatatattttccctcatacttgttccatctgtagttttcctcatctctgttgatcagccctctaatcttccagtgtttcaggtcaaaagacttggagtcatcaaactctacatccagactctctaggcatcatgctaaagcatcttcaaaataatctgatcactacttaccatggccaccattcacttcctggtcccaggatcccaccatctcttgcctagataatgtcaatcacttcctaatagggcttctgcttcaac

SEQ ID NO: 577709 - DNA, 466 bp, Homo sapiens
  misc_feature (1)..(1): n is a, c, g, or t
  misc_feature (438)..(438): n is a, c, g, or t
  misc_feature (465)..(465): n is a, c, g, or t
ngtgagtgaggggtgtgtgtgttgtgtgtgttactgtatacgtctgtatgaagtgtgtgagggataggtgtctcactctgttgcccaggctggagtgcagtggtgcaatcacagctcactgcagccttgacttcctggcctcaggcgattctcccacctcgccctcctagtagctaggactacaggctaatttttttgtagagatagggtttcaccacattcagcccaggctggttctccaattcctgggctcaagtgattcacctgccctgacctcccaaagtgctgggattacaggcatgaaccaccatacccagcctctttctgtatttctatatttttaaaatttagttttagtggccttgcctttgtgatcctgtattttgggccactgggtgttcattttgtttctattatcgttcttcagccacatttccnacattgggttagctggtcaagcacagng

SEQ ID NO: 577710 - DNA, 268 bp, Homo sapiens
  misc_feature (8)..(8): n is a, c, g, or t
  misc_feature (188)..(188): n is a, c, g, or t
ggccccgnaaccagcaggaattgggagaaccacagcaaagacgccaggactccctggaagcctagaaatggccagaaaaactgggaaaaacacaggcacaaccacaaacaggaagaaagacaaaaaaaacaacaagggccaaaaacattggcattactgggaccactgacattaagggatgtggccanagaattctctctggaggagtggcaatgcctggacacttcacagcagaatttgtaaaggaaagagaagaaagaaaaccaca

SEQ ID NO: 577711 - DNA, 178 bp, Homo sapiens
ataccggtaccaagtgctactccacaaacagccatatccacacaccacacacatccatatcacacatccatatcatgcaccacacacatcatatccacacacatccatttccacgcacatccatatccacacatcacacacattccactggctatacactgtttgtggaggtagcact

SEQ ID NO: 577712 - DNA, 489 bp, Homo sapiens
  misc_feature (449)..(449): n is a, c, g, or t
acttgaataagataacttctgagaataaatctatgcactattttggaagaattgctctatagagtaaaaaataattctggataattgaaagttatcttgtgagtatctggacattaaggatacatttcaagactcctgttttcactaaaatccaatatttgtttaagcacttcaagttaaagaggagcaccttcccctttcaccctgactatcgttgttaattcgtttttgaagctatataagaacgtttctttaatcggttttcccttaggcatacattagctctctgttcaagacttagtagcagagagtagtaagtaaatggttattagtggttcttcatataaaacacatttgagtttcttagaagaaaactatgcataaagattactttcagatatcatgtctgtagttcgttaatagagaagtttctctgaacgtgtggaacnctgtaataagataaataaatttttaaaaagaaaaaaaaaa

SEQ ID NO: 577713 - DNA, 149 bp, Homo sapiens
aagcttgtgagtatgtgtgcagcgcggtgggcattgtatcatgttgtgccacgttgccttccccagttaaaatactgctggatagaggctatctagactttggcaaatgtcaatcagctaaaggaaatgtgctctggatccagtaatct

SEQ ID NO: 577714 - DNA, 395 bp, Homo sapiens
tagagtgcacacgagtgaaagcaatagacaggcaaaaaactaacaaaaaattttgtatttaataaatttgatagttggccaattggacctaatagacatctatagaatactccacccaacaactacagaatatgcattcttctcatctgcacatgatatatattccaagattgaacacatagtcataaagcaagtcttaatacatttcaaaaaatcagaatcataccaagcatcttctcagaccacagtggaaaaaaaaacagaaatcaacagcaagaggaattcttaaaaccacacaaatacaggaaactaatcaacttgtttctgaatgactctgaaataaacgaaaaattaaggcagaagtcaaactgttatttgaaacaaactaaaataga

SEQ ID NO: 577715 - DNA, 637 bp, Homo sapiens
gttgtttattatcaagtacaatgtactgtacgtaattgtactatacttttttgtttgttttttgagacggggtctcgctctgtctcccaggctggagtgcagtggcgggatctcggctcactgcaacctccgcctcccgggttcaagcgattctcctgcctcggcctcccgagtagctgggattactggcatgcgccaccatgcccggctaattcttgtgtttttagtggagacggggtttcaccatgttggtcaggctggtccagtactcctgacctcgtgatccgcccgcctcgccctcccaaagtgctggggattacagtcgtgagccacagtgcctggcctgtactatccttttttttttttttttttcccctgaggacagaggttgcggctctcgtaacccagggctgggattgcggggggcgcgacctctttctcattgcggcctcgcgccctccggggtccacaggtgatactttcggccgtcagccctccgtgagttacgcgtgggaattacagagtgtgtgacgccagtggcccagcctgtgtactgaatacttggggatgacttggaacacagaagttttggttggcaggtgcagggggttggttaacaccaagtattcacctagaa

SEQ ID NO: 577716 - DNA, 148 bp, Homo sapiens
aaggtctgagtgatgttctaaagaaaaatggttttacttaaaatctactctgctgaaaaggtggaacctatggaggggagcaggacgaacttactggaatttctggacagctgagcatcactgctggactttatgaccttgtagctgg

SEQ ID NO: 577717 - DNA, 855 bp, Homo sapiens
tagtggaccaagccacccaccttgactataccaaggtaatgatctatccacagttctagccttaacttcatgctgactatctcatgcactctgatacgtcaatctgtatgtcccaaataatcttaagcgtgcagcttgtggcatttaccatgcaacctccttctgccagcaggtcacacatgcgttgaatgtcagtatgaaccacatgaggcacatcatggaattgatgtgagcattaagacgttctcccacaagagcccttccctgaggcagcaggagcgtggtgtgtactggagacactgttgaacgttgatcaagacccagaccagcccaggtctccttcgtgggatgtcatgacgtttgacataccttgggaacgagcctcctccttggaagatggaagaccgtgttcgtggccgatcctggtctcatccttggcgctgtttcttaacgatgcggagtcacatttcaatggtacgaagaagtggcttcgtaaaatagaagagcagtcactgtggaattagccaaactgggagatgctcggtgcgcattggggtgctttgggcataaaagatgaatgagccaaactattctctgggaccaggattctaggccagtttgttccactgaagctatgcccaacaggaagtccacctctgcaggctggaggcgaaatggttgccaagggtctgttgggaagatcacactgggatcgatgggtgagaaagctatgaagcgggcaaattgtctaaggggaagtggtccttccggggggccaacgtgtgtgaccctttaaaaagggcctctggtgaaaggaccgcggtatcttgccaaaaagccaaagttcagtgggac

SEQ ID NO: 577718 - DNA, 454 bp, Homo sapiens
tgtcatagttgattcctagagtatcaccttatgttctgacccacactgttggatgggactgtaaactaattcaatcattgtggaagacagtgtggcgattcctcaaggatctataactagaattaccatttgagcccagccatcccattattgggtatatatccaaaggattatgaatcatgatgctttaaagacacatgcacacatgtttattgcggcactattcacaatagcaaagacttggaaccaacccaaatgtccatcaatgatagactggattaagaaaatgtggcacatatacaccatgggatactatgcagccataaaaatggatgagttcatgtcctttgtagggacacggatgaaggtggaaaccatcattctgagcaaacgatcgcaaatacagtaaaacagacaccacatgttctcactcataggtgggtcagaacataag

SEQ ID NO: 577719 - DNA, 314 bp, Homo sapiens
  misc_feature (56)..(56): n is a, c, g, or t
agtcggttctaccatttacagaataactccaaatagcttagggatcgcaatatatnttttaaatgaaatgataaagcactgtactagaaacaaaacatggtgaacttgtctttaacttttgatgtagaaaaaaagctcaactgtgattgtgccactgcactccagcctgggggactgagcaagagaccctggctcaaacaaacaaaaaacaccaggcatggtggctcatgcctgttaatccagcactttttcaaaacaaacatttacaattttatgtaaaggcatcatgttccatgatcttatgataggaagat

SEQ ID NO: 577720 - DNA, 140 bp, Homo sapiens
agcggagcctagtagtagttcagtaagcggagcggcacgcctgctgggggtatgttgtgttggaggcgaggaggtgggatagaatgacggcaggagcagcagcggagtgtccaaccaacacctactgctccgcttactga

SEQ ID NO: 577721 - DNA, 332 bp, Homo sapiens
cctatcctgtacgccaaggatggcttccacgttcccatgatccccgactacctgtcgccacagcagcagggggatctgggcctgggcaccccagaccaaaagccctaccaggacctggagagccgcacccagcagccttcgactaacccctctgtctactattaaggacatttgacaatcagtcgggcatcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccg

SEQ ID NO: 577722 - DNA, 188 bp, Homo sapiens
attgagagcctgaaggaggagctggcctagctgaagaagaaccacgaggaggagattaatgccctgagaggccaggtggggtggagatgtcaatgtggagatggacgctgcacctggcgtgtacctgagccgcattctgaacgagatgcgtgactcgtggaaatgtccaccggcatatggcataaaga

SEQ ID NO: 577723 - DNA, 525 bp, Homo sapiens
cgggcggaggtgcgccggtggtgtggtccgcgggtgaggggttgggagcgggtgggatgtgggggggggggcgagcgcgggggggaggcgcatggggggaggcgtggggggatggtgccgggtgtggggtggggtgggggggggggggggggggtggagcgggggtagagatagacggcgcgggggggtggcgggccgtgggaggcgtgcacgggggggcgggtgtgggttgaggtgggcatcgcggggaggcgcgggtggtcgggggaggggcgggggtgggggtggctgggtgggctggggggggcgctggggtgtggcgcggggtgcgggaaggcggtgggtgggaggtgggggtggggcgcgggtggagggggtgggcagggtgtgctcgggggggggggagcctcagctggggggggcgccgcggctcggggcgcaaaaactgctgtgctgtcgtctctcgtgctctcgtctggggtctctctaactcggcgcgtagagttctcgcggagcgcgggggct

SEQ ID NO: 577724 - DNA, 965 bp, Homo sapiens
cgtggtggcaggcgcctgtagtcccagctgcgcaggaggctgaggcaggagaatgacatgaacccgggaggaggagcttgcagcgagtcgagatcacaccactgtactccagcctgggcgacagagcgagactccgtctcaaaaaaacaaaaaaagaaaaaaagaaatctcccagggcttacgacttcctctaaaaggtctggcatttaactcagcccattcttgggagccttaacaagatttatccaaagagaaggtttcccattggcggccactcttgcataacttagcaggcactgttccacacgtgtgtggcgccctcagggcacgcccaagaaggcaccggtaatgactcgacacagaacacaatcttgcgttggggctctcacttattccctgcccgggggttccctaaaagtaggtcctcctttcccatcaaacctccatggccacccccattcgcctacacaaaagttcacctttccatggccgggctggccgtcgtggcctcaccgccttgtaatcccaagcactttgggaagggccgctggccggcagcgcttcacctttaggtcaggaggtcacagaccccgcctggacatgagggtgaacaccccatttctaattaaaaataccacagaattagccggggcacctgcgtggccagtgcccttgtaatccccgacccttggggaaggtgcagcgggacaattgcttgaacccggaaggttgaagggttgcaggacgccgagcatcgaccccatggtacccagaccgggcaaccgacgttggactcctccgagaacagcgaacacccacacacaacttgctgcgccgtccgcccgacgaaggtctaaaactataggggcgggccaatcgtgcacacggccagacgcacgaaacacggacagctaggggtcccccacaacccggaccggggtgaaccgggcgcacgcaggaggcac

SEQ ID NO: 577725 - DNA, 423 bp, Homo sapiens
  misc_feature (14)..(14): n is a, c, g, or t
  misc_feature (25)..(25): n is a, c, g, or t
  misc_feature (240)..(240): n is a, c, g, or t
ctaaacacctttcnaaaaaccacangactttgcccattgccagtgtcctgaatgtcctgtaaccccggctcctttgggaggccctaggccgagaagatcacttgggcgcaggagttggaaaccagcccgggtaacgtccagaggcgttcaaacccagagtgaccccatcttgaataaagccctgggtaaaatgaacctgacaccctattggactctattccccaggaggttaaggcattnctaagcccacaggatgaaataggaggtcagtacaagacacaggtcacaaagaccttgctgataaaacaacatgtagtaaagaagctggccaaaacccagcaaaaccgagaatgagagtgacctctgatcgtcctcactgctcattatgagaggtgaagccagctggacttatagcttttctat

SEQ ID NO: 577726 - DNA, 280 bp, Homo sapiens
  misc_feature (9)..(9): n is a, c, g, or t
  misc_feature (55)..(55): n is a, c, g, or t
  misc_feature (57)..(57): n is a, c, g, or t
  misc_feature (78)..(78): n is a, c, g, or t
  misc_feature (104)..(104): n is a, c, g, or t
  misc_feature (171)..(171): n is a, c, g, or t
ccggccccntcgaaccggctgcgagagacgacagaagggtggctgaggctggcanancagagatcaggaggggaccantctggccaacacagcgaaaccccgtntccaccaaaaatacaaaaattagttgggtgtggtggcacatgcccgtaatccagctactcgggaagnccgaggcgggagaatcacccgaacccgggagatgaaggttgctgtgggccaaggtcgcgccactgcactccagcctgggtaacagagtgacagagggagactctgtcgc

SEQ ID NO: 577727 - DNA, 778 bp, Homo sapiens
gtttgttgtttgtttgtttttctgagatgagtttcgctcttgttgcccaggctggagtgcgatggcgtgatcttggctcactgcaacctccgcctcccgggttcaagcagttctcttgcctcagcctcccgagtagctgggattactggtgtgtgccaccacacctggctagtttttttttttcttggtattttcagtagagacagggtttgggccatgtgggccagggtggtctcgagctcctgacctcaggtgatccatctgcctcggcctcccaaagtgctgagattacagacgtgagccaccacacccagcccaaagtgttttttaaagacggagtcttggctgggtgcagtggcacacgcttgtaatcccagcacttggggaggccaaggtgggtggatcacttgaggtcgggagttcgagaccagcctgaccaaggtggagaagccccgtttctactgaaaatacaaagattagctgggcatgggtggtgcatgcctgtaatctcagctactggggaggctgaggcaggagaatcacttgaactcagggaggtggaggttggtggtgagccgagatggtgccatgggccctccagtcggggcaaacaggagcgagaatctgtctcgaaaaaacaaaaaaaaaaacaaaaaagggagaccgggggcataaggcggggggggaaaaaaggtaaaaacgggcccggcgtaggggccgcaccccttctggtcaaaggggggaacccggccccaaaaggggaaaatcaaaccggggg

SEQ ID NO: 577728 - DNA, 361 bp, Homo sapiens
attatacatgtattagcttttggtgtcatcttcaaggatgaaagctcaactaaggaaatgccggcttaaatttcatggcaataaattgtagttagcctgtgctgtacttcgaggacccaattttgtcattataatcaattctgtacgtatgattttctttccctggtgtgaattattgtacaagaaacagatttgttttttggttttagggttgtttaagtagctgagataatgcgcttcagcaaaatcaggattaaatttcaacaaattgtttaattccttctgcaaggaagctggagtgagggccttagtctcatcattctttagcaaagaagcctgttgagaaagaaaaaattctgct

SEQ ID NO: 577729 - DNA, 946 bp, Homo sapiens
ggcgcagcctcttcagctagcaggcgagaaatggagtgagtcaaggtagctatctagggaagaaatgctagccatatagcagcgtttcttgcaaagacttatcctactcttatgatatcccagggacagagagtattctagtagaagtcccaactagacgacaaatacccactagggtgtagagagggtattcctagggatcaggtacagagccaactagcagaagtgagtagtgactaaggaggctataagaataggagtataacataaaggtactataacaaacaggcaagtctacctatacagactatagctaagacataacttaagcccgaggtagttacccacctatatacgtaaaacctttaggttacacatccaaataatagtacacagccaccccacaccctttcacgtttggcacaacgaggaaacacaaacgcccaagaattaggttacgcacaggaatcgtggatgaccactaacacacacccaaagcggcaaacacaactgcaggaaacctggcggtcagatgctggttttcccaactgaggccgtcagccaccagcaagaaggaactcttatgcagaccggaatagcgtttcccttaggcgggcttaccacagttaaacgcgtgcggaaacggctttaccacagcttatgggttactcgcccaattgcacatacgaccgcccgctctgtaatatggtggtgccgacaacgggcagggctctaatcaccaaaaaaaacggaggagggccccccctaccacataaccagagcgcaagatcccaaaacaaccaacccagaaaccaaaacagacaccagcactaacacacaacggacggactaacacggggcaaatatcataagagggagaggattaccctatcacgaccttaatacacagaacacacaacgaaccaccataccaaaacacacgggg

SEQ ID NO: 577730 - DNA, 302 bp, Homo sapiens
acaattcggcccgggcaatggcatctcggctcactgcaacgtctgtctcctgggttcaagcaattcccagcctcagcctcctcagtagctaggattacaggcatgcgccaccacgcccggctaattttgtatttgtcgcagagacggggtttctccacgttggtcaggctggtctccaactcctgacctcaggtgatccacccatcttggcctcccaaagtgctaggattaaaggcgtgtgccaccgcgcccggcacacaactcttgtttctgtaatatattattgtatataggacgtgtct

SEQ ID NO: 577731 - DNA, 318 bp, Homo sapiens
  misc_feature (24)..(24): n is a, c, g, or t
tttttttttgagacagagagtacncctgtcacccaggagacggatctcactctgtcacccaggagacggagtctcactctgtcacccaggctggagtgcagtggcacaatcttggttcactacaacctttgccgcccactttcaagcgattctcctgcctcagcctcctgagtagctgggattacacgcgcctgccaccgcgcatggctaatttttgtattcatagtagagacagggtttcaccatcttggccaggctggtcttgaactcctgacctcgtgatgcacctgcctcggcctcccaaagggctggtcgacg

SEQ ID NO: 577732 - DNA, 256 bp, Homo sapiens
gtcgaccatcatctttgtccatccctatctagtgctttaaaacacacacatacaggccaggcatggtggctcatgctgtaatcccagcactctggaaggccaaggcaggcggatcacctgaggtcaggagttcaagaccagacaggccaatgtggcaaaaccctgtctctactaaaaatacaaaaaaatgagctgggtgtggtgtacctgtagtcccagctagttgggaggctgaggcagaagaatcacgtcgacg

SEQ ID NO: 577733 - DNA, 172 bp, Homo sapiens
atggagaagactgtgtggatccaccagaagatggccatctacaagccaaggacagagacctggaacagatgctttcattatggcctccagaggaaaccaaccctgtctccaccttgatattgcacttccaggctccagaactgtgaggcaataaatttctcttggttaaatc

SEQ ID NO: 577734 - DNA, 109 bp, Homo sapiens
ggtggatctagcaggacacccacgctgcacgtatcaaagtcgagccgaaaaatatggcatccccatatagcagccgatgcaatttctgcgaaaaagagcaatatgaaca

SEQ ID NO: 577735 - DNA, 784 bp, Homo sapiens
  misc_feature (18)..(18): n is a, c, g, or t
  misc_feature (79)..(80): n is a, c, g, or t
gcctatggtggagaaganaacttcggttcgctcccaggaccccgggcagcggcgggtgctggaccgggctgcccgcagnntcgcatcaaccggtcagctggaggccctggagaatgacaagcttccaggatgacccccagcgcgggactcccttcagtctcgggcaagaagactgcctcagttttgatgacgtatgcggacactggaaatgaaagagaagaaaacccgaggctgatcaattttaaacattcgcttccgaaaaaatcgtttcagagccctgtgtgggccgtgagccagaactgtgagtcgttggccgacgtggccctgaacttatcctcgtacggcctggtgccgggtagcccgctatccgcaggctccctagctgcgccctttctcggtgcttgtctcgtgtgcttcaccgatcctcccttacacgctggtgtcacgcttgcgggtgcctcggtagctgcagcatgtgcagcatgatcatgagtggacaccgaacagggagaccaaggtgatctagatagtgcgactgtgtgaggcacctgggcgattcgccaagagaggacagggccagcttgtgcatctgctccggacttcagataagacagaatttcatctagccaaatgcagaggggagctcttcctggaccaagggaggacgccgctcattcacccagactaaagactgtgtcgttatctgccaggaaagaccagcctcactcctgggaactgtctggcaggtaggctgggccccccagtgctgttagcaatacaaaag

SEQ ID NO: 577736 - DNA, 200 bp, Homo sapiens
agtataatgtagctgaatgcatttgggagttgtctgccaaaagtataaaatggctagggacagatttgatgagacagatagcaagtaaagaaaaggaatgtcttattagtgggctgggcgcggtggctcacgcctgaatcccagcacttcaggaggccgaggcgggtggatcacctgaggtcatgagctcaagaccaagc

SEQ ID NO: 577737 - DNA, 126 bp, Homo sapiens
  misc_feature (125)..(126): n is a, c, g, or t
ctcgtacgaattcggcacgagggaggtacttagtagaagctggccctcggggcccactcggatcagtgcaccccacagtctgggtaccagagtaaaggttttagcccaaattgcgccctattagnn

SEQ ID NO: 577738 - DNA, 383 bp, Homo sapiens
acaggggaagtttcgacatcagggttggcacagttgagcaccacagggcaaatgtaggcattccagatcattgcagtcgcactcatcattactcaatttagcttcatcacatcagtaacactcatcccttgagcattttacattctcacattgttatgatagtcaagaaacagaaatgtttgtctgttcgtttttgtttagggtcttgctcagttacctaggctagagtgtattagtgccatcatgactcactgcaacctcaacctccagggcccaagcgccctccaccacacctggctcatttctgtacctcttgcagaagacggggctccaccatgttgcccaggattgtctcaaactcctgggctcaagcaatccacctg

SEQ ID NO: 577739 - DNA, 1009 bp, Homo sapiens
ggtcccataggcgtggctgagacacacgcctggtgtagcagtgacagacggtgggaggaagtgagcagggtaacctggcatctgtcgcaaaggaggggcccagagatagtgccgcactccttcccctagggcagctcagttcaacgggggcaggaagctcggggtctcgtggagtgccgggcagtagcacatcatctcgcactccaggcctcggggtgaggagatgggatctgcctcccgtccctctgtccctggtagggcacctggtgggccggtgcactctgggtgctgtgggagccgctgcgtggggtgcatggtgctggtcacaggtgcagtgtctggacctctgcgtcggaccctgggtggcacgagtcggcttcacttcgcgcaggatgtaaccctataaaaccttgacacaacgtggttaagatatagaaagtcacagtgtggataccattgatctgcgccttgcttccatggcgtagagggacgattggcgggtcggctggtgaggtttgcaatcatcatcacgcgtgtgacaaggttccccttctgggtcatcctaggcaggatcggaggaggtaccgagggataccaagggcccactcaaacattgggggggggaaacattctgggggttcgtggcaatggcatttgagggccacttgacaattcctgcggatccgtcggtgtatgtcccatttcatcaccgttagctaatgatgctttgagggcctgcagatgcaagcctacaagtaaacgctggacgttccactggtgggtttcccggtgcccaacgaagggtcgataaagtgtgtcaaccaagtaggtgtccctgagattgagtcctcctcttggagatccgcgaacaaggggttcatcatggatctagtggagcattgccatgtatccccacgccggagaggtgaccatggatgtttgtacactctacaatccaacatttcacaccttggcaggttcacccaaaggggtgtgtaaccaagcctcc

SEQ ID NO: 577740 - DNA, 817 bp, Homo sapiens
  misc_feature (1)..(1): n is a, c, g, or t
nccccttctccctctctttttcttcttttgttctcgttttgcatgaaaaaagtgaataaatagtagatgagaataggagtgattgcgatggggcgggggaggaagcccagcaagaagttgtccaggtggcttctcgacacactattcggggacttttctgggcctctcaaaaagatggccacccccgcgcgctttttttaatcctcccgagttggtgcgcacccctgtgctaaagatttcttgcccgggaaaaattttattactgcctcgcctttttccacaggaggtggtgtgtttgaacaacccgccggcgggtataattttgctcgcccacggcgcgtctctgttcagaagtgccagattgtcccccgtggtttcgtcgcccgcacaagaaagcgcgctgttttattttggaaaaccaaagttgctgctcttcttcctatacaacgtagtccacaagttttgaatttcttgtggggggggacacagcaccacatttggagaggttgtagatttctctaaattgtgtcccatggagggtgcgcccaaatatagtacacacctgagatgcctggagataagggtgtccttgttgtggtgttaatggtctccacgacgcctctctttggagagagattgttgcgcaatctctccgaaaaaccacgtttaatccgagaaagggtgtaacatatgtaaagggttttatatgggaaatattcccgtccaaaaatttttaaagggtataaatgcgaactctttgtttaataatgggaacaacttgttaaaataaagtgaaattttctatccccaacaatat

SEQ ID NO: 577741 - DNA, 1595 bp, Homo sapiens
  misc_feature (1294)..(1294): n is a, c, g, or t
  misc_feature (1595)..(1595): n is a, c, g, or t
tttctccgtgcgaggggctttatattcccgggtccaacacacacacacacaccggggacacgggggccttggtgccgaggagcggggcagagacaccccacaccaggacacacacacgggggacagtggggggggggcaggcccagaggagaacagggcttcttcagccagagggtgtgtgccctggggctccctgtgggtgggtcccgggggggggtctcgaggggacagaggccgggcggggggtgtgggggccaccgtgagagcacaccgcggggggacacacgagggcgcccgaggccccaggggcccgagggcgcgcggccgcggccgggagaggcacaaacacatcagcgggagtggccacggggaagaggctctcgcggagcggtggcgccacacaggtgtggggtgtggtgtgagagggcgctgtgtacacaaatcaaagaggcgctctctgcgagagaggggtgtgtgtgagagcactcaagaggagagaaacaacgggcaccggaaagaagaaaaaacacgaacaacacgcggcacacgacgagccgcgagacacaaaacaccacaggtctctccgcgagagcgctgagaggcaccctgagagagtggtgagactctgcagggagcgctctcaggggcgaccacactagggggactatacacccccacagagagacgcagacagcggagagacacccaatatctacacacaaaaggccctcggggctccaccagagcggaccaccggggggggagccacaagtgcttgcgcggaccaagggggcccactgggcgcagcgacgtcgcctggggggcagcagcagcaagcgacaagaaaagaggaaacaaacacctcacaacacaagatgtgctgatcaccccaggagggcagacacacacatgggggtctaacagagcctcaccaacagggagaaaaaaagaagagcacagaggagaagcgaagcagcccccccccacgatgatgcccaacccaccgtgccagccaaccaacaccaccgagggggcaaacgaccacgacagaacagcacgcccccaacaaggaaagcaaagggccccccccccagagaaaggagaacaacccacgcccagacaagactgcgatcccaccagcgagccactcacacaagacgggaggaaaacaccacaaccacaggagaagaaccccccagcgccaaccgacgagaccccacaaggaggagggcgcaactaggagcccaacaggtgggacccacaaacacaacagagcgagataagacagaacgcngacacacgacgaccacggagcgccccccacacacaaagaaaggcgactgaagagcaactcccacaacacacaccacccacgattcaccacccccgccaggacaaacagcacaacgagccacacaaagtagtcacaccagaggagcgagcacccaccagaagctgagccacttcatcgaaacaccaatggtcgatggcatcgcaggcccccccctcgcaaacacgcacaagcgacgccacgatcatgcgaccagggcacaaacaaacccatgtggcgcaccacacagagggcacaacacagn

SEQ ID NO: 577742 - DNA, 858 bp, Homo sapiens
ccggcgctgtggtcgacgtggcggtttacctgttctgtgtctttgtggtcccgtttggatatagtgtgtcgcttccacggtggttttcggacggttcgtttgtataattgggcgtcgccgttttcccggggctgtttcgctcgccccgtcggctgctgtgttagccgtgctggcgcgacctttgtatcctggtggggcgcagactggatgtcgccgtggtgtgtcctctcatgtatggtccggagcaccccctcaggttctgtgccttctgaaccatcgatgtttatacatatgtgcccttcgcaagtaattttttttaatactactccccgctttgatcaccacccgtgtaaaaagtagttgccctccaataaaaaacaacactacatggattttacccctctaaaataaacttgaggaataataattataggcccccacaacccactataagtagggtatatatgttcagcacacaacacattaatacaacatgatctacattggtgccacaaatgtaaggagaataatacataatcttatgtcgatgaaaaacaggtggattccacatcagatgtcttctagtgcctgcgcgccccccttatgtgtgcacccccgcagtctgatatagcagaaatagtgttagacctatctgacactgcgccctgtatatggatcagaaactagatggattagaaaaagatatcatggcaagaaacagagtggagaataccacacgagaagagcgaccacctgggttggggtaaaacacagccgattccttctacgtgcattgagcttctgttttcccccccaagtatatttctttttaaaaacaagggtggcccccacaaaaca

SEQ ID NO: 577743 - DNA, 935 bp, Homo sapiens
  misc_feature (530)..(530): n is a, c, g, or t
ggttcaatgggatggaaagtcacacccgtaaggatggcacattcgccagtgtgaaccaacgtcatgccttgacggctctggacgtgcactcctaccaccaagctcgtccaaatgacaagcccgtattgtcgccctggctcgtccaggatgatcctacaatgatgtgtggtggctagttggtacatggtgtcccttgtgagggcgtagatggcaacgacgtgggtgattcatcagaaaacctggtatggctgtgatcgacctttttgcgaccaggtctacacgttttacaatactggaatgataaaaatcatgttcgaatattgctaccattgaaaggcatttgagttgaagcttctactctgggggagcatcgtgggcgttcgaatgctcaagaaaatcgtggtcgatgtcagatggatttgtttcggtctgtgggctatcgttgtgcttggtgaccatgcaaaagatgaaacctacacatactggatatgctaagcttggagcttctactttgcatcgatgtgtgattntagtcctttgaatccgatccaaggccaattctaaagtcggccctgcgtttatgcccccttggtaatttgggaatttgccaccaccgggtcatcatagcagtgcaatgtttgcctgagctgagggaaaacgattgattctgccggactggtaaaaaacgctggaaaggatgggggcacgtaaaattctttgaaggtcggggtgatgctgtcattgtgagatagtgggttcctggcaatgcgccatgtgtgttcgagaggcattctcagaactaatccaccgtttgggatcgcttttcggctgattcgtgatattgagacagacagattgcgggtggggtgtcaatcaaagcagtggtacaatgaagggctgctggaactgggcaaggtcaccaaagttcttgccca

SEQ ID NO: 577744 - DNA, 142 bp, Homo sapiens
catcatctacatcgttccttccgcctggttctattagggttgtacggtcagccctgctcattcttcctcctctgtgggtccttcgaggcgtcatgctccgcttttgcgtcgctgggttatggtttaatccccctcccctgcc

SEQ ID NO: 577745 - DNA, 540 bp, Homo sapiens
  misc_feature (83)..(85): n is a, c, g, or t
  misc_feature (126)..(128): n is a, c, g, or t
  misc_feature (330)..(330): n is a, c, g, or t
  misc_feature (332)..(334): n is a, c, g, or t
  misc_feature (336)..(340): n is a, c, g, or t
  misc_feature (343)..(343): n is a, c, g, or t
  misc_feature (350)..(350): n is a, c, g, or t
  misc_feature (352)..(352): n is a, c, g, or t
  misc_feature (358)..(358): n is a, c, g, or t
  misc_feature (363)..(363): n is a, c, g, or t
  misc_feature (377)..(377): n is a, c, g, or t
  misc_feature (379)..(379): n is a, c, g, or t
  misc_feature (388)..(391): n is a, c, g, or t
  misc_feature (393)..(394): n is a, c, g, or t
  misc_feature (399)..(399): n is a, c, g, or t
  misc_feature (402)..(402): n is a, c, g, or t
  misc_feature (414)..(414): n is a, c, g, or t
  misc_feature (416)..(416): n is a, c, g, or t
  misc_feature (461)..(461): n is a, c, g, or t
  misc_feature (465)..(465): n is a, c, g, or t
  misc_feature (469)..(469): n is a, c, g, or t
  misc_feature (524)..(524): n is a, c, g, or t
  misc_feature (532)..(532): n is a, c, g, or t
  misc_feature (538)..(538): n is a, c, g, or t
cgcggctgtggctcagagctgcatggggagacgccgctgcaggtccggtttctcggtgtctggtcggtgccatcattttcctnnncctcccccgtcctccccaagctggccacttcccctcccccnnnccctccccaccgagggggcagggggctgggcacggagtctctatgatgatgccatgtgcggtgtctgtgccgggcggcagggactggggcggcagcgagaggaggcagtggagccaggagagcggtggtgaccgctgaccgcttgcccggctgctcctccgctccctcccgcccacctccttcctttggggctggtactcanannnannnnnaanccctccncncatccnagggncctcccagcctctnangtaaacatnnnntnnaaaantanatggtggatccntnccctcccccatccgcatcctcctcctcctgtaccctcttcctctntgtncctnaaaaagaaatcccctctttgcatctacccatccctcgctggcctgctcctgatcnccttatanaataanaa

SEQ ID NO: 577746 - DNA, 320 bp, Homo sapiens
tcggccggcgttggtgaaatacttattcaagagctcagtcatggcgcagtggctcacgcctgcaatcccagcactttgggaggccgaggcgggtggatcacgaggtcaggagatggagaccatcctgggcaacacggcgaaaccctgtctctactaaaaatacaaaaaaaattagctgggcatggtggtgggcgcctgtagtcccagctactcgggaggctgaggcaggagaatggcgtgaacccaggaggcagagcttgcagtaagtggagatcatgccactgctctccagcctgggtgacagagcaacactccgtctc

SEQ ID NO: 577747 - DNA, 903 bp, Homo sapiens
accgatctccatggcagccctccaaagatgtctctaagggctcctagagagctaagagcgtgaatgcgtgtgatagcactggtcgatgcaatatatacaggcctcctgcatagcatatgggctcctaaccaggacggtagcctgatagcatgaagggcaggcgtatgatatcaggagagagaagtacaatacccacggtcccttgcggaacagcttggtgcagatatgaggctgcgatgtcggtagtagctccttatcaattcatgcgtctaatgagagtgtaattgtctttgcagcagggactgtttggctagtacgtctcattttatcacacgtctcagtctatagccacacctaccgctctcacattaattgaaaggtgacaagctctgcgatgcatggaatcaatgaggtatacactttcctaaagcgtagcatgtcgctctagaagttcattgcagatataatcacggcagttatgtgacgtcctcaagacaactcgtagattgccaaacatacctattcattcgccccatcttccagagtattctacaatgagttgaatagtcaactcgcgtctatgtaccgtatgtgactcgcgtgggccctacataattggttgctcatgccatgagtgagactcaagaaataactcccgaggattcttccacgttggaactaaattacagaaggggttagtacgtcgtggctcaatagtgtcttaaatggttaggcaccacttggactttacacacagagcttttggaccagttggttcaacatgggcttgtattttatgtcgcacaccatgtttgagtgtgcatcctgcgggctaaaagaatttaggttttgttcccaaaatttcggttcttgcgtatgggaaagcagcattgtagaaactgg

SEQ ID NO: 577748 - DNA, 664 bp, Homo sapiens
  misc_feature (187)..(187): n is a, c, g, or t
agttctcacccctgaatgtggtcctagtcttcccccgggtttgaatgctcgtttggaaggacactctgtctcccttctgggtgggctatactctgttcaaccgccacgaatggttttgggccacacttgagaccacggcacactgagtgaccctggcacgggggcccggtggtgcatggccctggangggaggcccatgacttgacccgccatcatgtgatgcctcttgaggcgttgtgtcttcggctcttgctccagtgtagagactgccagccccttggatagagcgccagatctttgccagccaaatagccccacacatctacgccagtggccacagctagagaaagtctatcgagatcccagagccaaacactggagctcgtgtgccagaagattcgcccctggtttgggccggtccctgcgagaggccccaggccaggtgagaccgaggaggccgagactgtgagcgcccatggccttgctgtcggtgggggccgagcaggcccacggctgcggcagcccgggaacacagccccaggccggcagaggagcccactggagcaggagcctgccctgtgacgccccggcccccatccctttgggcttcacccttgtgattttgtttattttttctattaaaaaccaaaagtcacacattcca

SEQ ID NO: 577749 - DNA, 224 bp, Homo sapiens
cgtcgtgcccattcctgaagctatggcgtacgtactgttacgtccgctgcttgatgatgtgccggaggatgaactgtgcgcgtagcgcccggaagagtattgccggtatcagagcaatggcatccactgttgattgaggcgttaaccagcattccaaaactcgaagccggagctccgtctggtggcactgcgacgtcatccattccgttgcccccgttgaaaat

SEQ ID NO: 577750 - DNA, 197 bp, Homo sapiens
agaatttcatgtggctacacttgtggtgtaatttgcagagaggcctcacgagcatcttccaatacagcagttctacacgaactttgttgggtcaatgattcctttttccaccatatgcaccagatctcgagtgcatagcatcataatcgcaagcgtctgaggaacgaggcattattttctcagatatcacgatgatc

SEQ ID NO: 577751 - DNA, 1162 bp, Homo sapiens
  misc_feature (224)..(224): n is a, c, g, or t
  misc_feature (226)..(227): n is a, c, g, or t
  misc_feature (230)..(232): n is a, c, g, or t
  misc_feature (241)..(241): n is a, c, g, or t
  misc_feature (369)..(369): n is a, c, g, or t
  misc_feature (462)..(462): n is a, c, g, or t
  misc_feature (572)..(572): n is a, c, g, or t
  misc_feature (807)..(807): n is a, c, g, or t
  misc_feature (983)..(983): n is a, c, g, or t
  misc_feature (1076)..(1076): n is a, c, g, or t
  misc_feature (1091)..(1091): n is a, c, g, or t
  misc_feature (1160)..(1160): n is a, c, g, or t
gcgcagccggcgctgagcttgcagtggccgctcccctcacccgcccccttcgagtccccgggcttcctgccccacccggcccgtgggggagtatctgtcctgccagcttcgcccacgccctgactccgggaccgtccctgcgcgctcttgggcgcaccaatggcccgcggggctgcgctggcgcatggtgctcttcgagcctgctgggtgtactggtcggccgncnncgnnntggtggttncgatttatctgatgcccttcctgacaatgaaaacaagaaacccactgcaatccccaagaaacccagtgctggggatgactttgacttaggagatgctgttgttgatggagaaaacgacgacccacgancaccgaacccacccaaaccgatgccaaatccaaaccccaaccaccctagttcctccggtagcttttcagatgctgaccttgcggatggcgttncaggtggagaaggaaaaggaggcagtgatggtggaggcagccacaggaaagaacggggaagaggccgacgccccaggcgtgatccccgggattgtgggggctgtcgtggntcgccgtggcatggagccatatctagcttcattgcttaccagaaaaagaacgctatgcttcaaagaaaatgcagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgnctgagagcagagatggaggccttctgttcacggcggattctttgtttcaatcttgcgatgtgctttgcttgttgccgggcggatgatgttgactaacgatgaatgtttacatccaaagggggataggcacttggacccccattctccaaggcccgggggggcggtttcccatgggntgtgaaaggctggccattattaagtccctgtcactcaaatgtcaaccccaccgaggcacccccccgtcccccagaatcttggctgtttaccantcccctgtccctcgngcacgtctgaaacccctgcgtagcccccacttctttttaattaaaataaggtaagcccttcaatttgtntc

SEQ ID NO: 577752 - DNA, 329 bp, Homo sapiens
  misc_feature (16)..(16): n is a, c, g, or t
  misc_feature (61)..(61): n is a, c, g, or t
  misc_feature (67)..(67): n is a, c, g, or t
  misc_feature (96)..(96): n is a, c, g, or t
  misc_feature (101)..(101): n is a, c, g, or t
aggatttttgggctgnttccagcttggggccctcatccctgccctggcaggcctttttacnccgatntgcatttagtggggggtcagcgtgagcancagcnccgtgagtttttaggccaaaaaccttttcccctttaaaaaccttcctgggggagggtgagtgggccaggcctggagccccgtacccaccctttatacccaggggaatgggtcccaagggcccaaataacgccccccactttttggggttcccccgcgtccttagacatttgggaactgcctctgcctgggccaaagcttttcccttaaaacttttttgctgtgcttta

SEQ ID NO: 577753 - DNA, 455 bp, Homo sapiens
tgttgcaatgagctgagattgcgtgccattgcactccagcctgggtaacaagagagaaactccgtctcaaaaaaaaaaaaaatggaaaagaaaaaaaggaaatggtattacagggtgaatctagacaaatcctactttccaaagtttcaaaaattttatctgtcaatttactaccattggagctccctaattagaattaagtataatattctcttaatatttatactcttactagtgcctttgtatatttatggagcacaaatttaagtagtaaactctagcttcacagagggccatggatatatacggtggtgcactggccccagcttgtgccagctgaggagagtcaatagtgtgcttctcttcccaattctgcttcaaatttgccatttaaaagacacatggtaaactccagagaatcatgtacatagctagaaatctgcatcaaggtccgg

SEQ ID NO: 577754 - DNA, 133 bp, Homo sapiens
  misc_feature (39)..(39): n is a, c, g, or t
ggtacccactctagtcaggtgacagagtgagactctgtntccacaaaaaaaaagaaaaagtattgggaaagtattgggactcaaactatgtggggttgggaaaggagtggggatttaatttaaattggctatg

SEQ ID NO: 577755 - DNA, 442 bp, Homo sapiens
  misc_feature (224)..(224): n is a, c, g, or t
  misc_feature (226)..(227): n is a, c, g, or t
  misc_feature (230)..(232): n is a, c, g, or t
  misc_feature (241)..(241): n is a, c, g, or t
gcgcagccggcgctgagcttgcagtggccgctcccctcacccgcccccttcgagtccccgggcttcctgccccacccggcccgtgggggagtatctgtcctgccagcttcgcccacgccctgactccgggaccgtccctgcgcgctcttgggcgcaccaatggcccgcggggctgcgctggcgcatggtgctcttcgagcctgctgggtgtactggtcggccgncnncgnnntggtggttncgatttatctgatgcccttcctgacaatgaaaacaagaaacccactgcaatccccaagaaacccagtgctggggatgactttgacttaggagatgctgttgttgatggagaaaacgacgacgacgacgacgacgacgacgacgacgacgacgacgacgacgacgacgacgacgacgacgacgacgacgacgacgacgacga

SEQ ID NO: 577756 - DNA, 2024 bp, Homo sapiens
  misc_feature (1763)..(1763): n is a, c, g, or t
  misc_feature (1828)..(1828): n is a, c, g, or t
  misc_feature (2024)..(2024): n is a, c, g, or t
atttaccctatagcaccccctctaccccctctagagccaaaaaaaaaaaaaaaaaaaaaaaaaaaaaaaaaaaaaaaaaaaaaaaaaaaaaaaaaaaaaaaaggggggcgcgcgcggcgagcaaactaatctctctccccaaggaggggcgcacaaactaaagcagcgcggcccaacgattttttatgggaacagaagagggcgcgcaccacaaaaaagagagagcgagagccgtatatatatacacaacagacaagcacgccgcggggcgcgccgccgaccaacaaaaacaggcgcgactacttcgggggcaaccacccgcgcggacagccgaggaacaatattagggagaagcgacgcacacactaccctcgcgggggcggaggcgagaacaaaaagaacggagcgcgagcacacaaacaaccacaccaaacacaagagaatacaataaaagacaacgccccgagcgagagcggcacaaacatataaaagacactccataccccgcaaggccgtataccccgcccggtggggcacaacaaacacacgccaggatcaaaaatcagcccgccgaaacagccagaccgacccacatatttcgcgtggcacaacaaaagcgccgtcgcactagtcctatataaataaaaaacaccactatatctctatacacaccacggagagagggaccccattcacgtcctacaacactcacaccgcccgacacacaccaacgcagacaccgacacacacccaccccaaaccgccacacacgaacaccaccactacaaccacaaacaaaccaaccagcggcacggagaaggacgcagaccagacagcagacgacgaacgagcacacacgaaagagacagcagacgagaacaccaagagcagacaagcgacgagcagacgaggcgaggggccaatacccggcaacgaaaggcgagacagcggcagaaggagaaggactcagacgacgggacacacaacgacagacaaacacaatcacacgagatacgaaacgaagaacgaccaacagacgcagcagagcccgccgacgcaactacgcccagaacgcaccagggaacgcacaggggcgggaggaaccaagaaacacgagcgcagacaacaagcgcgaagcgcgagaggcgacagagccagacacgcgagcgacaaaccacagaaacacaacactaggagcacacaccaagaagaacagacgagaaagaacgaacagagcgcacggcgagagacaggacagtgtacagaagaaggcgaacagaaagcgagaaaacacgacaaacgaccgacgcaactgagacagagccgcgcggaaaggcagcgcagacgacaggacgagaaagcacggcactcagtacaaggagacacagcactgagagacaaacaaagaccgtacaagagaccacgacgaacacatgcgacaggacagcacaacagagcacagcgacagcgagagagagtacgcacgcaagcggacggcaggcacacacaggagcgagcagcagagaggcaggcaagaacgcacagagaacgacgacaaccacaggaacacgagaacgacgacgagccaccacgacgagcgaccgacgagcgagcgagacaaagcagagcagcgaagagaacgcagacagagaagcggacagaacgcagcagacgacgcgcacgcagcagcgcgcgaagccacgacgagaacaggatgacgagcagacgagcgacgtgcacgagagacaggctcagcagcgcgngacgccgagagcgaatgagggtagcgagaagggacggagagctcgcagcagagacgacgaccggnacgcgcacgccggcaccagcgtcgagcagcagacagtcacgcgcccgaccagacgagcgacgacgccaagcagcgagacgagcgagacgagaacgaagcgaggcgaacgacgcagcgaggcgagacgtgagcaccgaacgagagcaggtagtcgaggcgagcgcgaggcatggacacagaggcgatcgatgagagn

SEQ ID NO: 577757 - DNA, 583 bp, Homo sapiens
actgtctagaaagatagaacaggaaggccaggcgcactgcttagtgtactaaaatgagtgttggtgtgtgtacactgctaacgtcaccctcacagggatggccacggcgactgttattcgccaggctggttttctagacctgttacctggaagcatggtgagcaccatttctggacgctcaggccgtgtcgggcttcagtcatctccagcacacaggtacagcagcgctttctggtagtcgcccttagctgtcttgctggatattatagtacagggacttgccgtactttctcttgaattcagacctaattttcaacatgtccacttcactgcgggagaccatgattctgatcaggaccttatctcgcgtccccttggccttcatggagtcatacagccgatcagcaaaatacaggggcttgttctgaatgcactgaaccaggttcaggaaagcattttccaggtctcctttaacctctttcctgatgctttccaacatgtcataagggctgtaactcttgtacctatcaaatactttctggaggtggggacgctccgctcggtcatgatgctgatccacttg

SEQ ID NO: 577758 - DNA, 424 bp, Homo sapiens
  misc_feature (51)..(51): n is a, c, g, or t
  misc_feature (53)..(53): n is a, c, g, or t
  misc_feature (275)..(275): n is a, c, g, or t
  misc_feature (329)..(329): n is a, c, g, or t
  misc_feature (419)..(419): n is a, c, g, or t
actgggcatccatctctcagcacagcctcgcacaagtgccaaagagcagcntntgccaagaacagcaaccctggccacattggcacactgtgctcagactgtagcgaccacagcaaacacaagcagcccatgagcactcgtccaagtccttccaagcacatgccagtgacaccgcggcaagcctgtacccctatgcgtcccaagcacaaggtcccattagcaaggtgtcagtggacagcctgtggttaacacaacaaataaatccacacccatgncctcaaacacaaccccagagccggccccaccccacagtggtgaccaccaccaanggacaagcaagggggcaacacccaggagctaagggggactaagattgcaagccacggactcgtgccagcccaggacccaagggccagtanatgtt

SEQ ID NO: 577759 - DNA, 1763 bp, Homo sapiens
  misc_feature (385)..(385): n is a, c, g, or t
  misc_feature (387)..(387): n is a, c, g, or t
  misc_feature (459)..(459): n is a, c, g, or t
  misc_feature (497)..(497): n is a, c, g, or t
  misc_feature (530)..(530): n is a, c, g, or t
  misc_feature (612)..(612): n is a, c, g, or t
  misc_feature (626)..(626): n is a, c, g, or t
  misc_feature (640)..(640): n is a, c, g, or t
  misc_feature (656)..(656): n is a, c, g, or t
  misc_feature (663)..(663): n is a, c, g, or t
  misc_feature (679)..(679): n is a, c, g, or t
  misc_feature (684)..(684): n is a, c, g, or t
  misc_feature (714)..(714): n is a, c, g, or t
  misc_feature (718)..(718): n is a, c, g, or t
  misc_feature (744)..(744): n is a, c, g, or t
  misc_feature (799)..(799): n is a, c, g, or t
  misc_feature (876)..(876): n is a, c, g, or t
  misc_feature (884)..(884): n is a, c, g, or t
  misc_feature (946)..(946): n is a, c, g, or t
  misc_feature (1102)..(1102): n is a, c, g, or t
  misc_feature (1122)..(1122): n is a, c, g, or t
  misc_feature (1223)..(1223): n is a, c, g, or t
  misc_feature (1245)..(1245): n is a, c, g, or t
  misc_feature (1283)..(1283): n is a, c, g, or t
  misc_feature (1286)..(1286): n is a, c, g, or t
  misc_feature (1309)..(1309): n is a, c, g, or t
  misc_feature (1373)..(1373): n is a, c, g, or t
  misc_feature (1498)..(1498): n is a, c, g, or t
  misc_feature (1556)..(1556): n is a, c, g, or t
  misc_feature (1605)..(1605): n is a, c, g, or t
  misc_feature (1763)..(1763): n is a, c, g, or t
gagccgagttgggatgtgggaggactcgtgtgcggctgtccattcctgaagtatgagttgaatatgctcccgaccctcacttcgacgtgctccactcgattgtcgtggtcacgactgggctgtgtatatgctgctgtgtacacggtaatagacagacctcaggccgcgacactgtatcatctgatgacatcaactgactccgccactacgaggcctctgatgcgatgtcgatgatacacactgcgcgtgtggccctgagtccctgccgtgttctctccgtttggcgtcggcggtgatcctttcgtacgatccttagtgcggcgttgcccgatgagctcctcgaccagaacagtatgcgctggtaatgtctgtagaacaggtaatngngggacgtggagtagatcactttccgcgttcggtcgtactaccagcagcagtagtaagacggtgggatgagtngaagatggtaatcccctgagtatgtggcttacggatgnagactgcgtccagtccggcaaagttaagtcaancagtgcaacggacgactgcagtgcttagttaatgctgtagtttctgtggagcgcgctgttatgtggatcctggtcagccgtntgcgctgcttgtantgtagaaggtgtcnctttccaggtagagcncattagngttctgaccgcaatgngccgnccatatgcgtacatcttcagttgaattggnaccnagactggggacacaaaggaaggagcntccgggaaatcctaggataaaggccgccaacaaagtatggggctgatgtggattnaccacctaatgaacggggatccctcctagaaggaaatagactttgtatcggtccaccgtaccaagtaacgaacaacnggtgatgntccctcggaactgtgaacaacgcattagtgctctgaattggcgttaactatgccaatgttcncactttccaagtgagccaggctgtaatcaaagcgcgtagtgcgtccgaaaatctattgatgggccaaccttaagtccaacttttgaacacccgagttctgtgtacttccgttaggcgggtgtgtcaatgcagaagtctcttgacatgggtcccttntgttgaaagttgaactgtcnccacagccggtgtttctcagtttggacgccacaatctggtgccccatatgaaaagaatgtgaccccttttgcccccctctgaaaggcgcaagtcacatcgnggggccgtgggagggcgcgcgncttggcagtattttagcacgttgaaatttcggaaatcntgngcgtattaaggccaaactcgttnctaatgaggtccaatcaataggcaatgcgattagttgtcacctttcgacgaaatgattgacttncgacaattgaaggatccagatgccaaagggatttggcttagagttcagtatacaacggggtggcctttggacaggaagtgaggtccaacaatgaattgcagtgagacaaatttttgggtcggtgncactcgagtttaataagagagagggaggaaaaaaaaggcctctagaaaagtgattatngggaaagcggaaaagagtaaaggaaatcacaagattagagcggaaaagnaaggaagaaagggagcagaatcaagagaaattatggaacacgagacggtgagtaggagcagtagtttaaaacgcgtgagttggattaaaaatatagtaaaggagcagcaaataatcatcaaaatgtatgagtccactagggcgataggataggtcagn

SEQ ID NO: 577760 - DNA, 229 bp, Homo sapiens
  misc_feature (46)..(46): n is a, c, g, or t
  misc_feature (52)..(52): n is a, c, g, or t
  misc_feature (74)..(74): n is a, c, g, or t
  misc_feature (90)..(90): n is a, c, g, or t
  misc_feature (144)..(144): n is a, c, g, or t
  misc_feature (220)..(220): n is a, c, g, or t
aggagcggaccaaaggcaagaagaagtccaagaagcagcctccagnagcganggaggcagcgggggagccggtncagaatggcgcgccanaggaggagcagctcccgcctgagtccagctactccctcctcgctgaaaattccntatgttaaaatgaccctgtgacatccggggcagtctgcaggaggacagccaggtcacttgtggccatcgtgctggngaacaggag

SEQ ID NO: 577761 - DNA, 461 bp, Homo sapiens
tcgaggtgccggcagaatcaactcaaatacacacacgacacacacaaatacacacacacacacacacacacacacacacacacttcctttctttcctcgcaaaagaaagacagctagagtctagaagcccagaattgcccccgcgttccgaacaccagctcgaattcttatgaagtggacttgtaatatccttagtgtcgctgtagggagtcagttacagattccattattgtcgcatcagtgcagtcgcctatgcgaggtggggggcaggacatggaggaggcaggcagcaagaaaggcagggcatagcagcagcttcctattcacagatttcatcaccctgccttttcttgcaggacatcttcgtaaagggggctgtagaacatagctcaagccaggaaggggacagggggctgcagttcttgcggaggcactgaagggccctgtgaaaccctttctcc

SEQ ID NO: 577762 - DNA, 198 bp, Homo sapiens
taaatgtgtctggaagcgagagtaaaaatacggagtataagttaagcacctggaagagagagatataaagaaaatcaggaagatataagacagtctgtgcacgaagtagtggctggcaaggtcgtgtcatctgaatgtcaaagaggtggaatgaaaatatctaaatagctaccagacggggcagatgctagctgaggt

SEQ ID NO: 577763 - DNA, 803 bp, Homo sapiens
gttgcatggaggcggagtgacgcttctgcttgtagaccgagcctgccggactacaccaaggctgaggagcccatacccatgaagagccttggagccctgctctagctgctgaacgcctgcactggcggagagcagctggccctgtgccaactcctgcccgacaacattcatgtgcaggagaactgaactctcgctgcggatctatgggaagtggtacaacctgtacatcggttgcacctgcccctggctgagaaacatcatggacaggatgactgagaacacgctagcgctgtgagagggcgctacacacgcggaatcatcatgaccagcactcagaggaggagaggcgactgaaaggatagggcttgagcttactagaaagcacattctgataggaagtcactctatcacactgccaaatgggacataaccatggagtcctatgagcgccacaccacctatgatgagtatgccatagctctgacccatatattgagccggaatcatggacccaccattactgacaagctctacaggcggacgctgcagatgacggtaactctacaggacgactacaaattgtgtgcccagagtgtgaacatccctgcggactacattttcaccatgggccgccgaggtgaatgcgtccctgaagagcacgaaccatagcccatcttaacaccgagagtccggaaggctgagcttcccccagatgaggaaggatcacgacgtgagcaactggtaactgtattcaccggagatactctgcagctgggctatcacgccgatcctgcatgtgatgc

SEQ ID NO: 577764 - DNA, 1887 bp, Homo sapiens
  misc_feature (365)..(365): n is a, c, g, or t
  misc_feature (373)..(373): n is a, c, g, or t
  misc_feature (441)..(441): n is a, c, g, or t
  misc_feature (501)..(501): n is a, c, g, or t
  misc_feature (503)..(503): n is a, c, g, or t
  misc_feature (538)..(538): n is a, c, g, or t
  misc_feature (625)..(626): n is a, c, g, or t
  misc_feature (1046)..(1046): n is a, c, g, or t
gagaattattttgagcgattcccgtcgagccccagggatttaatcggggagcgctgaggagacgccgtacttcccccgccgcaggatcggtggaccgtcgggccagctcgtgggcgatgatgcgatatgagcccggcatcatcgcggcgcgccagtgcagtaggcgtgggtcgcgcatgtcgcgtctctcggtacggggccctgctcgcagctgtcctggggtcgagcgcgcggcgtggcgggcgcacctggcagcggacggcgacgcgctggagtcgtgacgcgcgataggtcgggaggtctgcctttgagtagagattgaattgtctctagagacgtcgtggtatggcaaatacctcacgatntcatacanggcatagaagtatgcacatgcatccgatcgactccgatctatgtctcaacaaaatgctaccacgatancagcgtgtacacccaggttcgcatataagagaaaaagttctcgatagcgtagcatgatgntntccgatctaacggaggggggtcgcaaagaagctgntccatttgcatgcgcaaaacccgcagcggacttgcgtgcgttcctccgtcgtctgggtgccctgacgcagagtctctgtttcgcaanngggcaagacccagatgggaatgtgagcgcggcgttgcaagatggctctcgatgtggcagagcgcagcgttggagagtcttgggtgggggcagagggggcaacgaggcaaaagggaatgtggggccatctttacccccattctcgaaaccctcccttcgcccaacgcacccttacaagaggtcccacacggcgcgaaaaacttatccatagggcgggataatccctaatacggcgaggtgtgataacaatagagattcccccaggttcatccctccaggacttgtcatcacatttcacccctttacgcgggattcttgagtacacgacatatgggacattcgcgcagtctcatgctgcacccccattagaaaaaggccgcacccctttagttcctttgcactttgccccaagaaggtcgcnctagtaatttatacgaccttcactgtatgaggacataggacaagagtcgcaaacaggattaccaaacggatatccgacgggaaacagaaacagcgtggcgacacaatccaatcgcctgaggtgtccacaacaaacacgcgccaacagcaaacgaaggcggccaagatgggccaacacccggcacaacggccacacaaggggatatacaagcaacgccacaggcataagcgatcacacaggggcgtcccaagccaaggcaacggacaaatcacccaacacatcacccccaaacattggcacacgaacacggcgcaacacacggaacaacaagcaccccaggagcagcgtctaagaggacacaaacgcacaacacgagtctcaaatcaaaacccaggaacctacaggctagagaccaaacgagcaccattgatgaacacgacaaaccacccaacactgacaccaaaggcggaacaaagcgacaaatcaccgaaacagaccaatcaacaacaaaacacccgaggcgaaacacatcaacacgaagaaggacaaacaacacggaccccacacgagccactagaaccacaaaaaacaacacgaaacaagtacttacaccaaaagtcacacactaccggacccacaaaggacagaaaaaaaaccacaagcagcagcccagacaaacaacaacacaacaccacagcacaaccaaagagagcagagaccaaaaccaacaccaaagacaacagcaagacagagaaacacaacccaaccaccacaacaaacagaagacaaagaaccacacaccagcaacacagcaaaagcacaacaaacaacaacacaagct

SEQ ID NO: 577765 - DNA, 287 bp, Homo sapiens
tttattttgtcagtgaaactggtaagcactagaatgatcagaggaaacggatcaagagaaaatctaagtgcctttatgcccatcttctcactatacagagaggtccaaacaccatgtatatggtaggtgcttaagcttggtgaatggataaactaactgggatattttaaaggatcgacaatcaaatggctagttctaagacctaaagatatctcaaaatgtgtaataattgttctaaagtctgtttttatagcaaaaaatgtacttaacagagtgtaatcctttga

SEQ ID NO: 577766 - DNA, 104 bp, Homo sapiens
ccccgattatgagtcttggtcgcattgctaattgttatagtttttgggggatcaattcctgtggtgatggagcccacaatgggctcagaggtcactgtgccatg

SEQ ID NO: 577767 - DNA, 156 bp, Homo sapiens
aatcgagctccacgattatcgaaaccattcatcaaaccctgtcacaacccttcatcaaacccttcatcaaaccctcatcaaacccttgcgtgttggagttaagccttgagcgacccaggtagacgatgtagtcctccttctttagggtttcgatga

SEQ ID NO: 577768 - DNA, 340 bp, Homo sapiens
ctaaaacttcagcagctctcgcagctcttggaataaatctgaactgtctggaaaggcaagcatggaagcctggacctcgcttccactccggtctccactggggacacgctcccctccctgcctgtccactgcagtgacacggaaccacttctgttcctcacagtgacaagcttatttctcccgtggggtctttcaccagacactgtggttgctggaagcgctcatctcattgtcacacctctggtatcttcttgatctctgcttaaatatcccctacacagaggaggcacttctgaccatcaacgcccaacacggtgcgttggacggtgcgttggcccaa

SEQ ID NO: 577769 - DNA, 466 bp, Homo sapiens
  misc_feature (17)..(17): n is a, c, g, or t
  misc_feature (53)..(53): n is a, c, g, or t
  misc_feature (74)..(74): n is a, c, g, or t
  misc_feature (77)..(77): n is a, c, g, or t
  misc_feature (217)..(217): n is a, c, g, or t
  misc_feature (358)..(358): n is a, c, g, or t
cacgaggggcggcgtanttgcgtcccacgcagaacacgcggcggatcgggaancgggcgttgctgccggcgacngcnacgctggcctgctcgacgggcggaatcacgaattcggtcatggtgtcagggggtgaacggggatcggagccgattgtaccgagccggactcgcaaatatgaagcgaatcattttggcgctgaggatcgaaaacttcgatngacgatttgcccgccagcgggccaaaccaaaataattttttggttaatcggtgcggcaaccgcttcttccgcctgccgctcgtctccacacttgccgtcacggctcgccgtgcctgctgcgttcccatgcgtttgcatggnggcccatgcaaggcgcgaagacagcgccggcataacgagacgaacgagcaagaaaggagaccccatgaccaccaggccgacccgcctatcccgcagccgccgcacctg

SEQ ID NO: 577770 - DNA, 314 bp, Homo sapiens
atcttcttcttctttctttgagatgagtctctgtctgtaccaggtgagtgaggagacttggtcataactcgctcccaggtcagcgttctctgctcagctccgagtagtggatacaggcgctgcacacgccagtaattttttgtatttttagtagagacggggttttgcatgttggcaggctaagtctcaaactcctgagctcaagtgatccacccggctcggtctttccccaaaagttgctgggattaacagtgtgttgagccactgctttggggggccctttgggggttttttttcctttggaactttcgggg

SEQ ID NO: 577771 - DNA, 428 bp, Homo sapiens
ttcaagctttctcaatccttgctccaagttgcctttcaatccaattcgaattcctacaaaataatccatcaataagcacatgtaacctatcaaaatgataaactagagagaagaactacatatttacaaatttataattaaaaaggcacaaacaaagttctaaataagagaaaagatgagataattgcctaaactcacatctctcaactaagtatttttggcaattattaagtgtgttgctgcgttcatttgaattgcagttgcagtgttttttcttccgtctttcttcaaaaacacatattttcccttgcacatctcaaaaaatttcaatcgttcattttccagaatatatggtgcagtacaccatcattcatgcagaagaaggtgatctgcagcagagagaataaggggaagaaattgggggagaa

SEQ ID NO: 577772 - DNA, 173 bp, Homo sapiens
tcgatcgagctcggaccctggtatcacgcatgggttaggaagttcaaccagtctctaggaggctccaaattttcacacattttcctgtcttcttctgagccctccaaattgttctaatctctgcctgttactcggttccaaagtcacttacacattttcaagtatcttcacat

SEQ ID NO: 577773 - DNA, 524 bp, Homo sapiens
  misc_feature (131)..(131): n is a, c, g, or t
cctccaaaagcacttcggatttttggtgaggtgtgtcccactggccacaactttgtgaatgttcttcctggggggggggacccatatttagtccttttattgcaagtatctggatctctctctcttgttgnaggtgcttaagcagaagcattacctctttggaaaagggggtagctggggaaactcaaacttttcccctgtcttgatggtcagctcccttctctgtagggaacttttgggtcccccatccccatcctgcagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctcacacctgcgtcttacgggggggccatcctccctcaagaggtgtatgctggctctttccgtgctcacacacggatccacatgtgggtgtggggcaccctgcgtct

SEQ ID NO: 577774 - DNA, 165 bp, Homo sapiens
  misc_feature (20)..(20): n is a, c, g, or t
  misc_feature (84)..(84): n is a, c, g, or t
tgtaaaatgtaaagttaacnaaggcagaaactggtggtgggaagtggaggaggtccttaaaaagaaagatgggactgggcctgngtgcacgcctgtaatcccagcgcttggggaggctgagacagaaggatcacttgagcccagaaatttgagttcaccctcagc

SEQ ID NO: 577775 - DNA, 281 bp, Homo sapiens
aaattcacggcccgtcgacgtgatctcgacttactgcaagccccgcgtcctgggttcaagaaattctactgcctcagcctccagagtagctgggactacaggcacctgccaccacacctggctaattttttgtatttttagtagagacggggtttcactgtgttagccaggctggtctcaatctcctgacctcgtgatccgcccgcctcagcctcccaaagtgttgggattacaggcgtgacgaccgcacccggctaaataaacatttttcaaagcctccc

SEQ ID NO: 577776 - DNA, 462 bp, Homo sapiens
  misc_feature (342)..(342): n is a, c, g, or t
  misc_feature (428)..(428): n is a, c, g, or t
  misc_feature (434)..(434): n is a, c, g, or t
agcgccttcctgcgggtctcaatgaagtcatcattgaaacgttccaccatgcctttgacgataaacttttctggcaatgggggaataatgagagtggggtgtgcttcttcaaagtttgcccttcaaccacaggaaatcttgataacgtcgcctgacttcaaattcactggaatcaaactccccacgagatgtcttggttacgatcctgtaagtgatgaaagtttcaattgtagtgacatggctctcaggtgcatcaactgtaatgaagagatcctttaaatctggtccatcttcaaacttgatctggtttatcatcgacaaaggggatgttggcatcatagngctaaatgagttcatgtccatcagggaggcatccttactgaacacctccaggtcgtcctcgtcctcgtccagatccagcacaatcngtgctnagcaggctgcaggaaccgctgccactcc

SEQ ID NO: 577777 - DNA, 1490 bp, Homo sapiens
  misc_feature (164)..(164): n is a, c, g, or t
  misc_feature (193)..(193): n is a, c, g, or t
  misc_feature (1126)..(1126): n is a, c, g, or t
  misc_feature (1140)..(1140): n is a, c, g, or t
  misc_feature (1150)..(1150): n is a, c, g, or t
  misc_feature (1158)..(1158): n is a, c, g, or t
  misc_feature (1165)..(1165): n is a, c, g, or t
  misc_feature (1172)..(1172): n is a, c, g, or t
  misc_feature (1174)..(1174): n is a, c, g, or t
  misc_feature (1184)..(1184): n is a, c, g, or t
  misc_feature (1233)..(1233): n is a, c, g, or t
  misc_feature (1235)..(1235): n is a, c, g, or t
  misc_feature (1240)..(1240): n is a, c, g, or t
  misc_feature (1255)..(1255): n is a, c, g, or t
  misc_feature (1262)..(1262): n is a, c, g, or t
  misc_feature (1268)..(1269): n is a, c, g, or t
  misc_feature (1298)..(1299): n is a, c, g, or t
  misc_feature (1343)..(1343): n is a, c, g, or t
  misc_feature (1349)..(1349): n is a, c, g, or t
  misc_feature (1376)..(1376): n is a, c, g, or t
  misc_feature (1389)..(1389): n is a, c, g, or t
gctcacactataacatgatggtcgtgatgtgtcgctgctaggcaaataaataacgaatcacgcctgttagtgtgtggtacagcacgcacagatgatccgggttttaggggcgccgaccctaagtatgaggagcctctctgaatggggatcgtcccccaccaagnggtgtggtgtaccacgcacgagaatatgnccagacggggctttgttgtgtaaataacagccctccgtcgcgcctccgcgtgttgtgcctcttatattgtacgccggggtggtctcttatataaaggtgttttctcgccaaggtctcctcttcgtgggggttgtgctcccaaatatattttggtgccaaccgtaagagggggggttgttgccaccaccacgtggaagaagagatgtcgcctgtggtggtttgattccccaccaactaggggccacaccgctgggcgccaccccgcgccctcagtgttggtgttgtaacacgcagggggtatattgtgtttgaaaaagagaaaccatcaagccctccggtgtgctccgctccaccaatgtgtttggttgggccgtttttctgttccccgagagagttgcgttgccccccgtggtgaagtcgctcccagaagattttctgcgcccaaagtgttggtgtggcaccacttggtgggggcccgtggtaataaagaggcgccccaaaaaacagtggtgtagtgggaaagttttttccctcgcgcttgtttgggttgcggcccacacaacaatcgtggtgtctcctcaagaaattggaaaatgagtaggagccgccagccgtggtgcctccctggtcttgggagagcccccctggggagagcttggccccccggaaatatgtggggcccccaaaaaaagagtacacatgggtgtaagaagagatgtttgttgcgcccaacagaattgggctttcccaaaaaaaccctggggtttccggcgtcccacacacccctttcccacaggtctatactcgcgattccaacacaagaatatttgttctcatgtttcatgggggctgtacacaggcgttcccaacacacaggccatatcgaagagtgtcccctttgtggaaaacccccagaggccacatgtgtgccanagggttccacacantggcccaagntatcacanggcccancccgccncncaagctgccnggcacacaaggagagccatgtgattgaggccctgccccagggcccaagntncaagntttcctggcccgccnagaagantccacnntttccaaagaaagtggggcttcacccaannttccaatgctgatgaatttgaagaacacatggtggctgaaaaancggctnatccccagaatggctgtggggtcaaanacacatcccccantcgtggccctttggacaaatggcgggccctgcactcatgagggcttcccaagtgctgcccccctcttaatactcccccattaattttacttcctgtcacca

SEQ ID NO: 577778 - DNA, 897 bp, Homo sapiens
  misc_feature (203)..(203): n is a, c, g, or t
tctagccaaatgctatgttgcaaaatgtggcatcgttaagtttttatgtctgtgtcttcttgtttactataccttgggtaatttgtgttaccaaaaaaaaaaaaaaaaaaaggaagtgtaatggtgtaatgtccgaccacaaaaaaagcaaatcagggtggtaagcttaaagtacaattccaaaggtcataccaacagcgggngttttttttgatactttaaaaacttttatgctacatatcatggccatttcatattggggggtttggctactcttatacaagggaatcaagcgaaaggtcatccagccactgaatggcattattatatctaaaaagtctctaagatgacagttatcactatctggtttatctccatgctgaccttttgaaagaggtcctagtatccctctagccagattgttagtttttcgtgggtactcaaccaacagttgtactaaggaaagtaaagctaggacctaaatcagaatcatagtgcctgcatattggtaacaggtcgggtgcatttgttcacaggatgagtgagaggctgagcagaatttattgacattctctgtggtgataaagaccttctttgtttaggtaagaggaattacagaaccggtgttacccaatctaagagggggtaacagaacaaacacacaggggctggttcagggtttccctagaggatatgcgaggtcaatcattacactaagtggtggaacatatttcgttggtacacgagtctctcgccccgactacaccacctgttcttagacaccacagggcgcctcacatgttgctcacaacggagagaacagtcgaagtcggagatacaactcgaacacaaacacacaacacaaccgcggcttccgcacagcacatcacaccgcgg

SEQ ID NO: 577779 - DNA, 857 bp, Homo sapiens
aggcgtgacggtacgtgtgaggtaaacagctgagggcgtggagacggtggtgatcatgccatagaccaggttgataccactgaaaactgtattaccagtcgtcgatagaatagtttggtagtggccccaatgaagaacctacagaacctgtagacacactgtcgctttggagccagcacagcgccttcgagccgagagaactggcccaggcaagccaatgtcggaggagcttcttggcatgctggactcccccatgctgggtgtgcgggacgacggtgacagctgtctttaaagagaacctcaattctgaccgtggccctatgcttgtaaacaccttggtggattattacctggaaatccagctcacagccggctattgcacaatcctgacacaccttgcaatgagccacatgacaaagcaacctcttggaacaggataaacgaagtatgttgggcaaaagccgccactcgttatatccatcctctcgtaactgaggtcaatgtcactagagactgccagccatctttggaaagcataagctctctcaagccaccttctttatgcccttctttactcaaaatgtctcaaggatggaccatctgaccgtcagtttgtcctcacaatcagggcgtcgttggtgttgagtaaccattgctagccaatgaattccacagatcactagggaaaagcagcattctccttggatctcctttctgaccatttttagaaccggtctgttcattcactggctggcctgaaagaaaacaggcccacgttgggggaaagtcaaaacttggtccattttccatgcgaatttttaacaacctcttaccataggccttaatgagagaggtcc

SEQ ID NO: 577780 - DNA, 303 bp, Homo sapiens
ccccagtttgatgtccttccaagaatgaatccttccctggtgatgtctctcgccctgtcttaccagcatccactctcccttgtcctcccaggggtgtatctgagtcagccagtggcttcttgatgatggtggtggtggttgtagtgtgacaggtcccctttaggttatttaagggtgcatgtcccctgcttgaaccctgaaggccgggtaatgagccatttccatggtgcccagctgaggaccaggtgtctctgagaatccaaacatcctggagagtatctgagaaccaaccaagtaaaagtc

SEQ ID NO: 577781 - DNA, 110 bp, Homo sapiens
  misc_feature (1)..(1): n is a, c, g, or t
nctgtgagagagctttaggacaaaaggtccttttatgttattgtttttccccccaaatagataagcatacacttatttagagtatggacaatatatttttcttctgtttc

SEQ ID NO: 577782 - DNA, 711 bp, Homo sapiens
  misc_feature (143)..(143): n is a, c, g, or t
ataccagaaggatatagtatagtatatgtaagacgacgcagaacgagtagagacagagagcttgtcatggtggtaatgaacacaatgggcatcaatacgattgatcacaagtgcaatacggggatacatcgagatatcgcagntgtcagtagacgattaactaaatgtattccatcagcagggttccgatcatcggcatgaagtagcagaatgcgcaactgtaccaggcaagcaacgaatagagcaccgtatatgaagcccgagcaagcgcaccacattggtggccaacgacgagtagatagcacccgtgtgtatgactaaaagactagttgtgtatcaaatgtaagttggggaccacaaagcagaagatcttgggacacaagtatgaatggcatgcatagatagaataacgtagcaagtcagtactatgacctaatggtaggtatgcagaagagtagtggagaacctcggacgatgaactgttttagccacttatactagcgggatagcaccaaacgagggtattatcaccctgaggacgagacatgtcgagaaggcctcatcgcaatatgccattcggcgtattgatcaaggacaagcagtctaagatattcactttgtgacttactgggaacaactatgggaatgaggggtgcctatctgatgcaatatctaatgaccatttcaatagcaagaggtcctggggacgga

SEQ ID NO: 577783 - DNA, 153 bp, Homo sapiens
ccggaacagtttacccagatcctttaacttatgagtggccgagccctagcactgaaagccaggtagtcttggaaccaaagtccgacctcctgactaataaataggggaattaaattagattagcttgacattttagccggtcggctcgtcacc

SEQ ID NO: 577784 - DNA, 405 bp, Homo sapiens
tataacctaatcgcagcgcgatatcttgtaaaacacatcctatcctatacttccaattcgcggcgtaaggctgcagcgctcgtatgagtgtttcacctaacggctgatcgatatcgtcagcaatgcggtacagctcgtccttggtttcctgttcacctttgatgttgatctggacattgcgcccagtttagtaacggcgttttgctcgttcgactggggggagtcaacaggggcgggctgtcggctgacatatagccgtgtaggttcgccatttgttccacttctgcattgcttagctttgttttctgctcggtggctgctttaggttcgaaattcttcaagctatccaaggggtctacgcgactcatgatgaaatcttctcctggtgcgataagggttagtggg

SEQ ID NO: 577785 - DNA, 290 bp, Homo sapiens
aagctactcgggacggtcccaactaggtagtaaggggctgccactgctacctcaacggactagacacccccattaggaagacgctcacatgctgtcctgctaggacgctgcaggcctggccgttctgtggccgcatccggtccatggtccctgtgtcctggctgggcgagctaggagggggctgatccatgggacaggttcagcagcgagttctgaatgtcttccaggacttcaaggaagagctcctctcgggactcatgcccgccagaagacattcacacgttggctca

SEQ ID NO: 577786 - DNA, 743 bp, Homo sapiens
  misc_feature (531)..(531): n is a, c, g, or t
gcacatctgtaatcctagctacttggcaggctgaggtgagaagatcattggagtttaggaattggaggctgcagtgagccatgagtatgccactgcactccagcctgggggacagagcaagaccctgccgtcaaaaaaaaaaaaaaaaaattcaggccagggtgtgctgtgggattaacagggttggtgagccaccggtcgttccagccgaggctttatactatagtgtttttttaacaggcggtgctcttttgggtgtgtctcagaaaggtggatatagttctcatgtggctctccgctctgtggttttaaagacacctgtgcagaggcccggaagtcacacagagggggctctccagtcccctgtgttaaatctcccagagccaatgttgtggggagagacaccaagaggccgggacagtgagaactcaccaccttgaagaggtctcagagggaaagctctcagagagacaccagagcgctgtgcgctataacacctcgtgtgcgtgtggacacacccctctgccgatnctctctccgcatgcttttataaaaaaattatgcgaccacacaatatattgtggtgcgccgcgggggagccgcgtggggggaggcgggccctcttcgaatgtggcgccgcggtgatttaaaagtctcgcccggaggagcaaagttttgttgggggggggaagaggggcccccaatgaggggcgcgggctgggtgggaaatttccgcgcggagt

SEQ ID NO: 577787 - DNA, 331 bp, Homo sapiens
gtgagacttgatgcacgatggcccttcatgcaaattgcgaaaatgaaaatcctataaatttataaatgactgatttataaggattttctagaaaatccaatactggcacaatcactgcacctatcactccatgcttgccaacttgagccaatggagctgatagacatgagcctgatccaagataaattcgcttcggtattttccaactacgacgtcaccacccagccacgtccggacggcggtatcctgttgaccctgcgcaacagcgaaggtaaacaggtcaagcgctcgatctcttatcagcagttgcacaccgccgatcaactgacct

SEQ ID NO: 577788 - DNA, 88 bp, Homo sapiens
aatctcgcgccgggccgtacccatatccgcagcaggtctccaaggtgaaaaagagcgagaataaagagagaaagaagaaaagaaaaga

SEQ ID NO: 577789 - DNA, 1020 bp, Homo sapiens
agcggagttaattagtagacatgaagaagaatctaatatacttaaagctgaattaaacaaagtaacatctttgcataaccaagcatttgaaatagaaaaaaacctaaaagaacaaataattgaactgcagagtaaattggattcagaattgagtgctcttgatagacaaaaagatgaaaaaattacccaacaagaagagaaatacgaagctattatccagaaccttgagaacagacagacaaaaatggtcagcagccaggagcaagaccagacgaaccagttacattcagacacgcttaacttgtgaaacacacgactgaacgcctattcagacctgccctaacaacgaacttctcaacacttggagagagacacgtgtcgacgaaacgacgttactctaacgacaaaagttaaaacatcttgagaactcaaactagcaccaaagtcctgccattgactctaccagaggagattcattcaagcttaggttgctgaacttcaagaaaagcttcaggaagaaaaagcataagctttctagaacaacttgaagagcaaagaacaagaagaccgaatgacagcaacatgcaacattgtccgaaccatctttcgattgcggaacaacaagaccaattttaacaactgtcttaacaaagagagaacaatgacgaacagaacacgataataaatgatcttagtgatacagctcgaaccagtacaactgcagcaacacagaaccgggatacacgactcggatcagagtcaactacgctgacgaactcgagacctcggtctagacacacgacaggcaaaaagaacacaaacgctcagacaacgaccgaacgagccccggcacagctaagccggacacagacaccaggaatccgtgaaccctacacagcacatcatggcaacccgcaacacccccagaacaccgacggcacgctagtagcacccggaacctccacccggtgaaatccagaaagacacacgctgcagcaaaaccgcccgaatgcacgcgag

SEQ ID NO: 577790 - DNA, 1726 bp, Homo sapiens
  misc_feature (223)..(223): n is a, c, g, or t
ggccggtggatttcttaatgaagtgtctccgctatgcgttcagtggaatgtctggaggggaggtgtgaatctctaggaggagggagaggggtggacgagaaatagaggggagggtgactggcggggacggggacaatcgagggtaggcgacggtgtctcgcctacgcctcgctgccgtctgggcacatggtggatgtattttagataagagctccaggcagantcatgtcattgactgactttcagctgtgcgtccttgctagtcgcacgactaggctcggcgagagcctgtaatcgtactgctcgtagtgaagtgcacagcagcagtgcggtgagtagcggggcaatcgagccgtgccagtgcgtgctgcgatgcgcagggaggagctgagccagtgacaacgcgagctgtgatgcctgtgtgggagcgtagggctgccagctgagcacgcacgatgaccccgggccaataggccaccgaatgcgataggcataggtcattgtggccatgcaagtcgtgaacacggtcccaaggacctagcttgtcactgcgaactctttgcgtgttcactggctacgcccccgttcgcatgggtggcccgtgcgcgactcgtgtctaccccacttgagtgcctgggccgcacatgcatgtggtctggactcgatactggatagtcggtaagcattagccctggaggccccccggagacatggcacggggctggccgtgccccaaaggatggatgacacgcccacggcgaccatccgcccggataaggcacccacgcacaagcgcactgacgagcccacaacgtccgaacacgacacagcatggagggacggcacacgggggacattaacccacgccgattcacgggggtagggaagcaaagaaagtaaacactaagcggaaggacgatggacccgagacagtggctatgcggcacaaaccaaatacaggggtaggagaaaccaccagatgtcccgcatctcaccacagcaggagacccagcgttgtgtgacgcgcctcgataacaccaaaacctcccgggggaaaccgcaataccgagatgtaaacaccccgggggaatgccacggattcaacgcggaccggcggccgtcagtgaacacgcccggggaagaaaaccgggagcgcagcgaaccacatccataaggagatgagcaccaacggcggcaccggttacgccacaacgatattatgagtcgcgcgcaaggcagctataccagcgcccattgcaaggtccaaacacaccaagagcgacagagatgtggagcaccgcgagcaaaaaccctggggggacacgcataaacaacgggcgaagcgttgcagcccacggagggagagcatccagaaccagggcggcaacaacagccgcagaaagtccaggcaggtagtacagacgaagcgtggcaaagttgagaacaccgacgccggcacagagacacaggggaaaacaccaacggcaacactgagagggaaaaccaatgaccaaaaggtgaaaggatgaccagagtaaagggagtagtaacagggcacacccagaagcagaaacaataagagcagaatacaacacacgagcggtagtagagagacagtagcccctactcacagaaaggaggcatacgacggaggcacacacacggaggaggaagacaccaaccaggaaccacaagacacaaacccgcgcacacagaaaggcgagcg

SEQ ID NO: 577791 - DNA, 275 bp, Homo sapiens
tagaagtgtgaaaacgtaggcttggattaaggcgacagcgatatctaggatagtcagtagaattagaattgtgaagatgataagtgtagagggaaggttactggttagatattgctagggtggcgcttccaattcggtgcactgacgtaggtggcctgcacgtactgttacgcggttaggcgtatggccaggactacttggttgacatgacgtacggctgatggtttcgactaatcactacgtactggggactaggggtgtcggtgtgccttgac

SEQ ID NO: 577792 - DNA, 184 bp, Homo sapiens
cgatgaggtgctccaggcagtcggggtgccgggtgcgcactgccacgtgcaggggggtgctcccgatcttgtcccgggcattgacccgggctccctggttaagcagcagtttgaggatgaccagatgtcctccgcggcaggcccagaacacaggtgtcctgtccagcaagtctcgcgcgtccac

SEQ ID NO: 577793 - DNA, 460 bp, Homo sapiens
  misc_feature (211)..(212): n is a, c, g, or t
aaacgggttcagaaactgccaggggcctcatacagggatatcaaaataccctttgtgctagcccaggccctggggaatcaggtgactcacacaaatgcaatagttggtcactgcatttttacctgaaccaaagctaaacccggtgttgccaccatgcaccatggcatgccagagttcaacactgttgctcttgaaaatctgggtctgaaannacgcacaagagcccctgccctgccctagctgaggcacacagggagacccagtgaggataagcccagaatgaattggaccatttgcagaagcagaagtaaaagcatgggacaagcatgataactcagaggtgacaattttaaacctgccacccctatttccaaaatttggaatcaggtaaggtaacaaggactggagacaaccaacctgtggccccacttattaaattttttaaaggggcccttaaggg

SEQ ID NO: 577794 - DNA, 150 bp, Homo sapiens
  misc_feature (7)..(7): n is a, c, g, or t
ccccagnttcaaattggcgtcagaaaatatgtcagctgccacttcgttaacaagacctctcggggggagtctgtgtccacggcgtgcaatcatcctctgcagctccatgttactgcccacttcttaccacatcgcactatgtacaaccat

SEQ ID NO: 577795 - DNA, 255 bp, Homo sapiens
ggctgctctgtgccaggtgggtacagtggatgatctggctcattgcacctgcacctccagctcagcatctctactcagcctccgagtagctggactgtaggtgcacagcaccgcctggctaattttcgaatttttttgtggagcggtgttcacatgtgccagtctgagtgcatcgtgcgatctggcttactgcagcctcgcctccgagttcagcgattctctgcctcagcctctgagtagctgggcttgcaggct

SEQ ID NO: 577796 - DNA, 739 bp, Homo sapiens
cgcagtggctcacacctgtaatcccagcactttgggaggccgaggcaggcggatcatgaggtcaggagattgaaaccagcctggctaacacagtgaaaccccatctctactaaaaatacaaaaaatgagccaggcgtggtggcggacacctgtagtcccagctactcagaaggctgaggcaggagaatggcgtgaacccaggaggcagagcttgcagtgagctgagatcgtgccactgcactccagcctgggcaacagagcaagactccatctcacaaaaaacaaagaacgacagaaagaattagcacaataaacacttgacagggacatcaatatacaacgagttaccacggaacacaaaaccttaaagccacaaaaaatatcactataacacctaaaaaggctgacaataccaagtgtgggcaaggatgcggaactcccccatatagctggtgcagtatacaatggtcctacatacattggggaaagacgatatccaagatttacttattaaagtcaaatcacacaattgtgctctatgggcgagtaatttcacaaccatttagtttataaggaagacattgaaaacattgtgccaaaaaatcagattgtacgtaaaaatgttcatagcaacttatttcaaaataggcagaaataatttagaggccaacgggtaaagcagtaaccaaatggggtataacaagaaagggagaaatatgaaaaagtaaggggatagaga

SEQ ID NO: 577797 - DNA, 970 bp, Homo sapiens
gggtcctgtaaaatatgagaacccagtgctttgaggcctgtccagcctctcgtgagcccaagagaaatgtctgtcgattctactgccaccaacgccacacatccaagtccacagtgcaattcttagccacagaccaaggcatctgagagtgttttctttgatttctgactccggcctccatggctggtgatggatggacattccctctggaccatgactgaaccagcccctcttgagtctgggtgtgagtcgcagatccctggtcagcaccctggaatccggctgcaccgggcccctcccagcccacacagtgcgttcacctcaggctcccgcacgtgcccagcaggcctgggtccaggtatcccttgagactgggagccccaggggctggaccacctctcctagagcacctccagtccccacttggggacttacctcctcccaaattatctccagcccaggatctgcacagggccctctctccccagtctccaggacgtgattagcaacttcagttcctcaagctggagaaacaagaacagaaagggaagtggcctgtccacaaattccactttcagccccaggacataaattcccccagaacaaggaagaaccaggaggaaaagccacagattcatctcacggacttgacctcaacgtggacgtgttccgggaatcctcgtactatgtaggaaggtgctcccactctgcagatgagacaccaagatccgagggctatgtggcgtcaggacacgaagtgcaagcagagtgatcccagacaactccaaccaaagcggattcgacaggtgctcaggttccggcaaatggacccaacggccaacacacaaactgggaaggaaaaagggacaagacacaaaagcacaagagaggaacaaacaagagagaaggaagcgagacacccaatggcagagaaagggcaaagggaaaaaggagaggcacacgacagatt

SEQ ID NO: 577798 - DNA, 191 bp, Homo sapiens
cttaggcatacttttaatcaagtagaacaaaaatcagacttttttgaacttcatgtatgtttactaggtctatacagacaatactttctatactcatatccatttcggtgtccgtctccagtcagactattattacatcatattagtagtaaatgtaaattaaaatttatccttcggtagttcgtacgatc

SEQ ID NO: 577799 - DNA, 1066 bp, Homo sapiens
gagatccaacaagagaagaataaaatgaagcaagctagatgatcagtgctgtaagaatgaggcacgttgaatttagacggggccgtcgttattcacgtccgtggtatcaggaaggtatagtattctagagctcacgaggacttgtagtagtaacaacaattgacctcgcctacatgtatgatgcgtcactgatgtggaagcccctttgtgcaccgagacttgcgtgcatctggtgtatggtggacaaggtggcgtttagctcagagaggtcaattcgctggtatgacttagctaagtcagtgctaaccaatacactgtctagccagcaaatcgttgagcagacacatatggttcacatgccttcaatgctcgttcttgattaaaggcaagaaatgtcaatctcaatggactggactagacttccgtctagaggatcatcgtcagtggaagcgaagatgtgagacggaaaatggagggcattgcatgttccgaattctaagtattgacagggttattttagatttggaatcgcaaagtatgatgcaatcgagaatcaatcaggttaatagagcaggtcaaatgggccagttgctccgtggagagagattgaatgcacaggaaggaaggaagtgatgatgtaggaatgcctgcagtatcatatcaataagctgtcaagtcatgacatcagagaatcatgtgaacgacagtgacgaagaagtgacgaccgttgactgctgcgcttacagacctggagatgactcaggacagggggcaaacgtcagccatctgggtgacactaacttccattccgaaacttggcggtacattacccagagatcgaggcccaaaaagaggggcccgcacaaggtccaagcacccatgggggcaccccccgcaacacgaggcacaactggtgacacaaccgccaggagaaacccgcgggcgcccacgagcccccaagaaccccggggaccgaaagaagcccccagtgaagcaccgggcagaagtagcagaatacggacacacgagcaagacagcgcgcacaggagcgaacagaaacacagcg

SEQ ID NO: 577800 - DNA, 391 bp, Homo sapiens
  misc_feature (26)..(27): n is a, c, g, or t
agaacaaagtaagaggactcacactnntcctaatttcaaaaccaaacaacaggtaatcatgatagtgtggtactggcataaagacagacatatagatcaacagaatagaattgagaatccagaaataaaccctcacattcatgggcaagtgattttcaacaaagatgccaagacaattcaactgaagtataagaatactcttttcaacaaatggcactgggacaatggataaaataatgaagttggactccctacctcatatcatatacaaaagttaaccaaaaatggaccatagacctaaacataagaagtaaaactacaaaactcttaaaagacaggagtaactctttatgaccttggatttggcaataaaatctcagatatgacacca

SEQ ID NO: 577801 - DNA, 149 bp, Homo sapiens
ttccacagctgctacgtcttctggtaggtggtgcccacgggctctaggtaataatacctactcgcagccgagtcggtgcagcacagggctggagagtagcgccagcccgttaatagagccgctgaccagatggcaccctgcgtatatgt

SEQ ID NO: 577802 - DNA, 223 bp, Homo sapiens
tttttgaaaggctgggtcccaggttgtcccggtgcggaactggaaggccccggtggcttttggccgaggctgggcttttccctggatgaggacctgggaaccgcctgggaggacagccccaaaaagggagcccgagaccaggggtgtcgccgacatgcaaatgggttgttttgggggttgggttttttttttttatcttagatattaaaagtaagaaaaatga

SEQ ID NO: 577803 - DNA, 688 bp, Homo sapiens
tccacaaagacattgtgaacactatacctattattcgtgcgcatgagctggagtcctaggcacagcgtctaagcctccttattacgagccgagctgggccagccaggcaaccttctaggtaacgaccacatctacaacgcttatcgtcacagcaccattgcattttgtatataagtcttctttcatagtaatacccaatcataatcaggaggctttggcaaactgactagttcccctaatcaatcaggtgcccccgcatatggcgtttccctcgcatacacaacataagcttctgactcttacctccctctcgtcctactccttgctcgacatctgctatagtggaggccggagcatggaacaggttgaacagtctaccctcccttagcagggaactactcgcactcctggagcctccgtagacctaactcatcttctccttacacgctagacaggtgtcctcctctatcttatgggccatcaatttcatcacaatcaattattcaatataaaagcccctgccataacccaatacctaacgcccctcttcgtctgatccgtcctaatcacagatattcctacttctcctatctctcccagtcctcactgctggcatcactatactactatcagacgaaactgcaaacactttttgaccccgcgaaagggaacccttttttccaacctc

SEQ ID NO: 577804 - DNA, 311 bp, Homo sapiens
aagtggtgtttgtatttgaagcacgaaaactgggctcctagtgagcacgttcagctttggtatctatgttttttaacattggccagcttgtgttcagattttaaaagtttaacaagaagatacttcgcattctacaataaaagagagagactgagggagatgtatgctcgagcaatgggtgtatcctcttgttcttcaccaaacaaggggaaagttttacattcctttacatccattttacaagtttgtcagacatataccgcttagggagaaaaatatcaaggcctcggttccgggcagtgatgctttga

SEQ ID NO: 577805 - DNA, 642 bp, Homo sapiens
cgtagcaactgaggtggtcctgtttgtgtaactcggaccatggtggcgctccgtgagtcgtcgtagagaaccatgaacgagaggaccatggaaagcctgcaaaaagagtgatgatcgctagtgtgactagtagctgaagagtgagcagtatcgaataagtctctcttatcgggctggactcgagagaacgagtacgtcaatcaagaacttccatattaagttgagtaaaagtgttctcgattgtacaagatttgagtaatattgtgtaccgttagctatctgtaatcatagttccgagttacatatcaatactcattctaagcgaataccggtatagggcagggaatttcagcttgaaaatggcccgtaagctctctgtcccgggacgagtacggtggacatagatataactgaccgtaactcgtggagacgacaggtcgagatgcagttccacagaatacttctggcatgcactttgggaggccacaggcggagcgtgatacacgaggtcaggagatcgagaccgtcctggctcaacaccgtgaaaccccatctctactaaaaatacacaaaattagccgggcgtggtaggtgggcacctgttagtcccagctacttcgggaggctgagtgcaggagaatg

SEQ ID NO: 577806 - DNA, 115 bp, Homo sapiens
gcgaatataatgaggatgtagtcgtggcgattatagaatgagtggcggtgaagcttcagggggtttggatgagaatgggtgttactacgagggctatgtggctgattgaagagta

SEQ ID NO: 577807 - DNA, 364 bp, Homo sapiens
ggggtttttttcccccggccaataatttccgctttaatgggggttaattttgggggggccccgggtttcccccggtttttttaaattttgggaaatatacctccccaatagggcctttaacccgggcttttggggtaagccccccgtggggtattccccaactaaatgccgggggggttttcccccccccccaaatttttggggggcccccttttgccccccccgtgttccccccagggctaacttcccgggggggggggatttcccccccggcccttttaagaatttttttccccgtttgggggttacccattgggtttccctttggcccccttttggcttttttaaaaatgggttattccta

SEQ ID NO: 577808 - DNA, 103 bp, Homo sapiens
ctctacgaggatcccctagtagtcaaagtgccagactatagtcgaggcttcaactaggttctttctttcctccgctgtattccgcctaagcccgttccctttg

SEQ ID NO: 577809 - DNA, 110 bp, Homo sapiens
gaccctcctcagttcccaaagcgctcaaatttacgcatagctacacacagccaggactgtggtactgctgtcttgagtgaatgctcacactctcaaggagtatatgtgtg

SEQ ID NO: 577810 - DNA, 552 bp, Homo sapiens
  misc_feature (1)..(1): n is a, c, g, or t
  misc_feature (96)..(96): n is a, c, g, or t
  misc_feature (109)..(109): n is a, c, g, or t
  misc_feature (130)..(130): n is a, c, g, or t
  misc_feature (142)..(142): n is a, c, g, or t
  misc_feature (149)..(151): n is a, c, g, or t
  misc_feature (157)..(159): n is a, c, g, or t
  misc_feature (171)..(171): n is a, c, g, or t
  misc_feature (188)..(188): n is a, c, g, or t
  misc_feature (192)..(192): n is a, c, g, or t
  misc_feature (219)..(219): n is a, c, g, or t
  misc_feature (276)..(276): n is a, c, g, or t
  misc_feature (280)..(280): n is a, c, g, or t
  misc_feature (306)..(306): n is a, c, g, or t
  misc_feature (356)..(356): n is a, c, g, or t
  misc_feature (359)..(359): n is a, c, g, or t
  misc_feature (361)..(361): n is a, c, g, or t
  misc_feature (370)..(370): n is a, c, g, or t
  misc_feature (372)..(372): n is a, c, g, or t
  misc_feature (546)..(546): n is a, c, g, or t
nttttctcataatctgtttctaagcatatataataacatcatatatattcttaattggagtagaaacgtttttaaaattactgtgaaaaacaagantgagattccaganaaaattgcccccctacagcanatctgcgtttangcccagnnngccgcnnnctcacacctgtnatcccagcccctttggntgtncgaggcagacagatcacgatgtcaggngatcaagaccatcctggccaacacggtgaaacaccttctctactaaaaatacaaaanattngccaggcgtggtggcggctgcctgcngtcccagctactcgggaggctgaggcaggagaatgggcatgaacccgggnaancngcagcttgncngtgcagccgagatgcacgccactacattccagccctagggctacagagcgcagactccgctctcacgaaaaaaaaagagaaatctggtttagaagataggaatgttcattgaacattgacctggaactgtcaattgggactaaagctttttctcatttctccacctaaatacanggaaac

SEQ ID NO: 577811 - DNA, 293 bp, Homo sapiens
cgagactccatatcccaaaagaaaaaaaaaaaaaagattcaaatcttaattggcataagccagtcctagtaatgtcatgccctttggccagtcgttggtcacagggtgagctaatgacccaactctgacaaattacatgtaagaggaattctgctaaaaagatattttcggccaggcgtgggggctcacacctgtaatcccatcacttggaggctgaggcaggagaaatacgtgaagccaggagtttgagaccagcctgggcaatatagcaagacccacatctctacaaagag

SEQ ID NO: 577812 - DNA, 210 bp, Homo sapiens
  misc_feature (33)..(33): n is a, c, g, or t
cggagaagagatagttgggttttggtgagggangttcaggagtaacaatctcactatgttaaccaggctggtcttgaactcttggcacccaagcgatccttttgcctggaatcccagagggggggaggtactaaacaatatttcattgtaattactttttatactttataggtcaagagctctggtttaaagacaaaatttattggaata

SEQ ID NO: 577813 - DNA, 439 bp, Homo sapiens
  misc_feature (4)..(4): n is a, c, g, or t
  misc_feature (10)..(10): n is a, c, g, or t
  misc_feature (418)..(418): n is a, c, g, or t
catngttggncaggctggtctcgaactcctgacctcaagttatctgcccgcctcagcttcctaaagtgctgggattataggcatgagcaccgtgcctctactcttttgttttattttttaatagagaggagatgtcattttgtcacccaggctggagtgcaatggccagacatagctcagtacagcctcgaacccctgggctcaagcaaccctcttgtctctgccttctgggtagctgggattataggcacttgccaccacacttgggctaatttttttgttgttgtttcaaatatttgtagagacagggtcttgctatgttgaccaagctggtatgggtactctgatcctccagccttcagcctccccaaaggcaatgaggttatagggaatggaggccaccgcacccagccaaaantaacattccggggggagcgtc

SEQ ID NO: 577814 - DNA, 854 bp, Homo sapiens
gggaagaaacatccctttgtataaaacagctgtgagaactcaatccgttcatatgacagtgatctagaatgttgacaccgaacagtctagacactagccgtgcgatctcctgggtgccctgccagtattaatgtgtcgtgcgggtattctacaagtcttctgatcactaggacctgttgctggtcgatcgtggacggtggaagctctcagtgaagtcgaatgatgggtgctccgggcaggagggtgttctaccaaggcaagcttgtccctcacgtgtcgcgagggaaccgaccctggggaatgcgcgactgctggatatgtaccatgctgttcagatgcatgctgacactataggatagatgaggcatatcggaagtgtctccagaagggagccgtgtcgcgtaactgaaggcatcagtggcattaccgctgtgggggtgaagattcatggtgaagcaagttcgtttcctagctttcgagacatcaaacgcaaagggatcctgatgactgggtaagctgttctggcagtacgcagatacacacttcgggcttgctctagttgttccctgtgaacgtcggtaccggataatggaaggggttaatgccaggggcaagaaggcaggtgaacactaacttgagaaccggatagaacccaatgaaactgggcttgacaaagggtatgaggcgacgacggagaatctcttcgggacaacgaataatagcatgtggaccctggtggtctccccaactgggcaacatccctattttggctagccatggagacgacttggaattgcacattgtatgagattatgaagatatgaagggagactattcttggactgacgatggac

SEQ ID NO: 577815 - DNA, 123 bp, Homo sapiens
  misc_feature (78)..(78): n is a, c, g, or t
ctagaggatcccgatcacgtgcattgtgtactagaaggtgagaaggagggcgggaagtcagttgagatgggcacggtngctgtgaggaggctgagaggtctgttcagcctctagtgggcttcc

SEQ ID NO: 577816 - DNA, 237 bp, Homo sapiens
acttgggttgacttctgtaaaccatgggtataaataatgcccttgtccgatgcccataaagattgaattgaattggggcgacagccacccactgacacctctcagatcaggaagctaccagttactccagcttttggccaaatccaccctaaccaggatggtcattactgccaagatcatcagagcacgtactgcatgctggacactgttctccgctccatacggaggagaaactga

SEQ ID NO: 577817 - DNA, 371 bp, Homo sapiens
ggcacgaggggtgtgtgtataccgcccgcgtgtgtgatgctgtgaaagcgctcaaggctgtacgctgtgatatccctgtggcatcagaggccgctgtatttccagctggacacgactcatttgaagacacgattagaagagatcagaatggctgtggaagaaggagctacagaaatcgacgtggtgattaacacgaagcttggtgctgacaggccacagggaagccctgtatgaagagaatcggcaggttcgcaagggctgtggggaggctcatattctatattagcgacaggagaacttggaactcttactaaaggctatggcagtatgatagccatgaaggcaggatcagagtttattaagctctctgg

SEQ ID NO: 577818 - DNA, 411 bp, Homo sapiens
acaaccgtacaagccccgtaaaagcggcatttaagctccccacaacaataaaacgatacggcgtactcaatcagtaaaaccaacaacgaaacacccactgtaaccacacaccgcacctgactcacagcaaacccaggccccacctccattcattcatcatcccgccatagcgaccccaacggaatcctcaacttgctggtttgcacccccctaccgagcgtggctgcacacgccgcgcaacattgctctggccgccagatccacggcgtttaatgacgaaattaccgaaaccaataccaagatcaatgccactccccgtcccgcctagagacaacgacgcatcccctttcgtcaccaactggatgttcccagatttcacaatcccgacatgcgcctccgccccaccatacg

SEQ ID NO: 577819 - DNA, 567 bp, Homo sapiens
cacccattctgtgtcttttagtagcattgtgtctgcaggagccctagccctggagacatagctgttcagtgcccttatctctctgtagatggatgttgatgcactggaggtctttagcctgccttgcatgctgcctgctggaggaggagagagctctgctggcatgagccacagtttcttgactggaggcatcaaccctcttggttgatggcttgttctgagccctgacatgtgcttgggcactggtgggcctgggcttctgaggtgggctcctggcctgatcagtgaccctccccgctttcctgggcctctcagttgaacaaagcagcaaaacaaaggcagttttatatgaaagattagaagcctgggataatcaggctttttaaatgatgtaattcccactgtaatagcatagggattttggaagcagctgctggtggcttgggacatcagtgggggcaagggttctctgtccctggttcaactgtgatttggcttcccgtgtcttcctggtgatgctgttaggggtctgtgggttgggtgggagagggcctctgtctgatgtac

SEQ ID NO: 577820 - DNA, 233 bp, Homo sapiens
gcaggtcagtagcaggaagaagtcaagagctcgtatgtataccaagtaactctaggatctttggtttgttttttaattttaagttccaggcacatgtggaggatgtgcaggcttgttacataggtagacatgtgctgtgatgtttggctgcacttatcaacctatcgcgtaggtattaagcccagcatgcattagccatttttcctgatgctattgaaacttctaaaactagg

SEQ ID NO: 577821 - DNA, 264 bp, Homo sapiens
ctgatgcctgacgagttgtcgggcggcatgaagcgtcgtgtcgccctggcgcgagccatcgccctcgatccgcagatcctcatgtatgacgagccgttcgtgggccaggacccgatcgccatgggcgtgctggtgcgcctgattcgcctgctcaacgatgcgttggggatcaccagtatcgtggtgtcgcacgacctggccgaaaccgcgagcattgccgactacctttatgtagtcggcgatggtcaggtgctggggcagggc

SEQ ID NO: 577822 - DNA, 1451 bp, Homo sapiens
ggttgacttggtgatggtgtacacacgggtaggtgggctacgaggcatgagactgcggagaatagggcgtgcgtcctacttcgcgatcatccgagtttccgtgcgatgaccgcgaggcgtccggcactgggggtcctctcgttctcgtattgtctcagggagagcttgaaaaggtcggccaagtccaggtgcctggtagactgcggtttggggtgagcggtcatcaatgagcgacgctgagcacgttggcgccttcgcgcgtctaaggagctaccttggcgcagaggaagtaggtatgtcttggagaaggcagagccgttggcacaagcgcggactagatgcggaagattgcgcggtcaagcgcacgcgtagatgggaagacccgccggcagcgaaagcccccctgtccatgtcgcgaaggcagcggaccatcagccgaggaggggcatcgagccgacgcatcgagataacgcgagagcgagaaacgcagccgagtatgtacccacggtgtgcaataagcgtgttgcacacgtcctcacctgggtggcaatttgtctatcgggagaacacggccatgtcgatgggctccgaagcacgcgatgctctaaaatgcccctgtcgtatctttacttgacagaaccaggacgtccctgccatgtcgcttagctaggcaagaagcctcggtgacaaagctactggcagatgctggctggtggtcagagaagctcgtggacgccgggtgccatccttggcaagttttgcaccccactgtagacgcttagcaagggcgaaacggggccccgttaaccgtgctcacgggactcgctggcccgttgggcccagcattcattcgcaatggcgcattcgaatcgaaaggcaacaggttgggaaagtgcccgttggggcgttcacttaagcaagaaaagggctttcgtcgggacggcattggggaccccccgggaggagaacggacggaaccaatttacacgaggttccccaaagggccgttcaaatggaagtaaggccgggaaggcatcgaaagcacttggcagcgggagacgggggccaccccaagacccccccaactgggggaaggggcctgtttggggaccagcgcgttcccggaccaaattccgaccggcgcccttggtttgggcacgccagacgcccttggcggtttccaatggcagcgttttgggctttcggagaccctagatgtaaacacaaatcccccagaatttcagagacggggtccatgtttccggggacatgaatttcggcgtgttggcacaacaaaccccttgttggaacctcccgggggcacagagccccttcggaaaaggatcctggtcacaagtcctactaccacgagggggaccaccaggagtgccccgcaacgatgcaaccgagaaccccacaatgtgcatagagggccagagcccaaccgtatc

SEQ ID NO: 577823 - DNA, 732 bp, Homo sapiens
taaatcgaaggtcccttacgggtcctgcttccagtgatttagccgttgaccagggaaaaaggggaaaggaaccagccggcacagggaggggtcatctccacaacatcccatttatacacagaactaaacagacaacgcacagagtcactatggcggttaaaatgtgggcagcaggggaagggggaggaccagggggggaagggggatgtggtaaaaaaaatacgggctcccccacaatgggggtgccggggggaaactgggtctgtttcagcccaagaggatttcaaaagatcaaaagcagttggggaaggccaaaaccgtcaagggatggcagggagagggaaaatccagggggtggggggtctgttgggcaacgggggtgaagggatggccctccccttgtggggatcccccaagcccctcgggtctgggcaggaagggcgcagcctgaaacccccaggggcaggtgtggggctgccaaatgctccaggcagggggccaaaagggggctcacaagggctgtgccctccagggagatgacggcatggcccccacagttctcggccagggtgcaggggtcctggacctccctcgaagaagttggctggcactccaggctggacacccggttcagctatctcctgagagggcgtccctgggagccggcgttaaactcatgtgggtctaaggggcggcaaaactcgggggcccagaagaataacccccagatcc

SEQ ID NO: 577824 - DNA, 1476 bp, Homo sapiens
gatcaaatccatgaagctgatacgacagagaatccgagcggtgtctctttcgacaagacttcagcctacctggcttgctctgtccagaattgcaggtctttgctaacagggcagtgctttcaggctacaccacggaaaacctacctatacttaagcgggcagttgcaggagatgcctctgagtcagcactcttaacagtgcactagacgctgtgactgctggcttccgctgaacggagactgagagacacagactacgccaaaactcgctcgcagatacccttcaaactccaccaagcaacgtaccagctcgatctactctcactaacgaaccccaaccacactcggaggccccaaccaccgtgctcggatgactgaacgcggcgccccacgaaacggactcctagcaccgcattgcagcatcatattcctcctccacggcacaggacgcaagccaccatcgcactgacggaccgctgacccccaccgccacttctccacgacacgcccctatccaggaaccctgccgcgacggccctcgcgcagcacaccgacgcccccctacgagtatactagcacaccctctccaccatgcaccaacgaattgacacccacgcattacccttgccacgcggactcacccacgcccacgcaccacacatgcaccgcaaccagatcgcacactacaccccccatacctacggaaccacactcctccgacgcacacaccgaacagcgcgacatccaatacctcccagtagccacacggaaccaccatacccaacgcgcgaccgccgcccgattcccctgcactgcccccgcagacgcccacccgccccgcacccctgcccacacaccccccaacagcccacaccctggccccaaccagcgaacaccctcaactcccaaaacccaccccgcccccacagcgctcacacgacacacaccgcgcgcacgcgcccaccccacacccaacaccaagccacccgcagcaccccgctggaccgcaccacttgaggagagagccccgagcccacgcccacaccacctcccccaagcctcacgacccaccggcgacaacacacccagcggccacagtgacacaacggcccgggacccgacaccgaacaccacggcacagaacagacaccaacaaggacaacacacacccacacgaacccccaccacgccaagcacacttccgcgaacgtcaacacaccacgcaacaacacacccgcagcccaccacaacccacaccacaacacagaacacgcccacccccacgcggacacagagaacgcacaacacacgagcgcaccacccgaagacccaacacacagacaaccaacgcgatcacacccctccacgcactcgccgacaccaccaccgacgcccacacaacggcgagcccgaaccacaagcaacacagccacgacacacgcacgcacacccgcccgccgagcgcacgcagagaccc

SEQ ID NO: 577825 - DNA, 293 bp, Homo sapiens
ttccatctgattcatttttcccatcctcactgctaccatcttgggccttctttatcatgtcaaggtagattgcttgagcccaggggttcgagaccagcctggccaacatggcaggactcccatctctacaaaaaatacaaaaatttgctgaatgtggtagtgcacatctgtagtcccagctactcaggaggctgaggtgggaggatagctgaagcctgggaggttaaggctgcagtgatccgagattgtgccactgccctccagcctgggcaacagagacactgtctcaaaat

SEQ ID NO: 577826 - DNA, 305 bp, Homo sapiens
  misc_feature (15)..(15): n is a, c, g, or t
  misc_feature (19)..(19): n is a, c, g, or t
  misc_feature (144)..(144): n is a, c, g, or t
  misc_feature (171)..(171): n is a, c, g, or t
  misc_feature (185)..(185): n is a, c, g, or t
  misc_feature (204)..(204): n is a, c, g, or t
  misc_feature (232)..(232): n is a, c, g, or t
  misc_feature (297)..(297): n is a, c, g, or t
agttcggcacaggcnggtngctgacccgggtgagaggttcccgcggctcagggaagatggcggccgtgcgtgctggctgctgggttgcgcgcgcagacgccgtggcgcacacgggggtgcgcggggggcaggtccgaggagctncaggtgtgactgatgggaatgaagtgnccaaggccagcagnaactcctgggggagcagcnaaccatcttctcccggatcctggacaanaagctccaagctgacattctctattaggacaacagtgtcttgtgttccgtgatgtggcccccaangttcctgt

SEQ ID NO: 577827 - DNA, 131 bp, Homo sapiens
  misc_feature (41)..(41): n is a, c, g, or t
  misc_feature (49)..(49): n is a, c, g, or t
aatcccgtaaactgttagtccaaggggaacacttggacatnggaaaaancttgtagagagagtaaaaatttaacaccctagtaggcctaaagcgccaccattaagaagcgttcaagctcaacacccatacc

SEQ ID NO: 577828 - DNA, 449 bp, Homo sapiens
aagaaagattcatgtcagacaaatcaggggatgggtaataagaggccagggagaaagaaagaataagggatgactgatgttggcctggaggtgacaagtagaagggtggaaaaacaataatgagaggtcagagaggggaggtgacagactaaatctaagatatgctgagattagagtagcaacaagatatccaattagctccgtcatgcaggcatttagaagggcagaagcaaggtcgggaaaagagacgtgtataaagaaatcccagcacttggggaggcggagggggatggatcactggaggtggggagttggagaccagccgggccagcatggcgaaaccctgtctctactaaaaatacaaaactgggccaggcatgggggcattctcctggggtccgggctactcgagaggctgaggcaggagaatcacttgaccccgggagggg

SEQ ID NO: 577829 - DNA, 174 bp, Homo sapiens
gaactgcagaataccaggcagagtgttcccatttcaatagcgaagcttgcgagcctggaggagctgaagagacaggctgagtctggatgggaagtctggctaagcaaaatctagtacaagtgctacggccataataaaagaactcaatgagaagatcaccaccaggtgattctt

SEQ ID NO: 577830 - DNA, 282 bp, Homo sapiens
  misc_feature (80)..(80): n is a, c, g, or t
  misc_feature (166)..(166): n is a, c, g, or t
  misc_feature (182)..(182): n is a, c, g, or t
  misc_feature (186)..(186): n is a, c, g, or t
  misc_feature (211)..(211): n is a, c, g, or t
  misc_feature (219)..(219): n is a, c, g, or t
  misc_feature (224)..(224): n is a, c, g, or t
ctgtctatcagtagtccatccgcaccgacgccgcctgttcccccgtagtcccctcccatccattttccttccccgtactntgcccaacgttcgcttctctcctggctatcttgcctagcaagcacaaccgtggtcgcgcaaatagtctagcaaaaaagaaaaatcnccggttattgatgtantagntttgtgtatgtcttttccccagttntagtttcnccttncacagaataatcaggaaaagtgtaaaaattcaaaagtgaaataaaaattttatcagtt

SEQ ID NO: 577831 - DNA, 163 bp, Homo sapiens
agccactggcttttcctctccacttcgagaaagtatggagttctggcctgtaaattaggtcattaaccacttcaccttgaaaggagaaaaacacgaagagcttaagcggtttatctatgctcttacagctctttagtgtcaaagcagtgggttcacctaaaaa

SEQ ID NO: 577832 - DNA, 490 bp, Homo sapiens
  misc_feature (16)..(16): n is a, c, g, or t
  misc_feature (47)..(47): n is a, c, g, or t
  misc_feature (75)..(75): n is a, c, g, or t
tttgtgcccaaaaagnactgtcccctattaaaacctgaaaaccttcncccttacccgggaacagtgtttttctanctgttttaaaaccctttaagtgaaaatttcagtggattttgagctgggtggttacaaatatgataatgcaattattaacctgattagttgcaggagccattacttgacattagggaaatggggctttactagcaaaatgttcacaaaatcctttgcttccatggtggataaaagtggaaaatgtccgggcagcccagctttgcaaaggctctcgtggctctgcaggcacctggcatgcaccctccccattgccaggatacccaagaggaaggttcagctctgctgaaggggccaccaaggaagagcccaagaggagactggtgcagttgtcagctaaacctgctcctgcaaaagtggaattgaagctgaaaaaggcagcagcgaaggataaatcttcagacaaaaaagtgcaaaa

SEQ ID NO: 577833 - DNA, 215 bp, Homo sapiens
gcaccatttaaatacagactttaaaaaactccacctttaccctgtaacactgactagatccttgcttcatgatatttctaaaactaagcatatccttcatattttcaactaggtaattttagaagtagatactttaaaaatgaaccactacttagtaattagtggttcatttaaataactcttcaggacactgaaccaagcaggtagagtccagg

SEQ ID NO: 577834 - DNA, 126 bp, Homo sapiens
ttctcctcctcctaggtggtgtttaatagaacttctatcagtcttgtggatctgaagatacagcaattgtacgttggtgcccgcaagtggaagagagagttaggctttcagttggaaccctgacaa

SEQ ID NO: 577835 - DNA, 144 bp, Homo sapiens
tatgcaagaacagttagaccagtcagctggttgctcctacattcagtggctgagcagtgggagctgcagaccagtcttccgtggccgactcagccgctccccaacctcatatagagggcacgtcccatgtgttgtatctgaagt

SEQ ID NO: 577836 - DNA, 233 bp, Homo sapiens
ctgagtagctagaactacaggcgcctgcatcatgctcgctaatttttgaattttagagagagggtttgccatgttccaagctagctaaattcctggctaagcgatccacccaccttgcctccaactgagtgctgattacggcgtgagccaccactcccggctgcatgacgatttgattccagaggcctagctctaaaatccaccctctggcagatgttgccggtaccgagctc

SEQ ID NO: 577837 - DNA, 359 bp, Homo sapiens
agacgactccaaagcatacatcaacaccaagatcaaacggacaagaatacctacaagaaacacggcaacacactcctaaaacaccaaccggacctagttctgtagaagacattaaagcaaaaatgcaagcaagtatcgaaaaaggtggtatctcttcccaaagtggaagccaaattcatcaattatgtgaagaatagcttccggatgactgaccaagaggctatacaagatctctggaagaggaggaagtctctttacgaacctcgtataaacaataagaaaaaaaataatccgtcttatcacataactgtaacagttgatatctggctgtcctatatataatgcagagtgagaactac

SEQ ID NO: 577838 - DNA, 116 bp, Homo sapiens
ggcatgagcatcttacagcaaatgggtggtgagtggtggacccacagtgctcaggagtgctgagatgggccatgtgcgcacattccatttcctgagagcccgcatagtgcttgcca

SEQ ID NO: 577839 - DNA, 104 bp, Homo sapiens
tctcctctggtatcccacctgagactatacatgtagctcaccaatgaggagaaagatgctctatcacccagtgaattcccaggactaggagctgtgtcagatgc

SEQ ID NO: 577840 - DNA, 437 bp, Homo sapiens
  misc_feature (13)..(13): n is a, c, g, or t
  misc_feature (394)..(394): n is a, c, g, or t
ttttctgtcacanagggctcaaaggtttttgtaaagaaaatagaaagctacaaagcagctgttgagtggtatgtgtctatgagtgttttcagcagggttggagacaatctacttttcattcagggctactctaaatgagatcccctgtgttctggacaggagcttagacactgggggacaggtggacaggtcactttacagtgatagatctggtgatagctatttccaaatgtcaagcagtatgccgtttttatgctctgcaggttataaaagcctgttcattgtgaaccttgtaacactgctggttatttctaattaaattatcagatgctaacatgctcccattcatgatttcatgacaatattggcttcttcctgtattggggttttagtntaacatgaataaataccaccatttgaaagctcagtttgttatt

SEQ ID NO: 577841 - DNA, 127 bp, Homo sapiens
ttcatgtcgagcgctttcatgcctatgatttgtggccatgggttctgaatccaggagtctgagagacatgtgacttgaaaagtatgaagcgcagatacattgctccagtatcatgagtaaagagggg

SEQ ID NO: 577842 - DNA, 126 bp, Homo sapiens
  misc_feature (3)..(3): n is a, c, g, or t
  misc_feature (87)..(87): n is a, c, g, or t
  misc_feature (91)..(91): n is a, c, g, or t
aangaaggagatatttatgcagtggagatagttggtggtgctacacgaatcctgcggttaaagaggagatcaggaaatttttcggtnaagnacttagtacaacattaaatgctgatgaagctgtta

SEQ ID NO: 577843 - DNA, 332 bp, Homo sapiens
tggtataggagtgtgtttactttgtaatcattcacttagctgcatacttgtgattagtacaagtttcccatatattgttcaagttaaaaagttaattaaaaacaagtttttttattttgtgggacatggtctcgctctgtcacccaggctggagtgcagcagcacagtcttggctcactgcaacctctgcctcctgggcttaaaccatcttccccacctcagcctcccaagtagctgttgaccacaggcaagcaccatcatgcctggccaattttggtatttttagtagaggtggggtctcgccatgtagcccaggctggtctcagactccg

SEQ ID NO: 577844 - DNA, 162 bp, Homo sapiens
gagaaaggactatattggggcaagagtggaggaagtagaatggtcaggacacgaatgcagtaatccagaatagaagtctgatgtggctggtggcaagtaaagcaacttaatgttttcagattcatgatatattagtattttggagggaaagccatatgagac

SEQ ID NO: 577845 - DNA, 746 bp, Homo sapiens
  misc_feature (41)..(41): n is a, c, g, or t
  misc_feature (162)..(162): n is a, c, g, or t
  misc_feature (176)..(176): n is a, c, g, or t
  misc_feature (226)..(226): n is a, c, g, or t
  misc_feature (316)..(316): n is a, c, g, or t
  misc_feature (323)..(323): n is a, c, g, or t
  misc_feature (334)..(334): n is a, c, g, or t
  misc_feature (345)..(345): n is a, c, g, or t
  misc_feature (365)..(365): n is a, c, g, or t
  misc_feature (385)..(385): n is a, c, g, or t
  misc_feature (389)..(389): n is a, c, g, or t
  misc_feature (394)..(395): n is a, c, g, or t
  misc_feature (399)..(399): n is a, c, g, or t
  misc_feature (409)..(409): n is a, c, g, or t
  misc_feature (417)..(417): n is a, c, g, or t
  misc_feature (434)..(434): n is a, c, g, or t
  misc_feature (455)..(455): n is a, c, g, or t
  misc_feature (465)..(465): n is a, c, g, or t
  misc_feature (550)..(550): n is a, c, g, or t
  misc_feature (558)..(558): n is a, c, g, or t
  misc_feature (567)..(567): n is a, c, g, or t
  misc_feature (587)..(587): n is a, c, g, or t
  misc_feature (593)..(593): n is a, c, g, or t
  misc_feature (605)..(605): n is a, c, g, or t
  misc_feature (609)..(609): n is a, c, g, or t
  misc_feature (639)..(639): n is a, c, g, or t
  misc_feature (670)..(670): n is a, c, g, or t
  misc_feature (678)..(678): n is a, c, g, or t
  misc_feature (731)..(731): n is a, c, g, or t
gtttcaatacatcattagttctgttaagacataagttactnactttcaaatccaatacttgaacagtttcctctgttcatagtttagcagggctaattagcataagatgctatttattaagaggtatatgatgctgagttttaacagttgctgaagtttggnatttttatgcagcnttttctttttgctttgataacactacagaacccttaaggacactgaaaanaagtaagtaaagttcagaaacattagctgctcaatcaaatctgctagcataacagctatagtaattaaaagcgttaaaaaaaagtgttgnaatctgnactagtatagnccgctcctgtnaggataagactgctttggancagaaagggaaaaaacagcnttgngtttnnttgngctgggaggngggaaggntgagttacctggttgcntctccctggtgattggcaggncaggtaaatnccagaacatattccaactcaacaactctaggtaactttatggaggtggaagctgggttagttcatgctaggtggctgtagcactnacctcatntataaaacncaaaacacttaaatactgtnatctangtcttaattgcnagcnatactgaggatttttttttttttttttatnttttggctatactttcattccaaaagaaganctgaattnatgcttgatttacagcaccagtttattattagtgaatgaagtatattcttggnagataaataccagat

SEQ ID NO: 577846 - DNA, 934 bp, Homo sapiens
cttccctgcatctggccttcccttttgtctcagtgggatagatggaattgtgaaatggcatctcccagaacccctgcccgtggcaagctggaatgatcgtgcctgcccagcctcgtcaccagagggactccttggtgtcctggcagtgcatgtgccagcaggtggaaaactctgtgtacctgtgcccaggtgaatgggcgcagggtccgtccgttgcccttgtccctgcgggggggacccacgtagttcctggcattcagcgacttgctcttagcattcgtcggaaggttacttcaacgtgccttgccttttcaccaggccttgccttctagtgtcatgtaggacatttgtaaggttatattgatatggtcgggtattataaaattggcacagaacactaaagaccgaaaaggcgtggcactcttgttcgtccttgaaagctttggcttgtgtgaactgcctttcccacttggtagaaagagcccagaagcagcccgtgggccatgtaggatggactctttcatccttcagatgtattgtaggctttgagtttctctgcatctgtccaccccgatgtgtatataagcccaggccctggctctggggtggtcacctcgtcagtgcctttgtgctggaggagaggaccccccccgctgtcagtgaggtctcttcctgttctgcacccctctccccatgggactttggagaaaactgaactgtacagaccctggacaagtgctgttaacagatgcaagctttcttgatcaagcttggagaccaaaaaaacaagcaaaaaggtggggggataagaaaataccttgagggccagtttcgcggtcacgttttgtacagggcccaaggaagatagaaaggaccagggggtacaagcgtagggaaacgatggatctggacgccctcgggggaagaggacaaa

SEQ ID NO: 577847 - DNA, 1026 bp, Homo sapiens
gtgaaccatgatcacgaaaaaaactctacctctctatacataatcgtccctagcaaaatctccctataagttataacattcaccaggcacagagactaatcgagtagtattatatcttctatcgaaatcacagcgtatatccgccaagctgggcgtatcatcacccgatgcaggcaaccaggcagaacgcctgaacgcaggcacatactatgctattctacaccctaagtaggcgtcccgttcccgctacgtcgatcgccactaattgtacgacgtccacgaatgacccctagggctacattaaaacattctaactaacttcaaccctcaagtgcgccagagaattgatcacagactccgtgtaggccgaacaaacttgaatgatgaagctcagctgtacacgaatagcttctcatagtgaaagatacctcttgacggactccacttaggactccctgaaagcccatgtcgaagcccgcatcgctgggtcaactagtactttgccgcagctactcttgagcactaggcggcgtagtggtataatacgcctcacgactcattctcaaggcccctgagaaaagacataatcataccccttcctgtgtactatccctatgaggcataatgatagcaagctccatctgcctacgaaaaaacagacctaaatcgctcatggcatactcttcaatcaggcaaataggcctcgtagtaacaggcattctcatccaaaccccctgaagcttacaacggggcaggcattctcaataagtcgccacgggctttacatcttcatactattctggctaagaaagtcaaataacgaacgcctcacaggcggatcatgaatccctttcaaggactgcaaactctaatccaataataagcttgtggtgacatcttaagcaagcctggtaactcggttaacccccatatatactatgtgaggaccctgtggagacacaggttcgctgtcaatataagcctagacaggccaataaagcacagccaaacccctaattccacaag

SEQ ID NO: 577848 - DNA, 668 bp, Homo sapiens
ggagtgagcccagcacagatggccacaggcaggcccccagcttcaggcccaagggcctggggcggggtggaacagtcactgggtctcagattctgagactgttgtttagcttacctttctgctaggattggcttcccgcagagggcagggcccatcctaagtcagacttccaaggtcccacaaaggtggcttgtgggaggatttggaaggagctgcattgtgggcggggagtgtgtgggtagggttcgtaccagcaacgtatgactaggaactgagcccagtgaaagggggatgtctgcctggtgtgtggctggtcagctgggacgtgtccatcatcaggggaagatcatacacaggtgcactcagactgcccagggcctctgggacacttgccttgactgtgcacacttgccttgaacgatcgcgagtcagagccagcatggtgctgtggtctctcacacaattgagccgtatgtgactctgttggctctaagactggcgcttgaagccgcctgaggcctatgcatctgagcaagtgggtctctcccttgagcagcaggagtgggtgccagacctggcccgaggattgcccaggaagcccagctatggtctagccagcataggcgttgctagttccttcttggtcagaggtagctgcagagggggga

SEQ ID NO: 577849 - DNA, 263 bp, Homo sapiens
ttggtcgctctgacggatccccggtcagcccctggttgctcctgaggttctgaaggtcggcgtttgatgatcagccgggctcccctggtgccaccctcttctcgtacttcgtactgattacgattagtcgggtgtggtggcaggcgccatgttatccgccactactcgaggaggctgtaggcatggagacctcacttgccacccagggaagtgaaaggtcgcagtgtagccaggacttgcatcactagcactccacgcctggg

SEQ ID NO: 577850 - DNA, 966 bp, Homo sapiens
  misc_feature (44)..(44): n is a, c, g, or t
  misc_feature (118)..(118): n is a, c, g, or t
  misc_feature (122)..(122): n is a, c, g, or t
  misc_feature (124)..(124): n is a, c, g, or t
  misc_feature (145)..(146): n is a, c, g, or t
  misc_feature (155)..(155): n is a, c, g, or t
  misc_feature (167)..(167): n is a, c, g, or t
  misc_feature (193)..(193): n is a, c, g, or t
  misc_feature (199)..(199): n is a, c, g, or t
  misc_feature (201)..(201): n is a, c, g, or t
  misc_feature (205)..(205): n is a, c, g, or t
  misc_feature (210)..(210): n is a, c, g, or t
  misc_feature (220)..(220): n is a, c, g, or t
  misc_feature (222)..(222): n is a, c, g, or t
  misc_feature (274)..(274): n is a, c, g, or t
  misc_feature (289)..(289): n is a, c, g, or t
  misc_feature (293)..(293): n is a, c, g, or t
  misc_feature (298)..(298): n is a, c, g, or t
  misc_feature (309)..(309): n is a, c, g, or t
  misc_feature (312)..(312): n is a, c, g, or t
  misc_feature (337)..(337): n is a, c, g, or t
  misc_feature (340)..(340): n is a, c, g, or t
  misc_feature (359)..(359): n is a, c, g, or t
  misc_feature (365)..(365): n is a, c, g, or t
  misc_feature (374)..(374): n is a, c, g, or t
  misc_feature (392)..(392): n is a, c, g, or t
  misc_feature (403)..(403): n is a, c, g, or t
  misc_feature (414)..(414): n is a, c, g, or t
  misc_feature (417)..(417): n is a, c, g, or t
  misc_feature (436)..(436): n is a, c, g, or t
  misc_feature (580)..(580): n is a, c, g, or t
  misc_feature (680)..(680): n is a, c, g, or t
  misc_feature (689)..(689): n is a, c, g, or t
  misc_feature (711)..(711): n is a, c, g, or t
  misc_feature (857)..(857): n is a, c, g, or t
  misc_feature (882)..(882): n is a, c, g, or t
  misc_feature (910)..(910): n is a, c, g, or t
tcttcacctgcctggtcatcctgtttgcctgtgaggtgccgccngcatctggggctttgtcaacaaggaccagatcgccaaggatgtgaagcagttctatgaccaggccctacagcangccntnttggatgatgacgccaacaannccaaggctntggtgaagacantccacgagacgcttaactgctgtggntccagnanactnactgntttgaccacntnagtgctcaagaacaatttgtgtccctcgggcagcaacatcatcagcaacctnttcaaggaggctccnccanaagancgatgacctcntcnccgggaactgtacctcatcggcatngcngccatcgtggtcctgtgancatgancttcgagangatcctgagcatggtctntgctgtggcanccggaacagcnccntgtactgaggccccgcagntctggccacagggacctctgcagtgccccctaagtgacccggacacttccgagggggccatcaccgcctgtgtatataacgtttccggtattactctgctacacgtagcctttttacttttggggttttgtttttgttctgaantttcctgttaccttttcagggctgacgtcacatgtaggtggcgtgtatgagtggagacgggcctgggtctttggggactggagggcaggggtccttctgncctggggtnccagggtgctctgcctgctcanccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactntctgccttcatgcacctgtcctttntaacacgtcgccttcaactgtaatcacnacatcctgatccgtcatttaataaagaaggacatcaggcatgctaaaaaaaaaaaa

SEQ ID NO: 577851 - DNA, 1414 bp, Homo sapiens
caactgtaccccggctggtccgcgcgggataactatggaaagaagaagaagaggaaaagggacaagcagccgaggagagaccagaagaccaaacacaccgagttaaaacgaagcacgcagggatggtaagactacttaagagtcaaatgactagccctgacggagacagatgctccatggagaaatgcgggcacgatgactggacgaagaccgaacagagtgtagtggtagcaaaccggtgcagggatgaaaaaagagagtgcgttcgttacatacgaaggtgaatggcagctgcctcaagcccacccacgagacaatatataaaggcaaaccaagagaacgactcaccgcgcgccaagcgccaaatacttatggaagtgcgtgggcgaccttgggagaaagagcgcggaacgctgaattggggaggggagagccttttgtgggggctttgttgcccaattgggcgcgcatgggactctctggggggacaaattgctgatggacagaaggaggatcctcacacatttcttgggctggatgctgcactgtggtggctctgcaaggaatgtcgcggcctgcgggctaaaagcacaactttgtgccaaacggatgggcacgccaatcgcgcaagtgcctgcaaatgcgcccattgcggacacatcagctcagaatagaggctccaaacagctgggcgccacgtcggcaacttgtcacttgcgtggccaacaactgtcttaatggcgacggctgccaatctaaagctcttgtcacgccacttttgactttgttcacatttcatatccggccaacaagagcggggcgtcctgccaggcgccagtgaggctctgccaagggcggccgtgcgaggcagccttggagtcgcaaaagggggggcttgccactcgcggtggcaaaaaggcacagtttattttcgaaaattggctacatggcgtaaatccgaatgtccacactttgggctgtcccaaaaaatttttttccaaattggcgcggcaatctttgtggctgcggggcgaaaacactttggctttttaaggggtcgtgccacagttggcgtcaaccgggcttgctgtcaaacattgcgcaatctggtgccaaggaattttatttgagggcgagcacaattttacacaatttactggccaactgtgggcgaacagtgcgggggcataagcggggtgggattttttgtgggcgaatcttgggatgcgccagagatggggggacaatttgagtgtcggggaaaatctgtttccttttattaatttcatagagtattgccttggtcatttgtctatgagagattttcaataatagagtgcttggcgaacacacataatctggggggatggcgataaaggaaaatttaaaacatacttcattgcgggccgagact

SEQ ID NO: 577852 - DNA, 1327 bp, Homo sapiens
gagatggcggacgtgggggagataatcgagggctgtcgcctacccgtgctgcgggggaaccaggacaacgaagatgagtggcccctgggcgagatcctgtagcgtgaaggacatcagtggccggaacgctatttctacgatcctattagcattgacttgcaacaaacgtctggatgcatgggtgacagcatgagcgtgctggtagcctaaagaatgatccagttccccaaagaaagaggccaagatccccactaagacacggactgccatgggtccctgtcctggactctccagagaacgagaggtgacaggcctctggcgcaggctcgagatgggaagaccttgcgcaatcccggtccaagatcacagtccgcattcaacctgtccaaggagacgggatggccatacccggtggcagagcctgaacagtcgatctcctccagcatccatggcactgagagacacagaccatccgacgtcaagcggaaacagtgaaggatggagagctgggttaacaagcaggaaagcatccaggttgaccaagcagaaggaggaggacaccagggactacgagagtatagaaaacgcacaaaaaatgagagcaccgacacggatacggggcaagaggggcgacgacacaacgaccacagggacacggagacgctggacaaaaattcggcaaatccggtcaccggggcacaccacagaattcgaagtgaacgtccgcccagggaaacacgcatacgtgaattgggaaacatcaccctgggaagaagaacacgccaagcggccatagcacttggaccaggccctggggtgctcctagactcgagaacagaccaaacggaacgacacaagtcagatacgaggcagagggcattgaaatgtagacaagtttagaaagagtagaacattatggcagagagcatggggaggaacagggaggaacgggaacaataaaagagccaggagaggtaaagatgacatacaaaatggaataaaagacaaaagaggagaatagtaacgcgcacagaatgtgcgcacgattgagacaatacgtaaagcacaacgatagaagagaagattgacatggcgccacgtccacaaaggtaacggggaagcaggagaagcgaaacacaaaagagggatcgtaacaagaagggagcagtaatggaacccagacgggggaagcaacgaaacggagaagagtgctgcaaggagacacgggacagagagaaacccgggcaaacggggaccacaccaccactgacgtatgagaacaggagcaagaactgaacggacacaaggcagcgagcaccccagcaag

SEQ ID NO: 577853 - DNA, 387 bp, Homo sapiens
cgcacgtgaggcggcactccactctcggcgggccccgggcctctttacgcacgcacacagagctgtctccgcacagttggaggaacgtaggagggacccccacccaaggatgacacttcaggaaggggactgccgaggaagccagaatgtgtacctgacaaagggaacaggcgacagtgatgagatggccccggaggccccacagcacacccacattgatgtgcacatacaccacgagactgtcctgtgcaagatcctggttacctggtggtctgcgctgaggccccgggccaaccaggccaggggcagccggctgttgtgggcctcgtgggtgatgcagcgcgctggggatcttgagtgcgcacctaggaggatttttctacttcg

SEQ ID NO: 577854 - DNA, 354 bp, Homo sapiens
gtgcccgggcagattgttgtaaaagtaggaattccaaaggatgagaaagacagggagaaacaacagccatgatacatcggaagctgatagaagagtggcaaaagtgactttatagagacgctaagacaaactgaatcctaggccagcaagggggagagtcaagcaccagcctgagttacactccaaaatccacctctccccttccccaaaccctaacgaattggtggcaccaaatagcttcattaggggtgaaacagggatatgaaaataagactcttttcgagtacgttcgagaagtagtgggaccccagttccctccacagctttaggtgactgcctttccctcattctggc

SEQ ID NO: 577855 - DNA, 1598 bp, Homo sapiens
cgtccctgtcagtgtttgatcgtgtgtgcctgctttgttggtgttgctctccgtcttctctcttggtggtctgtttggttctgcctgtcctgttgctctctgtagtgcggctgtggtctttcttcggtgcctctctcttttttcggggggttcttcctccctatatttatgggggcttggttcgttgctttgattatgctttggggtgctccttctgtgttgtcctctcccactccagcttgagagggctcggtggttcttatttttccacggggggtgcacctactaacgggtgtcaatctatttcttggcgcccccccttttgcgttggtgtgcccgccccgtgtttgctgacagttggggggtgtcaccccactgtggttagtgttttgttgatgacaccgctctgcttcagatgtgtctcttttcgagcctaataggtcttccttctcttgtcatcaacactaatcacaactctggtgtttgtgagcaatcccccccttgggccaccaataggggtcatagtcctacgattgaggacgctaacctttttgtgtgttatttcccttgtgtcacaggatccttcctattgttcacacacccgtggttccatctggcgccagttttcatctttgtcgccttacccccaccgatagggaacttcgttggcgagtttgggcccccctctccggggggaaaactcttgttgggcggtggttaattggtctccccgcgggggcttctttccccaggagacaattccaatatccccctgcgcttcttacttgtgggcaccctctgcacacagagccttgttggggctaaagagtgctcataccccttggagacttgtttactggggtatagatcttcaccttggcaactgggccctttccccgtgtgcgcaccccactgcccacaacgtgttacacagttggtgggagccctgagactctgtcccgctgttatagaataaatcgctctgcgccagaatattcgagtcgagacacttcacacagagaaggttgtgggttgaaacgcacgggccgtttctggttagggcgccccccctcttatagaggcgcatactcctgggcgtattacacacatgggagacgcacacacagagtgtgttctttctcctctgtgtacatttcttacacacagcgtgtacacacaccccacatctcttctcacaccctgttgtgacacctggggggctgggcgcattgcgccttctcaacgagccccctttgttctaaagcgtcaatttccctggtaatgagccacccgaaatttgggtaacaagccacacagggtgtgtggagccctcacatggcgccacacacatggcgctctcacacaggaggtataagaacccctggaccacccagccccacggcaagagcaccaagaggaagagagagaccctcaactgctggggagttccctgccaacaactcagttcccccacccaccacctgaattctcccctccctcaacacgttgccactgtagaccccttgaagaggggaggggcctaggggaccgcaccttgtcatgtacccatccaatataagtaccctgtgctcaaccca

SEQ ID NO: 577856 - DNA, 1595 bp, Homo sapiens
  misc_feature (282)..(282): n is a, c, g, or t
  misc_feature (345)..(345): n is a, c, g, or t
  misc_feature (1032)..(1032): n is a, c, g, or t
  misc_feature (1102)..(1102): n is a, c, g, or t
  misc_feature (1162)..(1162): n is a, c, g, or t
  misc_feature (1277)..(1277): n is a, c, g, or t
  misc_feature (1383)..(1383): n is a, c, g, or t
ttcctccttccttagtagtacaccagtggtgttgctacgggagctccctgctgagtgctaggtggagacacctcactcttggtctcctcccacgaggggtcttttcttcctccgcgttcgccagaaaatttgtggggcgccccattcgccaactgttgtttctggtcgcacgagaatatcctgctttttcaccccctgggggggtttttcataatagggagtggttatatattctcccccaacgtctcctacttctcgcccgaagatatttggtggggggancacacgccttgatgacacacggggtaccccatccttggtgacccgcgtggttgttgtcgcccngttcgcacacgcacgtagaggggccccacttgaattgccgccccccccccccctggttgtcgcaccccccccgccgcctctcataatcaggggtgaggtataatgaggctaatttaatctttttcccgccgctttgggtaagaacagataaatgagagtggtaagaacaaagggaattataaagtaggttaagcagcctgcgcaactatgtgtcttcttagagagttgaatatttgttgggaggcgcgcccccccacaatatagtagtgtggccctgcccactatcccttctttttttcgtttttgtgtttttgttctacacatagggagattgtggtttggggtgcgaacacccatcgggagaccttttggtgctttattatatagagagtgacaacaccggcggtgatcacagcacgtctggtttttccttcgggtgcttctcaccatcttcgagatgtttgtacacaacatttttcgtcgaaaaaggttttttttgtcttcggaaaaaaaattggttgtctctctcacatggagatttaataagatttccacgcgcgcttattacaaacgcgtgtttttggccctcgcgggggaaacacccctcgctcacggagggacacacacatgcgctcgttggagaggtttcccccacacacgcttccacaggcccacaactttccttgncgcggcacacagagagagaagggtttctataagctttttgttgccgcactcccaccgccactctatgatngagatatatttcacgcgagactcgcgtgttatacttctcggtttataaagagagagcggngttttctataggagagatttcttgggttcccctctcttatagaagacacaccgctctatactctaatataatatgagagtgagctcttgggagaaagcccggtgtgttctcacangaggtgtataaaataatagcctcgtgatattctgagatagagtgcactatcctctctctaaccactctgtttatagcacttgtgattgaatagtcctctccctcgncctctgtggtgtctcattatgtatatttcactatcttctacacctcgcacaattttgggtgctcacaatttttactgtggcctcttgtgttttaactaagtgttctcgctcgttgcacaaaaagaaagaaacactttctctgcctcgaggttttaatttttgtcccaagttaattttaatctataccattaaaaccctttgctatccaacca

SEQ ID NO: 577857 - DNA, 110 bp, Homo sapiens
caggtagttgcgtttcttctcaggtagttgcgtttcttctcgggctcatcagagccgctgccaactgtcccatttcaacaaggggtcttaaaatgaacattcatagaatc

SEQ ID NO: 577858 - DNA, 1530 bp, Homo sapiens
  misc_feature (1530)..(1530): n is a, c, g, or t
agcgggccgcgcggggggcgggcggcgcggagtaggtggcgtgcggccatggccgaaggcgtccccgtgtccctggacggtacttcgtgccacgtgctgctcctgtggaggtctgtccgcgctgccttgccggaattatagtctgtcacaatgtatgcggagatcgtaggattagaggtcgaggcagcttcctggaagatgaccgaggagcacgggcaaatgggttcttgccccgcttccaacatgctccccacgagagccagatgcgcggcctacctgctcggtgatgccccgctggaccgagtctcctttgtgcgtcggcatgcgccgcaggtggcttgctgggacaggtttgtgcctttcgggcgagtcttgcgacttgacctagcttctcgaaggagtccccgcgacgttcctcatccctggtgggctgcggtgtgccttggacggaacagagccagtgtatacgcgcatggaaggatagccccgggaccgtgaacgaacgacgatcgcattcgcgttcgcacagggccatcccgtagatactggtcggcgcccgggaacaatgacgccccccaggagaccccatagctagtatcaaagcagcactagtcccggtgcggaggcacacagaccatggggcctgagtccacctagaaaagggccttgtttcccccagcaaccaggccattggcggaaaggcgcgactccagtccacaaagcctaaggccttctggatcacagagcggcgcatgtaccaggtccaatcgtggccctgggccacacgcagataacaacccaatagccctttggtagcgccccccttggagcgagacaggttccctatagcccagcctccgagaagcacccctttattgcgacagccttaacagccactagggagggtggtcccccaacaatctggggcccacttggtcgcaatttgctagcaatttggaagttcctaacccgagcaacggacttttcgcgccttccaatattccagcggcttttgcggcacacagcaccacagaggtgaggactccgccccacaacataacgctagggggaccacggcaaaactaactcagggacagcaaagagtaatttccccaaggaggtcgcgcagatacaccacccacagaatccaggattcccgcacgcagacatccacaagctttgcagaaggcagaacgccacacaggcattaggggcgtctgcccccggcgagccgactccggcagcagtgtatccgccctgtagttggtgtgtgccaccaggcgcgtactgcgatcctatagatcgctctgggccttgtcgtgtgatctgtgacgccaccggtatgtgccgccggctgcatcaccttgaggccccccttgtcgcgaatgccgcacagccggtgtgtctcccacatgggcaaacggtgggcgtgtccgctctctcgtgtgtgcccgcgttgatccgatgtgcgctgcccggcccggggacgcatcggccgtgtccccctcgggttactggccggcagaaccn

SEQ ID NO: 577859 - DNA, 742 bp, Homo sapiens
gacagagtgctgacgtccggacttcggagcgggaagtggctgctgtgcagcgattaactggacgagtcaaatatgcgtgcaggtaggacgaaacgtcgcaagacagagttctgcatttgagtcgacagttgtaacctcagttgcacacttacgatctgcctatatgcggaaggagtccagaggtccgatccaccatgtaccctttgggggagcccccaaaccgttggttcttaccccaatggggttctcttgtagcgggggcccgggaaccgatcagagcgtccatgggagactctcggcctttaggaagacaattagagtcttccctttatacaacaacccaagaggcactccgtggcgctcactcatacttttcaaaacagcggcaattaaccccgaagaaaaagggtgccccaatcttccgtagggtccacttaaggggtgaacaataagatgggggagaaatagagcgaaccaaggtggttcacattggtctgcaaagtggttacaatctttaatgttggggcaaaggggacaattttccccaagtttgagaagagtgcaggaaggtgttatacacctataggtttcgtgcgcagctttggaggggaccaagtgttgaggacgaagaacgttagttgttggttaacttagagcgtggataagtgggtataaaccgggcggagccaaaatttgtgatgagggagcggataatatccgagggaaaaaaatatgagtcgtg

SEQ ID NO: 577860 - DNA, 124 bp, Homo sapiens
tcggtaccctaatctgcatcatggtgcagttgtttgaaaagggctatggcaggatgctgctgcattgccatggaagccattgcttttgcacgtaaccaaggctttgacgtggtgctggtggaca

SEQ ID NO: 577861 - DNA, 381 bp, Homo sapiens
  misc_feature (41)..(41): n is a, c, g, or t
  misc_feature (104)..(104): n is a, c, g, or t
  misc_feature (133)..(133): n is a, c, g, or t
  misc_feature (374)..(374): n is a, c, g, or t
ccctgctctggccctaaactgcctttgggctttgtgtaatnaaatcttaagtcccttggcggttttttccttttagatttttttcccatataaaatctcctatncttgccacacatggtggccgtgcctgtanatccagcacgctgggaggctgaggcgggtggattgcttgaggcccaggagttcaagaccagcctggccaacatggtgaaaccccatctctactaaaaatacaaaaatcagtggggcctggtggcgtgcacctgtaatcccagctactcgggaagctgaggcaggagaatcgcttgaacctgggaggcagaggttgcagtgagctgagaataggccactgcacttcactccaggatgggcgnaaaagtg

SEQ ID NO: 577862 - DNA, 692 bp, Homo sapiens
agcgtgtggctgtaatcccagctactctggaggctgaggccggagaattacttgagcctgagaggcggaggttgcagtgagccaagatcgtgccattgcactccagtctaggtgacagagactccgtctcaaaaaaaaaaaaaaaaaaaatttaaatgattttgggggggtttgcctgtaactcccagcgaattggggaggctgaggcaggagaatcactttgaccccaggaggtggaggctgcattgagccgagattgcaccacttgcacttccagcccgggtgacagcaagactttgtctcaaaaaacaaaaaaaccatcctctgcaaaagccaattctcagtatctcctaaaaccttgctgtttttggctggttttacaaactctgactcagtgaataaacctctttatttttacacaagaaagagggtgatatttctgatagaatgttttctgacgaggccatttgggttacctcccttccccagaactgtactggctgagttatatggctaaattctgctgccatttttctgggatgtgtggcttaacctagaattatattttcaggcatccgtgtacaaggatttgcggagaattgtttgacgatggagtgggttttaccctttcaaagtcagcctgatcttttgggagacaacgtctgtgatacgttattcggattgagagtaga

SEQ ID NO: 577863 - DNA, 270 bp, Homo sapiens
  misc_feature (2)..(2): n is a, c, g, or t
tnatcccaacacacctttcatagcatctcagaaaaaaaaaaaaagggctttggagtggcagaagcaccaattaccggtaacaacactagcaagagggcaagaattttcttctaccaccggtaaccatttttaagataggaagatagttaccagtaataaaactatcccagggattttaccagtattgtatctactcggggaagaatcaaaggtaactttccatttatcgtggggtgggggcgataaccatcaggggtacccggagctcga

SEQ ID NO: 577864 - DNA, 185 bp, Homo sapiens
tctacaggatctcatggtcgctcactgatatgccaggggtagatgcgaatatatttgccaccgaccttccgttaacactgacgccaagccggtgaagcaaaaaccatgaaggatcaacgttgaacggagccaagcccttagtgaagaagtagaccaactcctcaaagtcataacaccacacaatt

SEQ ID NO: 577865 - DNA, 305 bp, Homo sapiens
  misc_feature (43)..(44): n is a, c, g, or t
  misc_feature (203)..(203): n is a, c, g, or t
gatctaaggatccgcggcactgcttcggatgtggctgcagccnnatccccgccctgaaggctgcgtccctccagtgcctcgcagattagtcaggatgcccacttagcactggccacggggccttgctctgtcccgggtccactctcatccccgtgtggtgatggacctctgtggacaaatgcttttattttatttattttttngagatggagtttgtctctcgtcacccaggctggagtgcagtggcgcaatcttggctcactgcaacctctgtctcccgggttcgagcgattctcctgcctcgg

SEQ ID NO: 577866 - DNA, 140 bp, Homo sapiens
acctgtagcattaaagtgctgatttttatattttaaaagacgaacgaatattgcgatatgattcaaatcgaatgtatttggatttcgtagacgatagaggcagagttaaaaattccactacactatggataaaaagtgca

SEQ ID NO: 577867 - DNA, 346 bp, Homo sapiens
  misc_feature (43)..(44): n is a, c, g, or t
  misc_feature (203)..(203): n is a, c, g, or t
gatctaaggatccgcggcactgcttcggatgtggctgcagccnnatccccgccctgaaggctgcgtccctccagtgcctcgcagattagtcaggatgcccacttagcactggccacggggccttgctctgtcccgggtccactctcatccccgtgtggtgatggacctctgtggacaaatgcttttattttatttattttttngagatggagtttgtctctcgtcacccaggctggagtgcagtgagccaagattgcgccattgcactccaacctgggcaatgagtgaaactccgtctcaaaaataaaaaataataaaataaagccgttcaataaggagaatttgg

SEQ ID NO: 577868 - DNA, 335 bp, Homo sapiens
tctgctctatgaattaactagaattaactttgcactggagagccagagctaagaggctcggaaaccagactagctaccatctgaacacgtctatgagagcacacccttctatctcgcagaatagtgggaagatttataggttgaggcgacaatacctaccgagacctggtgatagctagtcttccaaaataaactctctagtcctaactttcaaatttgcccaactgaaccctctaaatccccttggtaaatttacctgtttgtcccataaaggaacacctctttggacactaggaaaaaaccttgtatagagagtgatctattttacaaccatt

SEQ ID NO: 577869 - DNA, 579 bp, Homo sapiens
  misc_feature (149)..(149): n is a, c, g, or t
  misc_feature (154)..(154): n is a, c, g, or t
  misc_feature (169)..(169): n is a, c, g, or t
  misc_feature (199)..(199): n is a, c, g, or t
  misc_feature (253)..(253): n is a, c, g, or t
  misc_feature (273)..(273): n is a, c, g, or t
ggctcctcacgcctgttctcatgatcatctgcgtagcagaagcctatggagttccgacgagaaaggcaactggaaatccctttgagtaaacaagtccccagaagagggagagcataggtgtgaaaaataataattctaccatctaaatnccatntctcagccttagttnacacaggtcagaagatctgtcatttgattnaagtcacttccctgggactgagaaaagattgctactgtactcttgaagggtgantctactccactctgtagtanatgcctccacatggtagatcccctcaaattgggtcatgtatctctcctctgccctcaacccttgggttatatcacccatttatagctttcaaaatattggagacaccatggtttggaaggtaaaacaatagcaatgagagacacctgtttatcagtagagcaattaaaaacctagctggtgaccaaacctgcccaactctatgtatataagttttctatcactatataacaaattaccacaaatttagtggcttaaaacacataaacggtggggttatcaaatgagagagggtgatgctcagaatc

SEQ ID NO: 577870 - DNA, 211 bp, Homo sapiens
  misc_feature (34)..(34): n is a, c, g, or t
  misc_feature (39)..(39): n is a, c, g, or t
  misc_feature (55)..(55): n is a, c, g, or t
  misc_feature (78)..(78): n is a, c, g, or t
  misc_feature (86)..(86): n is a, c, g, or t
  misc_feature (93)..(93): n is a, c, g, or t
  misc_feature (115)..(115): n is a, c, g, or t
  misc_feature (124)..(124): n is a, c, g, or t
gggagtattaaacatgcatcttagtttttatttntacanaatggtccaaattttnacttacatataactttccaactntgtaagtnttttgangcaattatgtttttcatttggnttttttggngtgtcattttcttctatactgtacagctgctttgtttctttgcaatgcattgtatggctttataaatgataaagttaaagaaaactc

SEQ ID NO: 577871 - DNA, 197 bp, Homo sapiens
tccgtcacctgcgcagtagtatagctgtggtcagattcagtcccttgtccaggaacttccatgagccgtggtgctgcattaaaaaaagaagaagaagaagaagaagaagaagaagagaagtatcctgactctctgtgtggcaggggagtggtggaggggaacaagagcaataggatgattcgtcctatgtgtacagt

SEQ ID NO: 577872 - DNA, 863 bp, Homo sapiens
  misc_feature (21)..(21): n is a, c, g, or t
  misc_feature (107)..(108): n is a, c, g, or t
  misc_feature (111)..(111): n is a, c, g, or t
  misc_feature (127)..(127): n is a, c, g, or t
  misc_feature (253)..(253): n is a, c, g, or t
  misc_feature (266)..(266): n is a, c, g, or t
  misc_feature (487)..(487): n is a, c, g, or t
  misc_feature (550)..(551): n is a, c, g, or t
acagtggctgactgttcttgnggatgaaacaataaagatctatgaccctgcttgtcttactattcctgcttgagatacactaggggggggggagacagaggatattnnctnaaaaactgtctaacancaaataaattaactatggaaaacatagacattatgcttttatatgctattcagatttcaaatctttccaatttaccctggaatcaggtttgagggagctgataaagactttagcggagtcggtaancctgatacataanccatatttaaaattctaagaaataattaatgggatgatatatcttggggtatctattaaaatggctctgggtcataaaatggattaaaatatgggagatcagtagggtatacttatatagatagggatatatttcatttttaatttggcattgttgggggaaaatataatcactgggtgggataaataaactatctattgatcatttatcattttaagaangagaggggggggggagggggggggggggggggcgaagcacgaggcgaggggagcagacgagcnncctcggggcccgtggcgcaaaggggggggttttggggcgggttcctttgaggggggggaaatagaggaccccgggaacgaccccgggggccggggggtagggggggggaggggggttcacggccctaagggggggtaggggggttccccaaagtggggaagacgcgcagagaaaactggggaggaaaggcgggcacaaggcggcaggagcccggagaagggggcgtggttggggtgtgttcataagggtcccccacgggcggaaggagcaaaaaaaggcgggttaagggagagggggggacccgcggggagt

SEQ ID NO: 577873 - DNA, 293 bp, Homo sapiens
agtgtcttctcaattatttaatcagtgtatgtggttttcatagcagaggttttattttttttttcccccatccttgtggtaaaggtcaatccctaggcatataattttggtagctatggaaaatagaaatttctccctgggttccttttaaagctagttggtaacgggtatataaaaacataactgatttgggtatgtggatttggtgccctgaagacactgcccctgcccagttgcttggcggaatcctttaaacatcaggaagtgtgaggctactagcttggtccttttgg

SEQ ID NO: 577874 - DNA, 953 bp, Homo sapiens
  misc_feature (591)..(591): n is a, c, g, or t
ggaataatcctcacagtctagaggtcacatgatgaacacagatgttgatgtggaaggaggtgggtgatagaagatattggatcccgttgatgggtggtctaccaacggagataaaggagaagagctgaggaagtccttgctagcactgagtgattctccggctcttcgtggatgaccctttcaacttttaagatcgagtcagaaatttgattgcaagaagagagactgggagagtcccctgtgcttcactaatccttgtcagtgaacatgggagcagcataggaagccaaatgcagcatcgtcacgtttaaagagacagctgcctgggggtccagacgatttacaagccaaaccgggaaacgaggtgcgaaaggaagcaggtcggatatgcacgccaggagatgctggtcccctaaaatgtgcccttaggaacctaaggtggggaaccaccatagcccagtaggtaagttaacgctagagtgcatgtcctcaggtgacgatcattgcacacgtgcacaggtgtcaagcaacaaatcgttctcagagagtgtgtcctttcagaaatgaaaggttcatgtggggaaaaggggngtttcttggtagtgaacacttttcaaagtgaaaatcctgtttacccataatttgacctgtttatgaaatgaggttatcacaagttgggcagtaggtctttaggtggtggaccatcggtgtgtaggtgagatcatatatctcagaggtgtatggttggttaattggcaaacggtcttcaggtacggaggactaaggttcacggttgtaccaaatgggggtgcaagttttttacaaggtaccagaaaataatcttgtgaaggggagaagaggaacgcgaggaatagaggaaggagacaacagtgtagtgtttaaaaaagaggataataagtgggaaagtgggagaggggaaatataggagaagc

SEQ ID NO: 577875 - DNA, 253 bp, Homo sapiens
cgcgttattcttacgcagtcgcaatcctattctatagatcatactaagctataaggtttacgacctcgaattcttcgatcaggcacatcccgatcgtgcagccgctattaaaggttcgtttgttcaacgtcttgactgctacgtgcacctgcgttcagaccggagtaatccaggtcggtttctatctacttcaaattcctccctgtacgaaaggacaagagaaataaggcctacttcacaaagcgccttcccc

SEQ ID NO: 577876 - DNA, 97 bp, Homo sapiens
ccacacctttcctcccaaatcgaccccctctgccaatttcgctctttattcaaacagtgtgcgctttcgcttatgattccacgtcctaaattacgtc

SEQ ID NO: 577877 - DNA, 117 bp, Homo sapiens
ccagctcaattccacacatctagtttttcaatataaatactttttctaccttaatgataatgactccttaaagttccattttgctacatgacttaatacactagtttcgggcatggc

SEQ ID NO: 577878 - DNA, 307 bp, Homo sapiens
tcttcaagtgatgggtggtggaagcagctattcctccagtgctcctgaggggctgtgcaccttggcatcgatcgcccgcttggtccccgttgcaggctgactggaaaaagaggctggctggtagaccttaagccgtgactcctgaaggctagaaacagggaggcggggggcgtcgccagacggagaagccacaggcagcacggaaggggctgtcgggaatgtgttccgtcgttgaacttgactgagagcttcgtagtcacctggctccgtggaccacataagccacaccagcgcatcacctgaaggt

SEQ ID NO: 577879 - DNA, 211 bp, Homo sapiens
tatacctaagctgtctcttatccgagttaattcattatgcacaaggatatagaggtaagtcccaggtatataatgcttggtaatgattgagagtctttacctactggtagtatatctgcgtgcgagtggtgtcaatatccataggctatccgcatatttaggtttatggattggagaaggctgtgtgccagaaactcagagtgagtttgcg

SEQ ID NO: 577880 - DNA, 353 bp, Homo sapiens
  misc_feature (55)..(55): n is a, c, g, or t
  misc_feature (58)..(58): n is a, c, g, or t
  misc_feature (64)..(65): n is a, c, g, or t
  misc_feature (72)..(72): n is a, c, g, or t
  misc_feature (108)..(108): n is a, c, g, or t
  misc_feature (180)..(180): n is a, c, g, or t
  misc_feature (182)..(182): n is a, c, g, or t
  misc_feature (217)..(217): n is a, c, g, or t
  misc_feature (247)..(247): n is a, c, g, or t
  misc_feature (254)..(254): n is a, c, g, or t
  misc_feature (256)..(256): n is a, c, g, or t
  misc_feature (264)..(264): n is a, c, g, or t
  misc_feature (300)..(300): n is a, c, g, or t
  misc_feature (325)..(325): n is a, c, g, or t
  misc_feature (335)..(335): n is a, c, g, or t
gagagagagagagagagagagagagagagagagagagagagagagagagagaganacnctcacnnggggacngcatgcacgcaatgctagctgcccctttcccgtccngggcaccccgagtctcccccgaccccgggtcccaggtatgttcccacctccacctgccccactcaccacctntnttagttccagacacctccacgcccacctggtcctntcccatcgcccacaaaaggggggggcacgnggggcgngnttagctgnatctgggagggagcagggtgagggtgggcgacccangattccccctccccttcccaaatanagatgagggnactaaagttcgtcttcgg

SEQ ID NO: 577881 - DNA, 289 bp, Homo sapiens
gctataattgccttgggatggatctgcatggcatcctaactccaccgctatttatgatgacccatttacctcacgttagcaaaaatgtgaacgttgcgataagtcacactaatcctggactcggtggctcacgcctgtcatcctgccactttgggaggttgaggcgtgtagatcactggaggtcaggactttgcgaccatcctgggcatactggtgaaacctctttcttctatcgaagcaaggatacaattatccggggtacgacctcgaattcgttgtcatcgttcta

SEQ ID NO: 577882 - DNA, 335 bp, Homo sapiens
tacgtcgctgtgccatgtagccccacctatctggtagacactccaaacgatctcttcctttctcttaacgttttctccacacacaatactctgtctagccaaagatgatgcaggcccttgtaactgctccctagggcctctgactcttttttttttttacttttttttttttttttgggaaacataagtctcacttggtcgcccaggcgggagtgcaggggcacgactcccagctcacagcaacctcggccctccggggttcaagcaatacatccgtgcctcagcctcccaagttaccttctgtggcacgcaacatcgccgggggaccctctaaa

SEQ ID NO: 577883 - DNA, 306 bp, Homo sapiens
ggatgtctgcacccctcctggcgggcgtggcaggcacgtcgggtccgagtaccagttgcggttcacctgtgtgggcttaggtccggctggcgaggcgtgctgcactcgtgtggtggttacattcccactgacttccctgctttcttggccctgattcatcacggcagatgacctcgttgccgcgtgtcgtgttgcactggttaaagcgggcggatgcactcaagccaatggtctggaagttgcccttaaccccgcacaggtaggccgtgcatgtggctccactgttctggcacctggtacggcggg

SEQ ID NO: 577884 - DNA, 548 bp, Homo sapiens
gatgatatactgattagaaatacaagagctcggtctccatcaacccagtgtcctggattgacacatagtcgatgggccaactggtgtagcgaacatgaactacctgccattggtgctcactcctccctgatgctaactaatctccacgctctgctacaaaccggaggggtgacccctatgcctaaggtcgtgactactaaaatccttgcgcctggcctggctgcatggactgtagtgtgtgcaccatgtggccctggccatggctgcatcccaggccttcctgtggatcctgctcccaggctgtgtcactgggcagacgctcaccctctctgagcaaggacacagggagaggctgtatgtggtgtgagaagtcttcctacactgggtgcctcgtcctgtagagacagcctcagtctgcatcctgcacacagccagggtccagcctaaggcaggcagctaacagattctgcgaggcccggcaaggggcagacttgaagagtcacaagggctccacgtgacaagatcctgaatcccaccgtcctggtcag

SEQ ID NO: 577885 - DNA, 1040 bp, Homo sapiens
agcgggagaggggagttcaaggagacgggggcgacgcggctgagggcttctcgtcggggtcggggctgcagccgtcatgccggggatagtggagctgcccactctagaggagctgaaagtagatgaggtgaaaacttagttctgctgtgcttaaagctgcggcccatcactatggagctcaatgtgataagcccaacaaggaatttatgctctgccgctgggaagagaacagatccgaggcggcgtttagaggaaggcaaactggtcaacaagtgtgcttctggactctcttcagcgccacgactaaacacgtcactgctgcacgacgcctttcacacgcaactacttggactcttgcatcgactccactactggcccagcagcttatctctcgctcactgtcgcacaacagcacggcaaagcttctgacgagctgtgctcgctggcacaaactgcggctgggtgcggcctgaccctggcgagcaactgtcaaaaggtcaccaaagctgacaacagcatcgcacctttaccggagaatccctactcactcaagaccaagaccggatcccagccctgagaatcgcacggagatctgcccgcctgccacacatggcagccgcttctcatttctggaccaagtaccacgatgggtccgtggcccacactcggctcatgtgctcagacaacgcactgactcaacaccgcccactgccggcccgcttccgactgactagatggtgtcctcacccgcggactcaccaaacactaaacccacaccagctaaccttactgtgactcggacagccaatcctatacccaactaccctgccaccacaaaattcccaaagcgcacgacccacgacacaaacgccctcacagcagcgtgaacccgcccaacagggcctgcacctccacacagcgcacgccccgccaccaacccaacgacccccgcaaaaccaccgcaacacccgaccatgcggagcacgcacgacgcgcgccgcggcactcgcacccgccccaagcccaccgcgcgcccacag

SEQ ID NO: 577886 - DNA, 99 bp, Homo sapiens
gccagcaccaaccagacatctatgtacctctgtgccagcagctctcgtgggcgagggaggagtgaagctttctttggacaaggcaccagactcacagtt

SEQ ID NO: 577887 - DNA, 130 bp, Homo sapiens
tgtttatcgatgcaccagttagggtggggcagaaacaaatgacaatggtggaatgtcttcagttaaggctgttttcacttctgggacctacagtatgataggtacataatgcagggtgtatcgataaaca

SEQ ID NO: 577888 - DNA, 222 bp, Homo sapiens
gcgtccgaaagcgtgccatcaggagatgaagaatatacccatcaaggaagccccttcctaaaaagaagaaaggacggcctcctagacacatcctttcaagcgacccgcagcccccattgtattgaaaccaaaatcctgtgaaccaattcgccggaaagcccaagttgaccacctctcctaataatctaccacctttatattgatctctaccaacaaacctct

SEQ ID NO: 577889 - DNA, 260 bp, Homo sapiens
tgctggatgagtgatgacccattctataccaacacctattctgatttttctggtcaccgctgactgtttatattcttatcctaccatgtgcttcttgaataatctcccattatttgtaactttactaattcctgtgaaaaaaatgaacccattttgtgatacatattgtattgtgtcttgatgctattgcatatacaatttgtgcttcactagtgtgtttaatctgttgttgagctacacccactatcattccactgtgt

SEQ ID NO: 577890 - DNA, 238 bp, Homo sapiens
  misc_feature (227)..(227): n is a, c, g, or t
aaaaaaaaaacccccccccccccctctggggcccacgggaaggaggtggggcccctggtcctcctaccaagttccttgggaccactggatcccccgaagcagtgctaattgctggctactgtgcaaagcctgacttcatgctcaggattcaagaaaatggaaggaatgaatcttgtgagaagaagttctcctttgtttgcaagttcaaaaactagaggaagctgaanaaatggatgtc

SEQ ID NO: 577891 - DNA, 110 bp, Homo sapiens
  misc_feature (110)..(110): n is a, c, g, or t
gggcggggctccaggccactcagtgggctccctcggtcctgatgggcagaacccacccgatccctaggggtagggcaccacccctcctcggggttagagcgcagtggcan

SEQ ID NO: 577892 - DNA, 129 bp, Homo sapiens
atccccggaataactgtagctagtattttatacaataatcttgtaagaaaattcttgaattctaaatatgtagtcttatctagattaaagacatcaaaaagtttcagtaaaaagatacttactattatt

SEQ ID NO: 577893 - DNA, 190 bp, Homo sapiens
cggctaaagctttgggggggggggggggggtaaaaactatttttttggcccaggtccctttcccccccccttttttttttattaaaaaaagggggccaatttaataattccagccccgccctccaaaaggaattttttttttggggttttttagccaaaaccaaaaaaccccaattttttttacccccca

SEQ ID NO: 577894 - DNA, 266 bp, Homo sapiens
  misc_feature (246)..(246): n is a, c, g, or t
gtgagtctttcttcaactaggggaatgtttccagggcacgccaggcctcactcacgcaggcctccgcgacaactgttcagcactgactgaggatgaagtgaaatcctgaaagctgagagccagcgccctcacacgagggctgggacgtaacaaaagcccatcaagagttttgcccagggctttcttgagccttgaagcatgacgagaccaggaccctttaggattaagcaagttttatgcggtctnaaaaaactccagggcctcca

SEQ ID NO: 577895 - DNA, 271 bp, Homo sapiens
tctgaccccgtggatgcagaggttgcagtagcccagatcctgccactgaactccagctgggtacagagcgagactctgtctcaaaaaaaaaaaaaaaaaaaaaaaaaaaaaaccaaaaaaaaaaaaaaaaaaaaaaaaaaaaaacccacacaaaaaaaaaaaaattttttaattttaaaaaaaaaggttttttaaatttttggggaattggaaccttttttggttaagcccactgaaattcattttttgtttttggattttgtggccactt

SEQ ID NO: 577896 - DNA, 293 bp, Homo sapiens
cgaaagagacaagcgacgtacttttctcagaatatattttgaagatcttagtgcctcatttcggtatccttatatctgtcagtttttgagcagtcacttactctacaaggtttgattatcatcccttctgaatcttcccagcagtctcacacttcatgtacctttcagcactctcccagccttacatttagcactcactgacatagcaatcaaagcagcctgtccaacagtcatggcagtggccttcacaccataggccgtaattcggttgcacaggtctcactgtctcaccc

SEQ ID NO: 577897 - DNA, 106 bp, Homo sapiens
ttaccccatggatttgactgccatttacgaaaaccgcctgtggccttaattcctaacggcggccccggttttcccttttcggcaataaaccaggcctagttttgta

SEQ ID NO: 577898 - DNA, 466 bp, Homo sapiens
tatggtgttttgactggggatgcaaggtgggtgtttttcgtcccagttgctttagtgtctgataatcttgtgctttggtgtaacggcttggcctgggacagtggggtggaaaacgatgacctctgtaatgctgacagtttggaatttgtagtgggagaagagtctcgatcggcactgggtactgagctggatgacaggaggttatcttcactggccttctgagtatcctctttactgtcaccaagagctgctttaccagatgctgtctcctccttgcttttctctttgctctcgtacatcttacgaatcactgaggtaggggtaaaggaaggagaaagcatgcttgtgatggaggcagcaggggcaggggaagaggaattccctcgatgcacgggtgcaggtgactttggcactcgctgttgcctgtatctgaatccatctctggttctgtccagctttggtttgc

SEQ ID NO: 577899 - DNA, 668 bp, Homo sapiens
ggggtaatggctcagctaatacagtttcacatgactccaaattctgacaaagaaaaggagaaaataacacaaaaagaaaaaaaaaaaactataaaaaaaaaaaaaaaaaaaagaaaacaaaacaaaaaaaaaaaaaaagaaaaaaaacctggcggccctctttgcccaattccgtttggaactagcccagtttttgaatccagcccccattcagggcatcctgggccattaccccttaaagggggctgctttacttaaaagggccagtagtttaacaaagggaacacgggaaaacccgggtggcaccccatttaaatgctctggggcaaatccccctttgggcaaacggcctaaatgccgaatgggcccatcccgatggccttcccaaaatgtggggcacccttattggccattgaaaatgctaccggtaattatttgagaaaattggggtcaaaatttgggtaaatccacttcatttttaacccagtcggccaaactggaaaaatcctttttaattaaaagaattccccccctaagggttgaaagcatttcaccttgggaaaaaggggccccttattaaggaccgggttttgcaacggaaaaggccaaaaaccggttttaggcgtaggccccttggggggacccatccccgggtttctgggcggggg

SEQ ID NO: 577900 - DNA, 245 bp, Homo sapiens
attcattgcccccacaatcctaggcctaccgccgcagtactgatcattctatttccccctctattgatcccacctccaatatctcatcaacacccgactaatcaccaccaacaatgactatcaactacctcaaacaatgtaccatcaacacactaagggcgagctgatctctatactgtatcctaatatttagttgcacaactacctctggactctgcctactatttcaccacaactaccattca

SEQ ID NO: 577901 - DNA, 793 bp, Homo sapiens
ggtgatcaggaataagtacgaatgtgagctgcaggaagccaaacagcacctggagagtgagaacgctgctgctctatgacacgctgcaggaggagctgctttgagcggatccacgtagtgctggaggaggaccgccagagcctggtacctcagctctgaatggtgggacgatctaaacttgcacgccaagaggcagctccatggtcttgggactccctgccgaccatgctaagaggaagaattgcacctctggtttctggcccatacatcgtgtacattgcttcaagagatcgacatcctggaggactggacagccatcaaaacatggctagggcagctgtgtcccctcaagaagagaaaatcggatgtgaccttgaccctgctgttcacatgtcagtggggacccttcagagcagtctggcactgcacccaggtattctctggtcttctctcctgcagactaggcgttgactccacgaggccccttcagggatctgcgccatgccaggcttccatggtgtgtgctgctgaggtcctccctacgtccatctggctactggcctgtggagtcctcctctgccctcctcgtaggcctgcactagtctgtgtgacgtggagctgactctgagcaggcaaggatgttgtctccatccctgagtctgctgcagctcccactcctgaagactccatctcttggggctcccctgacgagagaagacaggccgatagtcataggcatattctcttgctgatgttggaatgccaggctgtgcgagctcaggggccacggagc

SEQ ID NO: 577902 - DNA, 311 bp, Homo sapiens
  misc_feature (19)..(19): n is a, c, g, or t
  misc_feature (107)..(107): n is a, c, g, or t
  misc_feature (205)..(205): n is a, c, g, or t
ggcgtctccagaggcgcanacaaagccacactgtgttgacaactcatgacacgcactggggctggtgctctcccaggccccagctcagggctccccacacccatctntgtgtctcctagggagaactgaccatcacgaccgacgtggaagatctgtccacggctctcttctatgacaccgtgcctgatacgtgggtggcccgggnctacccctccatgatgggcctggcggcctggtacgcagacctgctgctccgcatcagggaactcgaggcctggacgacagactttgccctgcccaccaccgtgtgg

SEQ ID NO: 577903 - DNA, 111 bp, Homo sapiens
gaagctgatagaaaagatagtaattctaagaagctgagacactgcacattatggagatgatatttctaagcataatatttatttattttttttttgagactccgtttcaac

SEQ ID NO: 577904 - DNA, 857 bp, Homo sapiens
  misc_feature (617)..(617): n is a, c, g, or t
  misc_feature (619)..(619): n is a, c, g, or t
ggacactctgcagttctctggattatccttatacagttccctattctatgtctctgttgccctgtgaactccacttgctttgccttctctgggattccagttttttctgctcaagataggagactgcctgtctctacttggattccctctctttgcactgtgacctggaaatttacttaaacagtaagctggagcaatcttgtggcttatttctcaggggtcacattcttcattgcctgatattcaatgtcttgagtactactgtttgatatattctttccagttttttaagttgttttttagatgttagttgggagagtaaatcaacatgttgctccatcttaaccagaagcctaaaactatggtggattttattcactgatcatatctagtttcaattttccaggacaaatgaaattctgatgtgtttatccaacaaagtatcctagatatatcgtcctattgtgctataggcactatgttgaatattaagagagacacaaagtcacttaagaagcagctcctcacatactcacggagtatgtaaccatgatcatatattcatatattacctttgttcataagcacagcagtacttccagagagtagatattggntngtaaggaaaacacagaaaaaactcgaggggggccggtaccaatcgcctatagggagcgatacaatcatggacgcggttacaagtgtgacggagacccgggttcccagtaacgctggagaatcccttagcaaggggaatacaaggcgacgatgctccaaagtggacgtaagagagcatatgcgcactagtaacgcacgtgtacgcttggaggacttataaccagagggtggcctcgggc

SEQ ID NO: 577905 - DNA, 357 bp, Homo sapiens
cttgagagataccacgtgacacagggattagatcaacacacgctggggcctgatgcaggagccgtagcggggagagcatcaggataactagctaatgcatgtggggcttaatacctaggtgatacgttgataggtgcagcaaaccaccatgggacacgtttacctatgtaacaaacccgcacatcctgcacttgtatccagaacttaaaatattttaaaaatctttagagaatacaaaaaaaaaagattcttgcaatgcatacacaataaaattgcagttcagtcaaactttggaagtctttctctaactgtctagttggtatcttcattttcagcttcttcaggatcccactccaa

SEQ ID NO: 577906 - DNA, 662 bp, Homo sapiens
  misc_feature (465)..(465): n is a, c, g, or t
cggaggtgaacgacgtgcttccccaagagccgactggccaatcacaggcacgaagatgaaggttctgtgggctgcgttgctggtcacattcctggcacgatgccatgccacacgaggagcatgcgatggagacagagccggagcccgatctgctgcctgcaaaccgagtggcaaagccgacagctctaggaactggcactgggtcgatcttgggattactcgtgcgctgggtgcacacactgtctgagcacgtgcaggaggagctgctcatctcccaggtcacccatgaactgaaggcgctgatggactgagaccatgaaggagttgaacgcctacacatcggaactggaggaacaactgacccctgtggcggaggagactcggacacggctgtccaaggagctgcacgcggtgcacgcccgggtgggcgccgacatggaggacgtgttctgccgactggtgcancaccgcagcgaggtgcatgccatgctgggtcaaagcacacaagagctgcgaacccggccttggttccctctgctcaagatgcaatagcggcctcttcgttattcccaatccagatcgattgtccttttaacaggtgggcccccttaaggggcatatggcctctccccttctattttgtcttccccttactgttcctc

SEQ ID NO: 577907 - DNA, 367 bp, Homo sapiens
cccccaccccccccccttggggccaaagaaaaaatccagttaccggccgggaagaggctcatgccccgtaagccagcactttgaaaagccgaggcgggaggatcacccttagtcagcagttcgaaaccaagcctggcagcatggccaaaacccccgttttactaaaaatacaaaaaaaaaattagccaggcctggtggtgggcgcctgtaatcccagctactcgggaagctgaggtgggagaatcacttgaacctgggaggtggaggttacagtgagccaagatcgcgccactgcactctagcctaggcagcaagagcaaaactctgtctcaaaataaataaataaataaataaataaataagctgt

SEQ ID NO: 577908 - DNA, 698 bp, Homo sapiens
gcccacctgcacccaggtgaaataagcagccttgttgctcacacaaaacctgtttggtggtctcttcacagcaacgcgaatgaaatttggtgccatcactcggatcaggggacctcccttgggagatcaatcccctgtcctcctgctctttgctccatgagaaagatccacctacgatctctgctcctcagaccaaccagcccaaggaacatctcaccaattttaaatcggatcttctcagcttagcggctgaagactgatgctgccagatgactttggaagccccctggaccatcacagatgcccagctttggataactcttacagtggaggacaggaatatcaggtctctgagcccaagctaagccatcatatcccctgtgacctgcatgtatgcatccagatggcctgaagtaactgaagaatcacaaaagaagtgaaaatggcgcgtgcctgccttaactgatgacattaccttgtgaaattccttctcctggctcatcctggctcaaaagctcccccactgagcaccttgtgacccccactcctgcctaacagagaacaatcccctttgactgtaatttcccactacctacccaaatcctataaaacggcccacccctatctccattcactgactctttttggactcagcccacctgcacccaggtgaaataaacagcttgttgctcacacag

SEQ ID NO: 577909 - DNA, 454 bp, Homo sapiens
ctgagacgatgggcgtccgtacagagacgctcctaactgcggagatgctatggcctgcgcttagaggcgctcctcacttgctagatgggatggcaggcggggcagagacgctcctcactttgcagactggtcagccaggcagaggggctgctcacgtcccagacgatgggcaggcaggcagagacactcctcacttcccagacggtgtggcggccgggcagaggctgcactctcggcactttgggaggccaaggcaggcggctgcgaggtggaggttgtagcgagccgagatcatgccactgcactccagcctgggcaccattgagcactgagtgaaccagactccgtctgcaatcccggcacctcgggaggccaaggctggcagatcactcgcggttaggagctggagaccagcccggccaacacagcgaaaccccgttcgggtaccgagctc

SEQ ID NO: 577910 - DNA, 253 bp, Homo sapiens
attattttacaagatacctatggattatcaactattagcctggaggagaatggtggcttgggagaaatcgaacaagcaaagtaagattgttagacaccactgcccgttaatgatttcctagaaaggagaagagaatagaccttcactgactatgggagctgtttagaaaataggattcggtcttcagacaggggattaaaccatactatttaactttccaaaacctgtactggaagtaagggcttgatgtgga

SEQ ID NO: 577911 - DNA, 326 bp, Homo sapiens
caccggacggtgtatgtatgtatacggagaggcctggattctgaatcaataaaccaagctcgcatacttaccacatgtgtgaccatggcaagttgctcatgccttggttgcttccattttaacatggagataataaaattatagtaagaattcaaggaaataatgtacatataaaagcataaaataggacatgacaacattgctatcactattatttaacaaatgactgaattgtcgcatttcttcaaaactcacatataggccaggcacggtggctcatgcctgtaatcctaacaatttgggaggccgaggtgggtggatcacct

SEQ ID NO: 577912 - DNA, 340 bp, Homo sapiens
  misc_feature (139)..(139): n is a, c, g, or t
ggcttccatagagggccttgttctccttggcagaagctcaagtcctgattcccgcccttccttctcgttttaggaatattgttctgagaagccacagaaaaagggtaggcatataggaaattggggtatacgttgccgnaaaagagacaaatactgtacgtacttgaaagttttacctttgatgtgtaatccttacttttgatgcggcctcccgtgatctccgcatcttaaaggcccgtgagaaactaaaggagttggatctgatgggatggttctctcagatgctccgaggcaaagcacatgatcttaatgtgtaatgcgcttgccccatggctcttgg

SEQ ID NO: 577913 - DNA, 1166 bp, Homo sapiens
gctgcgcccttgcccactccaatgccatgacccagtgcggtttgccctatggactccgagctgtcttggggacccacaggtcacctttggaatgtgctgcctggtgctgcagtccctcgctccgcgtggcggacccttggctaacccgcccgggctgcttttctccccctccggctcacctcttgctctggcgcatccgcagagccgcacgctactggccgaggtgaaccagcctggtgcggtgtgttcgctcaacggccgcacccctgcccaacgccatccgcttgcgcatagtggagctggcgcacctgggcatccgaccctgtgacatcagtcggcagctccgcgtatcccacggcctgcgctgcagcacgcactcctggcgcgctacaacgcagaccggcatccatactgcccggggccacccggggcggcagcaagccccgacgtcaaccactcccacagctggccaagcgacatccgaggactacacaagccaggcagaccctggaccatctctcgcctgtggagatccagcagaacggcatgctggcacgacggcgtactgtgacaagttacaatgtgacattcgagctgagcaccactcaggccagcatcctgacgcaccaaagacacggcagcctggcgaaggcacggaccagtacagaggcaaggacagcagccagccggcgcagcctaccgctgcccacaagcaacatctacccagaacccccacgacgaccaagaccaggcgaacggacccacggacagcaacgaaaaggagcatgaacaccccacgcgcctccggggaaacggcgagaacacgacaagcaatcccgcgctaatggcactcggccccctcggacaccacaagcaggccatccggcacgttacttggagcatacccagggctgcctaggattgcgaacctgacgggccacactacacacaccacagagcagggacacagcggcgcgggagaaaaaccgaaccgaacacaaaggaacccaccacaagtaagtgctaacaaacctcaaccacagaggcagtaacaaccacagcaagacacaccccaaatccacgcgacggcaaacacgacagaacagccgcccgaccacaaggggcacaccacacacgacaacaacgagcaccacaagcgaaagaag

SEQ ID NO: 577914 - DNA, 181 bp, Homo sapiens
tacacatgcccaagcccacagatcgcttccacactcatacctacccatacctcccaattctcactgaagtccatggcgacgcgcacccactcgagtactccctaggctcacgtggctaacagttctagctcgtgggacacttcagtgacatctgggccctgtgctgagagccccggcactt

SEQ ID NO: 577915 - DNA, 866 bp, Homo sapiens
aacaagatataattatgcgttatggagcacgcaacctcctgattggtgaacatggtcgcagctggttcatctaatatctgtgctaataactagagtttgcaaataaccaaataatcagccgggagaaaaacttcgcagtggtaggagtgaatcacaagatgtatgtactagaggtcttaatgggacgatatacaaggggtcaaagcgatgtttgaaatcaaaatgttcgccatgactgtgtcattatataaatgcaaatcaaaacacaatgaaatattatttccccctagtcataatgactattataaaaacaaaaaaaagaaaaaaaatataacagattgaaaaaggaatcttctacactgtggtgggaatgtaaaccaggtatagcaactgtagacaacattatggcgattcctcacaaaagtaaaaatagaattaccattgaaaacagcaattttactactgggtatttactcaaaggggaaaaaaaatcaatataccaaggggatacctgcctcgcatgtttatggcagtatttcacaatgcaaagattgagacaactaagtgggggttgcgcttatgaaggtgatagtaaaagactcaggttgtgaagttgggagggatttgcaaaggtcttaaaggtttgagactgtggacagtgaatggcaggtggacggtcaacagcagggatgtctgtgcgcagggatacttgatgtcagttccagcatgtggggatcagcccaggggttgaggggtgaatgaaatcggatattattagggaaaaaaagatttgggttccaaatgcgatagggaaaaaaaaattgcgggcattaatggggaaagagatattgttacacgtgttttct

SEQ ID NO: 577916 - DNA, 1616 bp, Homo sapiens
ggcgcgcgcgcgcgtgggtgcgtgtgtgtgtggtccttcaggttggcagaggctctgtgtagagactctagggaacgccaggtttcatgcgtctgggcgggaggagccaggtgcttcctgcactgtctgaaggactctcttctccttccctgccagttccccctactctagtgccaggtgccgggggtccggaagagctcccccgtccaagccatatgacggtactcattcttcaaagcatggctcctcgcatgaagccttgccctcaaagtggtttctttccaccctaggctgccagaaattgacagagagtgcagaagaggacggcatcaaggcgacctaatgacttttgggggttcaatcactagcaccagtgtcctcgcttaacaaagctcaaatatgcagtgccatctcttctttggatgcagacagaggagttgctcccatcgcagatcgctcgtggccagactcgggcccttctgctgaagatgacgccttgtgctcaggaggatctgaagtggttacgggcgactacatgccccccattatgtcccagatgcgtgtcgcaggcggagaacgactcaatgccctgcgggtcaatcactgcgataatcaagggccccagcggcgaaggggctcagaaccgtggcgcgagaacctgggggcctacaaaggggattgaaaaccctgcagacgacgagcactcgatggagggacctctcgtcctgttaccccctggtggagtgagtgttcgttaccgcatcctttcttgttaaacactagcccacaccccgcgacccgcactcgacccagacccactgtgagccaacaagtgcagtccacacagtaactcacgcgacgccagcgaccaccgctccagacacgacgagccacgacgagaccagctagcggtccgaccacagaaggcgggacccgccggggggcaggcgggcgggagagaggcgggcgggcgggcgggagcggcagcgagcaggaggagggcgccgcgcgaggacacgggcgcagcgccggaagggcggcgaggagagaggagaggcgcgagcggcgagaagcggagcacagcgcagcgcaggagcaagacggaggggccgagaggcagacaaggggagagggacggagaagagcagggggcgggcggcgggggcggcgggggaccagggcagaggcgcagtcgggagaagaagacggcgcgaagaacgcggggcgggggggagcgagccggggcgcgaggaaggccggacgagagagcgagacgcagagaggatggcggcacgggaggacggaggaacgggagaggggcagagacagggagagcggacagagggaggacggcgaaggggacgagagaaaacgggagccagcacgcgagacgccgaccgagaagcgcatgccgcaggagcgacgagaagaacgagcgagagaggggagacgggtccgagaggccgcaggtaggaagagggcacaaacgacccaacagacagaggagacgaaggaagagacggggacagcggcagaagggaacaaggcgaggggccagagaccacagggcgcgaagcacgaagaacgaacagggacgaagcacacagaagcacaag

SEQ ID NO: 577917 - DNA, 1472 bp, Homo sapiens
gctgaccagcacctatggcggtctggcaagaacaagcgcctttactgaaaggcggcacaacaagggagccaagaagaacagtgtgttgatccgatctttcgtaagcaagagcagttggctcatgatgctgcaacagccaccctggctatgcttccacatgatcaagcatacatcattgcgatagagaggacgctcgatcgacccagtgacccaaagggaaaccgatagaattgccatctgcatgggtctccacagggttccgtgatgttgtgaagatcggagctcgtgtgcctagaattggtgcaagcaaatgtagttgcacaggtttcgccactttctatgatatatagttcgagaggcttggagtatcacgttgcaccattggattgtctcgagctgggtcaaacatagcgtggcctttgacctcaaagggtttcacaatagggcgagtaggaatactttaactcgcggttgcaccaaagagaatggtagtttacccactaggggtcccatacaaaagacaatggcgccaaagcaaatgagactcggaattctagtacacccgacgctccaagccgaattgtggcacttaggtttcggaacggaatcgttaaccccggaacttgcggtgttcatcgtttgggcttgttcagttgctttgatttgccttggttgttttggggtgttttgttaacggtttacataccagacacgcaggccaaaaacgagtagtccacaggtgaaattaacgcgcggacacaaggaaccgccgtccggtttaagttcgtgccgtccgaatgtgcacgaaccccgaaaaaccgtaaggtgtggtttcccggtgcccgcaaaatgaagtttcccccgtgcgcaactagcgggcaacacgggaactgcgcaaatctggggcacacccaccttcgcagttggaaacccccgccgtgaagaaagcgggttggcccagcggtaaaccgacaacgaagttggacatcttcttgtgcaaccgatggccaacaacagtttggggggctccccacagatcgtacaaaatcgtttttgtgcaacgttttccgccgacgtgaaaacacaaggcgtccatgttcttcgggcgcacagaccagccacggtcaacctcacgtttgaagcgaaacgacacaagtgtggccttatggcccccaagaaacgttccgcttacagttgttttaacttcagccgttaccttccccaagtttgaagttgggttcctttatccgggattgcaacgtaaagacagacggctttactaaacaaacatgtggcgcttggacaacacggacacaggcgcgccccaaagaggtttctcggcgccactttttgggtgcgacacaacagggccgcttccaatgtgtgcggcaacggccgttcttccacagctgtgcgctttgcaacaacgggggcccacggtgatcaacagtatatacctctggcggagaagc

SEQ ID NO: 577918 - DNA, 155 bp, Homo sapiens
tttgtatgtgaggacacgagattggagaggccaggcagaatgatatggttggctatgtccccaccaaaatctcaacttgaatgtatctcccagaattcccaagtgtgtgggagggatttaggggggaggtaattgaatcatgggggctggtcatt

SEQ ID NO: 577919 - DNA, 306 bp, Homo sapiens
tcgcttagcatgaggaatatgtgcagattcttctttacatgggtttaatatggctatcccagagggtgccagaggggagagagggttataggtaatagtgaaaagtaaagtggaattgccctttaatttcccctctactacttttgtcaggggctggcatccccagcaactgtgagctggaatcccagggctttggaaggatcaaatgtagtttctcatacaaaaaaatactagaaatgttggtgttggaagaagagtttcacaagactaatagctacccctggttacctcccttaagcggatcag

SEQ ID NO: 577920 - DNA, 866 bp, Homo sapiens
gcctccctaaatcgccaggcgcagcctctcactgcctctagcccatgatcttgtgtctatcccatgatcttgcgtctatcgcaggtgtcttaagggttgatttcccattaaacagcagagatgtctgatggccactgaactctgttttcagatctggacaaaagcatttaccttcttcatgccagagactttcttttttttttctcttttttttttttgggcggggtctcttgtgcctcgtgttccccttgaggctagaggtgtgcgaggtggcccactctcccggcctccctgtgacgagccccctcgagtctctctcctgtaggactcatcaagagcccgaactcctctccccacctctcaagacccctcctatagagtctagcctgtgggcaccccccaccacacaagcgtttccaccccacgcacgctcccgttgtaattctttgtgtgaatttttcttctgtgtctagagagacatggagcaccttcccacgagggtcgcggggcagtgtggtgtgcgctctcatgtcgcctgtgtttcatctcccccaggcccctttgtgcggagatttcgcccaagatgtgcgcgggtggcctccctctgagaggcgccccgcgaagttctctcgcagacacccgcgcctgtggcctgtgcaccctttgcgcgaaaacatctcccatctccctcccgatttgttaacacaagtgtcgcccacaacacggcattctacggcgtggcgcccgggggtgtgggcccccgttctcctgtgtttaccccccccggagtttacctcaggggaagggccgtgggggcctgtgaaggcaactccgctttgtaccccccagtggggggccgcagggct

SEQ ID NO: 577921 - DNA, 295 bp, Homo sapiens
attattatgtaactggcttatcctaggctgggcgcttgcactaagtaaagaagccacggagtcagatctagatagcagagaagtaagtctcataactaaaacattgcaactactgttagagtccaccccatgaagctgtctcagatcgtgtatataagacatgaattctataagtatatatagttcagactaaaacaaatgtggctagctacggtaggctgtgctgtctcagtaggacatagacagactccagcttacaccctctggagaccttggacctacgtgccacatgcaa

SEQ ID NO: 577922 - DNA, 405 bp, Homo sapiens
ataccgggatttcttagtcaagcatcctctacctctcaggctgctgcaaccagctaaggaccattggtattatccatgctataattcttatggctgctgaaatgtgtggtttatgatttattaaataatctcttaggagggcattacaaaaaaacaaaaaacaaaaaacaacaactaaaacacaaaagggggagcgacgcagtatgaaaacgacaaagaggggacccaagattaacggcggaccagcccgacttcgtctacaacacgggccccactagcgacacgcacgtatatacaacagagacgcggacaccccgaacacacacacacgaggaacgcgggcacacacgacgacgacatagcaacaacaaacgacacgacaaccacacaaaccacggaggagga

SEQ ID NO: 577923 - DNA, 369 bp, Homo sapiens
cattctggcgtgtagcacattttccaactcacgcataaagttgcagcaagagtggctccaactttgcaagccattcatcagtcagtcaacatccccagggcatctcagcactttccacatttctctttcatccagcattaggtcccaaacatccatgctcaagtcacctcaaagcaaaagcaacacatgtgtatatcgcacatagtgggttgtcctttgcacacactcaaacacacattcaccacagttcatgcgcagcacagggcacgtctcatgccacgcactggcacgtctcatgctaagcaagtggcacgtctcatgcccagcactggcacgtctcatgctacagcagtggcaacgtctcatgcc

SEQ ID NO: 577924 - DNA, 192 bp, Homo sapiens
acgactaaactagcacatgataatatcaaagtaaacatgtttatcgtgatacatatatatacataaaattgaacattcgtaccttcgttttttttttttggagacagagtctcgctctttcacccaggcggaattgcagttgcgcaagctcagttctttacaacctcggcctccggggtccaaaaggggaac

SEQ ID NO: 577925 - DNA, 160 bp, Homo sapiens
tgactctagatgatcccacacctagtgaggcagagaagagttacatcagctaagtgctgaactcgtgtgatagtgtaaaaatctcctctgtgagcagacaccagacatggaaaatgagtcctgacgtgatagacatgtggtacctgagctcgaattacgt

SEQ ID NO: 577926 - DNA, 431 bp, Homo sapiens
tagaattgcatggatcactatacagtgcatgtaaattatcggcaccccggtatgtacaatgctgctgcctcagactcctgcatagttgggataatcggcgcgcctcatcaggcccctctgcgtcaagcatagccagccgagatgggatttgacctattgttgctcaggttgaactcgaaattgctggtctcaggtgaacctccgtgcctctatgtcagaacacgcagttacgagcatcataatctgattctcatggtcatacctataacctgactatgaagaaagttcttgggattctgagagtctctgtgagaactgtttcacagaaggatgtgtgtttaccaagtctacacatcaaaaagaaatagataaaataaatggaacattagaagagtctcctgataatgatggttttctgaaggctccctgca

SEQ ID NO: 577927 - DNA, 262 bp, Homo sapiens
gggcccccccccccgttttttttcccccttaaaaaaccccgggggcggtcccccccccgggttttttctttggcgggggggggggtttcattttttccccgggaaccggttttccccttgggccctttttgggggccctttaaaaaaagttttttccaaaaaaggggggggggcgggggggggttttccggggttttttttccccccggggccgttttttggggttttcccttttttttaaaagccgttttttttcctggga

SEQ ID NO: 577928 - DNA, 102 bp, Homo sapiens
actttttttgagacagggtctcactctgtcgcccagttgtgcaaagcagtggcccaatcatacggctcaccgcaagctctgcctccctaggtctcaaggtgc

SEQ ID NO: 577929 - DNA, 162 bp, Homo sapiens
atcctgctggttctgcctctctgggagccctgatggctgcacagtgcgaggacttcagggccccgtcactttggctgtcgtttaccccccagtttatggtggcccctgtatttgcgggctccacatctgcagattcaaccataaaaataacaatacaacaat

SEQ ID NO: 577930 - DNA, 279 bp, Homo sapiens
gcctgaacggaaattacaacaacagcagcaacgggggcagagacacagagcatcaagctcgtagagaagtggagcaccgataatctgcagatcaatgacatatatcccatgcaggataccattgcaatgaaggagaagtatgccaagtacctgcactcacagagcagggcggtatgccgccaaacgctatccgaaaagctcagagatcccatagaggagcgcctcactaactccatgatgatgcacggacagacaacaacggaaagaagctcatgactg

SEQ ID NO: 577931 - DNA, 87 bp, Homo sapiens
aaacattgccagaatgagaaggataaaatgatacccagatgaaccctggaacagtgtgctacattgcaggctgccactgtaaaccag

SEQ ID NO: 577932 - DNA, 92 bp, Homo sapiens
catgtgagacatgatggttgtatgtgagccaagattgtgccactacaatccagcctaggccacaagagcaatgactgtttctcaacaacaac

SEQ ID NO: 577933 - DNA, 417 bp, Homo sapiens
gcaacatgtgttgctcattgcacctgggctgcaggtggggctgagctccgaaaagacgagtctgcaaagggagatagggttggggccgtctttataggattcgggaaggtaatgcaaaattacagtcataggtggttgctctctggtgggcaggggcgggggtcacaaggtgctcagtgggggagcttctgagccaggaaaaggaaattcacagggttaatcactcagttaaggtggggcaggaacaaatcacaatggtggaatgtcatcagttaaggcggggcagggccttttcacttcttttgtgattcttcagttacttcaggccatctgggcgtatacgtgcaagtcacaggggatgcgatggcttggcttgggctcagaggactgacattcctgccttcttatattaataag

SEQ ID NO: 577934 - DNA, 109 bp, Homo sapiens
tttactttttttttagaatttcattttcagatgttaagccattgcaggtattaaatttgtaaataaggggatgaaaaagaagaatgcggttcagaatgagctaatttca

SEQ ID NO: 577935 - DNA, 422 bp, Homo sapiens
ttatggtgggtatttctgggctctggcctatgctgggccctaacagtcataagtagcataactgggatcctagtagtgagctattgctctctgtattgttgtttgagctatggattcagggctccgccctatcggcatgtgtccctgcccagaggatgccctgagcctagctggtggagtgtaggaaaggtgcctgtgctttactcagaagtagcccaaggcggccttctagcgcagcatgactcagtgggtttggagcgcaggcgtacaaccctgcacattatgtaaccacaccgcatgaggcatattaggtgatcacccatgtgagcttgtgcttggcttggagggactattgtctgtaaaacatacaattaccctgctaacgctgtatatatggctcgcttgtgcccagagagagagta

SEQ ID NO: 577936 - DNA, 102 bp, Homo sapiens
tccccccccccccccctttttttcgggggggggggggggggggggggggggcccgggcccccggggggggtttttggggggccccggcccccctttttcttg

SEQ ID NO: 577937 - DNA, 534 bp, Homo sapiens
  misc_feature (71)..(71): n is a, c, g, or t
ctaatctggatttttgtgttaattctgcacttccatgagggaaagatgcctaaagaatagtcattcgcgtntgttaaagggaccacagtgacttgcttgtagatgctagccctgctacctagtctgttagcatttgaagtcaccttctcatactactttaattaaaatgtgccgtatcttcaatgttgctttaactactttagaggatttcagccttgatgttttaatatcctaggcctctgctgtaataagattttagacaaatgtttggaatttaagaagcaactcatgttactaatttgtatagcccatatctgtggaatggaatataaatatcacaaagccatgtgatgagactgtgcgttgtttttcccataggataaaaccaaagaagtaatttggttcttcatactttaaggtaatccacatacataaaaaatgaaactattttataaagtctagttctctacatgcagttataaaaatcagctttttaaaaaaataaaataagccattaattactaaatcagacac

SEQ ID NO: 577938 - DNA, 387 bp, Homo sapiens
tgaagaagttattttctatattttagggaaaaataaaaagcaaactatgaaaaaaaaaaaaaacaaatccctccccacaaaaaaaaaaaaaaaaaaaaaaaaaaaaaaaaaaaaaaaaaaaaaaaaaaaaaaaaaaaaccaaaaaacaaaaaaaaaaattaacaaaaaacaaataaaaaacaaacaacaaaataaacttcccccttcaacaccacacctcttttctttcccacaaccttttttctcccctcccattcctccccatgctgccctcattcccctcaaacggctcccatccccaactcactgcccgcttataaaaccagcgccccctttaaacactgcccgtccccccaacaccttccctctccttctcccacacccccc

SEQ ID NO: 577939 - DNA, 263 bp, Homo sapiens
tcagcaggaaaatctcagtcacacataaattcagcccatgtatatgatcctgtaatagtgggaattttggaacctagagagactcaatggacctggttactagtttaaatattatcaattagtggtataacaccaggctagtctcttcactctttatagctattgcctgatatgttcaagtctacgatttatttactgaagcaaaatagtgggtggagaaggctttgaagagactgagaaggatgggcctatcgaacaggaaa

SEQ ID NO: 577940 - DNA, 118 bp, Homo sapiens
tggccccggtgaacagctggagaatgtgtacgtaatattattttaacttatgcagggtgtgagatgtaccccctgctgtaaatgcaggtctcttggtatttatagagcttgtaactgg

SEQ ID NO: 577941 - DNA, 762 bp, Homo sapiens
  misc_feature (623)..(623): n is a, c, g, or t
tcgcgcatgcgcggagggggaagcagtggcgacataggatgctattaagctagagtttctcagagaagtttctggaaagatggagccaaagggacgctggggggtggggagcgccaggaagcaagcgttgtgaaagaaagcgaaaaaacccaagcgcaccgcgacacctccaacctatacgagccacggcccaagcagagcccaaggccactagagaccctcacagccagagaaaaagcacagggaccgcggccagccgctcctaccctctgccactagctcagcccccgagactccccagcacggggagagggcagggggtagccatagagaaacctagagcgctacactggactatatatgcgaggtggaaggaaagccgaaacccgcacctattggagccgcactgtgcgcacgggccccgtacgagtgggctcagtaacagtataaggactacagcgtaggccgccaaagcatatgatatagggggcgtactttcactaatttttcctaaggttttactctcctatacgggctactgtggtaccttatcacaaccatactatcactatatggtggcctgacggctaacggctgcgagttggggaaaccagtaataaccncgggcctgaggggcgtcccgggcggcggtgctccggtatctaccagcggtagccctttaagaaaagcccccggaagggcccgtgttgattataagttggtgcgccgacaaaggccatatgaggggttacgacctgtgcc

SEQ ID NO: 577942 - DNA, 189 bp, Homo sapiens
gactgaggatcccctgcaggcgcacttcccggtcgagtcgtgcactgagaaccttggcgagtttgtcttgctgttcttggttcaatgcaaaagcactggtcacttcaacgtctaccgatttctcttgttcggcctgtacaggtcaaacagagcggcgatctccggcagaagcgggagacggtcgttttc

SEQ ID NO: 577943 - DNA, 235 bp, Homo sapiens
ccagctcaccctcccaaaatactgggattaccggtgtgagccagtgtgtccagccacactctgaggtttttcagcaccaggctgcccagggatggaacataaaaagtgtcacccagagggcccttgagccagtccaggatcccacccaatttcaaacccggggtcagaacaggtggttacacgagtccctgccaatcaagccctcttgttccaagaaagctgcataccttggaag

SEQ ID NO: 577944 - DNA, 197 bp, Homo sapiens
  misc_feature (7)..(7): n is a, c, g, or t
gaccggnttagcggctaggcgctcgattttctcagctgccaatactgtgactaccgcaaatagtaatgatacgtacacgatgtagctcttaggtttcgtcaggtactggtgacttcaggggctttgtattaattcatgttgttctcacagctacccagtaaggagagacactgtcattctctctgcgttgtgtagag

SEQ ID NO: 577945 - DNA, 304 bp, Homo sapiens
  misc_feature (28)..(28): n is a, c, g, or t
  misc_feature (45)..(45): n is a, c, g, or t
  misc_feature (49)..(49): n is a, c, g, or t
  misc_feature (120)..(120): n is a, c, g, or t
  misc_feature (174)..(174): n is a, c, g, or t
  misc_feature (217)..(217): n is a, c, g, or t
  misc_feature (256)..(256): n is a, c, g, or t
gccccctcaggcacggatcatagctgantcgtttttttgtaggtnatgnctttggttttgtctgttcggtggcaaagataaactaagtttgagagatgaatcaaaggaaaaaaatatttncaaagccatgtgaaattgctccattttttgcttttggggggggtcaagtttggntgcttgctgttccggttggggggaaagttggtgggtggaaggngccaggtggaatggagggagtttacaggaagcaacaggncaacgtcgaaccgaattctgtctgggcaccaacgtcaaggggccacat

SEQ ID NO: 577946 - DNA, 415 bp, Homo sapiens
ggcaaatttatttgttattttatttatttgagacaagagtttcgctcgttgcccaggctggagtgcaatggcaagatcttggctcactagaacctccacctcctgggttcgaagcaattctcctgtcttgtttccttttagtattgaataatattccgttatctggatgtaccaccaactgaaggctgtcttgatagcttctaaatgttggcaattatgaattaggctgcaataaacatccgggtacagggttttgtgtggatatcagttttcagtttggctgggcacagtggctcacgcccgtaaatcccagcactttgggaggccaaggtgggcggatcatttgaagtcagccagaccagcctgggcaacatggtgagaccccgtttctactaaaaacaaaaatcggctgggc

SEQ ID NO: 577947 - DNA, 305 bp, Homo sapiens
cgcgagcgccccaagtagctggtattacaggcgcacaccaccacacccagctaatttttatattttgagtagagacggtgactctccgtgttggtcagtctggtctcgaactcccagcctcaggtgatctgcccacctatgcctcccagagtgctgtgattacaggcgcgagccaccacacccagcctatgtgaccttgattttacaagacgcctcatttaatgctagggctgacgcatttaatagtgttaacattgaactcagggccagctgttgtaagtagactgtgctgccatcatctgggt

SEQ ID NO: 577948 - DNA, 794 bp, Homo sapiens
  misc_feature (155)..(155): n is a, c, g, or t
ggagcccctcccgtgttccagctccgtctgccctggtgcctatatatacacatgcgtctatccatactgtgacttttagtctgtgatattgtctcgctgcaaactcactgtttctcagacaggccacaggcacatcctgacgtccgtatcacgancgcacccaaagcacctctcagatccagctttcccaaagtgccttggcaatccgcccctttcaggtcgaatatgcatcacctgtttactaccgctcctctcgatatgcataccacaggaagattatctttaagtctagatgtgatcatttattgtcttttaccattggagacagtgacaacaggtcatggagcttccacgcctagggcacttgatggacgaggactgatcctctccttctcgccggggttggcgttgtgggcttggtggcaccgcatccgaacagggagaatgccttccttcagtaaagtgctaggcatcatagttcttaaagatcagccaaaagcgtgatgccatgggtcacgcgccgtcatccgcgtgccaatggtctgttcactgctaggggctggcgggcggctacctgcatccccctgtgacgtgattcccgcgctccctgtgggaccttgccctgtggccttgactggaatgggggggcccctcgagtccccaggcccggggacacggttgccctggcggtctgaccaaacgtcggaagtcactccgttgctccacgtttgcccctgttcgctgtcctttggtactcccgaagttccgggtcccattgttgatcgatggggttc

SEQ ID NO: 577949 - DNA, 102 bp, Homo sapiens
ttgtgaagcagaattccacaaccgttggattgtccccactcaatagggcaacgtggcgtctgtccacgtgggtgtgtccacgtggcggcacgtggcgtctgt

SEQ ID NO: 577950 - DNA, 143 bp, Homo sapiens
  misc_feature (90)..(90): n is a, c, g, or t
  misc_feature (100)..(100): n is a, c, g, or t
aacgcatgatttgtcgtgtggtttgctctcagatgcttctctccacttcttctgcctctaaaccagaaagaccttaattattctccaggnccagttcaanggttatcttcctgggtgaaacttttccagctgccggtcgaacg

SEQ ID NO: 577951 - DNA, 941 bp, Homo sapiens
  misc_feature (43)..(43): n is a, c, g, or t
  misc_feature (72)..(72): n is a, c, g, or t
  misc_feature (74)..(74): n is a, c, g, or t
  misc_feature (78)..(78): n is a, c, g, or t
  misc_feature (82)..(82): n is a, c, g, or t
  misc_feature (95)..(95): n is a, c, g, or t
  misc_feature (146)..(146): n is a, c, g, or t
  misc_feature (181)..(181): n is a, c, g, or t
  misc_feature (191)..(191): n is a, c, g, or t
  misc_feature (218)..(218): n is a, c, g, or t
  misc_feature (252)..(252): n is a, c, g, or t
  misc_feature (263)..(263): n is a, c, g, or t
  misc_feature (265)..(266): n is a, c, g, or t
  misc_feature (311)..(311): n is a, c, g, or t
  misc_feature (324)..(324): n is a, c, g, or t
  misc_feature (328)..(328): n is a, c, g, or t
  misc_feature (364)..(364): n is a, c, g, or t
  misc_feature (370)..(370): n is a, c, g, or t
  misc_feature (388)..(388): n is a, c, g, or t
  misc_feature (412)..(412): n is a, c, g, or t
  misc_feature (434)..(434): n is a, c, g, or t
  misc_feature (466)..(466): n is a, c, g, or t
  misc_feature (475)..(475): n is a, c, g, or t
  misc_feature (540)..(540): n is a, c, g, or t
  misc_feature (552)..(552): n is a, c, g, or t
  misc_feature (596)..(596): n is a, c, g, or t
  misc_feature (601)..(601): n is a, c, g, or t
  misc_feature (612)..(613): n is a, c, g, or t
  misc_feature (628)..(628): n is a, c, g, or t
  misc_feature (660)..(660): n is a, c, g, or t
  misc_feature (827)..(827): n is a, c, g, or t
  misc_feature (855)..(855): n is a, c, g, or t
  misc_feature (927)..(927): n is a, c, g, or t
ctttttctttttcttttttctcttcctcctttccacccccagngacttgggaagggaaagaacgggaacctnanacanctantccccatatacanatactcacctccatggctcacaccagcaaattgtttgtgaaagagaaacangtccacccctccctcttaagggcccaccaggtctnggcatgggtnggagggccctgggctgggtctcttaanagatgtaaaggtgtggggtgcaagtcatttgaanaggctggaaantnntccagggccccaccctcctcttccctctgtgccctactgcctctnctggcatacaggngcangggtcccttcgtcccctcaacacctgttacactggntggggntgcagccattaacggtcnggcctttggacacaaaatactttngctttttggtctccttacgtgntcaccaccagggaggcatcttttctgtgggcnaactccagnatctcagccgtttggccccggttttcagttagcaggcggccggtccggcgcgtcccacaggcgcncgatgccatccnttctgcaggtatataccacggcagtgcctgcctcccacagcagntgtcnatgtccgactnntgcttacactgatgnctaagagtctgcgtaccaggtcatatatggcnaaggtcccttcctggtatccaacagctgccattggcatcacactgcagaagcccaaggactccaccgagttggactcactctcctccccttctcccaggctgggctgggaggccacagtctcaggtctaaaaacacccaccaccttgccggtggtggcactgaccancttggcctggcagtccacagagccagtnaggatcaagctgccatcctggtatggcagcaacacaggtgagttggccctggtggacctcagtccctttcantacatggatgaggg

SEQ ID NO: 577952 - DNA, 579 bp, Homo sapiens
  misc_feature (317)..(317): n is a, c, g, or t
  misc_feature (324)..(324): n is a, c, g, or t
  misc_feature (337)..(337): n is a, c, g, or t
  misc_feature (339)..(339): n is a, c, g, or t
  misc_feature (455)..(455): n is a, c, g, or t
  misc_feature (491)..(491): n is a, c, g, or t
  misc_feature (553)..(553): n is a, c, g, or t
  misc_feature (576)..(576): n is a, c, g, or t
aatgaactgctgacttttctaaagttctttaactgatcaattctgtatagagggatatttatctaaccactttccgtattttacaagtgctctttctaaaaaggaataactattatagctctatttccccaatctctataggctcatgagagattgcttgtgtaaatataaaagcaccatatgtgttcttaactcctatggctgcttgaagctcatgatgagtctttttgcagttttaattgttaagtacagaacaaacaattgtttggtgatggcctggttgaaagagagcatataaatatatcccagtggaactnaccaaanaagaccacacctnanaaattattgcattttctcattatgtgaggggttgatttgctttggttttaatgcagctcttttaatataaagatcttgatacagtgaaatctcttatttcaagtgtaagtatcttnaccacccttccctgccatggattccactgttcaagnagttcaacattacatgcatcgatgcagaggactgttttagaaagactggcatcctgtataanatttgtcaatgagccattcctgnttt

SEQ ID NO: 577953 - DNA, 1597 bp, Homo sapiens
  misc_feature (1)..(1): n is a, c, g, or t
  misc_feature (270)..(270): n is a, c, g, or t
  misc_feature (1001)..(1001): n is a, c, g, or t
  misc_feature (1019)..(1019): n is a, c, g, or t
ngtaagtggagcgggtatttatccagcgctgttgatgtggtgaccacgaggagaggtgttgtgcacatcttgacaccttgatgattgtgaacatcgcgaagaccgccaccacaacgatggtggggatatatacagacgtcggcgtgtggttgccacaaatagaagccgcgccgggtgctcgcctgttaaacacggggccccacgagatgtggttgttgtgaggtcctccccgcgaagaagaaaggtgtgatattgttactcccacaatcngcgggtgaaagggggagttttaagacttttttaaaaccgctgttgcccaacaagaggaaccacacatcttcacgacacgagcccttaattatggagaagtgtttgacaccacaaagcccggtgttgaaccatttggccgcaaaagtggtgcaaccccagacaccccccacgggcgttggggagacacagaatggccccgcggcgccaaatgatttttgtttggccccccacgatgttcgacccacgagttctgcgccaacagagggtgtcccgccgggagggcaaatttgtgtcgtgtgtgtgaacaggcgcgtggtggggtgttaaaattccgccaacagaccgtggccgcacgacagacgttttctttgcccccggggtggtgaaagacgacccaggcccgcgctccccacgagaacgccgcaatttaaggagaagcgttggccgttttccaaggggggaattttgtgttccacgaattcccccgggcactcccccacgcgaaaaatgcgcacgcgcttgtgaaaattttataagggccttggagacccacctggggcacccccagcgttggaggagaaagtgtttggtctcccgaaggggtgaaattaagatttttcttctaaagcacacatggtggtctgaaaatgaattgtggaggagagaagccactatagagaggagagtttataaaaggcacattaagcccccacggggcacttggtaatatnctgcacacattatgagtntatcaccacatcggtatatatagcgccactcgagagagagaagaatatatttggagatatagtggccccactctgagagggtgtctttgcacacaccacaaggctaatttcccacagtgtggtgaatccacacaaacccactccacagcccacacaagtttctctcctcgcgtgtcactgtttgtgccctctgagttaacagagagagaagctcgcacacaacttttcacaacactccacaaatattgggcgcgagaagaaaggagggcacacttaggtgagcctagcacaccacggctgtggagaacccaaaatcccacaagataattcaccacaccctcggcaccacgcttatttttctgtcttatactcacacttgtatgagtccacgagagaagcccaagcttcttagtagaacaccttgccactcgtgcacgatagtaatgttcttctataaagtagaatgttgagggcttcttgaaaatttctgctggtgctaacacaaacacttcggaagaaagggtgggaaagttactggagatagtccacccaagggacacaggaaacgggagatttga

SEQ ID NO: 577954 - DNA, 195 bp, Homo sapiens
gggggggggggccccccccccccccccccgggggggggccttcccccccaagggggcccctggggggtgggggggggggggcgtttttttttacccctttcccggggggcccccgggttccccccccccctttttggggttttttttggttgggggtcccccccccttttttttaaacccccccgcccccgggga

SEQ ID NO: 577955 - DNA, 116 bp, Homo sapiens
ctgcgtccatcagtagtaaaacagttaatttttaaccctttgcaggaattgctgatgggagaagactgcgagtcttctcccatcagataaccaacaaggtcaatatatagaatccg

SEQ ID NO: 577956 - DNA, 262 bp, Homo sapiens
cggccgcgacactgagaagaccaagttgaacaacttatcctggttggccttaatacagttgttattgccgtgttcttcctggcttttaagaatcggctgtttcaaccccagtgtggcccttacaggcagcattaagatggggaacttctttgcttccggcttctaccgccttcaaccccattcttggacccttggttctcatcccttttccccagcttcgctcccgggaggagggacccaagggccccctctgctcctgtgg

SEQ ID NO: 577957 - DNA, 165 bp, Homo sapiens
  misc_feature (17)..(17): n is a, c, g, or t
  misc_feature (50)..(50): n is a, c, g, or t
  misc_feature (90)..(90): n is a, c, g, or t
caacagccggtcccggncagtatccatcagctcttctatacgtccaacancatcatcctgcagtctgccctagtgtccggcctacgtgtncggccacgtggccggacacgtatatatgtgttacctacccttgtcggtccggcccggccactacgtgtccggcca

SEQ ID NO: 577958 - DNA, 333 bp, Homo sapiens
ttttcccttttttgaaccgggaaaaaaaattttttttggttcgggaaaaaggggggggatttccattgtccctacccccaggggcccgtttcccttgaaaagggaccgggggggcctcaaattttcaaaaccctggggggaggggaaaattggtttttttttaattggcaaattttccaggggggggggggggggtttttttttttttgggaggggtttttttgtagggcggcatattgggccgggggtttgttgggtttttagggttcccaaaattggggaaattttgggtttttgtttttttttttcaataaaggcccccggggcccccca

SEQ ID NO: 577959 - DNA, 1021 bp, Homo sapiens
gacgagtccttacgaccgacatggcctcaggacttccacgactctcgcaggttggtgtcgctccgaggtctcgcctcatggattaagggcaggagcgctctattcctaggatagcgatgtgtgaacgttggccagctgtgctggggtgcatcatatgccgctcgcattcgcacgtccagttacctctcaacttccgcgtagaacgcccacgttctcagtcgagtccactccgataggtgctgaagttggtgtcgagcctcgcagagcgtcccggtcactgcgaatggcacgtctttccaggtggtctctagggccgcacgtcgagggcatgtcttgaccgagcgtcgatggagagcatgctgggtgcggtcattcttgtaagctggaccatggtccggcttgagtagggtgctccgagcacaggaagccgacgcatggggacatttgactgctctgcacctgaggcaattcccctgctgtagcaccgtgggggtacaagttctaatacccgatttacaattacggtcgaagtacacggagtccccgtcactggacgcaatgaatgagaccttgtcttcatattgcgtgattgtctctggggactgtgatttatggtagtgattctgaaagatcacgtacctagcgtctaatataccgtgtgctccaaagattgagagacattctgcactccgatactgtgagcgacccttctttgtccgccagctccatcatcttagcatgcagattatcaatctggtgaattgtttccgacggacatggaggccacctctggtggtgaaatgacgaccggttgtaggcgcgtagacactatttcgaagcttgagtaattcaggatatggcatatgcagaggcaacgggttttatccgttaaacccggctcggatgaccggggcaggagtttccctcttaggacttttatcagattgttgtccatgtcttaaggtggcccttctcagtgggcggtaatccggccagctttggagatccgtataaaaactga

SEQ ID NO: 577960 - DNA, 239 bp, Homo sapiens
ggcctcccaaagtgctgggattacaggcgtgaactaccgcacccggcccatctctggaactttttcatcttccgaaatggaacctctgctcccgttaaacggtaactccccatttcttcctgttctaggcctcggcagccactattctactttgttttttgagatggagtctcactctgtcaccgtggctggagtgcagtgacgtgatctcagctcactgcacacttccgcctctcagg

SEQ ID NO: 577961 - DNA, 398 bp, Homo sapiens
gaccctcctcctcagcagacgcagctcctaaagcattttacagcatttccatcatcagttagcaggcttggtaaaggttgtgctttttttatttctaattcatctgcagccaactatttctacttttttttcttggagaatcgtaacaattagaaaaaactcagacaaactatgtagcctagaaagaacaaaaaaatggacaggtatgtcgcgtatgcataaaatataggtagatactagtcttttcatccagccacgtccataaagtatacacaaatgtgcacatgcttccagagatggcactcatgtgcacactgagcgaagtgtaacacccaacagaaagcagcgcactgcaatcataactgcagacagggagctgcgtctgcggaggaggggtc

SEQ ID NO: 577962 - DNA, 202 bp, Homo sapiens
  misc_feature (40)..(40): n is a, c, g, or t
  misc_feature (53)..(53): n is a, c, g, or t
  misc_feature (56)..(56): n is a, c, g, or t
  misc_feature (64)..(64): n is a, c, g, or t
  misc_feature (94)..(94): n is a, c, g, or t
  misc_feature (99)..(99): n is a, c, g, or t
  misc_feature (105)..(105): n is a, c, g, or t
aggtggatctagaggatccctccctattagacattaggangatgtgtaacatnagntatatttntgatatctagatggcagaaaaacacctctnaaatntattantggaagggatagaatagagtgttaactaacaattttttaaaaagaaattcacacatatgatatataaactgaattttttgaagtgatgtctaatagg

SEQ ID NO: 577963 - DNA, 890 bp, Homo sapiens
aactgtgttatcacaaggcttaacacttattatccttgactggtgagtggttttctttttccccgttagtgagtggctggtaattctggaatactgtcatctaaaatggctcgtggctaaaatctaccttcattttctgtttgaaatctaaactatattgaagtcataaaatagaacaagaaatacagcatctgttacccagcatgttttagctgtattacacacaataacagaaaagtaaagcagatgcttaagttgataaaagaagaacactcattataacttctattttaaaaagcatatgaaaggttcatattctctcatattttcaaggccttttgcttttcttgttaaaaataagatttgagaggaatttctggttaaactttgggtttactcatcacaagcttttcagagtaagaaaacaggcaatcgaaaaagctgtacttgtattatttacattataacaaggagcttttttttctttctgggaagctatagtgtagaaattgatgtaaaaaatacttagttgtattctttacacacagttgagaaatattattaaaataatgcaccaatattttataatggtattattaaaataatgcccatttgctggacacggtggctcatgcctgtaatgccagcattttggaaggccaaggttggtggatcagttgagcctgggagtttgagaccagcctgggcaacgtggcaaaacctcatgtatggcttcttggtaaccaagtgtctttgccaactttttcaatgcagaacttttgaggcgcattacttcccatgagctcagcaaatcctcgtagaggtaaacggcaggttcgagtgacgaactgcaatagtcgcattcttagctcaatgtctgtctctttcac

SEQ ID NO: 577964 - DNA, 690 bp, Homo sapiens
ccggtgctgctgggagaggctgagactccgtggccacactcttgtcctgcgtgaccaggtatcccgtggattgctgagctccttgctactctgggtctgagccctctggcacctttggcaccagtgaatcccagtctcaataatacctatgagttcatgagcacattcttcttagaagctcacgtctctgctacttcccaggattctgatctatcatctggggaggagatgaggttgattgcacctgctggaagtcctagacccagagatccaggagctttatgaggaagatgaggcttcggtgaggactgcaagcacgctggagtcctctctacagtgccagaacgctgctggagcatcgtactctatcttcactggcgaacgggctatgctagtgtgtggcacggagtgtggttggactgaatagaatgtaagacgatttcacggccagaccagcaagtgcatcacaggttgtaggcagacgacggacgtagttccatgtgagatctagtatgacaggaggcgtgggaagctgggtgcacccaaggcccgggctttcccggggcccgttatcgtcttctggcccccttggttaccttggaccgcggaatatcgcttatggcccgtgacttggcaacggcattgctacgctacgtggagccgcctgggcgctcgtgagaggtacccctg

SEQ ID NO: 577965 - DNA, 310 bp, Homo sapiens
ggatcaaatgatcactgcatagcctcctgagtagctgggactacaggtgcgtgccacatgcctggataattttttgtattttatagtagagatggggtttcatcgtgttaaccaggatggtctgaatctcctgacctggtgatctacccacctcagcctccctagttttttaacagataatttctatctctttatcattatcttctatatggtaagacattgttcttctactttcttttatttctttagacatgctttcttttagtattttgaacatatttaaaatagctgatttaaagtctctgtttag

SEQ ID NO: 577966 - DNA, 234 bp, Homo sapiens
ggtcactctaaggacccagtagtcggacggacgatcagcattgtgccaggatgagtgtatgtccttaatcaatctttcattcatcagtaacatttactgaactcctatgagcaggtactgtagccttttttatccttcctgagagaaatcaaggggacttatcagtgggtttcaggcaatgataaggaaatgtcaatttatggtctgagttttcctagtcagctttaagggtaa

SEQ ID NO: 577967 - DNA, 132 bp, Homo sapiens
gcctcctgcgccaactttatatgtacctggctatacctcggctggggcttgaactaagtaaagcagccaaggcgtacagatctagatagcagagaagtacagtctcatatctaaaacattgcaactactgta

SEQ ID NO: 577968 - DNA, 250 bp, Homo sapiens
ctgacggaaagacggtattcgccatgcgacgtgttcgacgtggtctacgagcagaaggtgatggacggcaaggtcgtcggcaccggcaacatcctgtccgcccgctttaccaaccgcggcaaaacctacaccgccgtgctttataccaacaagcagggcaacagtacctactacaccgcagacggcaacagcctgcgcaaggccttcatccgtaccccggtcgacttcgctcgcatcagctcgcgctttt

SEQ ID NO: 577969 - DNA, 320 bp, Homo sapiens
catcacaccacggagcctcaggtcacccttgatgtggcagttttaggaactggccttaggaaatctaactatgaaaccaaggttatggagtatcccccctcaggaaggaacactgaacaactgattgacagtttttttgccgccagccagaccaccaagtggcccattaaccaagagaaccagcgcaaccagatacgttgacccgcatttcctacctttcatgtgctttgcccagcccagcctgcataccttactcatgatgtcaattcccaagtttcgctaataaaaacatttttgcaagccttttcagggagccaaca

SEQ ID NO: 577970 - DNA, 275 bp, Homo sapiens
gggacccattcaccatttattgtaacaaaaagggggtagggacaggagctctaggactggcccgggggtgttctaaaggccacctggggttggaaaacaatggcctggacccttcactggggggcaggctgtgttccaagtccaccaaatacctcaagaagttaaccagttccgttccagcctttttgatcaggggggtcagctgctcctttgacttttaaaagaaaaacttggcctcggcctgaaactttgggtttttgaccttctccatcccc

SEQ ID NO: 577971 - DNA, 378 bp, Homo sapiens
cagagcttccagtttatccattttaatggattaccagcgtgctaatctgtctgcagctccttcaagcactccagttcctggtcattaaggtcaggtgtgctgggatgcttcaaatatctgtgtctttcaattttgcaatatccaaagacaagtttgtacggtgtccttctagatgcttttttattctttcccaaattttgatcttattaagagctattaacagtttccacaaatccttatgtttagctcctacaaagggccataccatttgaggttgaggtgccactacatcgccatggttcctgataataggaacccttgccgtatttcttatcatttctaccatctgacaattttgttcagaccatctgaacatag

SEQ ID NO: 577972 - DNA, 465 bp, Homo sapiens
caatactaacagcgagaaggtgaaggcacagacgagttagtactgggaacgccggaaggtgggagggcatatcataacatttctagttaatcaaaccaccggtggacaccttctttggcccatcagcaaggactagcgtctggtccgtcttggtgacagtgacatagaaggtgagggccccaccggtgctcttgggacgaagatccatgctaaattccccatcctgcagcaatgagtcccggatcaccgaacatttctggccccgttgtgtcagcccattcacgtaaaagcttgagcgttctttgccaacgagaacaaccacctcagctggcgtgatgtcgacgaacgtcctcccggagacggcggcccagacggagggcgagtccttgtagcccatgatggccgcgtcctgagaggtcccggtccgccatgaggttgtcgatgtaggcgttcccaggcggccat

SEQ ID NO: 577973 - DNA, 85 bp, Homo sapiens
cccggggcccccccgcccccccttttttgcccccagggtctttgcggggcatgttgggaaaggacgggcttttggcggaagggga

SEQ ID NO: 577974 - DNA, 349 bp, Homo sapiens
attcgcggccgcgtcgacatttgcaactgaatagagcaaatgctttatactttatattttgaagtcaggtgctgagcagagcacccaagcaactgccagagtgaggacagcttcaaaaggtagccacagtgtgacttctaagctgaatataatcaaacgaactccctttcatcctgttttcttccaaactctcagaactactatcgttccacacacaaaacagccagggttgaaaactggagcacagaattagcataaagctaactttaaataagcagttttctgctgaggtggaaggatatacctaagtaatttcgtcgacgcggccgcgaatttggtagtagtagta

SEQ ID NO: 577975 - DNA, 311 bp, Homo sapiens
  misc_feature (227)..(227): n is a, c, g, or t
cgaggtgagatctgaacgtacgcaacaatcctctgaagcaggcgcaaagcgcagggctcagcttcgagtcgcgccacagcctgcatgacctgatcccagaggcggagcagcagctcagggttctccagagtacgaagatttgcggtcggcacggtcagaatgatggggtgcgtggccagctctatccagggcactggattctcctggatacgcctctgacactcatncagggtggactcccctaggaagagagaccatggagcttgaaatcctttcccaaatcccttaaattacaacatacaacttagact

SEQ ID NO: 577976 - DNA, 395 bp, Homo sapiens
gggggtgtcggtaaagtcctacagattatagagtccgaattgtaccagaggagaagaggtttggacgtgggcaataaccaagagtagactcctcagtaggaatcgaggagacagaggacgtaagggtcaaagttttacagaattagactagtgaagagtggaagtctctgcacacacaacaaaaagaaatcgggtcaggacttaaagacgacatcgttgatattccatcttttaatccggtcagtgtaattaccgacggtagtcctacttccaaaatttggtccgcctaaggcctaggacgaattcctagttagtcaatttcaccttcgttaatcagagatagtaaggtcaatttcaacttgtacgaaatattagttttatagaccctcgttata

SEQ ID NO: 577977 - DNA, 964 bp, Homo sapiens
cggacgcgtgtgtaccgcctgtgaggaggtccctgagggatagggcaagttctggggtgacatcctggatttgcaactatagagagctctaccatacgcccatacgtggtgctcagctccacacctgaagagttgatggttgggccctgctgttttctgaagtgcgatagcatcctacgaagccggttgctcaaggtgcttgtagggagttcgggctcgagaatgctgtgatcttatcttggtgggtctaaggaacggtccatccccttttgatcgagcgagcaccctcgagatgtgtggttctcctagatccttggtgtgctatatccacgtcgttacattctcttcgtatcgactcaccagcaaaatcatgcgtccacacgtaagtacgaggagaaggcaggtactaattcgcactaacaatgtagttgtgccaggtccttctaaaccgagagaaagaagcgtttaccatcgaaatttatgttctttccatgaagttagtgccagcctagtaacctatctctacacagagccagaggggaggactgagccactgttccaatgcattagtcttccaccgacgattttagcgtaaaactccgtacagaattgttctttgtttcccagccgaaaacttgcaccttccgcctgcgttccacggggttgtgcgcacaccgagggaccggctatggaagtttcatcgtaagaacctcctcattcccgcttgttgtaagcgcagaagcaagccgatgcgtggaactcgaaaaggatattagcgcggggattaccgggacacagcacagaaggttccccgttgggaacattgcggttgtacaacggggacaaggtccttcaccctggaattaatcctgagggcaccgtacgatttcgcagggtgatgggatgttcgatggtgggggttatggacccatttcggtggtgccccaattttgcaggtagtttc

SEQ ID NO: 577978 - DNA, 296 bp, Homo sapiens
tgcatgtacatggcaggaggacgacgaggactccaaacaatacatctatccacttccttgtataggaagaagcgctctcgcgatacccttgttccgtaaaactgttggttccagttaggccattccatgaacccgagggccatgaagaaccgctctcgcatagccttgctccgtaagcgtcggttccagttataccgttccaggaacccgagggccgggaagaaccgctctcgcatacccttgctccgtaagcgtcggttccagttataccgttccatgaactcgagggccaggaa

SEQ ID NO: 577979 - DNA, 307 bp, Homo sapiens
gtactaatgtgcctctgtttcgtttccttccctccctcccttcctcctgtgcttccttccttccttccttccttccttccttccttccttccttccttccttcctccctaccttccttaccttccttcccttccattccctacctatctatactcttcttactatcttttgactcactctgtcaccaaggcgggagtgccagtggtgcgaactcactgcaacctcagactacccgggatcgggtaaaaactagtgcctcggccttctgagtagctgggataacaagtgtgtgccaacactgcctgga

SEQ ID NO: 577980 - DNA, 1166 bp, Homo sapiens
  misc_feature (1166)..(1166): n is a, c, g, or t
cacatcacacacacacatcacaacaccctgataagggctataccttgatcttaaggcactcatgctgctaatgtacaaacagcgttctggaataccacaccggccctagcgtgttcagaaaatcggacgcgacccgcagagtcggcacctagtggcccaaggggctccgatcgcattcccatgaccacttcctgacttagtccatctcacgtgacgacatggtgcacgcattgttcaccactggcagagtacggtgacccaacaggggacgcgtcgcgtacgtagaccgccaatacgagtccgaggacccctaatggaaacagaaacgtcatacacgtaggcctacataacattaacctcactgtacaattcacgcgtcctatactcaagaacggagtctctccgggaggtctctaatgctacctgcgctctatgtggatctcgatctaaactaaaaacaaggaaatgtgacgacatagtacgcctgcaatatacatacatataactaccaatacgtcatgacatcactggaaacactcctggaccaggataaggacactggagatcaaaggcaccctgagaaaccccagaggcgtcgtcacgtgagctttccacagttttgagtttgggggaccatacaggtacgtcatggacggacgccgtgtcacagggacatgctaacgttgagaacgcacaagtcctgggtctctcgtatggcgtgggccatactattctgtatcaacctggacaccaaactatgtcttctaattgatgatcatccggtgtctatttatctgagggtgttaaggaaccacaccgggcaggtcaaccaccaataaaaataacggcacacaagcgcaaggataacaaagtatagcgtcgcactctgtcggggggcacccctttggacaagaatgggttagattttacaccaaacttccaacccgtggcgcccagtgaaaacaagttacacggttgacaaacaggttacttatctaccaaagttccaagcggatgaagcacgggtatacgcagtatccaacgttagcgttgccagagcaacacactatcgtccatcccaatggcagaagctcgaaagggggatacagaacagggggatgcccaagtgagtggtccggccgcctccttactcgggagattcaccn

SEQ ID NO: 577981 - DNA, 145 bp, Homo sapiens
  misc_feature (32)..(32): n is a, c, g, or t
  misc_feature (132)..(132): n is a, c, g, or t
ggtgatctagaggatccctgatgctgcacaantctgcagtactgtttatccgaatcctgctactgatgtactgaatgtaagcaaagtttccggcaatgcttcctacactatttacagtgtatccggacagcnttgttgcgaaacg

SEQ ID NO: 577982 - DNA, 979 bp, Homo sapiens
  misc_feature (8)..(8): n is a, c, g, or t
  misc_feature (506)..(506): n is a, c, g, or t
gctcttcncggctccagctccgccgccagctccagcctttgctccccctcccaaagtcccctccccggagcggagcgcacctagggtccctcttccgtccccccagcccagctacccgttcagaccagcagcctcggggggcacccccccgacagcctgcctccctcccgctcagccctgccagggttccccagccatgaatctcttccgattcctgggagacctctcccaacctcctcgccatcatcttgctactgctcaagaatctggaagtcccgctcgtgcgccggaatttcagggaagagccaggtcctgtttgcctgtggtgttcactgcccgatatctggacctcttcaccaactacatctcacgtctacaacacgtgtatgacaggtggtctacatagcctgctccttcaccacggtctggctcgactttatacgccaagttcacaagctacttacgatgggaaccatgacacgttcagagtggagttcctggtcgtncccacagccattctggcgttcctggtcaatcatgacttcacccctctggagatcctctgggaccttctccatctacctggagtcagtggccatcttgccgcagcctgttcatggtagagcaagaccggcgaggcggagaccatcaccagccactacttgtatgcgctaggcgtttaccgaacagctctatctcttcaactggatctggcgctacccatttcgcagggcttcttcgacctcatcgccatgtggcaggcctggtccagacagtcctctactgcgatttcttctacctctatatacctagactcctcaaggggaggaagttgagttttgccggcatagccccggtcctctccatctctctcctcgggagcacggagaaggcagacggacgccgcagaagatgtaagcaggtttcccatccagggtgacttttcaaacacccactctggtgctccatccgcttctga

SEQ ID NO: 577983 - DNA, 678 bp, Homo sapiens
  misc_feature (8)..(8): n is a, c, g, or t
  misc_feature (326)..(326): n is a, c, g, or t
  misc_feature (339)..(339): n is a, c, g, or t
  misc_feature (341)..(341): n is a, c, g, or t
  misc_feature (412)..(412): n is a, c, g, or t
  misc_feature (476)..(476): n is a, c, g, or t
  misc_feature (478)..(478): n is a, c, g, or t
  misc_feature (497)..(497): n is a, c, g, or t
  misc_feature (504)..(504): n is a, c, g, or t
  misc_feature (506)..(507): n is a, c, g, or t
  misc_feature (509)..(509): n is a, c, g, or t
  misc_feature (518)..(519): n is a, c, g, or t
  misc_feature (532)..(532): n is a, c, g, or t
  misc_feature (535)..(535): n is a, c, g, or t
  misc_feature (540)..(540): n is a, c, g, or t
  misc_feature (558)..(558): n is a, c, g, or t
  misc_feature (561)..(562): n is a, c, g, or t
gctcttcncggctccagctccgccgccagctccagcctttgctccccctcccaaagtcccctccccggagcggagcgcacctagggtccctcttccgtccccccagcccagctacccgttcagaccagcagcctcggggggcacccccccgacagcctgcctccctcccgctcagccctgccagggttccccagccatgaatctcttccgattcctgggagacctctcccaacctcctcgccatcatcttgctactgctcaagaatctggaagtcccgctcgtgcgccggtgagaggcccaccagggctggcgaaggagagagatngcgggcgggggtngngggacgtcgcaggactcaggaagggcttgggggcactaggggcaccggttccacccccactgcttgctggngatctctacttctaggttactgcgtctccaggggatacagctcccttccccagactggcggggngngcatacagcttcactgtgnactggcntnnangcccccaanntcagccacccacnagncccantctgggcagcccgagggntcnntggcaccgcggtcacagggcacccgtggcacgcgcgcgcaggcgcgctgtgagtctggtgacgctggaccggggcggccacgaagggacacgggagggaaggtgaccggattgggg

SEQ ID NO: 577984 - DNA, 347 bp, Homo sapiens
gcagacgcacgagcctcatccccatttatccctttttttcatatagtcaaggttcatttagattgcacggtttacattttcttggcttacatgtcttccctccggcccccaccagtgagatttattggagcatacatatactggacaaattaaattggcatatatttatggtatataacatgatgtttggatgtatgcatacatggtgcaaggattactacaatcaagctaattaacgtggctcacgccggtaatcccagcacttggggaggccaagtggggtggattacctgaggtcaggagttcaagaccagccgggccaacagggtgaaaccccgttctctact

SEQ ID NO: 577985 - DNA, 130 bp, Homo sapiens
catccttacacttacactgttgcctttttacttttagcccttctcagttcagcacgtgatttactttgcattgcctgaggcaccctaggttgcacacactttttcacatcgttgcttccatgcattcggg

SEQ ID NO: 577986 - DNA, 717 bp, Homo sapiens
atttgaaaactgagtgagatgacattagaaccagagatggagcatctcgtgtgtcgccagaatgttactcagggtccatgaatgctgtgatgctgggaacttacggagagattcagccacgagttgagagtgataaaaatggctaaaatgggaaatggtgagcactcttatgattagtgagatctggtcaatacagacccattgaggatgggtaaaagaatactagcagtaaaataattacatataatatagtaagaatattctttagagggcagcgttactgagtgatcaaagcatagtagaaatcactttggttaaaagtgactcaaattattcactcttaggtaatctaccaacttcctgatgtttttctttaatatttggaactgttcaagacagaatggagcctacatatatggtgttccactaggtatgttccaaaatgtcatatcatggagaatggagacaccttccaggtgtctgtataaacccatcttctctgtgtacttctggcatcttattttggtaggatcatttggcagggggtaaagtacctgtacttttggcaccattgaaaccagctctggcccacttgtttgaatagctatcagactcaggtctctatatgctttatatacagttgagagaaccagtgtaaatgctcttgaaattgtatctttccatgcttcagaccagatgcattaacaaacatggatt

SEQ ID NO: 577987 - DNA, 203 bp, Homo sapiens
  misc_feature (85)..(85): n is a, c, g, or t
  misc_feature (194)..(194): n is a, c, g, or t
ccctggagtagtcaacaaacacactccaaatcaggatttccacccaaggtcttcctgctactaaaggggagcatctaacatttgncccagagtcagaagacctggtttctgcttcttgagttgtcagctgactccatctgggagagcagattgacaccttctttccagctctggtctggggtttctccatctancaaaaacaa

SEQ ID NO: 577988 - DNA, 588 bp, Homo sapiens
  misc_feature (322)..(322): n is a, c, g, or t
  misc_feature (385)..(385): n is a, c, g, or t
  misc_feature (425)..(425): n is a, c, g, or t
  misc_feature (558)..(558): n is a, c, g, or t
  misc_feature (584)..(584): n is a, c, g, or t
aattcgcggccgcgtcgacaatcctaaatgcaatcttttggaagtctgctattaaaaagcctttaaggatttactaacttcgagtctaagtgcaaggggacgaaagcttaagcctgtcagacattccttttcttggacaaaaagatcaaagtttcctacaaattgctaagctttgcacaagggagaagcctacatgtactagtgcatggaatcagtttcatcttatttcatggggactcttctcccactggaaagaaacagaatgaggaatgaatctaatggtctctcatcagaagtggtaaactggtctctatatcacgantcagacgttttttaagcagacgtggagcagacgaaccagcttccgtagccacagaccactacnggtatctaagctaaagcaagatgaacaatatccggatcantgaactgtactaaagggcagggtcaccactacaaaaaggagttgtctaaagcagaattcaatacgcgggtagagtccactaagggttgtccatgagccaacgctagaacgcgctcaactatagcgactgaggnactagcacgaggccttcttgggggcngttc

SEQ ID NO: 577989 - DNA, 506 bp, Homo sapiens
  misc_feature (17)..(17): n is a, c, g, or t
  misc_feature (297)..(297): n is a, c, g, or t
  misc_feature (346)..(346): n is a, c, g, or t
ctatgctggagcgcgcnatagatcatagctcactgcagcctccaactctcgggctcaagtgatccttccacctctgcctcgcctgtaggtgggactacaggtgcaggccactgtgcttggctcattttaaaactttgtagtgatggggtctcactgtgttgcccaggctgttcttgaatgcctgggttcaagtgatcctcccaccttagcctcccaaagtgctgggattacaggcatgagccatcgcacccagcctacctgctctgttctagctccctgcttccttcacgggcctgngcactggtaggtgctgcagggaaatggtctgtgaaaggacctcatatgncaaacgatcttacagacagaagcgtggtctttttttttttttctttttttgagatggagtccattctgtcaccggggcggagtgcagtagatgatctcggctcactcttgctctgcctcttgggttcagcgattctctggctcagctccctagtagctgg

SEQ ID NO: 577990 - DNA, 120 bp, Homo sapiens
acaagtcttgcatccttcctccagaccacgtcacgctctttgtatcactcgcagctcaagtacaactggctgtcctttgaccactgtgacttcctcttccagctgtttttacaaaaccgc

SEQ ID NO: 577991 - DNA, 214 bp, Homo sapiens
  misc_feature (213)..(213): n is a, c, g, or t
atacgaatcgagccggtcccaatttatgcagcttgcggggtgctggcgcgcgcttctgctcggacgcgtggacacgggggttgcacagggtggcgtcaaatttctcggccggccgatgatgccgctaaaaatcagctcaggctgttttggcaaccgtagacgcacgctgttgcgcagcgtcgggttcatctcgacgatcatttgggccgcgtng

SEQ ID NO: 577992 - DNA, 420 bp, Homo sapiens
aaaagccatttctaagctatatgcagtaggttgctttttttgattttctttaaggcggagttcactctgtgttggcccaggatagagtgcaagggtgcgatctgggctcaccgaaacctcggcctccggggttcaattgattctcttgcctcagcttcccaagtagctggattacaggcatgcgccaccatgcccagctaatttggtattttaagtagagacagggtttctccatgtgggtcaggcgggactcaaactcttaacctcaggtgatctgtctgcctcggcctcccaaagtgtggggataacaggcgtgagccattgcgccgggcctggactgtacattcttaagggcagaggccttatctgtctaaggcaagtgggtatcctgaacagaacctgacagtaagactctgataa

SEQ ID NO: 577993 - DNA, 912 bp, Homo sapiens
ctcctccaccaggcatgcctcctcctggctccttcccacccccagtgcacctcctggagccctcccactgggataccccagccatgcccacactatgctcctggggctgcaggaatggcccacatcggcggaaccacagagcacgaatcctggtcatggacactcactacacacccattcccaccgggtgggatgcccatctaggcacatgacatcagatgccagaacgcacaaccatggcacctcatggaaaagcgacacaccacaaacgactgagaccccacaggctcatgacagggcacagcccaacgccaaagacacaacaccaagaaaaatgcccaccagcccatggaacacagccgaccgaagggagcgatgaacaccaccgaagacgcacaaccaaaacagagagacacaccaaggggccaacactacgaaccaaagcccaccaaaaaggaagagccgtgagaccacacacacagtagacagcaccaacacaggacaaacacagacacaacacagaacgcaagccaaaaacgcagaacgcacaacgagaccacacacacaaactagaaaggagagaacacagaccaacgcaaacgaaacagaaaaaaaacaaacaaccaccaaaaaacaagcaaaacgacagcaaaaaaagcaacagacagagcggacaagactgatagccgcgggcacgccgcgaacggcgaaaagacgacgaccaaacgaacgaagaacaggccacgagcgaccaccgcgcgaaagaccgagccaggcgcacgaaggaaggacaacggaacagccgacacgcaccagccgaggggacgcagaagagaacgcaaggaggagcacgagagcgcaacagggcggcgcaacgaagagccccagaaagaggagggagagagggagaag

SEQ ID NO: 577994 - DNA, 338 bp, Homo sapiens
atttttccctttcccccccccccggggccccccccgggtcctcccttccccttccccttcccccccctttgggttcccttccccggggggccttttgattttccattggggtcccccgctttcccatttttggttttttttttgcgttgcgttcccctcccccggggttgttttttccccccccggggcctttttttttaaacttttttcccggcctttttttaagtgccttccccccctttctttttgccctttttaccccccctttcccccccccccgggcccattggggttttttccggcgtggattttaataaattttttttttttttttttta

SEQ ID NO: 577995 - DNA, 1747 bp, Homo sapiens
  misc_feature (934)..(934): n is a, c, g, or t
  misc_feature (1414)..(1414): n is a, c, g, or t
gttgatatggttggtcctgctccactcttcgtctcccgcttgttgattgttatttattattttggtggtggtgttctctcatcgatgatgtgggcgagagtggttgtatatcacatcaacacccgctgggtggggtgtgttttagtcatgtggtgagaatgaagggagattagtggttttttgattctatgattaattactgtgttgtttgttcctccccccctgttgttacagcggtggtgtttagagatggtgtctgttgctcacgaacgagtggtagttccgaccccccgagcgtggtttggttttggtgtgcttcctacgtcattaggatgggtgggcccccctacatgtggtgtgtttagggatatgtaggtggggtggccctccctccttctgctgcttttagttagtttgtagaggggagaaggagtagtatttttttctgttggggtagtgtgataggatgttggtgtgggtagaactcccccccccccaacttactacagctacttactggttgttgttgcttcctgctacttacgtcatgctcccgccccttggtttaatatgatgagtcctcccccctgcttcttaatagtgtgcggccgctcgccgttcggtagttatgattgtgtggtgtgtaggaagaatcactcctctgcatcaccagcaaacaccaacacgtcgtgtgttgtatagtaatagtgtgttgttgttgacccacacccaccaccaaatatatagttgagattgtggtgtgtaatagtgtggggggtggggtggggcagagtagagaaagagaggagtagtattataggtacttccctcacactgtcgcatcgtcggtgggtgttaatccacaccgctgtgcatcagcactttgtactctcttttttatatattataaaaaagagaagtagtattgttttantataagaatagttagtggccgcaacacagcagcagagagagagccctgttgttgtggaacacacaacagaactactacccctctccttattatatatagtagtggggggtgagaagaatagtgtttcgtgaagaagagatataccacacactatattattgtcttgcgagagacaccacacacacatactcttgtttatagagagagagatagtctctctctcatagtgtgtgagagatacacacactctcaccccacactactctctcacacactacactattctacaataatatatagtaccacacacacacactctgtgtgagagagagagagatatgtgtctcgtgtgatgaaatagtgtgtgtgagagagagagagagagaaatattttgtgattgtgcgcggctctctgctatggctgtgtggtctcttttcaatcactgttctctcacacaaaactctccacacacacaccgnctcacacagcaggtgtgtgtgcacacacacttttatgaatatttgtttatgaaatcatgttttccccaacacagagtgatatatattataacacaataaataagaagagagatatttgacaccacacacacacacacaatatatatatataaacttccgacacacccgcgcgcacacacacccctcatccatatatttgttatatctcgcttgggagaggtgttagagagagagaggagagagagaggggtttgaacacacacacagtggtttcaaaggcccccccgggcgcaccccaaacaccacaaaatcccttttttcccaaaaaaaaaa

SEQ ID NO: 577996 - DNA, 215 bp, Homo sapiens
gggattacaggctgtagcactgtgcccagccccttttctcagtaatacttagagttggtgatgaatatttatccgagaaccaaagtggttattatctatgctatatacaaggggaaagaaaggtctaggaagccgataggtcactggacactacacacaggacagttgattagctggaccaggactgaacacagctgttagccgttgagaagctt

SEQ ID NO: 577997 - DNA, 144 bp, Homo sapiens
actctagaggatctcctatgagttggagagggcaggcacccaaattcccagcatttcattttttctttgcagcaccaggtctcactctgtcccccaggctggcagtgccagtggcagctcatcaacagtggcagcaatccatgg

SEQ ID NO: 577998 - DNA, 226 bp, Homo sapiens
aaaaaaacaaaaaacaaaaaacaaaccacatttttttagagacagggtcttgctatgttacccaggctgaactttttaagtagaagtatactccaacataccaatgaaaagtataatatagtaaccacgtaacccacagtaccatagtcattttttgtcattatcaagtagagtattatgtagtgtcacataattgttctatatttttatatgcactgcttcacat

SEQ ID NO: 577999 - DNA, 151 bp, Homo sapiens
  misc_feature (7)..(7): n is a, c, g, or t
  misc_feature (66)..(66): n is a, c, g, or t
  misc_feature (68)..(68): n is a, c, g, or t
  misc_feature (97)..(97): n is a, c, g, or t
  misc_feature (105)..(105): n is a, c, g, or t
  misc_feature (119)..(119): n is a, c, g, or t
  misc_feature (128)..(128): n is a, c, g, or t
  misc_feature (147)..(149): n is a, c, g, or t
ggatcanaagaccttcggcacgaggtccaaggccctttccttcatgtatccatggaggagagacananatacacatcaataccaataagataggggnatccatanaatagacattcagnaggtatggnccaccggattttatcttannncc

SEQ ID NO: 578000 - DNA, 1058 bp, Homo sapiens
attttgcggaaggttctcatgtaagttgtataatggatgacttatccaattgggaataattcctttccggccaatattggatgcccaaggttcttgtactgaggcagaaccttcaggtgctggaagggctagaaatacaaagagtgaccacggtaccaggaataagggaaacgtgctatggtaatttcagggcaacttgaatcagtagtcccaagtggccatcctcaagttctgcgggtcatatcaatgccctacttcaggaaatcttctgaatccgtgttactttaggtggacatacctttcaagacaataactaggtttgtgcagtgctttgatgaaaacctcagaatttgtggccttccagccaggcatctgtggtttcatattgtcttaagcatttgttgcatccctatggattgcagctcttctataggttcgctgttgctgaaccaagaaatagaggcattacacagatttctagagcaaacctgctcaattcatataacagagttgttacaggaagatgcaggacaggctggtatcattctcagagatacaaagtgatctttggaagttgaaagaatttcttgtgggttaagagtttgtcactgacttgtgttcctgaaccatgaagcaatgaatatgtgggcatcgagataatagtttctctgtgataaataaacacagtaacaaacttttaacaaagagaggaagatgaagttgggcttagattgggtggaaggagatgcctggtaagggatctggtcttgatcctaacatgcaatggagttatacctatgttcaaatcccattaccaatcgtgtgtggcactcaagcaagttatcttagcctctctaaaccgttagtctttctcatcgtgcatgatgagaacaactgagaggacctatctttacaagagttaaatgttaatagatgtcaactactaagaacactaatcaatgctataattgttgttttgttgtgctgacactaatcaatgctacaattgttgttttgtcgtgcttcagacctgaggttatacgacctcgatttgaccc

SEQ ID NO: 578001 - DNA, 415 bp, Homo sapiens
cggcacgcgagattctggatattaatcccctatcagatatatgagatgcgcatatcttctcttattccatatggtgactttttcactctgtggagatgtggtctttgatgtatagaagtttttaggtttgaaatagtctaatttatctgtgtttacttttgtgggctgtgcttttggtgtgcatattcaagaaatccttggcttcaacggtataagggacttttaagggattttaggtggcttagactatatttctgtgctcacctttctttattcactcattagttgatgggcatggaagttgggtccatatctttgcaattctgaattgtgctgtgatcacgtgtctttttagagtaatggtttactctcctttgggtagatacccagtagtgggaatgctggtcgtgggttt

SEQ ID NO: 578002 - DNA, 226 bp, Homo sapiens
  misc_feature (16)..(16): n is a, c, g, or t
tgcaagagtgcatggnctgaggtctgctgaccacagcctactttgagaataaggtgttgtttcagtcactatgagcccttggcaaaaatttgaacccatgcagacaaagccctccttgaccatcatttgcccatctccttctcactagtagtgcctgttgtcagcaagttggtggaaatcttttggtaccctttctcacacctttacactcatacgctgggaggct

SEQ ID NO: 578003 - DNA, 1071 bp, Homo sapiens
ctgtcctcagacaacttcgtcacattttcacggctataaggacacagaaggactcttttaattctgtatttatcattctacttctctgtatatatagtttaataacctgctagggctgtacactttgccaagcctcgcaacttctcttacactgcatctctgcactaacacttcatatacctgctctcacgagccttacaacgcctactagcacagccatcgctccacggaacttgcctcggcaccactgcacattttcaacacctctctttgcaccattgctctcaaaccacagcgcatgtctcaatccttttccttgctcacctcagtcccaagcaacacacatcatgccttcacatgtatccattcaccccacaggcctttcgctactactgctctaacccatgctctcattacactggcctaaacaggttccggcctctatggttccaacaactctgtccatctaacgcacccctctttccagcaaaggggaatctcggataaggcccttaactgacactaactggctcttgggacaacaccaaaacaccacggtatacaatgcacgtgacacacacggggccagaacgccaaagaacactcctccctaaccactcttcacggcgacctcccaagaaacgaactgacgtctcccaacatcaaggactgggcaccactcatgacgggaccttacaaacgtcttatcctttcaaaacacaaattaacaggctctacctcattaccatataataattccccattgactctcctaaagctactattctctccaatggcacggaccacgctcctgacaacccctttgaatggtacaagtcgaactggtggttctcaattttcacgtatcccccgggcccaacccgtccaatatacacctcaaacaaatatggctgaccgccctctaggaacgggccaggacaagcgcactatgccccacacaatctaaccaacagccaaaaaacccggaacaaaagaacaacgcctagcacacttaaccccacagagcaaggaacacctcatccaccaaagaacccccgggcatacagcaac

SEQ ID NO: 578004 - DNA, 155 bp, Homo sapiens
tcatatgatgctggctgtaagacttgaaccagaggacctggagctgctgatgcagcggcagggcctggtcactgaccaagtctcactagcacgtctagtggagcggcacctgcccctggcagtaccgagcagctgctcatcccctagtgcataca

SEQ ID NO: 578005 - DNA, 299 bp, Homo sapiens
ggctgggaactggggaggcatggctgagttcggcctccaaaggcggcctttcgtctttctctcccgagtctctccgagagtgcggtctctccgaaagcgcggaggcctcggggtggacagcctggaggagggggctctaaacgtggcaggccccgggcttcctccgtgttgggactccaatccgaagtggaagtggggagacctggcgtcaagccccccccccgctgtttccctaaaccaagtggccgtgggcgagtcatttgccctctttggctctttgcaacatgaaagaagccata

SEQ ID NO: 578006 - DNA, 195 bp, Homo sapiens
ggtccctgaggactgctgtaaccaggatttcatcaccaatgtggtatttcaggatgttggcaagttccttggcatctcccaagagtctgcaccgttctcttggtggcagggctcgaaaaacagaatctccatctatcagccattagcaagtctatagctctatgatttggacacactactgctgctacagagata

SEQ ID NO: 578007 - DNA, 1532 bp, Homo sapiens
ctgtgcccgtcgtggcccggtcgttgtctgtgtgtcgccgttcttgcgcctgtggcgcgtcttgtcgcttgcgcctgtcttgcgtcgcgtcttcggcttgtcgtgcgtgtctcgtcgcggcgttgttcgcgctccgctcgctgttttccgtccttccgtgcttctgttcgctgcgtttccttctttgttcgttcctcgtgtgtgtggctgtcgtgtcttctcgctccgtttcgcttcgttcttctgcgttctcggtctttcgcttgttgctcctccttgtcctctccgctgctcgctgctgcctagtatttcttgtctggtttgttttcgttttgtttctgtgtgttgtttggttttttgtggtgtggtgtgtgtgtgttgtttgtattgtttttgtggggggtatgttgtatagtggttggtgtgtggttgttactgttttttgttgttattcgttttatgtaggatacaacaactactagtttagttcagctttagctttctttatttttttttgtttttgtgtgtgttggggtgagcctatgtgttggcctatttatcttgtgtttggcctgggtttttttttttgtctggtttgtttgtttgtgcagtgttggtgggcgcttgtcgcggctgttggttcgcgtgcgtgccttgttgtggttctgggcgtgatgtgtgtcgaggtcgtatcgttgctgccagtttctggtctctggctgcgggttcgcgattgtcgctgtgttgtggcgttttggttgttttgctgggtggcgcgttgctgcgtgttcaggtggttgcctttccggctccatctgcttgctgctgggatctaggggtggccgtctcgtggttgtctgtactatctggttttttcgttcctatgtgctgcggttccagcgcctcttgtgtcctgccttgggtatggcgtattctatagggtctcggtagtgcttcggtacagggtatccagggggcgtcttgtggcagagattatgcttgcctgttttgtccccaggaaacctgtaggtgctgtgtctagccgttctgaagtggcccatgggacccgtgagcgagggcgctcgatagcgccgatacacgagacagtcaagtgccacgttcgcgtccagccgcgtaatgcggtgcaccttgtaggagtcctagggttggaccccgtggagagtaccgcatatacgtgagcacccagtagtgtggacaatggagcgctgacgagtcctgcgccgcagtacactgagcaccatgggtcccgctgcgtgtatgccacttggtagtcatatgtcaggtagcctacgctcagaccccaccgtcaagttcggtgagcgtgtacatggacgcacagtggagtctgacattctctccacatagggagcgcttagagcgtcactagccttgggaagtgagactagaagaggggagcagaaagggacctggagtagacaaaggccacacacatcattatcattactgtattaagtgtctggctgctctctggacctgcgcgctcaggagta

SEQ ID NO: 578008 - DNA, 155 bp, Homo sapiens
gttagggttctcacttgctctgggtctgcatccacaccctggtaaaagctatcctaccaattcctacaacagtgggtgtcactagtcttgacaccctaaattctcaaaggtcagcatagcggtggttttggagaccatcttttcttctgttttgc

SEQ ID NO: 578009 - DNA, 412 bp, Homo sapiens
tctagaggatcctgaagttcaccgcgtcaaacaccaaccaaccgatgaagtcgatcttcactggggatcggtgatcaagacgcaaaacattgcgggggctctcaagcccacagtgatcctggtggactattcggattttggttgaaaggcggcgacagggatccgctggtacgtctggctggaggtgcgggatctggtggggaattgtctcgacggcctgggttcggccaagcgtggaagggtctcggtgaacccttgggccagcacctgacggattggccccgtcaattgtcaaatggggcgggccacctgggttataatcgaaccctttgaaagtacgtaggggggaaaaaccccccttggagaatgcaggtttcgcacggccgtcaaagcgtgggccaaggtgcggtga

SEQ ID NO: 578010 - DNA, 416 bp, Homo sapiens
tgagacagagtcttgctctgtcacctaggctggagtgcatggtgcaattttggctcaccagcaccaccgcctcccaggttcaagcaattctcatgccaaagcctcccaagtagctgggactacaagtgcgtgccaccacacccagctaatttttatatttttagtagtgacagggttttaccatgttggccaggctggtcaggagctcctgaccttaggtgatccgcctgccttggcctcccaaagtgctgggattacaggcatgagccacagtacccagcctatatattatgattcttaatgttttttttgagacagggtcttgctctgttgcccaggctaaaatgccatgatgcaatcacagcttgctgcaaccccaaactcctaggctcaagtgatcctcctgcgtcgacgcg

SEQ ID NO: 578011 - DNA, 170 bp, Homo sapiens
gctgtatctgaaacacaactgcatacgttttctacggtgatttgtatgaaaggtaacatcaaatcaaggagatagattcagtaaagtcgcgtagtgttcagtaaggatgatatacattgaatttgtactagggacaggttgatgagcaacaatagtgggaaaacttgtaa

SEQ ID NO: 578012 - DNA, 142 bp, Homo sapiens
ctagctgcaatggtgtacctggaaatctcacaatctgctcaaacctccaaatgggtctgactttggtatttctacatgtcttcctatactcagcactagctccacctctccccagtcctgcatcaatcctgcccctctgcaa

SEQ ID NO: 578013 - DNA, 111 bp, Homo sapiens
tcgatctaaggatccgtgagcaggatgatgatgtgccccacttttccctgtgtttggacggcatagacttgtttacgtagaccagaaccatttagaagaatacttgaagct

SEQ ID NO: 578014 - DNA, 433 bp, Homo sapiens
cggggggggtcccctgggggtggccctaagcccaatcagggaattgggtccccgttttccggtttcgggccgggccctgaaaaattgccctttcccattgtgcccccgggccccagggggcccgggcggtgttaaaggggggccttttttaaaaaaaaaccgggtgccccggggagctcccccccccggggggatttttttggggaggcccaagaattgggatttaaaaacggggccttgggggcaacagcccccctccccccccaaaggggggccccccccctggcgggtttttttttttggggggggggggaaaattttcccaaagggggccccagtggccggctcccaagggccccccgtttgggttttggggccggggctgtccccccgggccccttgtttttttttttttggtaaaaggggcccttta

SEQ ID NO: 578015 - DNA, 156 bp, Homo sapiens
  misc_feature (112)..(112): n is a, c, g, or t
  misc_feature (154)..(154): n is a, c, g, or t
caaagtatcagccttctaaccttctacctaagggtacatgtactcccttttacgattgtgtttaacatttcccctaccactttgccgttacctttatcgttgtggttaacangacacagtacattcccaagttatagcaatgtaagcaggcagnac

SEQ ID NO: 578016 - DNA, 133 bp, Homo sapiens
taccactgctgcagagtacatcaatgaactcgacgatggctcagtaagcctgactggctataacgcacggtactgttcttgaaatacctaatggctatgaaattctacgtcagtttgtgacaagatgggtact

SEQ ID NO: 578017 - DNA, 187 bp, Homo sapiens
gcccaccctccctacctcagaatctcttttctgcctgctcttcacccctcctgccttaccagacttttcctgcctgcatgcctgtcctccttcttacttggccaatcttgccagcttccagaacccctcaaatgtcacctccttctgagacatcctaaccctatactctgtgtctctgaccttctca

SEQ ID NO: 578018 - DNA, 664 bp, Homo sapiens
acatatattttcatggttcctcattgaaaaaaaaaatcgcgtgatggatgtgatctgcattttataaccaatactaaggcctggcacatcaaatacaacttgcctaagctgaacagcaagtaagtatgtggaacaggtgtgtgcagtcttacagaagtgtggtcccgaatcgccccactgctgttgccaaggaaattcacaaatctttttaggaaagtattaggggaaatcagtgtgccacacggtgaaggcccccaactcacagccttagatagtctttcacaaaactaaattcgggggcgggggaacatcttgagacatccataataggtatctgcccaatgcttctctttaataacgacaagatactggctattaacaggacaggtctctgagcgatgtacagtccataacatattctcacggagtcgaagtccacaggattccccataagacagggtgagatcgtcatatccagtcgggtgagaaagacctatacaacgtgataaatgcggcttctgacatcctggatcctggtatattacacctcgacgtgcattgacatgtacaatctatgctactcgacgatagtacaggaacctaatcagctaacatgtctttggagacacggatcctgtccgcgataaaaagctaggcatgcagg

SEQ ID NO: 578019 - DNA, 362 bp, Homo sapiens
cgcggtcacagggatattcaaaccatatcattatctaggagatataactcaggtccatatcaagactccaaatctgaaagaacatgaagaaggccaacctatattcattttcctataacataacatgcatccaaaatccataaaccaaataggcctaagtataaaatataatactttcagggaagcgatctgaaacaggaaaagggagccaataatgaatatatgtaagatggtggtgtgcataaagggaacaggtaaactttgtcaaatttaggtgtgcatcaacaccatttggtaagcttaactatattaatattcaagcaactcagatgtacagaatccgcattttcagtgaagcacgc

SEQ ID NO: 578020 - DNA, 914 bp, Homo sapiens
  misc_feature (3)..(3): n is a, c, g, or t
  misc_feature (23)..(23): n is a, c, g, or t
  misc_feature (63)..(63): n is a, c, g, or t
  misc_feature (93)..(93): n is a, c, g, or t
  misc_feature (109)..(109): n is a, c, g, or t
  misc_feature (124)..(124): n is a, c, g, or t
  misc_feature (175)..(175): n is a, c, g, or t
  misc_feature (177)..(178): n is a, c, g, or t
  misc_feature (185)..(185): n is a, c, g, or t
  misc_feature (188)..(188): n is a, c, g, or t
  misc_feature (208)..(208): n is a, c, g, or t
  misc_feature (210)..(210): n is a, c, g, or t
  misc_feature (223)..(223): n is a, c, g, or t
  misc_feature (237)..(237): n is a, c, g, or t
  misc_feature (278)..(278): n is a, c, g, or t
  misc_feature (284)..(284): n is a, c, g, or t
  misc_feature (288)..(288): n is a, c, g, or t
  misc_feature (303)..(303): n is a, c, g, or t
  misc_feature (314)..(314): n is a, c, g, or t
  misc_feature (328)..(329): n is a, c, g, or t
  misc_feature (332)..(332): n is a, c, g, or t
  misc_feature (344)..(345): n is a, c, g, or t
  misc_feature (347)..(347): n is a, c, g, or t
  misc_feature (349)..(349): n is a, c, g, or t
  misc_feature (356)..(356): n is a, c, g, or t
  misc_feature (370)..(370): n is a, c, g, or t
  misc_feature (384)..(384): n is a, c, g, or t
  misc_feature (406)..(406): n is a, c, g, or t
  misc_feature (408)..(408): n is a, c, g, or t
  misc_feature (410)..(411): n is a, c, g, or t
  misc_feature (415)..(415): n is a, c, g, or t
  misc_feature (420)..(420): n is a, c, g, or t
  misc_feature (426)..(426): n is a, c, g, or t
  misc_feature (434)..(434): n is a, c, g, or t
  misc_feature (436)..(436): n is a, c, g, or t
  misc_feature (440)..(440): n is a, c, g, or t
  misc_feature (442)..(442): n is a, c, g, or t
  misc_feature (451)..(451): n is a, c, g, or t
  misc_feature (457)..(457): n is a, c, g, or t
  misc_feature (461)..(461): n is a, c, g, or t
  misc_feature (465)..(465): n is a, c, g, or t
  misc_feature (473)..(474): n is a, c, g, or t
  misc_feature (495)..(496): n is a, c, g, or t
  misc_feature (509)..(509): n is a, c, g, or t
  misc_feature (513)..(513): n is a, c, g, or t
  misc_feature (534)..(534): n is a, c, g, or t
  misc_feature (543)..(543): n is a, c, g, or t
  misc_feature (557)..(557): n is a, c, g, or t
acnacgccgccgccgccgtcacnatggcccattacaaagccgccgactcgaagcgtgacagtnccggaggtacttggagaagtcgggggtgcnggacacgctgaccaangtgttggtcagcctnatatgaagaaccagagaaacctaacagtgctttggattttttaaagcatcncnnaggagcngcnactccagaaaatccagaaananagctgcttcgccncagaactggccganatgaaagagaagtatgaagctattgtagaagaaaataaaanactganagcnaagcttgctcacgcnatgaaccaccncaggaggagaagcnngcngaataggattcnncncngtttganagacaatgaaaaanggttttgtatgacntgaatagtttgtatagtatatnancnnttcngaacngatgcnatagaacncntttnanatgtttaantcaccnatcncacnctgttaannacacatagaatcatcaataannactcaatataacnttcnttgggtcttaaagcaggagantccaaagtnaatcctgacacaanacctaaacacagccatctaactcattaccttaaaagacattctgtttattagtctgattaggaatgatggcactggttgtattttagccaagacagtttagcatggagctattccttggtgcagttcaggatatgaacacaggtacagtcattctttgaaggtgacactgttctgtatattccctataggcagctggagagatctgtgtgacacaagatgcttttgtacgggttcccatgaatcttctgctcttgtttgtgtgacatggaacaaataacttctttgccaccactttgccttagataactgtgtgtgtgtgtgccagtttgaactctgacaccacattttccttctat

SEQ ID NO: 578021 - DNA, 122 bp, Homo sapiens
cagctcggacctctcgctcacgaacagggttggtgtaaaataggcggggtagatttgccgagttccttttacttttttttaacctttccttatgagcatgcctgtgtgcggttgagcggaga

SEQ ID NO: 578022 - DNA, 117 bp, Homo sapiens
acgtgagaaacttataataaatgtcttgagtcttgaattattttaaattctgttaaaagtagcctgccaggatttcagatttggaaaatttttgcttaccaaggtttactagaattg

SEQ ID NO: 578023 - DNA, 1198 bp, Homo sapiens
atccgagcgtggactggcggtcaggatgttcagctggatggggctggcaggcgggtcgtggcgcgaacgcgctgtgcggcgtcgagacagcgtgtgtcagacggtgagcggagcgggctgcgttctggttctagcctgcgctatgggtgctgccgtctggaggaggcgtaccgcttccacgagttccacgtcggccgtgcgcttggagtgatcgctcgacgttcggagacacgaatgccctattgatccttgcttggttgggccaagtactagcactctgggcaagagccacctttcagtcgagatagccttactgggagccaggagtttcgcgcagcggcattgacggcatgtggtcgcgggaagccgcaattcaacaagaacttccattcgattcggcgctgtgaatggtatcggaagcagacttgacgggcaagcgactcgccagggggaaatggcctttttagatccggtgggaacgcgcgcgaagagagaggcgcggtgttcagcaaatgcttccagggcggcgttccggagaacgggctttatcgcgtgatatcagaatttcattgttgcgtcaagcagcgtcccccgaaatcagggttccctggagaggagcattcagcggtcgatcgacgaaggcccccggtgcatccgttcacgtgcggcgagcacagcagcgcaatctcagccggaggccttatgacctttctgccagggttcctggcgagtggatatggcctgaggagcggtggacccggcatcattcctggctcttttggacgcgtcagcaagcttggaccattctcaggatggacttctcaggaggccatcaagggccttccgggggccagggccgacagatccgggtcggcgtggacaagggcggccacatggcccgccgcgcgttggtgacggggccatcggggggccccaatgtgggccctatgagacggtgcttaacaaggccccgagaatagaggggcaacaaaatggcgccctttggtgggccgcccccttgtaaacaacaggagaaacgcgcgctactaggggatgccccgcacggccattgaaatataccagagcccgccaaaagatcggggacagcacacacaccctacatgcaagcgagcgacaagagacagtacaccaatactaaagagacgacgctgtacgcgaacaagccacactatgctca

SEQ ID NO: 578024 - DNA, 977 bp, Homo sapiens
gtgctcgctaccacacccggataatttagtattgtgagtagagatggaagtttcaccatcttggatcaggctagtcttgaactcctgaccttgtgatccacccacctcagcctacccaaagtgctgggattacaggcgtgacccatcgcacttggccaggcagttctcttagatgtaatacagcaccctcatttcttccccgctatcatatgatcctggctagatggccccagccccagaagattgtttggaatggaggtatccagtactttttctcagtcattattaaagtcaggaaatagaatcacgataggcaacgacagaaatcttggagcttgaccctcattagaagaaacttacaggttcaggagtccatctttgcaagaacctcttggtctctccagtatttttgtacaaggaggtcagggttgcgtatgcatcgagtaggctataagtccctcaccagatctttgtagaactttttataacatgcctttgaggtatccagtatctacaacatagccatctatcatgaaccactgtacctcagctgagtgcccaagggcccacccttgtgttgcacacgttggagggtgtttactgtccctcgtcaacatgtactccttccacctctccctctgtttgtactgttctgtctttgatattcacaaccttattggcctactgtcatgcttatctggtccgggtagcaccctgactgtgatgccataccggactggctgctctggtctccgcggtcagtgcccgcctgtgtctgcttccagtcgttacgttgcggcaggacgggacttcgctcagcggggaggaccgggccgtcccagtcgaggggactctgcgcttgttccccactggtctgacacctgcccacatttcacttttgcgaggattgcgggggcgccagcggagtggcccgttctcactctgcctcgtccttccactttcttctccccccaagc

SEQ ID NO: 578025 - DNA, 205 bp, Homo sapiens
cgagatccccagtaaggttcaactgtccacttcagccttccatgtgcactctggcctgtctgcacccagagtcatcagcaatgaggcagctagaagcaggaaaagcagcagacactcagagtctgcgtgtgcgctgaaacagaaattgttccgtggcagtagaaatctagcccctatctatgcctagggatcacagcagtaggga

SEQ ID NO: 578026 - DNA, 305 bp, Homo sapiens
tctaaggatctaccgctctcacccacccgctgattattgtatatatcggtagagacaggctttcgctatgttgaacaggtacggtcttgaacttctgacctcaagtgatctacctagcttggactaccaagttctgggatgacggacgtgagccaccgctccccgacgcgtaggtagtatttgagaggcgagataaaacatacgtgcacagcaaacccttcccgtgatatacggacagaccgagtgacagagtgctgtggccgttaggggcagaggccgctcacggattacgagaaggctccctg

SEQ ID NO: 578027 - DNA, 261 bp, Homo sapiens
actctagcaggatccccctgtaacggctgatgcacaagaatcacttgaaccaggaggcaaggttgcagtgagacgagatcactctgctgcactccggcctgagcaacagagtgagatgctgtctcaaaaaaaagaaaaaacaaacaaaaaaagaaattaaaaatagatgtgtttagggtgtggtttaactgtagcatataagctaatgcaagacagttaatgcatttagctggtattcttttttctttatttcggttcaag

SEQ ID NO: 578028 - DNA, 1011 bp, Homo sapiens
ggcgcatcagggaagtgaatcaggcgccgtgtagtgggttgctgggctgagccttgctgagagttagaggcagcgccagggaagaggccttttgtagttggtcgggagagggatgtcgaggaacacgagtgtcggtctggtgcccgcttccggtaaggttggactgtggcattgaatattgatgagaccacgttcgtgactcgatgaagatggccgggcgacgggccatggtcgagggccccgagcggagcggcagaaggggggatcgtccgtgcccgagcgaccactatgaacactcttgacagactggcctcttggagagcaagacgtatgaatgaagacccttcatttattaaatacccagagattttcagggtccagtagacatgagcaccggagcacgggcacacgtcgacttgggcctttgaaaggatggcttcaagtctcgttttaacagtgctacccagcgtcgtatagttacaagagggcctgtccaaaattgccttcctgaactcaagaaatctgtctggtggaatcctccgtgactggaatgatacattatttccattcacacggggcattttcgtgcacgcgcggtgttgaacaagtcagccgagttcaccctttttttgcttgcaaagttggctttgcacaaatggtaaggatgggcctgctgagaaaaagaagttaaggggcgcccaaattgcccagtggataatgtcttacatgcaaagaacgttggtgataggtccatggcaagtgagccgggaattatcttgacctcggcgatgcggcacattgcagcggtacccaacgtaccgcggatcactatattgccaccgtaaggccctttgtgggggtaagcaattgtgttcactccctcagggagcgcccctcgttgagctttcgcacttttttggtaagagacaacactatctatttaggtgccccttaaagtaaattggggtaactactagaacaatcgcttgcacatcaagttgtcaccgttac

SEQ ID NO: 578029 - DNA, 831 bp, Homo sapiens
gaactgtttccattgagacccatgcatcgtataggataagaaactgaggttcttatcatttaataggataagaaattgaggttcagagaagccaagtaacctgcctaaagatgcacagctatgagaggcaaagctggcactggcttggtaataacgatggaaacggtctgaaatgagagcaggtaccatttcttggagctcttagcagagcgcgtgaggaccctgtctaagtgccatgagaccttagcagaggctgtgggtgccccgccccattccctccactcactcttccttgcaggtcgacctgcccttctttgctgaggcctttctctgcctccagagcctgcttggtcctcaggctgtaagtgcaggcagagctaatgtctctccatagctgccctccaccagcctgctcctgagacacctgctggccagcagcctgaagcagaatcctttactcagattcagccgcacagatgctcactgcagagatctccaaggcctgtggtcatccttgagcccatctcagatttgtgtggatagggtgttagagaacatggaatcagctggatagagtggttcatgcttgtaatcccagcactttgggaggctggggtggggggatcgcttgaggccgggagtttgaggccagcctgggcaacacggtgagactctgtctctataaagaatttaaaaattagccaggcatagtgtggtctcggctgcttggaaggctgaggcgggaggattgcgtgagcccagcagttcaaggctgcagtgagctatgactgtgcccctgcacccagcctgggtgacagagaccctgtctct

SEQ ID NO: 578030 - DNA, 220 bp, Homo sapiens
tacgatgacccttggagtcgtcggatccaccaccactccgctgtacacgtgaccgcacggcgccgctgtggcctgagattgagaggcccggcaactgcaccatcttcgccccgtacaacgcggcctgggcctccttgctcgctgtgagatgacctccgtctgccccggtgactcttctggggacctgccttacttcccctactggctaggcatcaagata

SEQ ID NO: 578031 - DNA, 628 bp, Homo sapiens
  misc_feature (502)..(503): n is a, c, g, or t
  misc_feature (507)..(507): n is a, c, g, or t
agactgaagaaggctcgagattaatgcaaaagctgatctgggattgcatcttggacctcaactctcccctttttattgttaagggacactactgggacaattttttttttttttcgttttgagacagggtctcgctcagtcacccaggctggagtgcagtggtggaataataactcactgcagccttgaactcccggactcaagcaatcctcctgcctgagccttccgagtaactgggactatgggcgtgtaccacaacacctcgctattttttttttcctactttttgtagagacggggtctcactatgttgcccaggctggtttcaaactcaagtgatccttccacctcagcctctataaaatttgaataaagttgtagatgagattggtcataggattgtatagtgtatcaatattagatttgctgattttgacaaccctactgtggttatgcaaatttgtccttgttctaaggaaataaatactgaattatttaggannaaangtgcataatgaacccattttcaaatgcttatgaaaattacacatatacacatgtgtgcatatacacaggcatgcatatacaaacagagggaagagcatgcacgtgtacatgagcaaagtgc

SEQ ID NO: 578032 - DNA, 613 bp, Homo sapiens
taactggggagcattactctttatcccaatattataataatatctgctctacaattataacctaggaaaaaccaggccatacagagataggagctgaagggacacggtgagaagtgaccagaagacaagagtgtgagccctcgtgtcacacccggacagggccactaaggggcggtaacggcagtgcccaggaaggcacccgttacttagcgaccttggcctagcagtagcgccagtgcctgggaaggcacccattacccattacttagcagaccgggaacggtagtctccctttccccgtggggagttagagaagactctgctccaccacctcttgtggaaggcctgacatcagtcaagcctgccttgtagccatccggaggcctaaacgtctccctgtgatgctgtgcattcaggggatcatgctccgtggtccactttcagtgtcccactcgtgtacaccgtggctctgccttctagaatagcagtagcagaattagtgagaattttcaaagtcttggatctctcagagcaaatgcatagaagcaaataatgacgtacagctgtcccccctctctctccgccttggataccaaacagggaagggcccccc

SEQ ID NO: 578033 - DNA, 132 bp, Homo sapiens
gggcccccttcccgggaaccggcggtcggagctacgcgctcgccgcacagctttgcaacccagcacttccccctcgggcagcccccccttttaatgcagccttccccttcgctcaccccccgctgggtccca

SEQ ID NO: 578034 - DNA, 877 bp, Homo sapiens
  misc_feature (751)..(752): n is a, c, g, or t
  misc_feature (756)..(756): n is a, c, g, or t
gaactgtttccattgagacccatgcatcgtataggataagaaactgaggttcttatcatttaataggataagaaattgaggttcagagaagccaagtaacctgcctaaagatgcacagctatgagaggcaaagctggcactggcttggtaataacgatggaaacggtctgaaatgagagcaggtaccatttcttggagctcttagcagagcgcgtgaggaccctgtctaagtgccatgagaccttagcagaggctgtgggtgccccgccccattccctccactcactcttccttgcaggtcgacctgcccttctttgctgaggcctttctctgcctccagagcctgcttggtcctcaggctgtaagtgcaggcagagctaatgtctctccatagctgccctccaccagcctgctcctgagacacctgctggccagcagcctgaagcagaatcctttactcagattcagccgcacagatgctcactgcagagatctccaaggcctgtggtcatccttgagcccatctcagatttgtgtggatagggtgttagagaacatggaatcagctggatagagtggttcatgcttgtaatcccagccagcctctataaaatttgaataaagttgtagatgagattggtcataggattgtatagtgtatcaatattagatttgctgattttgacaaccctactgtggttatgcaaatttgtccttgttctaaggaaataaatactgaattatttaggannaaangtgcataatgaacccattttcaaatgcttatgaaaattacacatatacacatgtgtgcatatacacaggcatgcatatacaaacagagggaagagcatgcacgtgtacatgagcaaagtgc

SEQ ID NO: 578035 - DNA, 422 bp, Homo sapiens
  misc_feature (305)..(306): n is a, c, g, or t
  misc_feature (314)..(315): n is a, c, g, or t
  misc_feature (365)..(365): n is a, c, g, or t
  misc_feature (393)..(393): n is a, c, g, or t
  misc_feature (406)..(406): n is a, c, g, or t
ccccccgcctcgtctttattattcagagcggggcctgaggaatgaatggcgtggacaatatcacgacctgacgctgttgcctatccaataatgcagcccgtaccatttctttcaaacaacaagaaagagggggtccttgcgtgggaagaaactgtggcaagggagaaagcttcccgcggtacttatcaagaaacatcggtcttggtgtcttcaagaacacccaagggaggggctattgaggggcaccttacatttggacaagaaaatgggccccttcacttgggtaatgttgtccattcgagggnncggatccnntctctggcgtggtaggaccaagaatgaagaatgcagaggactcattgtcnatccgccgagacttatctgcactacatnccgcaagtacaanccgcttcgagaagcgc

SEQ ID NO: 578036 - DNA, 335 bp, Homo sapiens
ctttttttcccatcagtaacatatgtattctaaacttttccaaaactgaaaatcaacttatcggccacgcatggtggctcacacctatatcccagcactttgggaggcagtccgatcacaaggtcaggagttcgagaccagcctgggcaacatggcgagaccccatctctactaaaaaaaaataaattagccgggcacagtgcatatgcctgtggtcccagctacttgggaggctgaggcaggaggactgcttgagcccgggaggtggtggttgcagtgagccgagatcatgccattgcactccagcctgggtaacacagagagacttcatctcc

SEQ ID NO: 578037 - DNA, 279 bp, Homo sapiens
aaaccttgggggtttttgtttttgggggggggggggggctctcccctgggggaaaaacgggttttttttcccccttaaagggaggttttttttctttggggtttttttataaaattttatagaaaatttcccccgtgtgtgggggggggggggggcttttttcccccggggttttttttccccttccccccccctttttgggggggggggtcccccccccccccccccggggtttggggttttttttttgtgttttaaaaaacccctttttttttttta

SEQ ID NO: 578038 - DNA, 311 bp, Homo sapiens
aaaatatcgaagcaaattatttgtattttctttgttccttaagactctcataattcttaaatgattgagaatctcaaagagtatatgtttatattgattatattgatatttagtgtggtagaattatacacttgaaatttttttcaaatctatttttagtttagatttcacagccttaccactgttgatattatgggctagataatgcttgttgtgaggactgtctgtgcatgcagagagtttagcagtatcatggcctctaccactagatgtcagtagtacccatgacccagtataaacagaatatcctg

SEQ ID NO: 578039 - DNA, 201 bp, Homo sapiens
gtacggactcaggtacaagttcagccgtccggggggcaggcactgcggccgagggcaagtggtgggtgcggaagaggatcggagcctactttccctctgctcagcctgggaggagctgaggccctacttcagggaccgtgggtggcctctggcccgggcccttctagacgtgcaccagaaacaagggggggccgtggggta

SEQ ID NO: 578040 - DNA, 1384 bp, Homo sapiens
  misc_feature (438)..(438): n is a, c, g, or t
  misc_feature (738)..(738): n is a, c, g, or t
tcccttgttggcccaaaatttttttgggcgggtcaggaaaaaagcggggggtaggggtccctttctttcccatccctctacccagaaagacaccctccaagtgacagacagaaagcccaagagctgtgttgcctcagaggacctggggaggcagacaattggtgtgtagtgatcttcgtgtgtccctcgagcgaggctgcggatagggtggcaatctctcctgtgctctccaggccggcaacttgtgattgctccatgtgacgccgctgtggatacctcctgtgatttctgccggctctcactatactcagctctcggcaaattctgcccaggtgtgggctttacaatataccgggtgtgactcacgggcctgtggattattgccgcacaggtggggctctccaagaggcggcgcccctcgcgtttatctctgtggcncgagtgtgtgtgttcttctcccagaggggacgagttttttcacagtgcctctccagcgcgtgtgtgcagcgtggcgagctctacaaaatgctcttcagagaaaccctcttgaaagaggtgggtggcgccgctcacgaggtctccagtataaaccctttcggggaaccccgtgccttcaactcgtgagaagcctggtctcccggtgttgttggtgcccagcgaggagacctctcccggggtctccacattctcttctcaggctccggggtggtgtgttgagacccagggggttttttcagngaattccttctcgcgggtctcgttgctctcggggccatttggaccctccatatatttggggctctctcgcgtatgtgtgttccacctctcgaaagggaactctgtgggggccagaaaaactcgtgcgtttgccccggaagaggcggagaaatctcccacttttccaaacacttagaaccctgttgcgcgcttcccccattttgtgggcccccctttcagagggcgttacctagtgatttttcccctcctatcaatgtaggggtctcattcttccccaggggattatgggccaaaagtcctcttttccattagaaggggcccttttacagactctttcgaattttctcccagggggtacgaggcccctgttgcggcccgaggggtatccacgtctatattcacaaggacaccctcttggcgacaggtgcccttgttatagaatttgttgcgcggcccttccagaccggcttacaaattgacgacaaggagactctgttgtttcccggtcttacaaaaactttgggctctggagaaacatttccactttgggacagccccaaaaaggggggtttttggtcagaatcttgggagggagacaaaatacgttggagagttctctcaaagtgggtgtgcggccccaaaaatc

SEQ ID NO: 578041 - DNA, 101 bp, Homo sapiens
tctgacactgcttaacaccatccccagctcacgggcttctcagcactttacctaattactgacatggctcttctgaaaggtgttatctatatcttatcgta

SEQ ID NO: 578042 - DNA, 301 bp, Homo sapiens
tcagggtcggggggtatcagggattgacctctgtgtcggtaacaactccctgccggtgatggtgatgtcttgttttcggatcagggaccatcctgtgttgcgcattttgtcccagcgcacacggaaagcaggagagggtgaacagttggatgttgatgaatcagcctgcagtgtccctagtgatccggcaagagtggacagtggtgttgatctggtcctcatcacagttcctccgtcacgcacatggacttgtgatgtgaggacttgtcctgtgaagggccatgaatttgttagtcggtga

SEQ ID NO: 578043 - DNA, 3706 bp, Homo sapiens
ggcacgagggccccgtcccggcctcgcgcacctgctcaggccatgatgagcttcggcggcgcggacgcgctgctgggcgccccgttcgcgccgctgcatggcggcggcagcctccactacgcgctagcccgaaagggtggcgcaggcgggacgcgctccgccgctggctcctccagcggcttccactcgtggacacggacgtccgtgagctccgtgtccgcctcgcccagccgcttccgtggcgcaggcgccgcctcaagcaccgactcgctggacacgctgagcaacgggccggagggctgcatggtggcggtggccacctcacgcagtgagaaggagcagctgcaggcgctgaacgaccgcttcgccgggtacatcgacaaggtgcggcagctggaggcgcacaaccgcagcctggagggcgaggctgcggcgctgcggcagcagcaggcgggccgctccgctatgggcgagctgtacgagcgcgaggtccgcgagatgcgcggcgcggtgctgcgcctgggcgcggcgcgcggtcagctacgcctggagcaggagcacctgctcgaggacatcgcgcacgtgcgccagcgcctagacgacgaggcccggcagcgagaggaggccgaggcggcggcccgcgcgctggcgcgcttcgcgcaggaggccgaggcggcgcgcgtggacctgcagaagaaggcgcaggcgctgcaggaggagtgcggctacctgcggcgccaccaccaggaagaggtgggcgagctgctcggccagatccagggctccggcgccgcgcaggcgcagatgcaggccgagacgcgcgacgccctgaagtgcgacgtgacgtcggcgctgcgcgagattcgcgcgcagcttgaaggccacgcggtgcagagcacgctgcagtccgaggagtggttccgagtgaggctggaccgactgtcggaggcagccaaggtgaacacagacgctatgcgctcagcgcaggaggagataactgagtaccggcgtcagctgcaggccaggaccacagagctggaggcactgaaaagcaccaaggactcactggagaggcagcgctctgagctggaggaccgtcatcaggccgacattgcctcctaccaggaagccattcagcagctggacgctgagctgaggaacaccaagtgggagatggccgcccagctgcgagaataccaggacctgctcaatgtcaagatggctctggatatagagatagccgcttacagaaaactcctggaaggtgaagagtgtcggattggctttggcccaattcctttctcgcttccagaaggactccccaaaattccctctgtgtccactcacataaaggtgaaaagcgaagagaagatcaaagtggtggagaagtctgagaaagaaactgtgattgtggaggaacagacagaggagacccaagtgactgaagaagtgactgaagaagaggagaaagaggccaaagaggaggagggcaaggaggaagaagggggtgaagaagaggaggcagaagggggagaagaagaaacaaagtctcccccagcagaagaggctgcatccccagagaaggaagccaagtcaccagtaaaggaagaggcaaagtcaccggctgaggccaagtccccagagaaggaggaagcaaaatccccagccgaagtcaagtcccctgagaaggccaagtctccagcaaaggaagaggcaaagtcaccgcctgaggccaagtccccagagaaggaggaagcaaaatctccagctgaggtcaagtcccccgagaaggccaagtccccagcaaaggaagaggcaaagtcaccggctgaggccaagtctccagagaaggccaagtccccagtgaaggaagaagcaaagtcaccggctgaggccaagtccccagtgaaggaagaagcaaaatctccagctgaggtcaagtccccggaaaaggccaagtctccaacgaaggaggaagcaaagtcccctgagaaggccaagtcccctgagaaggccaagtccccagagaaggaagaggccaagtcccctgagaaggccaagtccccagtgaaggcagaagcaaagtcccctgagaaggccaagtccccagtgaaggcagaagcaaagtcccctgagaaggccaagtccccagtgaaggaagaagcaaagtcccctgagaaggccaagtccccagtgaaggaagaagcaaagtcccctgagaaggccaagtccccagtgaaggaagaagcaaagacccccgagaaggccaagtccccagtgaaggaagaagccaagtccccagagaaggccaagtccccagagaaggccaagactcttgatgtgaagtctccagaagccaagactccagcgaaggaggaagcaaggtcccctgcagacaaattccctgaaaaggccaaaagccctgtcaaggaggaggtcaagtccccagagaaggcgaaatctcccctgaaggaggatgccaaggcccctgagaaggagatcccaaaaaaggaagaggtgaagtccccagtgaaggaggaggagaagccccaggaggtgaaagtcaaagagcccccaaagaaggcagaggaagagaaagcccctgccacaccaaaaacagaggagaagaaggacagcaagaaagaggaggcacccaagaaggaggctccaaagcccaaggtggaggagaagaaggaacctgctgtcgaaaagcccaaagaatccaaagttgaagccaagaaggaagaggctgaagataagaaaaaagtccccaccccagagaaggaggctcctgccaaggtggaggtgaaggaagacgctaaacccaaagaaaagacagaggtggccaagaaggaaccagatgatgccaaggccaaggaacccagcaaaccagcagagaagaaggaggcagcaccggagaaaaaagacaccaaggaggagaaggccaagaagcctgaggagaaacccaagacagaggccaaagccaaggaagatgacaagaccctctcaaaagagcctagcaagcctaaggcagaaaaggctgaaaaatcctccagcacagaccaaaaagacagcaagcctccagagaaggccacagaagacaaggccgccaaggggaagtaaggcagggagaaaggaacatccggaacagccaaagaaactcagaagagtcccggagctcaaggatcagagtaacacaattttcactttttctgtctttatgtaagaagaaactgcttagatgacggggcctccttcttcaaacaggaatttctgttagcaatatgttagcaagagagggcactcccaggcccctgcccccatgccctccccaggcgatggacaattatgatagcttatgtagctgaatgtgatacatgccgaatgccacacgtaaacacttgactataaaaactgcccccctcctttccaaataagtgcatttattgcctctatgtgcaactgacagatgaccgcaataatgaatgagcagttagaaatacattatgcttgagatgtcttaacctattcccaaatgccttctgttttccaaaggagtggtcaagcccttgcccagagctctctattctggaagagcggtccaggtggggccgggcactggccactgaattatgccagggcgcactttccactggagttcactttcaattgcttctgtgcaataaaaccaagtgcttataaaatg

SEQ ID NO: 578044 - DNA, 273 bp, Homo sapiens
cggggcttgtagtgaggcatgatggcaccacttgcagtccaacctaggcaacagagtacaggccctacctcaaaaaaaaaaaaagtgtaacattaacaattagcactccgacgtgtatcctataggctaaatattctcggcagagggaagtgacccgggataagggcggtgaatgggcacagtcgaattgtgggggaaccagtctgccagggggtgtcatgggggggtaatcaaggggcgagcacaacaatcagcagggttcagtgggcaatc

SEQ ID NO: 578045 - DNA, 2288 bp, Homo sapiens
ggcacgagggccccgtcccggcctcgcgcacctgctcaggccatgatgagcttcggcggcgcggacgcgctgctgggcgccccgttcgcgccgctgcatggcggcggcagcctccactacgcgctagcccgaaagggtggcgcaggcgggacgcgctccgccgctggctcctccagcggcttccactcgtggacacggacgtccgtgagctccgtgtccgcctcgcccagccgcttccgtggcgcaggcgccgcctcaagcaccgactcgctggacacgctgagcaacgggccggagggctgcatggtggcggtggccacctcacgcagtgagaaggagcagctgcaggcgctgaacgaccgcttcgccgggtacatcgacaaggtgcggcagctggaggcgcacaaccgcagcctggagggcgaggctgcggcgctgcggcagcagcaggcgggccgctccgctatgggcgagctgtacgagcgcgaggtccgcgagatgcgcggcgcggtgctgcgcctgggcgcggcgcgcggtcagctacgcctggagcaggagcacctgctcgaggacatcgcgcacgtgcgccagcgcctagacgacgaggcccggcagcgagaggaggccgaggcggcggcccgcgcgctggcgcgcttcgcgcaggaggccgaggcggcgcgcgtggacctgcagaagaaggcgcaggcgctgcaggaggagtgcggctacctgcggcgccaccaccaggaagaggtgggcgagctgctcggccagatccagggctccggcgccgcgcaggcgcagatgcaggccgagacgcgcgacgccctgaagtgcgacgtgacgtcggcgctgcgcgagattcgcgcgcagcttgaaggccacgcggtgcagagcacgctgcagtccgaggagtggttccgagaagaaggaacctgctgtcgaaaagcccaaagaatccaaagttgaagccaagaaggaagaggctgaagataagaaaaaagtccccaccccagagaaggaggctcctgccaaggtggaggtgaaggaagacgctaaacccaaagaaaagacagaggtggccaagaaggaaccagatgatgccaaggccaaggaacccagcaaaccagcagagaagaaggaggcagcaccggagaaaaaagacaccaaggaggagaaggccaagaagcctgaggagaaacccaagacagaggccaaagccaaggaagatgacaagaccctctcaaaagagcctagcaagcctaaggcagaaaaggctgaaaaatcctccagcacagaccaaaaagacagcaagcctccagagaaggccaagtccccagagaaggccaagactcttgatgtgaagtctccagaagccaagactccagcgaaggaggaagcaaggtcccctgcagacaaattccctgaaaaggccaaaagccctgtcaaggaggaggtcaagtccccagagaaggcgaaatctcccctgaaggaggatgccaaggcccctgagaaggagatcccaaaaaaggaagaggtgaagtccccagtgaaggaggaggagaagccccaggaggtgaaagtcaaagagcccccaaagaaggcagaggaagagaaagcccctgccacaccaaaaacagaggagaagaaggacagcaagaaagaggaggcacccaagaaggaggctccaaagcccaaggtggaggagaagaaggaacctgctgtcgaaaagcccaaagaaactcagaagagtcccggagctcaaggatcagagtaacacaattttcactttttctgtctttatgtaagaagaaactgcttagatgacggggcctccttcttcaaacaggaatttctgttagcaatatgttagcaagagagggcactcccaggcccctgcccccatgccctccccaggcgatggacaattatgatagcttatgtagctgaatgtgatacatgccgaatgccacacgtaaacacttgactataaaaactgcccccctcctttccaaataagtgcatttattgcctctatgtgcaactgacagatgaccgcaataatgaatgagcagttagaaatacattatgcttgagatgtcttaacctattcccaaatgccttctgttttccaaaggagtggtcaagcccttgcccagagctctctattctggaagagcggtccaggtggggccgggcactggccactgaattatgccagggcgcactttccactggagttcactttcaattgcttctgtgcaataaaaccaagtgcttataaaatg

SEQ ID NO: 578046 - DNA, 3517 bp, Homo sapiens
ggcacgagggccccgtcccggcctcgcgcacctgctcaggccatgatgagcttcggcggcgcggacgcgctgctgggcgccccgttcgcgccgctgcatggcggcggcagcctccactacgcgctagcccgaaagggtggcgcaggcgggacgcgctccgccgctggctcctccagcggcttccactcgtggacacggacgtccgtgagctccgtgtccgcctcgcccagccgcttccgtggcgcaggcgccgcctcaagcaccgactcgctggacacgctgagcaacgggccggagggctgcatggtggcggtggccacctcacgcagtgagaaggagcagctgcaggcgctgaacgaccgcttcgccgggtacatcgacaaggtgcggcagctggaggcgcacaaccgcagcctggagggcgaggctgcggcgctgcggcagcagcaggcgggccgctccgctatgggcgagctgtacgagcgcgaggtccgcgagatgcgcggcgcggtgctgcgcctgggcgcggcgcgcggtcagctacgcctggagcaggagcacctgctcgaggacatcgcgcacgtgcgccagcgcctagacgacgaggcccggcagcgagaggaggccgaggcggcggcccgcgcgctggcgcgcttcgcgcaggaggccgaggcggcgcgcgtggacctgcagaagaaggcgcaggcgctgcaggaggagtgcggctacctgcggcgccaccaccaggaagaggtgggcgagctgctcggccagatccagggctccggcgccgcgcaggcgcagatgcaggccgagacgcgcgacgccctgaagtgcgacgtgacgtcggcgctgcgcgagattcgcgcgcagcttgaaggccacgcggtgcagagcacgctgcagtccgaggagtggttccgagtgaggctggaccgactgtcggaggcagccaaggtgaacacagacgctatgcgctcagcgcaggaggagataactgagtaccggcgtcagctgcaggccaggaccacagagctggaggcactgaaaagcaccaaggactcactggagaggcagcgctctgagctggaggaccgtcatcaggccgacattgcctcctaccaggaagccattcagcagctggacgctgagctgaggaacaccaagtgggagatggccgcccagctgcgagaataccaggacctgctcaatgtcaagatggctctggatatagagatagccgcttacagaaaactcctggaaggtgaagagtgtcggattggctttggcccaattcctttctcgcttccagaaggactccccaaaattccctctgtgtccactcacataaaggtgaaaagcgaagagaagatcaaagtggtggagaagtctgagaaagaaactgtgattgtggaggaacagacagaggagacccaagtgactgaagaagtgactgaagaagaggagaaagaggccaaagaggaggagggcaaggaggaagaagggggtgaagaagaggaggcagaagggggagaagaagaaacaaagtctcccccagcagaagaggctgcatccccagagaaggaagccaagtcaccagtaaaggaagaggcaaagtcaccggctgaggccaagtccccagagaaggaggaagcaaaatccccagccgaagtcaagtcccctgagaaggccaagtctccagcaaaggaagaggcaaagtcaccgcctgaggccaagtccccagagaaggaggaagcaaaatctccagctgaggtcaagtcccccgagaaggccaagtccccagcaaaggaagaggcaaagtcaccggctgaggccaagtctccagagaaggccaagtccccagtgaaggaagaagcaaagtcaccggctgaggccaagtccccagtgaaggaagaagcaaaatctccagctgaggtcaagtccccggaaaaggccaagtctccaacgaaggaggaagcaaagtcccctgagaaggccaagtcccctgagaaggccaagtccccagagaaggaagaggccaagtcccctgagaaggccaagtccccagtgaaggcagaagcaaagtcccctgagaaggccaagtccccagtgaaggcagaagcaaagtcccctgagaaggccaagtccccagtgaaggaagaagcaaagtcccctgagaaggccaagtccccagtgaaggaagaagcaaagtcccctgagaaggccaagtccccagtgaaggaagaagcaaagacccccgagaaggccaagtccccagtgaaggaagaagccaaggcccctgagaaggagatcccaaaaaaggaagaggtgaagtccccagtgaaggaggaggagaagccccaggaggtgaaagtcaaagagcccccaaagaaggcagaggaagagaaagcccctgccacaccaaaaacagaggagaagaaggacagcaagaaagaggaggcacccaagaaggaggctccaaagcccaaggtggaggagaagaaggaacctgctgtcgaaaagcccaaagaatccaaagttgaagccaagaaggaagaggctgaagataagaaaaaagtccccaccccagagaaggaggctcctgccaaggtggaggtgaaggaagacgctaaacccaaagaaaagacagaggtggccaagaaggaaccagatgatgccaaggccaaggaacccagcaaaccagcagagaagaaggaggcagcaccggagaaaaaagacaccaaggaggagaaggccaagaagcctgaggagaaacccaagacagaggccaaagccaaggaagatgacaagaccctctcaaaagagcctagcaagcctaaggcagaaaaggctgaaaaatcctccagcacagaccaaaaagacagcaagcctccagagaaggccacagaagacaaggccgccaaggggaagtaaggcagggagaaaggaacatccggaacagccaaagaaactcagaagagtcccggagctcaaggatcagagtaacacaattttcactttttctgtctttatgtaagaagaaactgcttagatgacggggcctccttcttcaaacaggaatttctgttagcaatatgttagcaagagagggcactcccaggcccctgcccccatgccctccccaggcgatggacaattatgatagcttatgtagctgaatgtgatacatgccgaatgccacacgtaaacacttgactataaaaactgcccccctcctttccaaataagtgcatttattgcctctatgtgcaactgacagatgaccgcaataatgaatgagcagttagaaatacattatgcttgagatgtcttaacctattcccaaatgccttctgttttccaaaggagtggtcaagcccttgcccagagctctctattctggaagagcggtccaggtggggccgggcactggccactgaattatgccagggcgcactttccactggagttcactttcaattgcttctgtgcaataaaaccaagtgcttataaaatg

SEQ ID NO: 578047 - DNA, 112 bp, Homo sapiens
tagctcggactgcaccgcgagagtcacactgcacacgccgaatgcccatgggatatcgccgatcttcacgtgcacacgccgaatacccaaaccataatcgccgaggggatcc

SEQ ID NO: 578048 - DNA, 222 bp, Homo sapiens
tttccgctcgcagctcattcacggggatttctgctgctgctgctgccgcttctcacccgcgccgctcctcgcctctcttgttagcccgagactcgcctctcagccgcccgccgcacagacgcacgagtagacagtgcagctccatcggctgatcctcgctgagctccaagtgtaggcggcaccgggcggcccacgatgccgaagaacaagaagcggaactcc

SEQ ID NO: 578049 - DNA, 825 bp, Homo sapiens
agatttaatgatgaagacaccaaaagcaatttcaacaaaagcaaaaattgacatgtgagacctaattaaactaaagagcttctggacagcgacaagatactgccaacggggctaaaccgacaatctacagaatgggaaacatatttgcaaactatgcattcaacaaaggtctaatatccacaatctatcaggaacttaactaaatttacaagcaaaaacaaacaaccccatcaaaaagctgggcaacaacgaaatgaacagacacactcaccagacagaaggcacacacatgctggccaagaagtaatatgaaacaatcctcaatgtcagaaatgatctaaatcaaaaaccacagtgagatactactctgggcacctcagtaccacatggccctactcacctcataaaaaactcacaaaaaccaacaggcaactagacgtgaacggctcagcagaaaccacaacagtgaacaaacactaatcgaacctggcacggctgacgacgctaatattacaactccaaactaaaaatcccacacccaaccagcaggggcaaaggagaacgaggatgcgcccaaaaacgaccaaacaaacaggaaacagcaacacaacccaaacacacacacaacacaaaaacggaaacacacaaagacacgataaccacacccaacataacacctcagacacacatacattaccacaaacaacacaaaaaacaagaacaaaaatagttaaaccaccttaccaataatcacaaacagaataaacatacaaaaaataaatacagccaaactacaccaaccaaccactgaccatcactttacat

SEQ ID NO: 578050 - DNA, 257 bp, Homo sapiens
agaggctgtgcctggaggggacaccaaagatgcaggagctgagcctggagaggctgccaagaagccatgagctgaggcctggtagaggtcgacttgcagaaagttcagggcctggatgagaaggctgggaggcaggagctgggtctaaagaggccatatgtaacgatagagctgtgcctgtaggcaggctgttgtagaggcagtagcctcatctagcggaggctgccgtgacagtagtgtatgggcctaaataggcc

SEQ ID NO: 578051 - DNA, 918 bp, Homo sapiens
gccacttggttacagctgactggggatttaatcatttggagccacactgaaaaaaaaaatttccccctgaaatctactcttaactgatagtcgctaacctatgcattatgtgtggtaagtatttgacaagtgtctattcagacatattacattcaattgagtttctcaaaacaaaggtccttcctgaaatggtatctatgattcagctattcaaaacctaatgagagttggtgcctatgacaattgtggggaaatctatgacagaaaatgtggttgtacctggggctgtcactgctgtacaaggacgttcggcaccaacatagactgataggacaacctcattgtgaagacctgaagcgagagaaggaatttcaacacgaatgctagtgcggaatctgggaagagcgagtaagacttaaccaagctaagagaaaaggttcaccagggaagtattggcgcggagtcatttggaacgatagcacaagaggcattggaagaccctccccttttttctctgtgaaaactgagatcaactacagggcacatgcgccaacgttcgatacgaagctgttgtggctgagacattcctgaattcattgggaagaattccaggaaccctccatgggtgttacgaataaaatccttcggaaaacaaacactttgcaagagattacccacctagggaatttggggctggcataactagaactttcaggacaatagattcctacaggtacgaagagaattcaagaatgtcccccaggacactaagtaatggtgcagtgtggaggaaacaccacatggtcggtacacgcaatttttgtttattctcccaaagaagagtctcgcaactctggttaaaactttctcactcggtatcgggttgaacatttactcaacacctcttgcggtgtacag

SEQ ID NO: 578052 - DNA, 510 bp, Homo sapiens
  misc_feature (179)..(179): n is a, c, g, or t
  misc_feature (188)..(188): n is a, c, g, or t
  misc_feature (226)..(226): n is a, c, g, or t
  misc_feature (328)..(328): n is a, c, g, or t
  misc_feature (367)..(367): n is a, c, g, or t
gaggatcccgtcagatgctcagctcacagctgacccaccagagcaggagctggcgggtgtcttctgcggcaatagactggaacgattaaggacatggtgtgatagatccatttcaaatgattccatatgattgtcagtgtgtgctgtcagactgtgatcgatttcactagatgtctcantcatcagancaggcattcgggctaagtggtaaatgtgattaggaatnagacctcctcccattctgctagcaacatacagggacacttggaaaaccatttcccttccagtcagcttggtgtccatccccagagccaatttcaatggaaangccttttcccccggccccttggggggcctggacctgatngagcgcagagcctctcagcgtaggaagctggctgcttaatcgagctggctttactctagggtaagtggctgtggacttttctgcacagtgttttcataaagataataggatcctcttgcctgaagtctttttttctttttacg

SEQ ID NO: 578053 - DNA, 127 bp, Homo sapiens
gtcccatcatagccttaggagacccaggttaggtcaggggatgtgcgcttctcttccagccataggctgctgctgagccgccaagggtcttcagttccatcatgtagatattcccagtcaggccatg

SEQ ID NO: 578054 - DNA, 222 bp, Homo sapiens
cggctgggggcggccgttgatctccagcaaggcacttcttgcggggccctcacctggtgcaagggacaaacaagctcgcttggcctctttgataagggaactaatcgtgcccccaaagtccccacctcttaataccaccacctggggggctaggattccacatatgaactttgggaggacacaaacactcaccacccccagcgcactacggaaggccactga

SEQ ID NO: 578055 - DNA, 1032 bp, Homo sapiens
cggaagtatgagatgttgcccagacccttcagcagagtcggggcttggcagcttcagattcccttcagggaaccaggtggagctggcctgaccggagaagctagttcactgggggttgggggcgcttgacctcaggagagaggagctaggggtgcgcgcctatagctcgtgcttccactgtctcgcagatcctgacacagtgacaatctacgagtgctgactgctggatgagggctgttccgtgtggacgaccatcagatgagcataagcaaaagcgataaaatagaagcgaattctctcattttggctgaggcggaggagttgaattagcgcaaacgagcgggaattgggctcttgtgcgcctgatgcctactgttctagtcggtcatgttatggagggcagatgcacggggacctgtgtgtcggtgtgaaccaaggcgactactgttcaacctgggcagcacgtacaacgcatctgcactttgagcatccaagtgcgtgcgccgatgggccttcctcgtatcgcccgcagtatccaaacgcgttggaattagcggtgtggataggggggccaactaagtctatgcctggaatgatatccatattcacaagacggtgaggatagagttttgattgtatacaactagctcttttggagggtcaaatggttggtacagtagcttaattcgtacccccgagaaggttgtcgtaagagactagaaaatatggtggacctggttggtgaaagaggacacattaagaccgtcgagtcgagaaagtggaacctgagaacgtgggcgtgtgcgctgcttctgatgcatggcgaacaggcctgaggcataaccagcattcacaaaaggatttcttgccagaatgtgaaatcctcggcagtagattgcccgcttttatcctctcctggacagatttggataaggtgcccggttgcctgacgcttgcgtggcagatacagggggagacagggggaaagggggccgcggaaaacaccccacggggagaaagagcgccccaaat

SEQ ID NO: 578056 - DNA, 222 bp, Homo sapiens
tcagctcggaccaatgatgctcacgctccatctgcatccttggtgtggaagaaaagttataccacatcgagactcaaagtcccttagacacaaaagtctataagctgcaaggtaaaagtaactatccttgaaaattatcaatcagtggtttatctgaaaacagatgaaaaattttttgtcttattcgtttttattttttgttttttataaaggggaagaaaa

SEQ ID NO: 578057 - DNA, 1077 bp, Homo sapiens
  misc_feature (17)..(17): n is a, c, g, or t
  misc_feature (70)..(70): n is a, c, g, or t
  misc_feature (117)..(117): n is a, c, g, or t
  misc_feature (128)..(128): n is a, c, g, or t
  misc_feature (200)..(200): n is a, c, g, or t
  misc_feature (295)..(295): n is a, c, g, or t
  misc_feature (319)..(319): n is a, c, g, or t
  misc_feature (330)..(330): n is a, c, g, or t
  misc_feature (333)..(333): n is a, c, g, or t
  misc_feature (335)..(335): n is a, c, g, or t
  misc_feature (338)..(338): n is a, c, g, or t
  misc_feature (347)..(347): n is a, c, g, or t
  misc_feature (365)..(365): n is a, c, g, or t
  misc_feature (379)..(379): n is a, c, g, or t
  misc_feature (405)..(405): n is a, c, g, or t
  misc_feature (421)..(421): n is a, c, g, or t
  misc_feature (442)..(442): n is a, c, g, or t
  misc_feature (449)..(449): n is a, c, g, or t
  misc_feature (451)..(451): n is a, c, g, or t
  misc_feature (453)..(453): n is a, c, g, or t
  misc_feature (461)..(461): n is a, c, g, or t
  misc_feature (475)..(475): n is a, c, g, or t
  misc_feature (513)..(513): n is a, c, g, or t
  misc_feature (533)..(533): n is a, c, g, or t
  misc_feature (538)..(538): n is a, c, g, or t
  misc_feature (540)..(540): n is a, c, g, or t
  misc_feature (550)..(550): n is a, c, g, or t
  misc_feature (554)..(554): n is a, c, g, or t
  misc_feature (557)..(557): n is a, c, g, or t
  misc_feature (602)..(602): n is a, c, g, or t
  misc_feature (614)..(614): n is a, c, g, or t
  misc_feature (621)..(621): n is a, c, g, or t
  misc_feature (631)..(631): n is a, c, g, or t
  misc_feature (637)..(637): n is a, c, g, or t
  misc_feature (649)..(649): n is a, c, g, or t
  misc_feature (660)..(660): n is a, c, g, or t
  misc_feature (666)..(666): n is a, c, g, or t
  misc_feature (669)..(669): n is a, c, g, or t
  misc_feature (688)..(688): n is a, c, g, or t
  misc_feature (708)..(708): n is a, c, g, or t
  misc_feature (717)..(717): n is a, c, g, or t
  misc_feature (732)..(732): n is a, c, g, or t
  misc_feature (763)..(763): n is a, c, g, or t
  misc_feature (770)..(770): n is a, c, g, or t
  misc_feature (774)..(774): n is a, c, g, or t
  misc_feature (786)..(786): n is a, c, g, or t
  misc_feature (806)..(806): n is a, c, g, or t
  misc_feature (813)..(813): n is a, c, g, or t
  misc_feature (818)..(818): n is a, c, g, or t
  misc_feature (822)..(822): n is a, c, g, or t
  misc_feature (832)..(832): n is a, c, g, or t
  misc_feature (834)..(834): n is a, c, g, or t
  misc_feature (930)..(930): n is a, c, g, or t
  misc_feature (933)..(933): n is a, c, g, or t
  misc_feature (939)..(939): n is a, c, g, or t
  misc_feature (947)..(947): n is a, c, g, or t
  misc_feature (970)..(970): n is a, c, g, or t
  misc_feature (974)..(974): n is a, c, g, or t
  misc_feature (985)..(985): n is a, c, g, or t
  misc_feature (1000)..(1000): n is a, c, g, or t
  misc_feature (1069)..(1069): n is a, c, g, or t
aggctggtgcggaactngccgcccccagcagcgccggcgggctaagcccagggccgggcagacaaaaaangccgcccgcgtaggaaggcacggccggcggcggcggagcgcaagatnggccgggcganggggcagcgcgctgctggctctgtgcggggcactggctgcctgcgggtggctcctgggcgccgaaacccaanaacccggggcgcccgcggcgggcaagaagcggcgccggcggctgagaaagaaagacggatctccttcaaaacaccgctacacccgaagctgcgcnaggcgctcgtgtccgtgtggctgnagtgcaccgcnatnancangaatttaanacggtgtgggcgcacttncgaagggccggganctcctgtgtcatcgaagctgtccganaaacctaggcgtccanagagcctgggtgagcctgaantttaaananantggggaanatagcatggggaangagagctgttgggacgagaaactgctcatttttcttgngcccagtcacctatagcaangaaanancaaaaaaggngaanganacaatttgtcaacctcgatccacagtaacccgcatttcacatcangcctttccctgnaacccanataggctttngagaangcagcgtctcancctgtgtgaantcaaangantggttttgtgtggtcgaancaatagcccaggggaataanatctagaancgggaacttttccanacctcggataaggataagtgtacgttgaatngagaaanaaangtgggtccaaanaaatcatctgtttgaaaaanatagaanaaaantgtnggatcaaaananaaaacttgctcctgagaccaaggctgtcattcattggattatggatattccttttgtgctttctgccaatctccatggaggagacttgtggccaantanccatangatgagangcggagtggtagtgctcacgaanacanctcctccccanatgacgccattttcnaaacttggcccgggcatactcttctttcaaccggccatgtctgacccaatcggccacatgtcgcaaaangatgatga

SEQ ID NO: 578058 - DNA, 323 bp, Homo sapiens
agacaacctccatgctatctgagaataaatgcccaactgctcttgcttgctatgcggttggtagtgaaatactagaatgagcacccattccaaagctctattaccagtggcgtagttgcatgttcgaaatgaggtctgtttaaagtggcaatctcagatgcagttgggagagtcagatcttgctccttgaatatctttcgataaacaacaaggtggtgtgatcttaatatattcgacaaaaacttcattctcgtgagctcatttaaatgtgtacaatgtacacacgggtacttagagtttctgttggatactttataaataaa

SEQ ID NO: 578059 - DNA, 572 bp, Homo sapiens
agttcgacggagactctcactgatatggtgaccgacagactgggaaaacctcaattgctattgacacaatcattaaccaaataccgcatcaatgatagactggatagaagaaaatatggcgcatgttcaccgtgaaatgctatgcggccatgagaaagggatgagttcatatcctttgcaagggacatggatgacagctggaaagcatcattctcggcaaactaacaacgggaacagaataaccaagagcactggatgttctcactctgaagtgggagctgaacaatgagaacacgtggacacggggaggggaacatcacagcagtggggcctgatggtgggtaggggtctaggggagggatagcattgggagaaatacctaatgtaggatagaagggtagagtgggtgaaggagaagcagcgagtgacacgtgtatacctgtgtaataaatctgtatgttctgcacatgtatgccagaacttaaagtgtgataaaaaaattgggaaaaagttaagtatgtcatagatacgtatgatattgtggattctagtttagttgctcatatatgggg

SEQ ID NO: 578060 - DNA, 120 bp, Homo sapiens
  misc_feature (30)..(30): n is a, c, g, or t
cccccccggagctgcggcgggcttgcagcnctcgcccgcctgtcctcccggtgtcccgcttctccgcgccccagccgccggtgccagcttttcggggccccgagtcgcaaccaacgaaga

SEQ ID NO: 578061 - DNA, 626 bp, Homo sapiens
cggcctccccgcatcacaggtccctggcagcaagcgggaaatgggggcgcacactgtgtgcttgggggtgctgcttgtttaccacacatgaccagactcccagcaggacagagctgctcagtactttacagaaaccaagctgagtcgtttgtgcatgaattaagccggtctgcttccccgtcaccttcgtaacaaaacaagcgtcccctctcccctcgcctcgagcaggtttcttcaggacaccgtggctcgggcttgctccctgtctgcctaggcacgctggtttggctgtgcctgggcaccggtctcacgtgaatgggcactgggctctttgtgaccagcatcgtgatgctcacgtgctaagccgctatgccgggtcctggagagcctgtacccgtctgagttctatgggcttgtcccgctggagcctgcagatgctagactgttggggtgtgtcccgtgatgatatgctgggccaggctgggagctagggcctttctagcagggttgggtggctcagtgagggtgtggaacgttgggggacccacggggcctggctttgggactagacatgccagccccagctgggctggatgggagcctgagtgagccccgacatacgctgg

SEQ ID NO: 578062 - DNA, 368 bp, Homo sapiens
ctagggaatgtgctttgaggtaggttctcataggtataccaccgctgggagacagttatgactttaaaacgttgtgatcggtgtgttgctgctgtcaggtctccctgtcgactcagacaccgatttggagtctcttgggcatgacagcgaagtgagtggttgtccattcgaatggagcagtttgattccaggaaaagagactgctccttgtggtcctggtgaccagggataggactccagttgagcctggtggaagaggtccttgtcctaccccaacggagagccatgcagctgagcttgggtgatgtggtccacgtggttgtttctgagtgtgtcctgaggttgcaggatggcttgcttgttccgct

SEQ ID NO: 578063 - DNA, 172 bp, Homo sapiens
cgccatcttcagctaatactctgagtaaggctacaaagtacagcgcaagtacccacgtaaaagacgttaggtcaagtgtgtcgcccatgtcaagtggcaagaaatgtggactacattttctacccctagcagactacgatagcccttattaaacttaagggtcgaaagtgga

SEQ ID NO: 578064 - DNA, 1487 bp, Homo sapiens
  misc_feature (188)..(188): n is a, c, g, or t
  misc_feature (593)..(593): n is a, c, g, or t
  misc_feature (644)..(644): n is a, c, g, or t
  misc_feature (720)..(720): n is a, c, g, or t
  misc_feature (869)..(869): n is a, c, g, or t
  misc_feature (1043)..(1043): n is a, c, g, or t
  misc_feature (1053)..(1053): n is a, c, g, or t
  misc_feature (1189)..(1189): n is a, c, g, or t
  misc_feature (1344)..(1344): n is a, c, g, or t
  misc_feature (1471)..(1471): n is a, c, g, or t
gctcaggtggcgctccctgcgcgagcccgtccgtgctggtgctgcggcgagcgcttcccttattgctcccgacggcggcacaggcatagtggctggagcaggcgtcgcgtgtcgaccctggccatgagcctgaggcatagccggtcgccgagttcggcgcgggtgtctcggcgcctgctagctcggangcttgattagtcgtatgagtgcgcgccgcccatctcgcgagtgtgggaggtgtgatgaaacccgtccgccgtcagagtggtgtggatctacacggcctggaccctgacccggtgacactacggcccgcagaacggactgtccggtgaccgtgcgttcgggttcgtgtccgcaccagagctagctgtgggcgccggtctgcggcggcagcgttgtagcaccttccacggtgctggcaagtcaggcgttagcaccccgaaagtggagctctcgccggcggggattcctgcgccttccgggttacgccctgttgcctcgcagcgaatggcgtctggcatccgcgtggaagtgagcccccctgagtgttggtagcgcgatgagaggcgggtgggcgcgtggtcttgagnacgcgcccggcgcatggcctgggccgccgagtggcgaacatgtgtgctggncgtcttaccggcaccgcccgccgcgccgtgaggatccatagccaccatgcacggccgcgtggatccagttgccggnccacggcaggagctacgtgtgaggacaggctgggcgtagcaggaaccggcacgttatggcgggacagccccttaggaccggccggttgtgccggcagcacgggtcgcacgtgagctaccgtacaggacggtgtacgagggttcttctgngcacgacacgacaatcgtctgccataacaaagggaacgacttcagaaacaggtgcttctggggtcccgcgggggacttcggatgttcttcgtagagtcctctgcgatatcggaccccttcccaaagggttccccgtactttcagccagacgacatgggtcccgcagctgccagngtgcattcgnttccggcttcgtcccacggaatccttcgggtttccgcgggtccaagatcccaggggttcttctgggtcccaatggaggtttcatcccccccagctggtgcgaggcagtgtgcatcccccacattcccggttgccgnactcgagagaaggtctcgccaggttttcctggaaaagaagagcagcggctggtcctcttacagcagactgagtgttttggcggccgcctgtatcacgcggagtctgcgtccagacacagcacctcttcccttgaaagtcactcctataactgctntataaggctcggtgagagttctgtctactagcagcacagtgacgacaatatcatcgcttctcacttctcgaggcggcagctcgctgatacgactacactatcagtcgtctgtctcacagtctgaagntctattagatttggga

SEQ ID NO: 578065 - DNA, 908 bp, Homo sapiens
gagaagaagccctgcatcacctacgggctcaggtgcatttgctacttttacatcgaggtggagtgcagacaactaaagacctccattctggggtgtacagggggctctggtgcatgaggccatgactgatctcatttagctgatgggctcttatggtggacaagagggggaacatcctgatccccggcattgaacgagagtcgtggacgacgtcacaggaagaggagcacaagctgtacgacgacaatcgacatttgacatagaggagtttgccaaggatgtggagggcgcagatcctcctgacagcagcacaatgaaagacatcctcatgcaccgatggcggtacccgtctctgtccctccatggaatcgaaggcgcctatctactgggatctggggccaagaccgtgattcccaggaaggtggtaggcaagttctaccatcaggctcgtgccgaaacatgaatcctgaagtcgtcggcagagcaggtcacaagctacctaactacagaagtttgcatgaactacgcagaccccaagtgagttcaaggtgtacatgggccacggatgggaagccctgggtctccgacttcagatcaccctcattaccatggctgggagaagagccagtgaagacaagatattggaggtagagccagacttgaccaggggaagggcggcagatattcccgtagaccttgacttttcaggagtgccaagggcaagaacggtcatgctggatgcatgtggaggatcaagcggattgacggaagcccactccacagaaatgaaaaggctcaacaggtataactacatagagggaaccaaagatgctggcgaagtacctgtatgaaggttccaagatgaagactaggcacagacctatgagtagccatactcattaaaagca

SEQ ID NO: 578066 - DNA, 1458 bp, Homo sapiens
gcctgctgcgggctccgcgccggtcgtcccgggtctatgggtccattccccacgacccacccggaccccggtggtcactcgtggtctccgtctgtgccagtggatgcggagaatcaccgcgcagcggtcctctctgcgacttctgggcgactagagaacgctggccccggacgcgtgcgctgagtgctccgtgacgtcacaacggagacggtggcggcagtgaccatcccaagtggcgccgtgctgcatcccccgggccgcactctgtgacgtgctgcgacttccgggacgaaggcgtctggattctcggccgtgatgggccaagaccttgcacctggccatgcgttccttcaaccgcccgttcattttaccagtgactcagatcccagaaaggcgacacgcagcaggagtttgctcactgggcttctgcgtaaccaggaagtgcaggatgcgtgtgttcccatcttcgtacagctctgggtcctagttcttgtccccagggtggcttgacttggtgaatagcctgggactctatccccttacgaagagggtggacggtcgtctgagggcgacgatatggccacggggccgcacaccaggtggtggaggagaggtcgcaggacggagaaggtaaatgcacaagctggggcgcggtacacgaccctttcccacaggggccccgacaggcgacgtgcaccccgtggaggcaagggcatagcgacggggaaggaagggtcgaccagagatgccaacggacgctacatttaacggacacgacgagcgttcgaggacgacgacccaaaaagggagcgggggaaaaacggacggggcaacccggtcacaagcatggagtcggcgccttcagcagagtgcggccgccgcgaaagtaggtatgccacaggagagcaccgcggtgtagagcagccgcataagtataagcgggggagagccgcgggggcgcgagagcgacaacggacgcgggaggtagtggatagaaggcgcggtgtgatgcgcgctggtaacacagaggcgcgaggcaacgcaaccgagaagttggcgcccaagagaacatagcggttgcttagccagtgggtgaacacgggcgaagtcgagagacgaaaggtgcccacaccctcggaggcggatccaaaacgagggcagacacacacttcgccggagcccggtaggaagaacacctatataggcacgtagcgccttggtgcgaaagaactttccccgcatgtggttgtgacacacacattttagtagagaccagtgccgagtagccaatgaacaagggcggtattaccaggtatgattgcccctaaaaggcggggtaagttgaggcgcacaacttggacaatgggggggcggaggcaaagaagtgtagcagtgccggcggcgacaagacaataagggacgacgtggagtaggcgacactccatgcatcgcaggaga

SEQ ID NO: 578067 - DNA, 260 bp, Homo sapiens
tatagcacaataggaagggtcccaggttgtagaagccccaagttgagaacaataatgaacaattattgtatgaacaattgttagaaacagctaatcacaaacaacctgcgggcacaatgacctcattccacacgtagacacccttcagcaggaccctataaaactttcctccagcccttgcctctttgcacggtagccccattctctgtctgagcctgcccacatgcacacatacttttcacacatcttctctaactaac

SEQ ID NO: 578068 - DNA, 376 bp, Homo sapiens
atattattgtgtgtacgccctgacttggagcagacgggcagtggagctcttgaagtggggcataggcgagagtgccccacaggccttcagcctctcctggtcaactggctccaagcagcattttaaacccacaggtgtacaacagcttctgttcccactgtctgagggacatggacagatctcgagggctcagcaggagaaggtctgaggtccaagggtggcagagggaccaggtggaggaccgccacttctccagccaatctcgggccactcagttccaggctgggcagccacagtgcccctcaaggccagtgtcccagccaggcctatgaaccacttcctcctgaggggactccccgaccttgcattggtctac

SEQ ID NO: 578069 - DNA, 85 bp, Homo sapiens
  misc_feature (38)..(38): n is a, c, g, or t
agaaagcagtttcccagaaggttcttgaagagctgagnccattcgggcccccgcttcccccaccaatgaaaattaaaagttattt

SEQ ID NO: 578070 - DNA, 411 bp, Homo sapiens
ctgttcttcattgctctctacgaagtacaaatcctaagcctgtttattttttaaaagtaccaaaggaaaatctctgatcttaaagtctttcttataagctatatagatcattaactaaccatctctaaaattatagcagacaacttggcatttgttgactttcagagctggaagggccttctagcctggactgaccttccttcctccatccctccttcccttgttcccttagcattacaatgaaaacaaatcccaggttatgcacagttcaggacagagtgaattgcttcctcctaccattatcagccatcgtgttgcccattccagaggcaatcacaccccattttttatgaatctttccaaaaagaatgtaatgcatatttctatatactgtatttttgaagcaactaa

SEQ ID NO: 578071 - DNA, 229 bp, Homo sapiens
  misc_feature (72)..(72): n is a, c, g, or t
  misc_feature (74)..(74): n is a, c, g, or t
gacttagatcctgcaggacacaggtttgatctcaacttcgttgaaaacaggatgcatgacttggcggccaancnaaagaagtttgggtttaatttctatctatacacccagtaaaatatctgtgataccactggaaaaccttaaaatacattatctatttctgtgtaaaagactgatgacatgtgaatttgcacagcatacatatgtacaggtatctcttctcaacgga

SEQ ID NO: 578072 - DNA, 106 bp, Homo sapiens
ttatagctggaggggacaggacctggggttggttggaaatgcagaatatgggaacccactcccaatctactgaatcagaatcgcattatagtggtttattccatat

SEQ ID NO: 578073 - DNA, 190 bp, Homo sapiens
ctgtactaatgatgtcctaaatagctgtacctaaatggctgtacctaattggctgtacctaaaatggctgcacctaaatggctgctacctaaatggctgttacctaaatggctgtcacctcaatggctgttacctaaatggctgctacctaaatggctgttacctaaaggggcaccgagcccgactacgc

SEQ ID NO: 578074 - DNA, 254 bp, Homo sapiens
ttgttttattggttttctgttttctattttatttatttctactctaatctttgttatttctttccttctgtttgctttatgctaaatttcttcttctgcctctagttcttaaggtggatgtctggttactgattttagatctctcttctctactcaatctaggcattcaagcaataaacattcattaagcactgctttagcggcatcacacatatttgatatagtgtatttgcattccatttaggtcagatatt

SEQ ID NO: 578075 - DNA, 749 bp, Homo sapiens
  misc_feature (1)..(1): n is a, c, g, or t
  misc_feature (72)..(72): n is a, c, g, or t
  misc_feature (80)..(80): n is a, c, g, or t
  misc_feature (83)..(83): n is a, c, g, or t
  misc_feature (102)..(102): n is a, c, g, or t
  misc_feature (118)..(119): n is a, c, g, or t
  misc_feature (132)..(133): n is a, c, g, or t
  misc_feature (136)..(136): n is a, c, g, or t
  misc_feature (170)..(170): n is a, c, g, or t
  misc_feature (172)..(172): n is a, c, g, or t
  misc_feature (310)..(311): n is a, c, g, or t
  misc_feature (317)..(317): n is a, c, g, or t
  misc_feature (329)..(329): n is a, c, g, or t
  misc_feature (339)..(340): n is a, c, g, or t
  misc_feature (343)..(343): n is a, c, g, or t
  misc_feature (347)..(347): n is a, c, g, or t
  misc_feature (364)..(364): n is a, c, g, or t
  misc_feature (371)..(371): n is a, c, g, or t
  misc_feature (393)..(393): n is a, c, g, or t
  misc_feature (422)..(422): n is a, c, g, or t
  misc_feature (427)..(427): n is a, c, g, or t
  misc_feature (541)..(541): n is a, c, g, or t
  misc_feature (546)..(546): n is a, c, g, or t
  misc_feature (566)..(566): n is a, c, g, or t
  misc_feature (586)..(586): n is a, c, g, or t
  misc_feature (609)..(609): n is a, c, g, or t
  misc_feature (629)..(629): n is a, c, g, or t
  misc_feature (640)..(640): n is a, c, g, or t
  misc_feature (647)..(647): n is a, c, g, or t
  misc_feature (655)..(655): n is a, c, g, or t
  misc_feature (667)..(667): n is a, c, g, or t
  misc_feature (747)..(747): n is a, c, g, or t
ngtcccatcgtttatattagtttagtgtgatgtctatttactagctgttacttcatgagcagcatattatgnaatcgatnacnagtaagaactattgtcccngctcttcgacggagcnnacattctaaaagnnaanatacaccttttttaaaatggcatttttgtttggngntttctgcaaagtatctagaggaaatattttgtaaagtgagctttgcggtataatcttagcccctagtcattatttagagaatagaggaggaagaaatgaggaaggattattaaaggcgagacacatgacatgaccatnngggatngggggggttttnaagggagatnnacncagnctcatcaactaaggagngatttgntgcagttaataggatgaggganatagtctgtggggtgcaagcaaaggaagnggggngccttagacactgagtggagccagaaagatcatgcggcgcgtttttccaagtacactgtgccaccaagtaaagaatggtttggtgacaagacagaaaggctaaaacaggaaggnaatcntgtgcacctgacaaataganagaataaaggatcaaaattnaaggcaggctataagagtatcangaaattcttaaaaaccaaanagtgatttggnagcacanaacttacngttaatgctacncaatgtcatgatggggcaagaacattgtggcttcctaagttagaaaatgccatatgccgaaaattttaaatggaacacanta

SEQ ID NO: 578076 - DNA, 178 bp, Homo sapiens
ccacctcagcctcctgagtagctgagatgacaagtgtgcatcacgacgcccagctaagttttaaaatttttcgtagagacagagtcttgccatgttgttcgagctggtcttgaactcctgggcagaagcaattatctcgccttgggctcccagagtgcggggattatagctatgagcc

SEQ ID NO: 578077 - DNA, 529 bp, Homo sapiens
  misc_feature (502)..(502): n is a, c, g, or t
ggtccatttaatgaattgggctggaccgcaagggaaccttgatatgatgggttaaggtcatgggggtggcttccaaaataagatgtataaaaccattccagaccattcagagaaaaccatgattccaggataaaattattacaatggtcgggtgacatttaacatgtatccgcaatcccttcctccccctttggcaagtccaccacttcaggccatacacttaaggcaaaccaggaaaattaaacctagccacatggacttggtcagatttaataacccttttaaaacctggtccaaggagcactggtgcttgagtaaaaaaccaggggaatggtcgagggtcacaaaggaattccaaattaattctggagacttggaaccaaaaaattcccatccggtgattggaattacaagggtatctggctaacaaaaaaggtgtacttccaatatatcaggtctttggataaggaatacggcacaggactttctccacctatgtgtnaccacatcaggcccagtctccctgaag

SEQ ID NO: 578078 - DNA, 489 bp, Homo sapiens
  misc_feature (25)..(25): n is a, c, g, or t
  misc_feature (71)..(71): n is a, c, g, or t
  misc_feature (79)..(80): n is a, c, g, or t
  misc_feature (82)..(82): n is a, c, g, or t
  misc_feature (101)..(101): n is a, c, g, or t
  misc_feature (103)..(104): n is a, c, g, or t
  misc_feature (112)..(112): n is a, c, g, or t
  misc_feature (121)..(121): n is a, c, g, or t
  misc_feature (141)..(141): n is a, c, g, or t
  misc_feature (144)..(144): n is a, c, g, or t
  misc_feature (146)..(146): n is a, c, g, or t
  misc_feature (150)..(150): n is a, c, g, or t
  misc_feature (170)..(170): n is a, c, g, or t
  misc_feature (172)..(172): n is a, c, g, or t
  misc_feature (480)..(480): n is a, c, g, or t
agggctcatataaatcccaataccngctgctgcctgcttacccgtatcacaaactgacctctccttagtgnttgggccnnantttcttcatttggaaggtngnnggtgtggnaagcaaccnagtcattaacttgctcgcangcntnttgngcagttagctaacaggagtntnccagtttccagggcatctcacctctcatgagcccttgcacccatccctcaggtgttcaaatctcgaacgccgccagtattgccattcgctgctctgctctagcctgctggagtacaccccatcctcaaggctctccccactagaggcctgtgcgcacagcttctttgatgaactgcgatgtctgggaacccagctgcctaacaaccgcccacttccccctctcttcaacttcagtgctggtggtgagggcatagcctgggatctggggagtggggcggggtaggggggcagccaaagattgtgaggancttggtgtt

SEQ ID NO: 578079 - DNA, 852 bp, Homo sapiens
gtgcctctcaaggcagaaccacagagatggggtacttacatccactccctcaccgcccttcaccactcactccccagcgtcctgaggtggctggccagtgaacccccagttcccacctctcaacccgcggcacttgtaggccaaggcgccaggcagcacgacagcagcagcagcagcgtcgtccttgcagtccaagggagctcccaagggaagctgttcgacccctgccggtggccgggccactctgctagagtccatccgccaagctagggggcatcggcaaggccaagctgcgcagcatgaaggagcgaaacgctgggacgcaagaagaagcagaaggagcaggagcaagctgagagccacgagccaaggtgggcactgagatgtcggatctctgtcaacaagctaggtcatagaggtgcaagggcatgctctgggcaaaggacctccggggctgcgtgaggggcccggaggagcctcttgccgagcgtgtcgagacgtcacatgcccgtcgctcttgcgcgcacaccgctagcaagccacaggcagaggaggacgaggacgacagggaatcctagggggctccatgacacggttccccggccagacccagacattgggccgttgctcgtgacatggacacaagccaggacaagctgctcagacctactttccttgggagggtggtgagcggaagccagcaactgtgtgcgagactcagctgtgaaggagcggaaggctggcttgaggccacacagctggggcgggactgtctgtctgcctgtgctccatggggggacggctccacccagcaaactccacagggggggttcctgtcacttgccttagaag

SEQ ID NO: 578080 - DNA, 218 bp, Homo sapiens
taacttttaatcaggtatttaaatgtaaaaataattaaaaatatacaggaaaatatgcttaggtaccttataattcctatcccatttaatgtaagggacttaaccttctgcaaatggtggtgtccacagctaaccaaacggctctgtgcaggaaaaggccctacagtgaaggaaaaattaaacctttgtattgtggcctattttgtgtccatttattc

SEQ ID NO: 578081 - DNA, 272 bp, Homo sapiens
catcaacaacaggggcatatgtgttaatagtattcagaacataagctgcatagctttttagaataaaaaatgatataacttcaggtacatgcttcgggacacttggttaaacaaggaatcggtgtctttgatgaccaccttaaaagggccccaaacttcacagtgtaacttggaaacggacagggtgatagctgattacctcatgacatactgccttcaaaagaacattctgacagagcattaagcaaaacagagcccacaggttcaaggtt

SEQ ID NO: 578082 - DNA, 421 bp, Homo sapiens
aggatcccgacggtccaacggaacttttcggtacaaataaatttaatgctttttttttctgattctgtgaagaaggttatgggtagttggataggaatagcattgaatctataaatggcttgggtagtatggccattttaacaatattgattcttcctatccataagtatggaatgtctttccatttgtgtcatctctgatttctttcagcagggtttagtaattgtggtggtagagatctttcatctcccgggttagctgtattcctaggtattttattcttggggtggcaattgtgaataggattgcattcttgattaggctctcagcttggatgtcgttggtgtataaaaatgctaccatattttgtatatggatttcgtctcctgaaagttccgttgaagccgtcgggtaccgagct

SEQ ID NO: 578083 - DNA, 312 bp, Homo sapiens
  misc_feature (272)..(272): n is a, c, g, or t
ctggcataaagctttgctgtttaaaactctgatgatgatctaatctttattcctttatgtctctatatgcttttttatattgtttatatatccttgatatcctctttaattttttttttgctttttacttattgtgaaatatttaattgataaataaagattgaatatattcaaggtatacatgacaacatgatgatttaatatatgtatatattctataatgattacacaatcaaaatgacacatctgtcacactcatgctgtacatagancctcagactaatcttatactgaaagtttgtaccgtttgac

SEQ ID NO: 578084 - DNA, 889 bp, Homo sapiens
ggttttgagtgtggctgtacacggaaaatcttaggattgtttaatatgcggccacatagggatgtggacggtatgtcagtcgacatgcttatagagcactttgtagtgaaagcgcagcatcacgtatgccatgcagcttaccaaaccatcgagtctggtgactatgctggagataactatgttcatcgacgtggttgcaagtagaaacaacgagtggacaacagagtacctacagatatgaatgtgagggggcatacttgccgaggaagagaacatagactgccttacagttagcacgtattcatattgtactacacacacgaccacgacgtggacctctcagcgcaatctactggtgaaaacaagatagttcggatagagaaggagacagcagaggatagattaccaacatgaacgaccaaagtgtatacagaaacaatcgagaaggtgtgataatctagagcacaaactaaatgatctcctaaaagaaaagcagtctgtggaaagaaagtgcagctcagtctaaacacaaaagtggccaaactcaccaacgagctcaaagaggagcaggaaatgaacaagtgtttgcgagccaaccaagtcctcctgcagaacaagctaaaagaggacggagagggtgctgaaggagaacctgtgaccaaaaagatctgagatcaccgagatcccaggagcagctgcgtgacgtcatgtactacctggagaacacaggagaagatcaacatctgcctggcgaagagccggaggaaatccaggagggacagatccacatcggcagggctcggctcaagcctggctcctcgggggccaggggaaattgcccccaggaagggccgcagagaggggcagtgacccaagcaaagatcctgaa

SEQ ID NO: 578085 - DNA, 218 bp, Homo sapiens
gggggccccccccccctttttttttcccccttaaaaaacccggggggggttcccccccccggttttttttttggggccggggggggttacatttttttcccgggggaccctttttccccttgggccttttttggggcccctttaaacccgttttttcccaaaaaccggggggggccgggcccggttttcccggggtttttttccccccccggccccca

SEQ ID NO: 578086 - DNA, 165 bp, Homo sapiens
  misc_feature (35)..(35): n is a, c, g, or t
cttttgggggcccctttagaccaagtttggcaaanaaaacgggggggggcggggcggggattcccggggattttgtccccccgggggcgggttttttggggggggggtttttttgggttgggggggttaactttttttaaaaaagggggttttttattttcccca

SEQ ID NO: 578087 - DNA, 131 bp, Homo sapiens
ggactcaacaaagaggccgggtacattatgggcgtgattgaccacccatagagcaggaagagggagaggacggcaggaaagttggtgggcgacgtgtagtgccggcaggtcgaacacaaacaggatgatga

SEQ ID NO: 578088 - DNA, 1422 bp, Homo sapiens
  misc_feature (744)..(744): n is a, c, g, or t
agctacctactagcagcgggagacggagcgacctgcattccgagactgggcagattcgcggaccgcactgagatgacccgcgtattatctcagtcgacttaatgtggagattcgtgttaactagactagtggacaaggacatctgagtaatcgataacgaatcaatgtactagaatcatttggagtacaaagaatgtcgtggatttggactgtggaacggcaagtagaaaccgaattatggacatctggatgagatgaaaaaggagatctgctgatgatagcgatcgttgatagatctgggtcgtcgaggattggctaggtagactgatgtgagatggttggtagtactatgcaaatacattgcacagtcttgaagtcatctagacacgacatgtatcaacgaggataagaaacatgagctgaactgtaatcgtatccaatgagacaaatggaatgtcatgtaactacacagtgtacaagagaagtggtggtgtccattggatcaagaagagactggcaggaacaactgactgtgaacgactcagcggtgtgaagtgtcaatgcaacgtacgcgagtgggctctagcatttgacgtgtgcgggtccttggtatacgtgggtggtctgggatttgtaacttacaagatagagcgggctaaccaagggtactaggaattaccgggcacaagtagcactacgtgttagttgacctacaatggtcgagcccaaatcaaggggttccgncgcagaagtttccggggaaaggaaacggatagactcgggcaaaatttcattgaaacctcgacgcacgagttggcaggaacaaaaaatggaactttggaacaggaacaggttgggtacaaataaaaatttggagttccaagaacaggccatttgcgacaaaagaccattagaaaaaagggctttggccaaagtacttaattattattcccttcgttcccaatgcactggtctttacgattaagcaaaagatgttaaacacatcgtctgaacgaaagaggccccaaagagcatttcggacacttgggcggacacacggtccatgggaagctttccaatgggtgaaagggccagtaagttcctgggaaacagggccacctggggggaccgacgaacaggggtgctttaacaaggttgaaaccgaagttctgaattgggatatttgaacccagccaagttccaaagaaattctgggttcaagaaggttacagaaccttcaaaacaagctggggaaacaatacaaacagggggcaattttgggggaaaacagaaaaacaaacaataatataataccatcatatgaacagcaaagacaaatacgacaaacataaacaagcacaagagatagtctagatagaacgatcgatatcagatcagctaatagtacaataatagatagaa

SEQ ID NO: 578089 - DNA, 153 bp, Homo sapiens
gctgctgtggtgacttagaggatccccggtcagctcctctgtcttggtgaagaaccattcctcgacatcctgcggttcttctctgccatcttctcatactgggtcacgcatctcgtacagaatgcggctcaggtccacgccaggtgcagcgtt

SEQ ID NO: 578090 - DNA, 350 bp, Homo sapiens
tactctgcgactactggatgtgcgttccgtgctgtcttgtctgcggttcggcgtgacctcctttactgcttcagtatgacccactcctgtgcaggttgttctatctgcgtgattttcgagacaatactgtcagagttcaagacacagattggaacgaactggacaggaagaggcagcgatactaagaaaagaatccccggagagggcggatcgtgatgcgtccgtgctatcgtcgagtcacaccagttccattctgatgcaaccccttgcatcctcagccatttcctagctcccgccttcctccaggaattatcgggggtgaatatgaccaaggaacaacacttccctag

SEQ ID NO: 578091 - DNA, 510 bp, Homo sapiens
gtcatagtgctcatctgggtactcggcaaggttgtaactgcggagccgaaggccgcctcctggcaggcggtaaagcagtttcacgcgaagtaggccgtcgtggtcaagtgcgtacatttttccgtcgatgatgctcttggcgtcagtgttcacgccaacagtgctgccgtcaggtagcaccggttccatgctgttgccctttactggtacgcagccggctgcttcggggttcacgttcttcttctgcagggttcgcttgccaaagcgcagcttcctgccattcgtttcgagcatcactgcagatccgttgcctgcggagatttccgtttctttgaaaaacggcagctccacttcgtcaggcccaagcggggtgtggtcatcccagacttcaatcggatcgagcactacatctgcagatctggatcgttggggagttggggagagtggcaaatccttcatcagcctggggctgacgtccgtcgggtcgaaggagagaaccgatgcgaactt

SEQ ID NO: 578092 - DNA, 365 bp, Homo sapiens
tgtgatgagcatgcatcagtatttcatgcctatttcataggcgagtaatattccactctatggataaccacatttgtttatccagtcatcaactgatggataatcttgcctagttttatacatcactgttgatagcaagtccaaattattacaatctgaacatacagttattattaataatacataaaaacaggctgggtgtgtggttcatgcctgtaatcccagcacgcgggaggccaagatgggcagatcacctgagcccaggagttcgagaccagactgggcaacatgacaaaaccccatctctacaaaaacattacccaagtgtggtggcatgtgcctgtactcccagcaactcaagaggc

SEQ ID NO: 578093 - DNA, 207 bp, Homo sapiens
caggaacacgtgagggcaacaagctgtcctcagggcccctcaactgccctcccatgtcaccaggcccttcacagctggacactgggacttgctttactcaatcgacctcacgggctatagcactacgacagagcgccatgacacaacgcgagacggcaaaaacacaatctcgaacactctgaaaacacaacatcaatacttcaaaaa

SEQ ID NO: 578094 - DNA, 326 bp, Homo sapiens
aagggggagggaactcgtgagaggtgatatgaatcatggagaccgttcccccgagctgtgagtgagttctcatgagatctgatggtattgtgcggggctaaaccccactttgctactgtacttctctgtatcttctccttcttgcaccaggtgaggaaggacatatatgcttctccttccatcatgaatgtaagtatactgaggcctctgcagccctgtagaactgtgaatcaattaaacctctatcctttataaaccacccagtctcggttattttttcttagcagcatgagaagggactaatacaggggtgcggataccagggg

SEQ ID NO: 578095 - DNA, 329 bp, Homo sapiens
gaggagaagtctcactcttgtcccccaggctggagtgcaatggcttgatctcggctcactgaaacctccacctcccgggttcaagcaattctcctgcctcagcctcccgagtagctgggattataggcacctgccaccacgcccggctaatttttcctatttttagtagagacgggattccaccatgttggctaggctggtctcgaactcctgacctcaggtagtacacccgtctcggcctcccaaagtgctgggattacaggcgtgagccactgtgcccagctcttctagttcatttttaagtgttgagtcccttctgtcgtcttctc

SEQ ID NO: 578096 - DNA, 262 bp, Homo sapiens
  misc_feature (27)..(27): n is a, c, g, or t
  misc_feature (63)..(63): n is a, c, g, or t
gtgtacatccagatgacttgaagcaantgaagatccacaaaagaagtgaaagtagccttaaantgatgacattccaccattgtgatttgttcctgccccacgctaactgataccatatattcttcccccgcccttgagaatgtactttgtacacctatcccaaacctataagaactaatgataatcctaccaccctttgctgactctctttttggactcagcccgcctgcacccaggtgaaataaacagccctgttgctcac

SEQ ID NO: 578097 - DNA, 455 bp, Homo sapiens
agatgtcaggatgatgttgtatcctaatttatactctcaagtataaatcttgtgatttacttaatctctttgattctcagtttcatgtaaaatgataacaagaatttctgctttacctgtttcagagagctatgagtgtcacgagatatatatgattatatgctctggtgtaagttatgtgtaaaatgtacaatagtgtaattgttaagtgctggtattttttatttcatatttatctctcaggcttataatgaatttctccctctttaatgccaagacaccaggggtaacattaactcacattatgcatattcagatataataaatataatatttttgcttgctattggggttttcatcatgcagttgaaattcatattatttttaattgtgaaatttctttgtgagaactgacaataaaaatcaaaataatttccccctcttcccaactgata

SEQ ID NO: 578098 - DNA, 236 bp, Homo sapiens
tcccgtcacgcccagcagaccaagactgaggcacgcagcttgtgatccccacagctcacaggtaagaggctgctcacttcctctcctaacactgtaagcagtccttgtccttgggtaccggacactatggctttggccctgtgtagggagaagcggtgccacatgagttgtcttaagaggacaatggcatgcacggtctgagatcagacgttgtgacttggccacccatgagccac

SEQ ID NO: 578099 - DNA, 774 bp, Homo sapiens
attcatgtctgcattaccaaacatttgccagcttcaaataagactcattcctacacatctgcataggtgatactcggatagctagctatcgaaacaggtcctccatatgtctgtcgcttagatttgtattctctaatcttgtctcactaaatgcagtattctgtataggatcaagcttccttattgaaaatgccactgactagtaagcaccacatgttccctccgcaaatggactgagacggtctgaccgacatgatcacgcagtgatgaacctgaagagcctctgaagaatcatgctgatttcggacaggaatgcgtctcggagacagtctgcgaccggacgggtctaggtgacacagaagccaaacaggaggaggaagtaggagggtaagtgctatccgggtccgccgttggccacagcgctccgcgatcttattactaatcgccataattgtggacgccgtaacttgtgatcccctccttgaaagcttgctctgtacgcatgcgctctatgagtggcctttcccctaggttcaagctcccctccgacgtcatgcgtcctgttgcgtctagcggttcattcgaacgtcgtattaagctgggtgctgggcacctgtgtagcactggtgtccaataccagaagtcggatgtggcggcgtctgtgcttcctttgtacctcgtgaagcctccgttggccttgggcgggacggtgtgcgcaccctgccgggagttcgtagtcctggccccgaacggtggcctggcagcgcgggacgg

SEQ ID NO: 578100 - DNA, 634 bp, Homo sapiens
  misc_feature (233)..(234): n is a, c, g, or t
  misc_feature (611)..(611): n is a, c, g, or t
gcattttgacaacccttggtcccaggttggtccaccagtagtctatatgttaccatgagacaatgtttcaatgcagttaatattgaactcaactgactttgcataaagcagattccccttcataatgtgggtaggcatcatccaatcaactgaagttctcaagagcaaagacagatttcctgaagaacgactttggtctcaagactgaaccacgaaagccatacttgaatttnnagctggcctgccctgcactgtggattatggatcaggacgtgacatccacacttacctgaatttccagcctgccaacttgccgtaaagattttggatttgccagccccctcaattttgtgggccagttccttaaaagcaatgtttctctggataatcctgagtaatacagagtacatttacaaaataaataaatgacaatctttcacaagacctacttcttgaagaaaacacaccattttcaaattatgtacccttacataatttgacatgtaatggccaattttcatatagattcaaaatctgtaacaaattacataaattgaaatttccagaagtgccccattacatagttcctagtcagtttgcctgcctcttgntttttttttttttttttcttaaa

SEQ ID NO: 578101 - DNA, 633 bp, Homo sapiens
  misc_feature (233)..(234): n is a, c, g, or t
gcattttgacaacccttggtcccaggttggtccaccagtagtctatatgttaccatgagacaatgtttcaatgcagttaatattgaactcaactgactttgcataaagcagattccccttcataatgtgggtaggcatcatccaatcaactgaagttctcaagagcaaagacagatttcctgaagaacgactttggtctcaagactgaaccacgaaagccatacttgaatttnnagctggcctgccctgcactgtggattatggatcaggacgtgacatccacacttacctgaatttccagcctgccaacttgccgtaaagattttggatttgccagccccctcaattttgtgggccagttccttaaaagcaatgtttctctggataatcctgagtaatacagagtacatttacaaaataaataaatgacaatctttcacaagacctacttcttgaagaaaacacaccattttcaaattatgtacccttacatcctcccacccgccgtccccaattttgtaataatatgtcaccattgatatgtacatctcaattagtttttgtaaaatgcatccaattttcgatctttaataagactgcgttctttttattcttgatgaatttattcctaaa

SEQ ID NO: 578102 - DNA, 252 bp, Homo sapiens
acggagactcacatgaggcacatagcgagacccatgtcttaataaaaaaagccagtgtgataggtggcacctgtagtctcagctaagctactcgggaggctggagcgggagggtcacttgagccgaagaggtcgaggctgcagtgagccatgatcctgcacctggtgacagaggtagaccctgtcttaataataatccagcctggccaatatggtcagactccgtctctactaataacacaaaaaaattagc

SEQ ID NO: 578103 - DNA, 440 bp, Homo sapiens
ctgtcgcctgtgcgtgtgggtgaggatatgctgtcgccgggtccgcgtcacgctgtctgtcgctctgggcgcggagccatgtgggtttggattgagccgggcccggacggggcgccgagtcggagggggtggcaatgagcggaggtagaagctacggggctcggtttggctgacatgggagtcggcagagccgaggaaccatgcgagggccgcggagactggtgctgggcccggaccggctctggcttcggcttcttttgcgtgcgtggttacaggcgccgctggtcacctctacattcggggtctagaaccgcgctggcgctaccgcaaggtctgtctgtgcttcctggtctacaacttctttgggggcagtgacacacgctgttgaagctgtctttgagcctgtgtacacggtgtgagagaacgtgccgctgtgttgg

SEQ ID NO: 578104 - DNA, 714 bp, Homo sapiens
  misc_feature (648)..(648): n is a, c, g, or t
tgggaggacgcggacccggccatggcgcggaagaaggtgcgtccgcggctgatcgcggagctggcccgccgtgtgcgcgccctgcgggagcaactgaacaggccgcgcgatcccagatctacgcggtggactacgagaccttgacgcggccgttctctggacgccggtatgccggtcccgggcctgggccgaatgtgcgccgcgagagccgcctcttgcagcttgctcggccgcctcccgttcttcggccttgggccgcctgtgtcacgcgcaaggtccttggctggtggcagcaacgaggagccggtgctacttggggcgcctcacgcgggttgcggcccgaatacacgggccgcagaactgtggaccacgggaaaggcctggggcaatctgaccttcacaagggaagactgagagcgagggcgcgggagatcgaacacgtcattggtacccatgaattggacggctggtgcccaagcacggaggaggaggcctttcaccgagtaacaacgccagggcgccgggaaagaacaagctgtggcctacagaagagccgtaacaccgacttcatcctccggggcccatggatttactcggcaagaaccaggagagaaaagaactgggaagacaacaaaggcacacacgagngagccccatggcctgaatgtgtgcgaagaagtgattacggcatgggaacccatgggggattacccc

SEQ ID NO: 578105 - DNA, 121 bp, Homo sapiens
  misc_feature (6)..(6): n is a, c, g, or t
  misc_feature (23)..(23): n is a, c, g, or t
  misc_feature (41)..(41): n is a, c, g, or t
  misc_feature (43)..(43): n is a, c, g, or t
  misc_feature (48)..(48): n is a, c, g, or t
  misc_feature (52)..(52): n is a, c, g, or t
  misc_feature (56)..(56): n is a, c, g, or t
  misc_feature (69)..(69): n is a, c, g, or t
  misc_feature (76)..(77): n is a, c, g, or t
  misc_feature (101)..(102): n is a, c, g, or t
  misc_feature (112)..(112): n is a, c, g, or t
tcctangctctgggtgaatagancctgatggtatactactntntgcgnaatngcanacaactgtgcatnacaaagnnaatatggcaattatggtctggggnnaaattgagtntcagaaccc

SEQ ID NO: 578106 - DNA, 417 bp, Homo sapiens
  misc_feature (84)..(84): n is a, c, g, or t
  misc_feature (92)..(92): n is a, c, g, or t
  misc_feature (94)..(94): n is a, c, g, or t
  misc_feature (97)..(97): n is a, c, g, or t
gtcaggtcggcagcaacgcagcgagccgagcgggtggcggcgccatggcgtgcgcggggctgctcaccgtgtgcctgctccggncgccggcncnagncccagcccgcaaccccgcgagagccccagctcgcgcccgagctcgtggcccgacggacaacgctcttccaggacgttccgcaaggacaaatgatgatgggaagctctcatttgaggaattccagaccttactttgccgatggggttctcagcctgggaggagctgcaggaactgtcagcggcattgatgggcatctcaccgacaatttagaaacagaaaaactgtgtgactacttctcagagcacctgggtgtataccgagcggtgctggctgcattggaatcgctgaaccgtgcagtgctcgctgcatggatgccaccc

SEQ ID NO: 578107 - DNA, 851 bp, Homo sapiens
gcagtgactatgcccgtaatcccagcacctttggaggcaaaggcagggggaggatcacttgaggccaggagttcgagaacagcctgttcaacacagcgaaaccccgtctctactaaaaacagccaaaaattagccaggcaatggtggcacgtgccagtaaccccagctactcaggaggctgaggcacaagaatcacttgaacccaagaggcagaggttgcagtgagctgtgatcgcaccactgcactccagcctgggcaacagagtgagactctgtctcaaagaaagaaattattaaaaggggacaacgttagcgtcgatagcgagtatgctcagacaggggagacagaaaaacttttaaattggggggctacgaaggtacgagaactactgtaacaaccaacacagaactttacgcttccgctaggtaaattatacttggggtggccagctcaaatcatctccgacgatttcatctatgttgagacaccgttcctgagactggtgatacaaggcgtgcggattaccactctgacgatgaattacacagagcaccattccgtgggatgtcataatacattacacccggcacctgggggctaccctggaggacgacaccagaggaatacccgcgggcatattggcgacaagcaacgttctcaatacaaaaaacccccgtgggggccaaggacgcacaaggagggttcacaaacccctcgcgtaatcccccagcacgactagcgggcaaggcggcccacagggtggaacaacggggtacttcaccaacagggctcaagcgaagaaatcggacgaacccaactcccgggggctaacaacaccaggtgaaaacat

SEQ ID NO: 578108 - DNA, 2075 bp, Homo sapiens
gtctttctgctgatacagctcagttgttactttagctctggaagctgtggaaaggtgctagtgtggcccacagaatacagccattggataaatatgaagacaatcctggaagagcttgttcagaggggtcatgaggtgactgtgttgacatcttcggcttctactcttgtcaatgccagtaaatcatctgctattaaattagaagtttatcctacatctttaactaaaaattatttggaagattctcttctgaaaattctcgatagatggatatatggtgtttcaaaaaatacattttggtcatatttttcacaattacaagaattgtgttgggcatattatgactacagtaacaagctctgtaaagatgcagttttgaataagaaacttatgatgaaactacaagagtcaagatttgatgtcattcctggagatcctgttttcccctgtggtgagctactgtcagagctacttaacataccctttgtctacaggtctcgcatctctcgtggctacacaattgagaagaatggtggaggatttctgttccctccttcctatgtacctgttgttatgtcagaattaattgatcaaatgattttcatggagaggataaaaaatatgatacatatgctttattttgacttttggtttcaaatttatgatctgaagaagtgggaccagttttatagtgaagttctaggaagacccactacattatttgagacaatggggaaagctgaaatgtggctcattcgaacctattgggattttgaatttcctcgcccattcttaccaaatgttgattttgttggaggacttcactgtaaaccagccaaacccctgcctaaggaattggaagagtttgtgcagagctctggagaaaatggtattgtggtgttttctctggggtcgatgatcagtaacatgtcagaagaaagtgccaacatgattgcatcagcccttgcccagatcccacaaaaggttctatggagatttgatggcaagaagccaaatactttaggttccaatactcgactgtacaagtggttaccccagaatgaccttcttggtcatcccaaaaccaaagcttttataactcatggtggaaccaatggcatctatgaggcgatctaccatgggatccctatggtgggcattcccttgtttgcggatcaagatgataacattgctcacatgaaagccaagggagcagccctcagtgtggacatcaggaccatgtcaagtagagatttgctcaatgcattgaagtcagtcattaatgacccagtctataaagagaatgctatgaaattatcaagaattcatcatgaccaaccaatgaagcccctggatcgagcagtcttctggattgagtttgtcatgcgccacaaaggagccaagcaccttcgagtcgcagctcacaacctcacctggatccagtaccactctttggatgtgatagcattcctgctggcctgggtggcaactgtgatatttatcatcacaaaattttgcctgttttgtttccgaaagcttgccaaaaaaggaaagaagaagaaaagagattagttatatcaaaagcctgaagtggaatgactgaaagatgggactcctcctttatttcagcatggagggtttaaatggaggatctccttttcctgtgacaaaacatctttcacaacttaccttgttaagacaattttaaaaaagatcttttcacaacttaccttgttaagacaaaatttattttccaggctatttaatacgtactttagctggaattattctatgtcaatgatttttaagctatgaaaatacaatgggggaaggatagccatttggagatataacctaatgttaagtgacgagttactggatgcagcacccgaacatggcacatgtatacatatgtagctaacccttcgttgtgcacatgtaccctaaaacttaaagtataatttaaaaaaagcaaaaaaaaaatacaactcttttttttttaaaccaggaaggaaaatgtgaacatggaacaacttctagtattggatctgaaaataaagtgtcatccaagccat

SEQ ID NO: 578109 - DNA, 320 bp, Homo sapiens
cccccccccctttccccaattgggggggggggggtgcggggggggggttttttttacccacccctttttttttcaccccccttttcccggggggccccccccccctttttttttccccctttaagaaccccgggggcgttcccccccccggtttttttttttgggccgggggggggtttttttttttccccgggacccccttttcccctttggcccttttttggggccccttttaacccgtttttttccaaaaaccgggggggggcggggcggggttttccgggttttttttcccccccgggcccccccccgggccccca

SEQ ID NO: 578110 - DNA, 320 bp, Homo sapiens
  misc_feature (126)..(126): n is a, c, g, or t
  misc_feature (131)..(131): n is a, c, g, or t
  misc_feature (195)..(195): n is a, c, g, or t
ctaggagggaaggagctgttggggcaggggtgtaaaattatttcctttttctagtttgggcacatggccaggtagttggtgaacagaagagaaccagggagggtaacagaaagaggagggacctanctgancccaagagtaggaagagatttaacacttaaaattccactcatgccgggcgtggtggcacgcgcnctgtaatcccagctacccaggaggctgaggcaggagaatcgcttgaaccggggaggtggaggttgcagtgagctgagatcacgccattgtactccagcctgggcgacagagcaagactccatttc

SEQ ID NO: 578111 - DNA, 543 bp, Homo sapiens
cttaatcatgaaacctgatttatgtttttgaaggcccacatggcttccccataatgaattttctgcaccaaaatttatttaaaagtgttattatgctagcaagtcacaaaatttagtatttgcaattacatactatctttatatttgcaaaattttgaattttggatcctgtttcatggacttgtaaattaaaaacagaatgattacgcagctcctcaccagcaacggaacaaagctggacggagaatgactttgacgagttgagagaagaaggcttcagacgatcaaactaccctgagctaaaggaggaagttcgaacccatggcaaagaagttaaaaaccttgaaaaaaaattagacgaatggctaactagaataaccaatgcagagaagtccttaaaggacctgatggagctgaaaaccgtggcacgaaaactacgtgatgaatgcacaagcctcagtaaccgattcgatcaactggaagaaagggtatcagtgatggaagatcaaatgaatgaaatgaagcgagaagagaagtttagag

SEQ ID NO: 578112 - DNA, 106 bp, Homo sapiens
aagccgagagaaactcagacattgactggcaaaaggctctcgcatgaaaaggcatttgttttttaaccttctcaggacgtagaacatttagacttaaaataaatat

SEQ ID NO: 578113 - DNA, 321 bp, Homo sapiens
ctcgacacggagtcttgctctgtcgcccaggctggagtgcagtggcgggatctcggctcactgcaagctccgcctcccgggttcacgccattctcctgcctcagcctcccaagtagctgggactacaggcggccgccactacgcccggctaattttttgtatttttagtagagatggagtttcaccgtgttagtcaggatggtctcgataccctgacctcgtgatctgcctgcttcggcctcccaaagtgctgggattacaggcgtgacgaccgcgcctggcctaataccattttttaaaatggacaattctgggtcgacg

SEQ ID NO: 578114 - DNA, 801 bp, Homo sapiens
aataactttcctttggttgcattgtaactcctggactggaacactcgtgatcgtctttggctcctgtggctgcatttaattgcagtgatcttcctgaactgatcaatggtgacagtagacagatgtcctgagactccttatttcccaggatgaactgtcatggtggacaggctctccattgttcatagaatctggtttggataccagaagcacaggtctaaaatagaattctgaactttccattatcatgaaactaatgccatagaataaattggcaaatctggttcctaaacttacctagtttttctcactaattaatgtgacaattaagggagaagaggtaaaatggcaaaatggacataataatattgccatgcttgtcttagttactgcaagatcaaagggtccacaaatccattttgaaggatataaacgatcactgagatgctaggcacaactgtttattatacttgctttgtattatctaggtgtatgttctggaaacttctcatatcatatcctgcctaagtagaaattattgtagtttatgccatttgggtttcttaggtgaatacagttaaggtgtactttacggctctaggctatcccaggcagagggatatttaacactggtctctccagttttattgtcagatatacatttggcctggtatgcataatgttcatctcttggatttaataaccaggtaatcaagttatgccacttaattctttagcaaatgacaatctgagtacaaatcatttctaaattgtttctcacattaaattaatccaaaagta

SEQ ID NO: 578115 - DNA, 104 bp, Homo sapiens
gttgagtgatccccggacgctacgtgacgctgaatgacggggctggtgagggcgcccacctgcaccatgccctgtcattgctgttgtggcctcctccacggaca

SEQ ID NO: 578116 - DNA, 130 bp, Homo sapiens
  misc_feature (86)..(86): n is a, c, g, or t
tcgagtcttgatttccttttaatcttcgcaaacggttctatccattatcaaaaatgggatatgaagtctccaattatgccagattntgcttctcctagaagcagaaggcatggcaccccacatagggcca

SEQ ID NO: 578117 - DNA, 671 bp, Homo sapiens
  misc_feature (400)..(400): n is a, c, g, or t
  misc_feature (435)..(435): n is a, c, g, or t
  misc_feature (608)..(608): n is a, c, g, or t
agcctgttcaagtatgctctcactatagttaccattcatatttgataagaaaagaacatttaataaatgtatgtgtggggctgaagttctaaaggaattgaaaagagactataaacattgaatgagggtgagggcatccctgctggggagaaacctctgtccctaagaagagtccattcatatcatgtggtttgagatgaaccaaaggtctaaccccatcaaatcacatgtgatggcaaatataaaataagcaaatggatgaaatagtcgaataaataagttacataaaatgcatgacctgatcaccccatcaagtactataaacagttcccagaaacaattacccacttcacatatccatagatctaacccttaaactctaccaatatcaactacccanaataccataattttatccaaaagtatacttacttncttatttatctacaaaaagattgaaactgttgtattcaaaacctattttactaaatattcccactaaaatctctaatataattaacagatcattctatcaaaatcatatacaaatgcttataccataactcatacctataatgccatcactttaagaagccaaaagtggccanatcatcctgaacttacgactttaatacccatcctatacaacatttatgaaactgcatctctac

SEQ ID NO: 578118 - DNA, 113 bp, Homo sapiens
gtattacatgctctcacagcaaccactgaggtaaccgaaggacgtaatagcactgcttcagagaaggtgatcttgtatgactggtgtgtcggatcaggcctgctttgatgcag

SEQ ID NO: 578119 - DNA, 296 bp, Homo sapiens
gctggtatctaagatccgtgaggtacaatgtgaacctataaaatagaaaatacagagtgtcagggtgaggaaaggatattgaggcaggagttgatggtggtgagatgattgtgcactgtgtctcgagtgtgaaaagagtgagaatattcaaaaaaaaagaagaggcggtgtggtggtcatgctgtatctcagcatttgggaggcaaggcgggtggatcacttgaggtcaggagttcaagaacagcccagccaacatggtgaaactccatctcaaaaaaacacaaataaataaaaaa

SEQ ID NO: 578120 - DNA, 118 bp, Homo sapiens
tgatctagaggatccttctgggtgatgatgtgggtataaagtacataaaatatatctaactattcataatgtggggtgggggacaattattaactcaccagcacatgcatgcaccagt

SEQ ID NO: 578121 - DNA, 215 bp, Homo sapiens
  misc_feature (68)..(68): n is a, c, g, or t
  misc_feature (131)..(131): n is a, c, g, or t
  misc_feature (153)..(153): n is a, c, g, or t
  misc_feature (172)..(172): n is a, c, g, or t
aaattccgtgacaaatttttgtcaagtcgcttccattaaaaagtactgattttaaaaactaataactnaaaactgccacacgcaaaaaagaaaaccaaagtgtccacaaaacaatcatttgttttgaaggntttacgatgcattgttatcatnaccgtctttcactaaattntacgccatgaacacatttgagaccattttccaccactgattag

SEQ ID NO: 578122 - DNA, 227 bp, Homo sapiens
gggtttgcttaggcgcagacggggaagcggaccaacatgccattggcccggagctgggtttgtcgcaaacctagtgtaaccccgcggagacccttggggaaatctggtttcgaccaggagctgaggctgatcgccgagaatggcctccggaccaaccgtaagctctggagggacaaattaaccctggccaaggatccgcaaggccgcccgggaacctcttgacgctt

SEQ ID NO: 578123 - DNA, 201 bp, Homo sapiens
aaaaattgcttcccttttataatttgaggtgtggcatgggaattttaagctgatccctcataatgtaaaagttcccaaaatggttcaaatgtaacagggcaaaattgaaaatggaggcatgcatacccttccttttaaaaaaaggcaggggttgtaatttcaaatttttgggcaattagattaaatcataatgccccagta

SEQ ID NO: 578124 - DNA, 113 bp, Homo sapiens
gtattcctcctgctgctaaggaaaaatataacaggcattcagagggggaagatcatggctgagcttggcgtggtcagtagagaagcttcagagacaaatacagaacttaggta

SEQ ID NO: 578125 - DNA, 131 bp, Homo sapiens
aaccgtttgaaaattgtgagggagccacgaaacggggagaatatttggatgtataatttcgatgtctagtttgcttgcttatcagggaatacttaagttcctttcttttctgtatattctagttggtgaaa

SEQ ID NO: 578126 - DNA, 977 bp, Homo sapiens
gggcagcggaaggcagccagtttcgcgaaggtgtcgggcgcggagccgaggaccggagcgcttccccgagcacccggagcgctccccgcgccacgatgccaagaggaaggtcagctccgccgaaggcgccgccaaggaaagaagcggcgacatcggcgcggttgtcagctaaacgctcttgcgaaagtgaaagcgagccgaaaacgggccgcagcggacggataacttctccagcaccaaaaacatgtgcacaccacaacggggcaaacagggggagcacacggggcaacaccacgcgccgagagtgggtaaaccacaagacactacaaggaagacttaccgtgcgggcaaaacggggggaaagcgaagacttggagggaagagtccacaggccttctggtttgaacgcaggcgagatgaaagaaggcaaggttttggattaaattaagctattattacagtggtctatactcaagggggtccacatggtcatacctttttgggtaccactccaagacggacatattttccaatcaacttatttgttggaacagtggcacggtttcgcaggcacgttctaagacacacatttttaaaggaaggggagggaaactcccacacctgcatacccatatttctgcacgggtgacacacgcgctgatcacacagagggggcaaccccaatgggcggcgctacacatcttgctcaccacaccagggaaacataggggcgcagacacgggaacatagcgcaggcacgactggcctccgggcgcaagacttacactccaacgagtgggggtacagaaaatcttgcacaccgacaaggcactaccgggcagcaggggccaggcccggctacaggctgacattgaatcactctctacactgtggcgcacacaacaggtctcacgaacaagttgaatgggctccggaacgtggcccgacatcgggagcgcccaaatcgaccggccaac

SEQ ID NO: 578127 - DNA, 216 bp, Homo sapiens
  misc_feature (18)..(18): n is a, c, g, or t
aaaatagaacctgatganggcacccccccccccccccccccgctttttggggtgaggggagcccctgtttttgggttggggtttttttttgtttagggccccccggcgggggttgataccgttttttcatacaggggccccgttcctttgtaatcataaaggatatcaaaaataagcaccagtaagaataaataatgttaaaaaattaaatttaac

SEQ ID NO: 578128 - DNA, 439 bp, Homo sapiens
ctcgggtgatgtgtttctcttttcctgatgggtcttatggagcatgccatgtgcaggccttctcttagagaatgttttcctaattttgtttttcagtctttgtatgccattggctggaacatgccagactcttttttaaataaatgtttagagaattttacactcagagctcctttgagagcaggcagcctgttttaaccttagataaccgtcttcctgtgcctctacctttaagttcttcttatattcacacctagcaatgagagatatgaaagaagataggttttaggtttagaaacaccttgctcatttactgacctaactgcttaatagttctatgaacttcaagctggctacttaatctttctgaacttcaatttctttatctggttaaaatggataactgtgtggtaaagtccaaataaaatcgtgaaagtta

SEQ ID NO: 578129 - DNA, 428 bp, Homo sapiens
agataaataaataatgttaattatttttccaattttggtggaaaaaaatcaaattttacgttctgcctatatgccattacaagtccaataagctcaacaaaactccaggtacattaaaaaatcctgctacaacataatcaaaatatctacaatcaaagataaacagaactcactgaaagaagaaagagaaaaaatgtgcattgcccatagaatcacagtaatatgaattgtgactgactttgtattagaaacaatggagacagataatgatgcaatgccaactttaaaggtccagagaataatggtaaaacaataatcaacctgaagaaaaatgcttacagatataagcttgcatatacagaaatgaacaacagtaagaactggtaaatgtttgggtaaataaacaagacttaaattttaaaaaaaaa

SEQ ID NO: 578130 - DNA, 715 bp, Homo sapiens
agcggagacagtcaacatcaacactcacgcgctacattctgaagaaggtacctgtaataaacaacgattctgtggagatactgaaatgcagtgaagacgatgttcccaccttcttaaaatggtgtaatataaggttcattcatggaatgttgtatgaagcagattggtattccaacaagccttctaggaatgcagatattataggggcataacatgaactggtggtaaagtaggggggcatatttcgagcaggatgatttcttcacggagctactgaatttgacacgtgcagagtccgtagcaggaaaagagagggcacgaccccgaacatctattttgagctgcagacataattgcatcacagctgagatttcatagtccccggtcctctctattcctgttgaattacatgattaccggtaactatatatatatgaatatatgaagatgtcctaattgttgcaggttggagaatttgggccaggaagaactcacgttgggcaatgagttacaaaagtgagcaaaaagcattagcagtcatcagaatttctaagtagttaaattatctgcatggtgggttcagtataaacaaacatggtactctcaaatgactgttgatgggctattaattacattagtatcctgtgaaccctggtcatagctggcaacgagaatctttgagaactggaaaaccaggtatttgtactaggacatg

SEQ ID NO: 578131 - DNA, 205 bp, Homo sapiens
  misc_feature (6)..(6): n is a, c, g, or t
  misc_feature (54)..(54): n is a, c, g, or t
  misc_feature (62)..(62): n is a, c, g, or t
aaaggntccaatttggaaattattctgaaaatggcaactaaatccacgagtgtntgtttgtntgtgtgtgtgtgtgtgtgtgtgttttaagagacagggtctctctctgttgctcaggctggagtgcagtggcacaatcataacaaactgcagcctcagcctcctggggtcaagccatcctccatcctcaaccttccaaagcgct

SEQ ID NO: 578132 - DNA, 223 bp, Homo sapiens
  misc_feature (129)..(129): n is a, c, g, or t
gcagcgctaataaaggttgctttgttacagctaacagtaaccgatcatagagtatagcagcgtataagcgaggtttttttaataacactatattcctcccggaacgaaacgacaaaaaaaagggcctcntctccacaagcgcctttcccccgtaaatgatatcatatacaattcgtattaatacccacacccacccaaaaaaaggtttgtttaaaaaaaaaaa

SEQ ID NO: 578133 - DNA, 1200 bp, Homo sapiens
ccacttacaccataacgcgtgcttacgctaatgccggtggtcttgctgacggcaacttccgcaccgtccgatttgcctgaggccaactccagcgcagtggaaactgcttcttccagaatcttgcgctgcgcttcaacttgacgagattactttcattgcaagtgccataagtgtagagagtttctctgaagtctaacagagaaccgtttttcagtgcgcatcttaactggtaacattagcctcattttttctaaggagcctgagatgactaagtcagcccgaagactggctcgacgacgttcccggtgatgacatcgaagacgaagacgatgaaattatctgggtcagtaaaagtgaaattaaacgtgatgccgaggagctaaaacgccttggcgcggaaattgtcgatctggggaaaaccgcgctggataagatcccgtcacatgcggatctgcgcgcggcctatgagctcgcccagcgtatcacacgatggaaggtcgccgaccgacagttgcagctcatcggcacgatgctgcgccagacgacgacagtacagccctattcgacacgcgcgctggatatgctgaaaaaccgtcacaaccagacggatggcagctgtaccataacactggaaaactatgcgcgaatcgtcactgaatcgatcaagcgcgacgaaaccatcgatcgaggctcctacacactctgactggaccgactgccgaatcgctcaccacactgcactacccagaatacgcaacaccgcagcacaggaccagcacgggcaatacgaccgacgcacaacccgcacgcccaaaatacaccagtactatgcacaaattagcgcagcaccgacaggctaattatccgacgacacacactatctcgttgtaccacgaacacggcggccagtaagcccacatccgtccccggcacttagtaatatgataaacaaacaagtcaacaatcccaggcccactacgtactccaagattagctcataaattagaagtatcactaagacgactcatatctatcagagatcatcttcagaactccagattcgaacgagcaacaccaacgctatcatacctaacttcaacatcgcgggcagcacagtcacgccaagtagatagggagctacgctatacacatgagagagataagcaagcagatctcatatcactcatgctcttatacacg

SEQ ID NO: 578134 - DNA, 923 bp, Homo sapiens
acatcgggggtgtgacgattggtgtaatattactgccaatcggccctctaattggcgcctgtgtcccgcgacgtgccgcatttccctgatgtgcgcgggttcacacacagggtggactctattacacgggggcccccaacacaggcgccgggtgcaaaagggcctcctctaaggggttattccctgctgtattcccccgacgacagcttgttttcttcagccagagcattgttctcgaacccttttgacccacacgcactgcgctgtggtgcctcgcccccccctgtgtggtgcgggctcattgctccccccaacagagggctgcacccccgccgtgatgttccccctagggagtgtgccacccttccctggacaccactcccccgtgttatgtcttggccactcacagggggttatcaagatcacccctggggtctcccacataggttttgaatgccttagcacccgccggggggaacccccacggttaatcgctacacaccacccgcgctgaatccgccacagtgtatcatctggggtcgtctaaatttatatacgcctctctgctccacagcccctccgagtacctgtctgaggtatcccgccctcacccacattttcgccggccataatactggtgtctcaaccaaattttctgtcagcacccccagcggattcgccccaggaacgattctcacacgctatttatttgtgcgtcacgacactttctctcactcacagatatcgcttttctagccgccgccccacgtgaatatcgtccaccttttcagagccccccgacagatccacatttgggaggttcttgaagcacccccccctgatacctggccacatttgcttaaaatatggacttaacataattctcgataatgcctcccatttttttaagagggttcccaaca

SEQ ID NO: 578135 - DNA, 83 bp, Homo sapiens
accgaggacacggccgtgtatcactgtacgtggggattttaatcacagtcgatatctatgcttttgatatctggggccaaggg

SEQ ID NO: 578136 - DNA, 196 bp, Homo sapiens
tattgaatagaaaataagtaagaatgtttctatttttattttttttggaggtggggtcttgctgtcttgcccaggctggagtgcagtggtgcaacacagttcactgcagccttgaactcctggggctccagctatcctcctgcctcagtgtcctgagtagcatcacaggtatgcatcaccatgcctgggctaatta

SEQ ID NO: 578137 - DNA, 878 bp, Homo sapiens
  misc_feature (135)..(135): n is a, c, g, or t
  misc_feature (158)..(158): n is a, c, g, or t
  misc_feature (163)..(163): n is a, c, g, or t
  misc_feature (306)..(306): n is a, c, g, or t
  misc_feature (337)..(337): n is a, c, g, or t
  misc_feature (360)..(360): n is a, c, g, or t
  misc_feature (365)..(365): n is a, c, g, or t
  misc_feature (384)..(384): n is a, c, g, or t
  misc_feature (390)..(390): n is a, c, g, or t
  misc_feature (394)..(394): n is a, c, g, or t
  misc_feature (763)..(763): n is a, c, g, or t
  misc_feature (786)..(787): n is a, c, g, or t
  misc_feature (789)..(789): n is a, c, g, or t
  misc_feature (812)..(812): n is a, c, g, or t
  misc_feature (861)..(861): n is a, c, g, or t
ctctggatcccggggacggggccagcggccaaagtgaagcctgggaatgagtggcaccgcagcatccgggccgccagccacagggaagggccaagccccatgaagccccagtcatcctgcccagccctgcccccnggccatgccgggaggggccgganccccnaggcatcgccttcacagccccctgccccccgccccctgtcccggccctgcacctggtaaaagggtcatggacccagatggggctttccctttgtagccatccaatgggcattgtgtgggtgcttggaacccgggaagactganggggacactggagtgggtgcatgtgtctgcngtctcagaggccttggtcaggangaagnaggcagacacagcttagcntggttntgcntatacaaaagagaaaaaaacaacacaaggaaaagaaacaagcagaagcctttacttgttttagcaacagaaaaaagtacttggtcacttttgtgcttgaggaggcccatttactgcctggcagggggcaggtccgtgccctcccgccgactccagcagtgtcctgaggtgcatttcctgtcgtacacacaagggccaggctccattctccctccctttccaccagtgccacagcctcgtctggaaaaaggaccaggggtccggaggaacccatttgtgctctgcttggacagcaggcctggcactgggaggtgggggtgagccctcacagccttgcccttcccaaggctggcaactgcctccattgccnagagagaggcagggacaggctanntncttccctgtggaatgccgagaanctagcacctgcatgctggatctggctgcgggagctcttttctcctggcntcagttccacaggagat

SEQ ID NO: 578138 - DNA, 1897 bp, Homo sapiens
  misc_feature (153)..(153): n is a, c, g, or t
  misc_feature (155)..(155): n is a, c, g, or t
  misc_feature (311)..(311): n is a, c, g, or t
  misc_feature (1368)..(1368): n is a, c, g, or t
  misc_feature (1713)..(1713): n is a, c, g, or t
ggcacgcaccaaccgtgaatgtcagcgtggtcatcacggtccaacttgatagcgcttctactggctgctctcgatatacgatcggaaggttgggagatccgccaatcccccattgcatacacaatcgggtcgtcgccaaggtgatctgggctntngaacgcggcgaccatgccagatgtacaatagtgcactttcgtacgatctcgccacgagtacggtggtggccaagtcatcgagagacagcaatcggcccggctagtgagatcggatattcgaaaccattgcagcacgcatcgaagtatttcggacgntgtctgtgtgctctgagcatcaccgaacagagacggaaggcacaatgcgacgctcggatgcctcgcgcgactcctccgattgggatagcttgttatgagagatggcgcaattcccggcgcctgcgtcattggtcgcttcaacaggtggtggaccgactgatctatagcaaaggtggtagatctgtcgtagaaaccagcaacaggttctagcatagcatgacctttggccgcaccaccgagttgcacttttgctatgctcaccaagtggggcgttggcggcgtcatcattcttgggggcacagggcacgctcgcggtaatttctaagtggacaaattcttcacgcccttgacctttggatgccttagaattcgaacttgaggggactacggtcttgagtcgcactaaacttctttacggccggcgagttcgcggaagcgactcaccggctgagcgccatctagagttattccgccacgcggtaggctctgcggcataaccacccattttgcgctttccaaccagaagaaccgaatccggaggtggggtatagctgtacctcttcccccctttatccctgttgacctgattatggtggcgtttggaaacaccgtttggcgccgccttaatattgggcacacgcgcacgacacacgcagtaagaattccgttcatgggatttcctcggtgggaagacccaaattgtgcggatccacttataaagggaagaagggtcggtgtggcacctccgggggactgagcatactatgggccccgattgggggggctttcacacacttcgcgtgtgtgaacccgggaagaagggtataactcaagacaggcgcgatgtcttgcgcaatgcctacggaccacaattccctaattctcgtggactacatatcgccactctagaggtccctaagggttgcccaaataggcggccctagaagcaggttcctttgaccagaggccaaacacaagacaacaagtgggtgcgccagcataccaacctttattcgcggattagcaagaaccgcttttgattaggcgccatcaagtntctctatagccgacaggagaggaacagcagctacagaggataggcgaccctctccagacgtcatagaccacatttcgcgcaatgaggggccatgttcgacttgaaacacccacggggaattacacaacgcgacaacaccagatgaactcgaaagcaaaaggtgtttgaacaccattcccgactgatgattaccccgtgttacaatcatgggtccagggaagaaataattcgcacagacgagatatcggggagctgcggtcactcaagaccgatgtcgacacaacagacgacgaacaccgaagaaggaggcaacgattacatactggctggagaaacgcatctggnagaatgacgagacgacacataccatatgtgtgcgaacaccatattagaaggaagacaaactgctctgcatcggatcgactacaccgctcaacgtcaacagagtcacgccagcagaaggagagcgcaagcaatcacgaagagactggctgcatcatcaaccaggagacagtagcagatgccgacc

SEQ ID NO: 578139 - DNA, 1103 bp, Homo sapiens
ttctttgctccttgggtcttttcggtgtatttcgttttgttatggctgttggaaggtccggtgtcttttggcttttcctcgtttctgttttgcgtgtgcgtacttcggtggctgatcccggtttcattcgtctttggtggttttcacactgtggcgaaagcactgtctcattggtttcctgtcttcttcctttcttcctccgtaggtgtattccggttggctagtgcaatcctcctcttctatgctctctagcatacctcattgtgtcttgtgatttgtcttatcctagttttggccctattatcctcactcataggtttaactcccatgggtcatgctcaggcgttgtgatggctgtttaatgattgcttggtactgatgatgcctcctgtcaaggtctgtagcgtcctcttgtgtccgtggacgtgatgtctcagtgtcgtagtttgatcccaccaattacacgctcccctctagtcagcccctctcactccctgtcatgttttccgctggtctcactgcctactccacgctccatgctggtcactcatacccctacctaggcctaccattgatggagtcagatttttgtgggacatcaggacagaacgtgtgtgacattttccgatacagcagcatggatggatcacttggagtatcctggtagtggatccctgcgggtccgtcacatcagccccatcagtcccctgacactctaggttgttaccccttctacaaatatctgatcccgttcatcgtcccagagtgcccgcatgtctacttttgtggcaacacccccagctttggctccaaaatcattccgaggtcctgaggaccagacagtgtctgttggtgactgtccctgatcttcagtgccatcgcagatccgtcctgtccttgtgaatcctgcgcatgcctggctctgccagcccatcagcttctcgggcttcggggcagaggacgatgacctgggaggccttggggtctgggctcctgactctatatataatagtggttttgaccagagaggacccagatggaggctgttcattcctgcagacaccggcagtggtaataactgatcttgtttcttttttttcctt

SEQ ID NO: 578140 - DNA, 150 bp, Homo sapiens
ggctaagtatagtgctgggcctttctgaaggtacacctgtttggcgctagatttaccttgttcgtctaccactcgacgtacgtgctagtgacggcagggatgcggtacaactagtgcgtgcagcagaatctagtatggaaagtctgtcat

SEQ ID NO: 578141 - DNA, 189 bp, Homo sapiens
gaagcactggggcgctacagtcttaactcttaatattggatcagatgtgtctacccatgcccattttcagcggctctgtaagcctaccatgtcatccaggatgccatggtgtccccagagccaaagctaagaggaaatagtcaattgtctggattgccttcttcatttaataccctccccagtgcttca

SEQ ID NO: 578142 - DNA, 587 bp, Homo sapiens
  misc_feature (8)..(8): n is a, c, g, or t
  misc_feature (17)..(17): n is a, c, g, or t
  misc_feature (25)..(27): n is a, c, g, or t
  misc_feature (55)..(55): n is a, c, g, or t
  misc_feature (65)..(65): n is a, c, g, or t
  misc_feature (82)..(82): n is a, c, g, or t
  misc_feature (97)..(97): n is a, c, g, or t
  misc_feature (102)..(103): n is a, c, g, or t
  misc_feature (110)..(110): n is a, c, g, or t
  misc_feature (124)..(124): n is a, c, g, or t
  misc_feature (129)..(130): n is a, c, g, or t
  misc_feature (133)..(133): n is a, c, g, or t
  misc_feature (137)..(137): n is a, c, g, or t
  misc_feature (144)..(144): n is a, c, g, or t
  misc_feature (162)..(162): n is a, c, g, or t
  misc_feature (182)..(182): n is a, c, g, or t
  misc_feature (185)..(186): n is a, c, g, or t
  misc_feature (189)..(189): n is a, c, g, or t
  misc_feature (192)..(192): n is a, c, g, or t
  misc_feature (200)..(201): n is a, c, g, or t
  misc_feature (204)..(204): n is a, c, g, or t
  misc_feature (208)..(208): n is a, c, g, or t
  misc_feature (210)..(210): n is a, c, g, or t
  misc_feature (264)..(264): n is a, c, g, or t
  misc_feature (291)..(291): n is a, c, g, or t
  misc_feature (329)..(329): n is a, c, g, or t
  misc_feature (361)..(361): n is a, c, g, or t
  misc_feature (398)..(398): n is a, c, g, or t
  misc_feature (443)..(443): n is a, c, g, or t
  misc_feature (453)..(453): n is a, c, g, or t
  misc_feature (473)..(473): n is a, c, g, or t
  misc_feature (476)..(476): n is a, c, g, or t
  misc_feature (562)..(562): n is a, c, g, or t
tctcaatnaaatttttnaaagggtnnnaaaaatctgtgaaaaaattttggtcaantagtttccanaaaaaaaaactgatttnaaaaaaaaaaaaatnaaaanngccaaangcaaaaaaaaaaancaaannggnccanaaaaaantctcctttccttctgaangttttacgatgcattgttanaannaancanttttttannacnaaantnaaatggccaattgaaaaaaaaagttctgagaccgttcttccaccactgattaanagtgggggggcagggattagggataanattcatttagccttctgagctttctgggcagacttggngaccttgccagccccagcagccttcttgtccnctgctttgatgacacccaccgcaactgtctgtctcanatcacgaacagcaaagcgacccaaagggggatagtctgagaagcnctcaacacanatgggcttgccaggaaccanatnaacaatggcagcctcaccagacttcaagaatttagggccatcttccagctttttaccagaacggcgatcaatcttttccttcagcncagcaaacttgcatgcaatgtgagc

SEQ ID NO: 578143 - DNA, 103 bp, Homo sapiens
cccccccccccccctttttttaaaaaaggggggtttcccttttttttttggggggggggggggggggccccggtttcctccttttaaacgggttttgggggca

SEQ ID NO: 578144 - DNA, 137 bp, Homo sapiens
cctaggttatgggtgatgtcaggtgttgggggtgggtccaggactgcagctcaaccctcagacaccgacatctgaggatgctcaagtccctgatgggcaatgggatagcgtttgcacgtaacccacgcatcacctga

SEQ ID NO: 578145 - DNA, 152 bp, Homo sapiens
gaatctgacagtgtgatatactcgcgtatacttccgggtatcacagtcccaacgggctaagggcccttcttgttaccgcggtccattttgctataatccagctcctcatcactatccacagccatgtcatccatcgtggctgggtagcactc

SEQ ID NO: 578146 - DNA, 430 bp, Homo sapiens
tgattttacgagctcatgaccttgggggagcgaatcctgccagtctctctggatctctttcttctgtaaggttctgtgccacttatctatgatttcaaaagacgaaccatattacaaacaacaaaacgtgaatggtggtgatcatactgagtatttattgaatagtgactgagaaaatgaatgcacaggagacaggaggagttacctgtgaaaattcagagctatactgaactgatcaacgttcacggaattggagaaataacaaagtgtggagattaatgggggctgagggaacaggctgtgcactggtaggacatattcaggatctcaagctacctgcctgccacttctgcatccccaccgcgtcaaactgtggttgagctttctttattaaatatgtagcagtttgcttttgaaatacaatatcttc

SEQ ID NO: 578147 - DNA, 577 bp, Homo sapiens
caagcacgtggcatgctctcagcatcactgcaatctccaccttcacggttcaagcgattctcctgcttcagcctcccaagtagctgggattaaggtgtacaccataacacctggctaatttttttttttttttggaaatggattctcgctctgtcacccaggctggagtgcagtagagcgatgccgtgcattcagcaaccactatctcgtgccagcatcagccatggtgagcattgtggctctggtgtccaatgcccaacgtgcactggtgtcctcactgactgacttctgctcctgcctgccaccaaagctttgactttaagcctgcttctcccatcgtgctcagcacgagccggagctcctgaatagccttctgctaaatttcttccttccaaagttatgggagtgggatcctgtggctcacaaataagatttctgacagataacagtttgaggggattagagacactccaatctagctctcaggaggaagcgtataccttcttttccctgggattggtcttataacattgagctgttcacgaggctgtgccccgggaagtccagggtaccgagc

SEQ ID NO: 578148 - DNA, 296 bp, Homo sapiens
ttgtgttttacttagtccaactgctttaaagatcagcatatggaaatcggaaggtggaaagctcttgctcattgcttctacagctagttcatagcagatctagtatcttagccttgtgatatttttcaatagaacaagctgagaatagtgggaacctgagattttgaaattcaaggttttttaatttgatgttttcttaattgttattgaaatattctcacctttaattagattagtatgtataatatcttaaaataaccacatagtgaacacagaacatggaaaataaagcatct

SEQ ID NO: 578149 - DNA, 111 bp, Homo sapiens
aacccaggatcttgcagaagctctttatgtcaaacttctcaagttgattgacctccaggtaatagttttcaaggttttcattgacagttggtatgtttttaagcttgttat

SEQ ID NO: 578150 - DNA, 199 bp, Homo sapiens
  misc_feature (2)..(2): n is a, c, g, or t
anttaaataggaggtcaacattattagagttgatctacattcacaaatgaactaaagattcaatgcattttttcatcagaattctagcaatacttttcatggtacctgacaagctaattgttaagccactgaagtgcaagatgtgactgggcatggtggttcatacctgtaatcccaccattttgggaggctgaggtgg

SEQ ID NO: 578151 - DNA, 117 bp, Homo sapiens
tagtcagctcgggacctctcgctcaccgaacacaggcatgctcataaggaaggttaaaaaagtaaaggaactcggcaaatcttaccccgcctattttacaccaacccctgttgcggt

SEQ ID NO: 578152 - DNA, 117 bp, Homo sapiens
accgtgggacctttattgggacacaagcggttagcacgggtaggagaaaagggaaccttgacatgctgttggtgggaatgtaaattgttgcagcctgttatggcaaaacgagtacga

SEQ ID NO: 578153 - DNA, 1057 bp, Homo sapiens
  misc_feature (550)..(550): n is a, c, g, or t
  misc_feature (1057)..(1057): n is a, c, g, or t
cccacgcgtctggtcacgtgggagtggagtgctcgtgcgctcagtgaagcatggcactctgtgcgggcataccatgcgtggccctggcctgctcaccctgtgtgaaatgtacatgtgtcctgacagctgcagtctggtggagatggcgtgggtcttgcaggaacaccatgatgagtgcctggactctgaccattggttgtcccttgtgtgcttgtgtgctttttgtcgggccctgtggtagtgagtgcttggtacaatggtttttggatctgtgttcatcccttggcaccaccaaagtggtatgcacttgaagaatgatgttagtttggactcagtggtggtgcgttatgacccctgttgattttcatacgtgcttgcatttctcaccaccttgtgtagcgtggcaactttaattggacttgtcatgcccagtgacaacttgggccaaatctacatgcgtggattatcctgatgcccttatcaccaactactatctattggcctgcttgtgcacgttaggccagactctcatacgcttgtggtccccgcnctataccatataccactgtgtttgtgcctgtattgtccaattgtgttaggtgttatcttggaacttcctacctgtcctggaaggcacatcggctctaagcctagctcactccatcgtttccaccttgcagtgatgcagcttgaccctggaacggtcagactaactcctcaagtgtgcataccagtttccaagtggttgggttgccggtcagagcttatgaggactaagcacctgcaatgcccctcttcactctacaatgtcacttgactgcttagagcccttgatactagtctaatccaccaatactatggcctccaataaatctggtgaacttcatgacgttattcacttacacccaatttccaggcaatgcactcatccgagcctttctaagacatttggcaacaacctgccaagacttgtagatccagcttagagacgggaaccataatgtgcagccatctctatacagtaccggagaatacacaggcccaataacacaaggcn

SEQ ID NO: 578154 - DNA, 503 bp, Homo sapiens
aaggacaacaccaatcaggcaacaataggcatagactaccaatacaaaaactatgtacttcggaggatcgaacagaacgatggcaataatagggacacagcaggtcaagagcggtacaggagctagatccctagctacatatcgtgactccactgtggcagttgttgtacatagatatcacaaatgtaaactcatcccagcaaactacaaagtggattgctgatgtcagaccagaaagaggacgtgatgtaatcatcatgctagtaggacatacaccagatcttgctgacaagaggcaagtgtcaattgaggagggagagaggaaagccaaagagctgaatgtaatgttaatggaaactagtgcaaaagctggatacaatgtaaagccagataggagtctccctactgtagcccaggctgaagtgcagagacaccacctcgggtacactgcaacctatgctcccgggtatcaagcagttctcctgcctcaagtctcccacata

SEQ ID NO: 578155 - DNA, 355 bp, Homo sapiens
tggcccgaggtaaaaaaaatgatgtccccccgtatgttgtaaaaaagccctttaataaaaaaggtaagaaacctagggcccaagcccccaagatttagggttttgtttctccccgggtcctgcagcccaaaagggggggtattggttttaaaaagcaggggtccaagaaaaataaagaaaagggtgcagaatatggtaaacttttggcccaaaaaaagaaggagggtaaggagaagcgccaggaacaaatttggaaaaaacgcagactttcctttttgggaggttttacttttaagtttgaatcccgtcagaaataaaattttttgagtaacaaataaataagatccggctttga

SEQ ID NO: 578156 - DNA, 1260 bp, Homo sapiens
  misc_feature (89)..(89): n is a, c, g, or t
  misc_feature (1051)..(1051): n is a, c, g, or t
gcagacatgtcaggagcctgatggtgtctggcgttcctgacacacgcccaggttggatggctccgagcaacatacaggggataacgatngggcatcacaaagaagggaccatcctgtggtccatgcttggcccatacctagctgtccattatccatgctcccaagtaaccgtctcgtgagcctttgatttgaattcactcacaggactcgacttggtctccatcctgattccccagccatgattcccgctatctacacgtcaatactccagctcactgcatgcgcaaggacggcctctccctagacttgggtagatactcggtgtagtacgtgaatcccaccttgagtgcaaggacggtaaggcctaccgcgaatgaggacccgtggagagaagtcgcctgctaggcatgataaccacctacatttgaggcggctggctctacatcccacgagacgtttgacgcgggcgtgaacctcgagtacgatgcgtcgatgtccggtctgttcgtggccattctcttgctgtaggcacccgggaccactatctggtgcgcaatgggctggattatcatgatgctggccatgcactttagacctgccttgtgcccaaagacaccatccttgggacgcgttctgctgccgaggctagtggctctctatgtgctgacttacctgcagttcatgacggtgttgggactcaagacgcgacggggcgctagagagtcacaggtcggcactctatgattcacggagtttcatcaaaggccctccatcagtccccaaccaggattctccaattctattgcccagtgaggggtcatacagacatggagaaccctaacgtcccgtacccatgacatgaccagggcccctaagaacttggtacgagagcaataagacgcgcatatccttcctccaagggacctaacgtaattgtggaggctcctgcgattttgggcagctgtccgcccgccaggaaagggcgcagatggccccataggtttaattccgtgggtacccatggttgggattgggggttgaatgtacacanagcctatgtttcttttggggccccgtgaacaacaagtctaataccacaggagaaacctcgcgggagtgtaacaagttatagaggagggtccgggagaagaaggcgtgttatattaccagtgcggccattgggtctactagagctgctgctcggcaacgccgactgttgtgtttgcacacacgggggtaggaacttggcagagtcgaccc

SEQ ID NO: 578157 - DNA, 183 bp, Homo sapiens
ggagcacaatggatacagatgatactgacaaggcaagacagagagcgcatgccataaagacaaaagggagtctgcagccatatagtccagcctttagaaaacgaggtcttccgaagagaacagagctacaccttccccgtcagaatccactgttactaccacttagattaaaatgccccaaat

SEQ ID NO: 578158 - DNA, 118 bp, Homo sapiens
acaggcaagatgggtcagataggaccctggggtaacacggagtggtacgagggctggggtccccctacagtaagtagtaaacctagagtatccgactcacacgtcatgatattcctat

SEQ ID NO: 578159 - DNA, 157 bp, Homo sapiens
gctgccctccctcccctgcttacacctcaagccctagacgcagtgcaccttgaacagagggaggggagcgacccatggctctccctcctagcccgggagaccaggggccttcctcttcctctgcttttatttcataaaaactaaacacagaaaccgc

SEQ ID NO: 578160 - DNA, 101 bp, Homo sapiens
  misc_feature (26)..(27): n is a, c, g, or t
  misc_feature (29)..(29): n is a, c, g, or t
  misc_feature (38)..(38): n is a, c, g, or t
  misc_feature (62)..(63): n is a, c, g, or t
  misc_feature (75)..(76): n is a, c, g, or t
  misc_feature (80)..(80): n is a, c, g, or t
atgtgctagagggcaaagagttgganntntatcttagnaaaatcaaggcccgcaaaggcaannaaatccttgttnngtcntcacccatgtaataaaggtgt

SEQ ID NO: 578161 - DNA, 169 bp, Homo sapiens
gaagatgagactctcgtgtgggaggccttggtgaacaggagatcttatgcctccacctactttgatccttccagcccgcatagccgtaccttccacctctcgatgccccgcagttgctgcacttttgtggaccagtatcgagagcagctgatagcccgagtacatcggt

SEQ ID NO: 578162 - DNA, 417 bp, Homo sapiens
  misc_feature (409)..(409): n is a, c, g, or t
gtctttctgtgcccgagcaaagagactggcagctttttgcccctgccttagagagatctgtggaactttgaacttgaaagagatgacttggcatacctggtagaagaaatttctaagcagcaaagcattcaagaggaagcagagcataaaagtttggaaaatttgcagcctgatgatgtgataaaaaagaaaaaccaattttctagggagatatttaagccagctgcagaaatttccataagcaaggaggagcctgatattaatcactaagacaatagggaaaatgtctccaaggtctgtcagagactttaatgacagcttctcccatcataggcgcagagcctaggagggaaaaatggtttcctgggccaagtctgtctgcagccaaccatgctaaaagggccaaggnagagctca

SEQ ID NO: 578163 - DNA, 414 bp, Homo sapiens
cacaccactgagtcaggaagcagaaagtatatgcgtccaggtgtgtaggaagaaaatagattttggaagttatgagaaatgtaagagagtgagttgaacatagtttgtgattttgagggcctctaatagtattaaagcagtggcagccgctacacgcagacatgagggctaggctaaaacagtaaggtcaagttgtttgcacagaaaggctacagggtgcggtcctggctcttgtgtaagaattctgaccgcactaaccatgcctaggaagggaaggagttgttgttttgtaagggatcgaggtttgggagattaatcggacacgaacagcagggagagcacatgtgtttttacgagaattatgccgagatagcgtacagatgaggatgaaatttgggcttgactgaagtaatg

SEQ ID NO: 578164 - DNA, 579 bp, Homo sapiens
tagatacagagaaggaactgtcaaaagaaaaaatacaggaagctttgatatcagcaatctcaagaacagaaggaaatatcgtgcaacagctggtgggggacggaccgccaagggcaaacgacacacgtcaagaggcatctacgtatccgcctgcaaagtctctgaaaaacgaacgcagtgaaaggatgcaacgtcttctaaacaacgtcgtacgcaaacgaagcatcacgaacacacatcttagaaacacgcgcactgctgacagacaacgggacatttccatcggccacgaccagcacaccagtgccacaaccgcactccacaggaacaaacaacagcttactccttccagggcgcacaattccagacaaaccagccctaattacagaggaaacaacacggcaaaacacaattacacggttccagggcaaacacagcgtgtgtacaacgcgccccagccaacacctaaacttaagcaaacgcaggcccagcaacagcggacaggctgcacagcaagggcctgttgggaaacagcaagggcccagcttggacaacaagcacaccacacggagcactgga

SEQ ID NO: 578165 - DNA, 381 bp, Homo sapiens
acgcgtccggcggtgcagacgccgcagctctacaccaccttcctgccgcctccggagggcgtgcccccgccggagctggcctgcctgcccacccccgagtccacgccggagctgccggtcaagcacctccgcgccgccggggacccctgggagtggaaccagaacaggaacaacgccaaggagggtccgggccgctcacggggcgggcacgcggcgggcgggcccgcgccccgcgtgctggtgaggccaccgccgcccggctgtcccgggcaggccgtggaagtcaccaccctggaggaactgctgcgctacctgcacggcccgcagccgcccagaaagggggccgagccccccgcccctttaacctcgcgggcgctcccg

SEQ ID NO: 578166 - DNA, 258 bp, Homo sapiens
ttaaatcgtccaacaaatacttgcgatcatttaggagcatcccattcattttttcaatagctctttcagcggcttccggcgtctcaaagtgtacaaatccatagccctggagaaccattttcatcacaaaccaccttacatgaagggatgttaccaaaagcagaaaaggtatcacacagggctttataatcaagggattggtccagattttaaaggaatatgtggcctactccactttggcgaagggagggatcacgc

SEQ ID NO: 578167 - DNA, 189 bp, Homo sapiens
caggggggcggggcccaggaggtcatctctctctccttacccgggagcctgggaattgggttccaaaggtcctgcattccggttcattaatatgtggctcagtacagggctggtcccggcagcaggatcctgccaatcaccaaccacgtccacccacagggacacaaacaagctcacccaaacaaagcc

SEQ ID NO: 578168 - DNA, 187 bp, Homo sapiens
tgtgcggtaactgtgcacgtctttctatgaggttcagctaggcatgcttgcccaaaggaagcaggaactggatgggcatagagctgaagggaaggtatgatgcagcgctgacagacctcacattacgcggctcttcagcgctgcctggctttccttttcttgaggatttgaactttatacttaagac

SEQ ID NO: 578169 - DNA, 373 bp, Homo sapiens
  misc_feature (362)..(362): n is a, c, g, or t
tccctacacaatcataacatcgcctaaatcattatttcaccagcattttcatgcttgatacctgacataaccggcacttgcccccactaactcactcccaaattcaggaccacaactctcacaaggagaagagtaattccttgaatcatagcccttccaaactcctcctccacaactgccacaggattttagctaaaattccattgtgaccataacacttccctagttcgcaccctccaagaagtttgggcaacttaaaaagtcttctattatttgtgatctttcctctaccattccaaaactgacacttttaaattttatcttataagtctttaattactcaactttttttatgatctagnatctacttgtg

SEQ ID NO: 578170 - DNA, 1064 bp, Homo sapiens
  misc_feature (967)..(970): n is a, c, g, or t
  misc_feature (983)..(983): n is a, c, g, or t
  misc_feature (989)..(989): n is a, c, g, or t
  misc_feature (991)..(991): n is a, c, g, or t
  misc_feature (994)..(994): n is a, c, g, or t
ccagaaccagaggagggtggggcacagaccatagacggacccctcgtcctcccccagcggtggtagggggacccggggggctcctccccgctctgcagcctggggacactgggctgggaccagaatccagctttcttttaaaactctcagtgtaactgtatcccgtgacatttcattttttttaaatagtgtattttttttccatttttttttttaagagaaacaaaagactcgccagtcaatgactttcaaagagaactaactttggcttattcatattctgttcaaagacagtctattttttcactgtagaaagcgtccttgtgtgatagttacgttcgcaaacgcgcacgccaggcccatggctggtaccttggctttttttttttttttttttttttttaatttttcctaccatcagaaagtgtgctttgctcacagaagaatgggatgtccttttttctttcttggctttttttttccccctttttgtttcatttttataaattaaattttcagacatatcaaatacagttctgagggtaaggtcatgggggagctcggacccagtggcgttgggtgcggttgagggggacgctgctgtaagaggagagagatgacagtggtcctcctctgagagcctgagctgtctccccgtctcccgcccccaaggagacagagaggatcctacttcttcggggacagtggctgtatggctgtgctgccccacatcagggaccctttccccctgggactatggggcagtttgggagcaaaaccagaaggacaggcccccctctacccgcctaccctgagcaagcgagttgttcctctttgtacaagggcaggtctgcggttactttcaacactgtttattccagcggaagcagccgggtggttttcccacccccgtgtatgtagatatatcgactttgtattaaaggaagatcgtctgaaaaggactccnnnnccaaggggaaaancccctngnggngggccgcacccaatgggccattaaggggaggaattctatggcctggccgcgtttaaaactaaatttggaa

SEQ ID NO: 578171 - DNA, 1392 bp, Homo sapiens
ccagaaccagaggagggtggggcacagaccatagacggacccctcgtcctcccccagcggtggtagggggacccggggggctcctccccgctctgcagcctggggacactgggctgggaccagaatccagctttcttttaaaactctcagtgtaactgtatcccgtgacatttcattttttttaaatagtgtattttttttccatttttttttttaagagaaacaaaagactcgccagtcaatgactttcaaagagaactaactttggcttattcatattctgttcaaagacagtctattttttcactgtagaaagcgtccttgtgtgatagttacgttcgcaaacgcgcacgccaggcccatggctggtaccttggctttttttttttttttttttttttttaatttttcctaccatcagaaagtgtgctttgctcacagaagaatgggatgtccttttttctttcttggctttttttttccccctttttgtttcatttttataaattaaattttcagacatatcaaatacagttctgagggtaaggtcatgggggagctcggacccagtggcgttgggtgcggttgagggggacgctgctgtaagaggagagagatgacagtggtcctcctctgagagcctgagctgtctccccgtctcccgcccccaaggagacagagaggatcctacttcttcggggacagtggctgtatggctgtgctgccccacatcagggaccctttccccctgggactatggggcagtttgggagcaaaaccagaaggacaggcccccctctacccgcctaccctgagcaagcgagttgttcctctttgtacaagggcaggtctgcggttactttcaacactgtttattccagcggaagcagccgggtggttttcccacccccgtgtatgtagatatatcgactttgtattaaaggaagatcgacaaaaaaaaaaaaaaaaaaaaaaaaaaaaaaaacctttctactcttactgcttaacacacgcaacaaccaaaaacaaacaacagaacaaaacaaaaagaacccgagccagatactccaaccctctccggtcgctggctgccgactcgcgcaccgcgcacgaccactacctcaccgccggggccggccccgcgccaaagcacacaagcgcggcggcggcacagaacagcacagccagcacgcagcaccaccacccaccacgcccgacgaccagcacagcacgccgcgcgccagagacgacgcgccaccgcgacacagcggcgcagccgcaccggcaagagccggggcgcacacgacgctcaccgagcagcccgcaggaccgacgcggggacacacggcgcgggagaggtgagcggaacaaggccgcgcccacaccagcacg

SEQ ID NO: 578172 - DNA, 270 bp, Homo sapiens
aagaaaaagccccagcgggtgcgagggggtttctctaagagctctgggcaccggggagaaagactcaacccggtccgctggctctgattcccagccagctatgttgagattcacgtatgtcactcaagaaccctaaatttacgagcccaactttatctctttaagaggatctttgaggcttttaagctcactgatgatgtgagaggagaagagaggcgccagaaaactgacaactggggactttgcagccccagaggagggtttaagggg

SEQ ID NO: 578173 - DNA, 164 bp, Homo sapiens
tccctcatagtacaccctctgaggtgattattatatatgcccacttaccaagaattttagaaaaccctacagtgcagagaaattggtaactatgcctaacagctacacagacaggatgggttagaaatagggaattttgaccccacgacctgtctatgctacaa

SEQ ID NO: 578174 - DNA, 673 bp, Homo sapiens
  misc_feature (576)..(579): n is a, c, g, or t
  misc_feature (592)..(592): n is a, c, g, or t
  misc_feature (598)..(598): n is a, c, g, or t
  misc_feature (600)..(600): n is a, c, g, or t
  misc_feature (603)..(603): n is a, c, g, or t
gatccacgacaactcgttgactttcgccagaaagtgtgctttgctcacagaagaatgggatgtccttttttctttcttggctttttttttccccctttttgtttcatttttataaattaaattttcagacatatcaaatacagttctgagggtaaggtcatgggggagctcggacccagtggcgttgggtgcggttgagggggacgctgctgtaagaggagagagatgacagtggtcctcctctgagagcctgagctgtctccccgtctcccgcccccaaggagacagagaggatcctacttcttcggggacagtggctgtatggctgtgctgccccacatcagggaccctttccccctgggactatggggcagtttgggagcaaaaccagaaggacaggcccccctctacccgcctaccctgagcaagcgagttgttcctctttgtacaagggcaggtctgcggttactttcaacactgtttattccagcggaagcagccgggtggttttcccacccccgtgtatgtagatatatcgactttgtattaaaggaagatcgtctgaaaaggactccnnnnccaaggggaaaancccctngnggngggccgcacccaatgggccattaaggggaggaattctatggcctggccgcgtttaaaactaaatttggaa

SEQ ID NO: 578175 - DNA, 971 bp, Homo sapiens
  misc_feature (874)..(877): n is a, c, g, or t
  misc_feature (890)..(890): n is a, c, g, or t
  misc_feature (896)..(896): n is a, c, g, or t
  misc_feature (898)..(898): n is a, c, g, or t
  misc_feature (901)..(901): n is a, c, g, or t
gttcgacggagactctcttaaaactcaaagaattctaaaagtaacatttctattacacatagttggtctttgcatgtgttaatgtactgagtgctcactaggtgccacgcactgccaaatactttgcatccagaatgtaggagttgctcttttaatataatgaatggtaaaatctagttaaaaaaaggaaggagaggagaattaacataccatccatccattccacttctatgtatatgcccccaataattgaaagcagggattcaagcatatacttgcacatccatgttcacagcagcattactcaccatagaccaaacaaggccagaaagtgtgctttgctcacagaagaatgggatgtccttttttctttcttggctttttttttccccctttttgtttcatttttataaattaaattttcagacatatcaaatacagttctgagggtaaggtcatgggggagctcggacccagtggcgttgggtgcggttgagggggacgctgctgtaagaggagagagatgacagtggtcctcctctgagagcctgagctgtctccccgtctcccgcccccaaggagacagagaggatcctacttcttcggggacagtggctgtatggctgtgctgccccacatcagggaccctttccccctgggactatggggcagtttgggagcaaaaccagaaggacaggcccccctctacccgcctaccctgagcaagcgagttgttcctctttgtacaagggcaggtctgcggttactttcaacactgtttattccagcggaagcagccgggtggttttcccacccccgtgtatgtagatatatcgactttgtattaaaggaagatcgtctgaaaaggactccnnnnccaaggggaaaancccctngnggngggccgcacccaatgggccattaaggggaggaattctatggcctggccgcgtttaaaactaaatttggaa

SEQ ID NO: 578176 - DNA, 151 bp, Homo sapiens
agagaatctggtaaaagctccattgatgaagcacatgaggatcctgcatgttaatgggtttaatggagacagtgagaaggcaaccaaagtgcaggacatcaaatacaacctgatagaggcgattgataccattgtggccgccatgagcacc

SEQ ID NO: 578177 - DNA, 535 bp, Homo sapiens
  misc_feature (363)..(363): n is a, c, g, or t
cgggctttgtgctgttgttgtgtttgtgttggtcggggcggtctacaaggtttttccccgccggtttccccccgtgtgtcctgtggggtaaccccgttgtgttccgccccttatcgccgtggtgaaacggccgcgcccgttagatctctggttaattccgacctcctctattatgggggctatacctctgcccccaggcccgcgagcggtccgctgcgccgccgaggtccctgttgcgcaagggatctgcgcccccattaagtttgtgttatgccctaccctctaattccgaagtttttccccgttgggccgcgttccgcgagcactaatttcccccggcgaattcggcccccactttcgcgncgcgggccccccataatatttctccctttccaactcccaccatcaccctttggcgtttgcaaacaccccccccttaaatctcggcccttttttataaaactggtttgacctatatttctctttataattctctcccatctttatttatatgaagggttctcccccaaaaaaa

SEQ ID NO: 578178 - DNA, 196 bp, Homo sapiens
ctggtccggcttgtggtttatggacatgcagcgcagtcggtctacattacgctattcccctatcatagaagagcttacctcccctttcactgatcacggcctcataatcatttggctatatctgctttctagtcctgtatgcccttttcctaccactcaccaccaacctaactcatactaacatcatcagacgcac

SEQ ID NO: 578179 - DNA, 575 bp, Homo sapiens
  misc_feature (478)..(481): n is a, c, g, or t
  misc_feature (494)..(494): n is a, c, g, or t
  misc_feature (500)..(500): n is a, c, g, or t
  misc_feature (502)..(502): n is a, c, g, or t
  misc_feature (505)..(505): n is a, c, g, or t
gcggcgcctactactactactactactgctcgaattcaagcttctaacgatgtacggggacatgggggagctcggacccagtggcgttgggtgcggttgagggggacgctgctgtaagaggagagagatgacagtggtcctcctctgagagcctgagctgtctccccgtctcccgcccccaaggagacagagaggatcctacttcttcggggacagtggctgtatggctgtgctgccccacatcagggaccctttccccctgggactatggggcagtttgggagcaaaaccagaaggacaggcccccctctacccgcctaccctgagcaagcgagttgttcctctttgtacaagggcaggtctgcggttactttcaacactgtttattccagcggaagcagccgggtggttttcccacccccgtgtatgtagatatatcgactttgtattaaaggaagatcgtctgaaaaggactccnnnnccaaggggaaaancccctngnggngggccgcacccaatgggccattaaggggaggaattctatggcctggccgcgtttaaaactaaatttggaa

SEQ ID NO: 578180 - DNA, 747 bp, Homo sapiens
  misc_feature (24)..(24): n is a, c, g, or t
  misc_feature (161)..(161): n is a, c, g, or t
  misc_feature (650)..(653): n is a, c, g, or t
  misc_feature (666)..(666): n is a, c, g, or t
  misc_feature (672)..(672): n is a, c, g, or t
  misc_feature (674)..(674): n is a, c, g, or t
  misc_feature (677)..(677): n is a, c, g, or t
ttttgaaaaaatgttggaaaaatnttttggccgtagggaccatctccactgttcattacaaaaaaccgtacaccttggagagaaattgtggcaaaaatataaagcaacatttcatcaatgtgatgtttgtaagaaaatttttaaaggcaaatcaagtctgnaaatgcattttcgaacgcattcaggtgaaaaaccatacaagtgtcaaatttgcaatcagtcttttagaattaagaaaacattaacaaaacagtggcgttgggtgcggttgagggggacgctgctgtaagaggagagagatgacagtggtcctcctctgagagcctgagctgtctccccgtctcccgcccccaaggagacagagaggatcctacttcttcggggacagtggctgtatggctgtgctgccccacatcagggaccctttccccctgggactatggggcagtttgggagcaaaaccagaaggacaggcccccctctacccgcctaccctgagcaagcgagttgttcctctttgtacaagggcaggtctgcggttactttcaacactgtttattccagcggaagcagccgggtggttttcccacccccgtgtatgtagatatatcgactttgtattaaaggaagatcgtctgaaaaggactccnnnnccaaggggaaaancccctngnggngggccgcacccaatgggccattaaggggaggaattctatggcctggccgcgtttaaaactaaatttggaa

SEQ ID NO: 578181 - DNA, 722 bp, Homo sapiens
  misc_feature (32)..(33): n is a, c, g, or t
  misc_feature (46)..(46): n is a, c, g, or t
  misc_feature (57)..(57): n is a, c, g, or t
  misc_feature (104)..(104): n is a, c, g, or t
  misc_feature (152)..(153): n is a, c, g, or t
  misc_feature (177)..(177): n is a, c, g, or t
  misc_feature (286)..(286): n is a, c, g, or t
  misc_feature (322)..(322): n is a, c, g, or t
ggatcagccttctgatttcgttcatttcactnnatactccttcagntacggcccagnggcgtcccacggggatcccggactgcagccggataagaacgcacganggcaacagcccaaaaggaactttttagacagaaacagcgaaccacgcnnagcaaaacaggacaaaacaaaaancagggaggaaagaaaggaaccgaaacaacaagccagccaccagcaccacatacaggcaggagcaggaaaagcggcggcagcggcagagagggcgcaggaagcccagcangcagaggagaaaacacacacacccacaagaagggcnccaacacgacaacagaaaacaaccaggcagggaaccagggagcacaagaaaaaagcaagcccagccagacaacagaacaggcaaaaggcacccacacccaaaaaaacaacgacacaaaagggggaacggaacaagcaaaggggaaaacaaagaagaaaaacaaaaaacggaccaaaccaaaaacaccgggaaaaagaaaaacaaaaaacaaaaacaaacaaaaaacaacaacgaaagcacaaaaaaaaaaaaccagaggagccaaaaaaagagaaacaaacacaaaagaaaaagacaacagagaaaacagaaaacaaccacaagacacgaaaaaacgagaaacgaacaaaagaaaacaaagaacacagacaaaacaaacaaaaaaaaacaaggaaaaccc

SEQ ID NO: 578182 - DNA, 198 bp, Homo sapiens
acctgttataattttgatctctaattttcgctaagtttgcttaatatgttcttgtttctaaaaaaaggtttttttttaaattatctgggcagggtggaaatcctgtagtctgtatgcctagctactcgggaggctgaggtgggaggattgcttgggccaaggagttggaggctgcagtgagctatgatcccactgtac

SEQ ID NO: 578183 - DNA, 770 bp, Homo sapiens
gcctaacgccgggatgtgtttgtgttgatgtctcatcgacaagttttccgtatgtctgacatggttccctcgcatacctgattgagtgtagtcttgcgggcatcagtgtagccatggttgcatatgatgactttccactactgggtgacccatcctcctgggatacacacatcacagtgttactcggtgggatatcatagtgctgggcaatgtagtcacagtcgttgcgggaaacgtcaagagtccttatttcgcggtgtgctgtatagtagtggtcgccgttaagccactgatcaactccttggatacagattagctggccatggttgttgccgtaatgtttgtgccactaccgatttgtagactcgctgtacgcaagagggatcctgagactcgcttcaaaaagactttagtcgtgaagcggaatgtacaatcctcgtttattagatctcgcgaaacatcgtatcgaagtctaagaatttcgcacagtattgctcgtatcctactaatatgcgacctttgtacactattggtaacccagtcttgtgtacatgtgggtcaaagcatagatggaatagtggtaaagaacactcttactttagagtctttggaactaacatccaacgctttcaagtaactggtccatggaccaaagttatttacccgttgcttgataagattgtatatttcctgattgcagtccctgacttaccctccattttgccagtggagagatgtctccttccttggctggattaatccgaggtgga

SEQ ID NO: 578184 - DNA, 262 bp, Homo sapiens
tagtagtacatctaaaggcttatttatcctctttccccaccggcgggccacctcatcggggtcggcgagcttaaactcccataccgtctccagtccagctgatgaatgactggcaggattttgtctgatagcagctccagtgagaaactgccacagctgaaataggtccaacttcctgtgaacccggccagacacagctgcaggtatacactggtttgcctttctccactgggtcactcctctcttggactgtaatccattg

SEQ ID NO: 578185 - DNA, 311 bp, Homo sapiens
  misc_feature (138)..(138): n is a, c, g, or t
  misc_feature (264)..(264): n is a, c, g, or t
gaatttccattttgccaagaattataaaaccctgaggttttaaaattcagtttcttttctggggatttaacatggaaggacttggagggcaaatggcccagtgattggaaaggggaaaaacaattcatttcatttaanattattcaataaccattgccagcatttgggattctgagtgctgtttatgaagccctttcattgatataatttcatctatctctcacaaggctgtaagcaattcctatgtccatatggcagtgaggnaatggagatttgagcaggttaagggagttttcacctggaagctcttc

SEQ ID NO: 578186 - DNA, 896 bp, Homo sapiens
ggtgctcgctcgcgccaggcgaggtctcagcgtctccctcgagaactcggtgagaatgaattggcgccgtgcgacaccaggcggatccgttctggagaatgaacccatctccagccgcagccgcagccgccggccgggccgaggagcagccggagcagccgcaccagtgggaccgaagtgagcggagccagagtttgaggcagcgcctagactggtgaatcaggggccctcacgcatgagttcctcgcctgttaatgtgaaaaagctgaaggtgtcggagctgaaagtaggagctcaagaagcgacgcctttctgtacaaggtgtctcaaggccgagctcatggagcgactccaggctgcgctggacgacgaggaggccgggggccgccccgtccatggagccccgggaacggcagcctagagctgggcggggattccgctgtgcgctcgggaagcaggcctcgaagcagtgaggccgccggccgagcggtcgactgactggaggaggacggacaggaggacgagcagccgggctgggatcgccgcttagcagcgcctgctgatagatcgtcgaagcctttaacggggtggggagggccgtggcacgaatcgtgagcctcgaatgccaggacagtgccaaggacgacctcggaccggccggaactcgggggggggatccgagtgggtgactgaagaccaaggacacccacggcgaggggcatttaaggccaggacagagccgacacgccccggggagacgcaggccaaccggagtgtcagcggtgagaaaagaccaacaacggggggacacacgaggggtggaacaagcggacagcaggtcccggggcggccacccggggaaacgcaacaccggcacaagcggaaaccggagacgc

SEQ ID NO: 578187 - DNA, 503 bp, Homo sapiens
ataccttgagaagaaaataaaatagaagggaaatcattttcaatgaacacaaaacagttatttattgaaattccaattttgttgtttccataataagcattttcttgggcccacagccacgtgtattggtttgcgttctgtgcgtggttgtgttcacccaacagccatgttgagaaactgcaccagagaccgtatggcccacagtgtccgaaatacttacttttttttagagatagggtctcttgctctgttgcccagattgaagtgtggtggtgtgatcacagcacaccacagtctccaactcccgggcccaagcgatcctccttcctcagcctcctgattagctgagaccacaggagtatgccaccatgcccaagcccactctggtatatgacagagaaaacttgccactgccttctctatactgtacagttatcctaatatggtctttcagtatccaccacagagggttggggaaaaaaaaaataccctcaccaggacga

SEQ ID NO: 578188 - DNA, 367 bp, Homo sapiens
tcgtggttgcgagcggccggggctggggcttggccagtggccgctgcagtgactgagaccctgtgggatgtggctgtctgtgccctcgcagtggatgggccgtccagtgtcatctgcggggagactgaaaagttaccagacggccagcattgccactgccagtagcatcctgcccaaggccatgggaatcattgttgtgactgccccaagggttgcgaggactgggaggtggccccctgttggccctttgtcagggcctgttgcatggttcccgcgggtcccacaatgttacctggaactattaacccccaagggccttctggcgaaggcccgcttttccgtttcccggggacgacggttgggcagg

SEQ ID NO: 578189 - DNA, 3407 bp, Homo sapiens
ttgcccaatatgggtcaggagaccctcatccatctttggcatgcacgtactggcatcatgtccaagactgctgtgtaaggggaggagataaatgaggagacacaacaactattaactcccatattctgggaagtgacgtgtatcatttctactcgttggccagaaatggtcagctggccctaaggtaatgcagaaagatttggaaaattaggggagtaaatgaaatatttggaacactttcaatccaagcagttcttaatgtttcccccactatcatgctagcccattccaccacctttgcctgaaatactgcaagtatcctaattaatcttccttatcctaatcatgctccaatatgatctattccttcttccattcttgctacctccaactttttgttttccaactatcagttcaaacggttttgttaaatatgaaacagatttgctccaaaccttcaaaagccaagttacttcccatggcctccaggcctctacacaatctgggccctgaatacttctctgacctcctttctaccacttcctgcctaggtcactttgcattagctacactggccttcaggctcttcttgagcataccaactttatttctactcaaagccttcacatttgtgtttccctctgcctagaatgctctttcctcaaattttcaaataactcatcccttcatttatgcctctgcttggctatcaccctcttagagaggctgtctttgaccactctgtataaaagagtctacttctaaccccatatcatcagctgctaatccttttccctgatttttctttcatgggacttgtctgttcccaacattttattatttatttacttgcttagttgtttattgtctgtctcccttactttaatgaaagctaaaaaaagcacaaggaccttgactttaacccttctgctgttttcccagtatcaagagcagtgcccagcacacagtaggttctctataaatatttgttcaataaataagtgaattaattagtaaattagctaaaatatgccaaaattgagatgacaggctcctggccccagttcccagctgggcactccccaggtcacaggtctggcctctccccagagctgtctggacagcctttcctgtgactccttgaggtttccttgaagcccctgagaatattttgttgagaacacctttcatattggtcctagttctagtcaattttattaatcagatcagccaacaccattcacagaagttggaaactggaacagaaccaatttatgtggcagatttttaatgaaaatataatggcaaccaagagaatctgttctagaccttcaagaccgtctctgcaaatgaagctgtgaactccatggctgagctatgtatcttggaatagggcccatgtttagacagagaggtaaggcctgaaaaagtaaaattcaatcttcactggtaatgaaatattaaattagtgtggacacagtggagagacttttactcttttgctgtcactgcttcagcaagcttggcctattaaatccaaatgaagtgtggagaccagacatactctattgttccattttattcttgcatttttctagctgcagcatgccatttggctttcccacctaaaccttcttgctcttactcttcttccctgcatgggaattgtttgtacacagattgaaatagtgcataacagccagaattttcttatattggactctctaacaataacacaaaattattattatatgttgtcccttagacaatgggttgctctgcactggcatgaagttgtggtaacatggaatgcataagcttgtggttcacactgagtgtacaagatacagtttccctgggacataaatctgctctttattgatgtatccaagctccatctcaagtaagaattgggttaagggaaaaatagacccattcattgtgtacattcacataaaaggttttaagaaatcccactctaaagaagcctattcaactttgcttaatctgatatctcataaaactatgatcactgaatccattttatttttgcctgacaaagtgatactccacctgggccacagtgcctgcctcgttgtgtctgaaaatctgtggggacattttggtcacaatgtctggaggctctattggcatttaaaaggtggggaccagggatactaaacatcatctagtatgaggaccagttcttctacatcatgaaaaattatcccacccaaaatgccagtagtatccctgttgggtacatactaattcacactaggaattctagtatacaccacttttttgttgtacagatggagaaacagtctcagatagaggaaacggtatgtgtaagtctcacaactgtgtccatggtccaagtcagtactggaactcgctctcttttttcctattctgtactcacgcttcagcactgtgttgtctctattatgcatacactagcacacttgaaaagtgaacaaaagctaagttgttcaaaagccttaaagaaaaacctccttagagcctccagagtatctacatgcttgtgggaacattgactgatgaatgaatgaaaaattgaaacaagacaggaggaaaagttcagaactagctttcacttggcaattactacatgccaggccttatgcacgtagtggctcttttactccccacaacggaccaataacagaaagattactaactccttttttcagatgaagaaattgagtcttgaagaacttgcataagattctcaaggtcacagagctcataaaaagtgatagagctgggattcaacctgattttagtgtgacttctaagcctgagcactttccttcaggcctctcaatgaccagccaaggctcttgctctcagaaatgggaaacacgatgaagaagaaaaggaagactttttttttcaacaaaatttgttgttctgttaattacatttctattgttaaaaataacagaaatcagttcaagaatgtttaagaaaaagtgagcatttttggaaggatagtggagctcatgaaatctagaagttgaacaatccagctctacaagggcatgtggcagctgcagtatgtggacacaccctccagaatagcactgttgagactgactcactcccagctcccaatcctgtctcaggtcaatgcttgagagagataataggtctgattcaacttgaatcagatattcactcctgctccaaccagttgtggctgtggagttagagtcacatagcaggaacacagttgctgataagccatttttgtggacagagtgggtatctttaagagttacctatgatcaattcttggtcacattgtgaggcagttgaagtttcttttgtgtcctttatatccccctaacaacagggaagttttatcagtaaatgcctac

SEQ ID NO: 578190 - DNA, 168 bp, Homo sapiens
agctgtctgtctcagtgatctacattctgaagttgtctgaaaatgtcttcactgattaaattcagcctaacacattttgccgggcacactgcagagacaatgctgtgagtttccaacctcagacccatctgacgggcagagaaggtctcgtttgtcctcgacttggct

SEQ ID NO: 578191 - DNA, 279 bp, Homo sapiens
accaagacctcaacccctgacccccatgcctcagtgatactcctcaatagccatcgctgtagtatatccaaaaacaaccatcattcccccttaaataaattaaaaaaactattaaaccacatataacctacccccaaaattcatgaataactaacacaccctgaccacacctgctaacaatacaatactaaaccccctataaatatgtgagagaatattgcagctgaagaaattggggatcctctcaaagtctgcaccttgcatgcatgcaatgcttgt

SEQ ID NO: 578192 - DNA, 2057 bp, Homo sapiens
cagaatgaaaagctcaacaggtataactacatagagggaaccaagatgctggccgtcgtacctgtatgaggtctcccagctgaaggactaggccaatgcccatctgtgtaggcagtcatccaagtggaagatgcactgacttctatgaagaagagaagactaggatcagcacaatacatatgtagaaatcaaaggaatagagtatacctctgtataggcgagcgagacacacgccgaacaaacgcggcaccaccacctaacgacacggcagaaaacagaaaacagacacagagcgacaaaaaggccagccaacggaacgaaagacaacgagtacaaagccaacaaccaaaacgacacgacgcaaacgcacacacaccacacaaggagaacaacaccaaaacccagagaaagacaccccgagcgccaacgagacgatcagggcacagacggacacaagtgccaggcgcccgcgcgacacaccgccgagagaggcaacacgaccagcccgcagcgaccgagcgacatgaatcaacgacaccacccggcgcagaccgcagccccgcaagccacgcccgacactcactggggaccgcagacgcagacgcacaacgagaacacacgaccacgcgaaccagaagagagagcacaccaaccagcaaccggcgaggaggtagaggggccggagcaggaaggagagagcacgacagacgacacgcggaaagcgacgagacgcacaagcaagagagacgcgcggacaagcggcagagagcgaacacagaacgaaacgaggaaagcagaggaccgacgaaagagacggacgagagcaagcaggagagcccaacagaagaacagacgagcgtagacaaacgaagagggcagcccagacgcgcgacgacggagcggaccggagacggagaacgcggcaggcaacgccagacgaagaacagacgcaccagagccgcgcacgccaccaccacacacggacagagcaccgcacaaaacaagactccaacaccgcaagcagaagaccagaagcaaagcggggacgaccaaacaggcagacaggcacgcgccgccccacacgccacgcggcaaccgggaccgactaggcacccacgcgcagacgcccccgacacaacaccacagcgccgcgaaccagccaccacgccagagaggcgcagagcgcaacagcgcacagcacacgccacagggagaagacgacaggagaacgagccaggggggaggagacgcgcacggaccagacgcggaccagcgcgaagcgccgccgcgaccaggcaaagcgcgcgagcgaccacgcacagggcgcacagcgcgggaagccgccgcagcagccagcacgagcgcgcgcgcagagcagcagcgccagggcagcaacagcgagcccgagaggcgaaccgccgccgcgaccacacgactaccactcgcaagaggaccacgacggagaccagacgcgagagcagcaaccagcaaaccgcgcgacgccacacacagacacgatgacaagccgacccgcagagcagcagccgtcgcaattgacagcgcaggaacacgacggacggccagtgcagagcagggcagcagaaccaaagaggagcagcagcaagcaggacggtcgacgcgcatcggcgcggcgatcagctgcgctgcagaagcgtcagcgtccatcgcagcgggcgtcgcgctaccgcgcaagcgcgtgcggcgacgccacagccgccaccgcgagccagagtacgcagctagcagcacgcgagatcgacgacgacgacgctcacacgacgcacgccacagcatccgacccagtcaagccagacacaagccaacacgcgcacccagcacgcagcacgcgcacgccgagcagccgctcacaccacatcacagaccacgccacgcgcacacacacagcgaccaccggcacaccagaccacgacacacaacaaacaccgacagcgcagcacgagcagcggaccagacgcagacgacccgcgccaccacccaacgcgcggccgccgcttccgctacggtgcgcacacgag

SEQ ID NO: 578193 - DNA, 189 bp, Homo sapiens
tgccaaatgcgtagtacaaaaaaaaaaaaaaaaaggaaaaaaaagaaaccctgaagatccggtgaaggtatagaaaacagaaatcacccataattcctacttgtagcaataacgcaataactacctttttttttttggggtggaaaaggggttccctctttgtggccagggtggattgcggggcgataa

SEQ ID NO: 578194 - DNA, 139 bp, Homo sapiens
atgtggtgtggtgttctagaggatcccttcttttccatgggatatttttaagctctgtattctagtactcagaagaatacttgggaaatgatgttcagtatatgtttggtgaaagaatcaatgggcacacattatggag

SEQ ID NO: 578195 - DNA, 129 bp, Homo sapiens
tggtaaacatcactgtgttactctaccatgttactgcagccgcggcactgcctgagaaccgtgcttactgtgagcggcctcggcatcagcgtgatctctaagtactgcagctgcagctgtactagcgcg

SEQ ID NO: 578196 - DNA, 118 bp, Homo sapiens
gcacgagcggagttcaggttcactgactatagcaccaaagagaatgtcctatctgtgctcagaaacctccgctatatgagtggcggaacagctactggtgatgccatttccttcactg

SEQ ID NO: 578197 - DNA, 1341 bp, Homo sapiens
  misc_feature (1340)..(1341): n is a, c, g, or t
agaacacaggtgtggtgaaaagtaacccctaaaagccaaaacatgggaaaggaatagacgacttcatatcaacattgtcgtcatcgtgacacagtgagattccgggacaagtccacacacatactggtcgcagtctgatcttataaagtgcgggaggcatcgacaaagagaaccattgataaaactgtgagaacggaggcatgctgaccatgggagacagggctccttcaagctatgccatgcgtggtcattggtagttagatactgaaagctgagcgtgaacgtgggatcatcattgcatcatctccttgagcgaagatttgagaccagcaagtactatgtgactatcatggatgccccaggacagagagactttatcaaacaacatgattaccatgggacatctcaggctggacgtagtagctagtcactgattgttgctggctgggtcgtagggtgaatttggagacgctggtatctccgagaggaattgggctgacccgagaagcatggcgcctttctggcttacatcatcgtgggtggtgaaacaagctaaatcgtcgggggtgaacaaaatggattccactgagccaccctacagccagaaagagatatgatgggaattgtcaagggaagtcagggacttatcacttaggaacaattggcgtacagaacgccgacatagataggcatttgtggcaattatctggtcggaactgggtgagcaaatggtgggagcccacaggtgcgtaaccatgcctgtgcgctgcacggtgcattggcacagtcacccgttacaggatgggcaatgctcagtgtgaaaccaagaacttgattgaaggggccttgggactgggatcctaaccacacaagcataggtccaatggacacaggcctttgagctggtcgtctctcacagggggtgcgtctagcgcacccatcgggggggcattccgcggacacggtacccccagaagggtacaccaagagagacaccggggggcgtgccacacacacggcgagctcagggggggacaccccatggatccagaagaagggtgaaacggggaacacaaaaagacgccaaaggacaccgacaggcgtagagagcaaacatccgcagggcaacagggcgaaccaggccaaacgatcgtaacgaaaaagcaggaccacaactggagaccaagacagaccacacaaggcacgaaaggacagcacgacgaccatcagcacacacagaacaaaaggcagatcggacgagtaaaaaacagacaagccgaaagtcaacaacgaccgacaagcagaaggatggcacagtacatcatcacacatcgcgacgnn

SEQ ID NO: 578198 - DNA, 417 bp, Homo sapiens
tacggtgatagctgcccagattgatacacacgagcaccctcctcttcaaaaaaaataggataatgtgattataatagtgtcttacactatcaattgctaggcatgtaatacacactcaacaaattcttaccagtaaatatagtagactatctgactaataaataaaaagtatataaacgcacacaagatagcctacaataatagaataggatacacaaaccgtacaaagtagacaaatagtaatactatcacatacaaaggaatagtagtatatataaaagaaagctattatagtagcctaaaataatatacaggacacataaacatactacaatataatattccacatagtcaaatatatacatatcacctactacatataataatactaccacctactaactataataaacacta

SEQ ID NO: 578199 - DNA, 1607 bp, Homo sapiens
gccgcttcgctctctgctcctcctgttcggacagtcagccgcatcttcttttgcgtcgccagccgagccacatcgctcagacaccatggcggcaaggtgaaggtcggagtcaacggatttggtcgtattgggcgcctggtcaccagtgtctgcttttaactctgggtacacgtgcggatattcgttgcccactcaagttgaccccttacatatgaccttcaaactaccatggttttaccattgttccaaattatgatttccaaccccatggccaaaatttcccattggcacccgttctaagggctggcacgaaccgggaatgcttttgtcattccaacatggcaacattccccattcagccaatctatcccagagaacgccgacgaatcccttcactaacaattccacaggtggggggccgattgcattggacgcctggaagtacccgttacgtggcagtctcacctggggcagttcttctcagccgaacccatgtgagcaacgggctggggcggcctccatttttgccagtgagcgtgaggcccacaaaggggttcatccattcttcctaggcccccctatccatgaattggattgcaccccccagctgctatccgtacaatagggggtgcttgaaacgcaattgcacggaacggttatgtaccaaacaggccattacaaacgactccagtcacgcacaaaattggcaatccttgtaaccaacccaaactggccatataagcaacccccctgaggccaaaatggttcatagccactggcacagtcactttctggggtaagtccgtgggcacgcggactcagctggaccgactggggtcccagtggccgactaaccatggccctaccccaagaaagaacctgttgagcatttgcccatcttccggggcacaacctgttcggcagatgtatgggacctgcggtgggcttactcccagaaacagttcattccctttccctcttattggacgacatgactcaaagtctggctggggtcacacgtgtcacatccccttgaaggcctgtcctgccgggacagtcttcacattgggactgtggtccttccccgcgatcccccatcatggcccatgagctgttcagagactgaggacccatgactctggcacgttttcacatgtacacgccagaatatgatgtacctacagctatggtggtgcatagcacagaggcttgaccgtgccccccttacagggagacttacctgcgtctacacttgtaacgcgacagtggcctactattgaacttcaacacacaacaacacaaatcaacacacataaacactactgatcacataaagccccacaaaccaaattgcaagccattctacgtgaccatactcagcacattagtctaaactacaacttattgaatccatcttactcccacaaagtctctacacaatagatacacctctatcacacaccacaaacaacccataacaaacacaaaacaatatcgaaaacctacaacatagacacacatatatctactcaccacttactactcatataagtacgaactttgtcttcactactcaaaacaatcaatcaacacacaaatcatatcta

SEQ ID NO: 578200 - DNA, 158 bp, Homo sapiens
agtctatgctttgaaccttgttgtggtggtagcagaaaaatcaacgaaggggaaatttcataggcgggggctaaaatgcaaccatacaattcatccctgtcctgatcaataattcttattatatgaaattagtaagaatattaggaaagctcaattag

SEQ ID NO: 578201 - DNA, 611 bp, Homo sapiens
acccacgctgtcgcggacgcgtgggtcgaccctacgcgtccgggagcatcccgaagggagctgctggatcgcgaggccagtacctgacccttgtcggcccgctcgcactgtgctcgcgtcgagtggagcggagagtatgatcttgatccttccacgtcttcgtcaatcaatcggtggacaagtgagctcgctgtgcgttcagccaatgttccacgtggtagccgttctcagcagacagatcatgtttcctcatgcgcaggtacatgatgctagctagtcgagcgttggtcttaccatagactcacggtacggtgtcagcattctgcctggtcagtagagtgcttgaaggactatggcacagttctgcagggacgcgcgagtggtcacagtcaacaacaattaggacgtgttcccgaacaacaaaatgtcatgcctgcgcagccatgagtccatgcggtgcagccacccgcaccggggggccctcgaacatgagggagtcaattacgggatcgtattcactgagattgattcagatgcctcactatatttatccatgtgccatcacacacgcgggtcgtgtaatttccagcgtgaatggtgccaaagccaac

SEQ ID NO: 578202 - DNA, 116 bp, Homo sapiens
  misc_feature (64)..(64): n is a, c, g, or t
  misc_feature (74)..(74): n is a, c, g, or t
aaggatggcaaaagctcctttcccgggcctggttttgcacactggatggtcctctgcagaacgntggtgcaagngtagacacggtcttctcacaggccaccttgaggttattgggg

SEQ ID NO: 578203 - DNA, 454 bp, Homo sapiens
  misc_feature (13)..(13): n is a, c, g, or t
  misc_feature (39)..(39): n is a, c, g, or t
  misc_feature (133)..(133): n is a, c, g, or t
  misc_feature (135)..(135): n is a, c, g, or t
  misc_feature (188)..(188): n is a, c, g, or t
gccaggaaggatngtaataatggcaccagttcttcctgnaacagtagtaattatgttatatgtaccactggagtgagtggtagaatcatctagttccgagcccgggattataaacgtaggtgaatggaatgantncgaatatgttgtgacatatatttaaagctttttatattactgctattctcacntgatttgtgcaacgttcagttttaaaaaaatcttcctatgccatccatgtattttattttatttattttcacaagtatttgacagtatggtagaataaaagatgattgtaagattaaaaatgtaaaaattgcttatgtattattctgaattgtgttaggttgaaaaagatgattgtggtgactattatttcttgtccactatttgttttttgttttttcaccaataatgtcttcatatttgaacctattcaataaagacatgaagc

SEQ ID NO: 578204 - DNA, 441 bp, Homo sapiens
  misc_feature (4)..(4): n is a, c, g, or t
  misc_feature (23)..(23): n is a, c, g, or t
attnccttgaaaaatttaaaaantttgcaagcacccttgtgaaatttgatgtgatacccccaaggcaccctgagcacacagtttgggaacccattgcccttggaatattaatcatagttaccctcccagagagtgaaattttggataattaaaaaaatttcttttttcttgagatggagttttggtcttgttgcccaggctagagtgcaatggcgtgatctcggctcaccgcagactccgcctcccgctttcaagctattctcccgcctcatcctcccaagtagctgggattacaggcatgcaccaccacgcccggctaattttgtatttttagtagagacggggtttctccatgttggtcaggctggtctcgaattcccgacctcaggtgatcagcccgccttggcctcccaaagtgctgggattacaggtgtgagccac

SEQ ID NO: 578205 - DNA, 211 bp, Homo sapiens
tgtgacgagacgacctgccatccactacttctgacacgactgtcttaatcttcctggttttctttatatctctctcttccaggatgcttaactgatatactgtagttttacgtattctacttgcagaaggcggcggtcagtagcaatttcctgttcaagtcgagtctttatgtcacgaaggatatggtattcgatgttctggcgtaccaag

SEQ ID NO: 578206 - DNA, 279 bp, Homo sapiens
  misc_feature (162)..(162): n is a, c, g, or t
  misc_feature (210)..(210): n is a, c, g, or t
  misc_feature (217)..(217): n is a, c, g, or t
  misc_feature (222)..(222): n is a, c, g, or t
  misc_feature (241)..(241): n is a, c, g, or t
  misc_feature (259)..(259): n is a, c, g, or t
gaattcggtacgagcaaatttgcatgaagacaaatagttatttcacaataggtgtggaaggggcttggccgtgaactgcacagctatcagttagtgtccccgaatatttaaaatgagcacgtcccagggtagaaactcactttaatgagactccttggaggnataccacctacatgtatgggctccagacaagatggagatcatggagtntgcaggnaagtngtctttaccagaggtctanggactgtgggcttttctntaccaaaacagtaagtaggt

SEQ ID NO: 578207 - DNA, 257 bp, Homo sapiens
ttgtagctgctctgtgtcgatatatgatcgatcactacgtttgattagtatcttcaattgggggccccatcattttaacagaacatgttgactaaacagaccaactctaaaggaagttgacccattcttcaacactagctcactctggtgtcaccttggttatgataccctcctctacttctatgcctttgttagtgttgtcattctctgcgtcgaatgtgtctcttatctcctttttctgccgagtccgctgcatt

SEQ ID NO: 578208 - DNA, 201 bp, Homo sapiens
ggccagagagagaagatcggggggctgaaatccatctacttcctaccgctccgcccggtgttggtggaatgagcgtagcatgtagtcttgaagagaaagagctagtgcttttggcaaggactctttcagcccccaacctgtaaacatcacccttcaagtaaccaggctaattcccaaacagtgccttgctggctttgtgac

SEQ ID NO: 578209 - DNA, 439 bp, Homo sapiens
  misc_feature (10)..(10): n is a, c, g, or t
  misc_feature (77)..(77): n is a, c, g, or t
acaatccatntgtgcaatagtagtcctgaggtgaattacattctgagcttatgaagataacaggattaagagattanagtaaagataggcataagaaactataagagtgttaattgggaacgtgataaatgtccatgaaatcttcacaatttatgttcagagattgcagtaaagacaggcataagaaattataaaagtattaattttgggaagtgataaatatccatgaaatcttcacaatttatgttcttctgcctcagctctggccgatccctccattcagggtccctgacttcctgcaaaacaatcaatgccctcactttaacagtagatacttggcgaggctgtgcatggtgaggctgtgcatgcacctttcattgcaggtcagccactaacatgataagagcttatgtctatttttccacaatttcagttcttt

SEQ ID NO: 578210 - DNA, 265 bp, Homo sapiens
cggcctcactccatgtcacaatcacatattccgactgagtgatatgcaaatataaatatgcaattatattaaataattatactacattattatataaatccataacacgaggaatacatctgctctcattcattccttcatttatccactcccttcatttattccctcattatctcaggaaatagcttcctttgtggcaggtgctattccacgactctggcgatactaccgtaaaaacaacagaataaaatcacaaacactaaaa

SEQ ID NO: 578211 - DNA, 573 bp, Homo sapiens
tgtctcatccatctgtctgtgctcgtttgcatgtacccacagctgtctccaggcatcctagatgtaagcaatgcctctggttatccttatacagagatgtcacagttcgaccccttacattactttctgctttaacaggatatacaactataccaactatcccctgcagaagctttattcatgtagcagcagaataatgtaatatgtttgcacggacacagagttatcatactttggctgaccttatgcaacataccaaaagtgtcttgtaacttccacaaacttgaattacttacggaaaaatataatgacacacttggcaggcttcttcctactgacttgggctagcctggtggggtcgttagctaacagagctaccaaccgtgtataaaaagaagcacctacagagaacattagaacgagggtatgagatttctgccagtctcatttctttaagaacacagccatatatttatggggtagactgggcaacaatactactgtagggggaaatcaagtaggaaaatcacagttgatccttcattgagaagacttaggaagcaaaattcttaa

SEQ ID NO: 578212 - DNA, 663 bp, Homo sapiens
  misc_feature (331)..(331): n is a, c, g, or t
caagttttgaagatgcccggaccaacccaaactgaggaccacacaccgcagaagaagggcaaagggccggaccgagactgaagtgaggacacaaccgtgtgaaagcccagcccctggaccacactgactgaaaaagcacccccactgagcacctggcgaccccgactcctgaccgacagagaacaaacccccgtagacggcaaaatccccagacctacccaaaggctacaaaacggccccacccccatcacccacaccgactctctggacggacacgagccacctgcacccaggtgaaagaaacagccagggggctcacacaaagcccgcnggacggcctcttgacacggacgcgcatgaaaccaactattaaaccaaggataccagaccagtgccaagccaccagggcaaaatacggtacgctgcagggctagcataaaccccaagtgcgcactatctctgagacccatgtgtcggaatcacgttgagtgataggaagatgccatccaaatccaattagggactaatatatgatgaggacaactcagggctatagggccagtccccagaggacaaaacctagacgaggactttggaggacgacaggcacagggaccgtgcagacgggtagcgacctcagagggaggctgaaccggtccactg

SEQ ID NO: 578213 - DNA, 826 bp, Homo sapiens
cgtggcacggtaggctggtagtcccagtggaccgcacacaccatagcgccaggcggactccttgatgatcctatgggaggagactggcaggcatccacgtcatgtgtgctagcaggcctcgatcatcatcacgtcctctgttgtcgtagcagtagcacccattgatgttgccgatagaacaacagattacatcgcagtgatgtacaccagctcgtgacacgatgcagtatttccgaagcacttggcatcacatccgcgtcgtacggattttagatcatatgcacacccacaccacacacactgagctgtggttgagcgtcctcttactcacatgatgtctgcagcagtctgcctcatcatctatcatgattatgaccataagcaccctgaacctcgcttggacatacaccatgctacacgcagaagcactctgtgcgggcggtcggacgccatcgtccccagagaacactgggagcacttctctcacaatgagggcgctgcagactgtgagactacacagtctgcatctagtggcccctctgtagagggatctcggccacatgatttctgcgcacacgaacagatgacgctgacatacacgtcaaaagaagatttgacgggtctctgacattaaaagtcataatatctgtcatcggctgcgggcctcactgggaagcacagatagcgcactgggagctgaggcatgcccttcctgatctgccactggtgggcgataactgtgtgccttgggggcgccccaccacaaggacttgttttggtattgtgtgcttgtataaatctcccataaatgttaagccaatgtaaa

SEQ ID NO: 578214 - DNA, 340 bp, Homo sapiens
ccccccccccctttttttttttggggggacaccttggggccaaaggggtcccccccttttcggagtggggggggatttttttcccccccgggggggggtttttcccccccgggggccccctttttcaatggccccccccccccccggggggggaaaattgggggggggccccggggggggggggtttttcccccgggggccggaggggggtttgggggccccccgcggggggccctccggggtttcccccttttttcccccctttggcccccgcgggggggcccccttttttttttttgggggggttttttttttttttaggggtctccttcccccccca

SEQ ID NO: 578215 - DNA, 179 bp, Homo sapiens
  misc_feature (36)..(36): n is a, c, g, or t
  misc_feature (38)..(38): n is a, c, g, or t
  misc_feature (67)..(67): n is a, c, g, or t
cgactcctgaggatcccctgcccttctgtgtctgtntngatgatcactggtttaaagtctgttttgntggaaataagaataggagtccctgaaagagaggggagaaagcaggcaacttggaaatcatatttcagtatatcattcaccaaaactttttcagcttcacaagagaagccgac

SEQ ID NO: 578216 - DNA, 971 bp, Homo sapiens
ccataggacccccgtgactcaaagcaagctacctgaagagtcctaaaaatagctcacacgtcttagtgaacatgcagcgacatgaaatatgagagtacaggcgaactgtcgaccgtattcgtggttgtaacagcaggaaccgctaaaatattgaaagaacatttgtgacaatgtgtagtccaatttggtaccttgacgtaggtgccatcttaaaatccacactaagtctagattgaatatgttgaagtaccaatgattcgcaacagtatgtgatgagttgatctggggtagtatgtgaaactgaatacgatgggatgtatggatggaaaagactcatgagaagatatattaaggattagtccgattttgaaaggagtaggatagggcggcttgaattggctagaagattgtgaatgttaagcttaacttggtgtcatgtagaggtctgtcgataacccatatgcgtgtacattttcttagacacctagttagattgaagcatatgtttagattcgtattgaatgcccttgataagttcgtcgcaatggggttctcggtgatttcattacttcaagtagatcagaacttcgtagaccgactgaagtttgttttttgaagtacttgtttgtgttagcgtgtcgaagatagaaaagaccacttgttaagtactaagtcatgcattatggctgtgaaagttacctctgggatgagggttgaagtagtaaaggcactgtctgggactctgttgtcagtagtgtaatgtggtgatttgcaagtcctgtactgtgaccgacggtacgcggggatctataaatgggggcagggggtttgcaaagattttggttggacctcttttaggtaaaaaaggcgttgtggtcttgaagtttttgaggataaaacacaatagtagggacgctaactcaacgaaagaaacaaaaggggttaagaatttaaacatttttacagtagag

SEQ ID NO: 578217 - DNA, 102 bp, Homo sapiens
agcatgcactgcgcgtcgtttacactaacagctataaacatgcactgcgcgtcgtttaacacgtaacagctataaccatgcactggccgtcgtataacacgt

SEQ ID NO: 578218 - DNA, 720 bp, Homo sapiens
gatgatgagtaacgccatgagctgtcggagccggcgagagacttagaccgacggaaactggacactggaccggcagcgccatgagactcctccccttcgcttgctgctgcttctcttattcgtgttcccgtggcactgctcttgattccagagggcggcccagaggcttgattagcatgtggcgacgagagatcatgtacagaggatgatagaaacacgtagaagattccagtaaattgaggatgagagatgatgaagccgaggtatgaagaagggatgaacccacagaattggtagaagataaagaggcagacgatgtgtctggtgaacactgaagacttcacctgtaggtgcagactgctcgcctatactgctttgtgacaggcacgaccgatcttcccggcgaatatcgttgtggagttcctggtaggactttaccaacaagggtacagaagatttcttcgttgaatccttagatggcctcatttccgtatcctcaaggactaccaggtgcttatatacagaaatttcaccagttcttccttctgaaaaactgtaagtgcacccccagagagaggcaagtgtggagtactctttccatatcctgcaagagccactgggggacgaccattggttgggcatgaatctgacactaacgagatttgacggacatgtatcaagatggggctctatcacaaggtcaggtttgcgacgaggagg

SEQ ID NO: 578219 - DNA, 549 bp, Homo sapiens
  misc_feature (154)..(154): n is a, c, g, or t
aggtccctttctctctagcagtgctcctctctacttctgagatctgttcccagtggacctctactctctgcttcctgtatctggcagtcatttccaggagagcagagccatccagggcagttccataattttgtgcccatttcccactcatttntgacagaacctttcattttattgacaacacatgattgtttttactgttcctccctccagcttcaacaaaggtggagggggtgggtcaatattttatataggtatttacttagcattaactcttcaaactgtcatgttattttaaactttagtttcattttttaaaaatctatgacataccctaattggaggtgacaaaaaaaaaaaaatcatggataatccagaggatggaaggcattggggctagtggctctactccccaaggttttgtaaggatggaggttttaaaaaaaatgagtctatatctgtggatggaaggaaaaaataattttaaaaaatgataactctgtcctattctttcagggtcaaattccagaaaaatcatactttggaaaa

SEQ ID NO: 578220 - DNA, 347 bp, Homo sapiens
  misc_feature (30)..(30): n is a, c, g, or t
  misc_feature (44)..(44): n is a, c, g, or t
  misc_feature (200)..(200): n is a, c, g, or t
  misc_feature (207)..(207): n is a, c, g, or t
  misc_feature (210)..(210): n is a, c, g, or t
  misc_feature (214)..(214): n is a, c, g, or t
  misc_feature (270)..(270): n is a, c, g, or t
  misc_feature (275)..(275): n is a, c, g, or t
ggtccccctttgtttccagccaccctttgnttgggtttttgagntggtggccctggcccaaaggtttggcggaggcccaggcagcagccatggcggggtgtttttacaggggaaaggggggagcctcaccccttttcctgccctacctcctaataacacttcctgccccatttggacccgtaccatggggctcaggacanagggagntancagntggcctccatggccccacagcctcctttgaggttgtgttgggtgcagaaccgccanagccncccaaaaggtgttttttttttgctccctgaaccttttaacttaataaaacgttcccgccgaaaaaaaaaaaa

SEQ ID NO: 578221 - DNA, 114 bp, Homo sapiens
ggtgtagaggatccctaaagggagtccgggtagctgaggtgaggatccctgagtctgggaggtcgaggctgcagagagctgtgatttcaccactgtactccagcctgggagaca

SEQ ID NO: 578222 - DNA, 552 bp, Homo sapiens
  misc_feature (180)..(180): n is a, c, g, or t
gacggcgtcggtgatcaggagtgagtctggacacacacatatataacaagagagtggcataagagggcataaaacacttttaatgagattcaaatgtagctttccctggtatcatggaaataaagcacacaaggcaaataaagtaatgcgaactgatggtcagaataagctgtgtagccnatgcgaagtgaggttagaggtcagtgtgtctcaccttgcaggtgagtgatcgcgtgcaggaccttttgctctccgggtcctggactccacagtgcttgttcgggtcgaacaccctccctgtaaacaccagacggagagaaaaaaaaaaaccaggtcatcacggctgatttcagaattcggtcttcgggagtaccaggaagacttctttggccaatacttggtgaatgacaggagagaagggtcttacaaagtggtgttataggacctacagtagactgttgttcgactgaaacttcccaaatactcctgagaggttttccccctgagttaaacacttcaattgtccctgtaatcttccacatgtcatctcta

SEQ ID NO: 578223 - DNA, 513 bp, Homo sapiens
  misc_feature (49)..(49): n is a, c, g, or t
  misc_feature (58)..(58): n is a, c, g, or t
  misc_feature (86)..(86): n is a, c, g, or t
  misc_feature (94)..(94): n is a, c, g, or t
  misc_feature (139)..(139): n is a, c, g, or t
  misc_feature (168)..(168): n is a, c, g, or t
  misc_feature (487)..(487): n is a, c, g, or t
gaggcaggagttgagcccatccggccaacatggtgaacccccatctccncctaaatcnaaaaattgccgggacatggtggtccgtncctgcagncccagcctcttgggaggctgaggcaggggaatcggcttgaacccngggagatggagggtcccagtgagccgagntctcggcactgcactcccagccctggtgacaagcaagactcccatcctcaaaaaacaacaaaaaaagttacccttataatcccagcaattcccatcacctaggtatacagccaagagaaataaaaacgtgtttatacaaaaacctgtacacaaatattcactgcagcattattcacaacagtcaaaaagtagaaaataatccaagtgcccatcaactgatgaatggataaacaaaatatggtacatccatcaaactgagtattatccagccatgaaaaggagtattgatgcaagtcacaacgtggatgaactctgcacntgtaatctaagcatcagaagcagacc

SEQ ID NO: 578224 - DNA, 355 bp, Homo sapiens
  misc_feature (79)..(79): n is a, c, g, or t
  misc_feature (82)..(82): n is a, c, g, or t
  misc_feature (235)..(235): n is a, c, g, or t
  misc_feature (245)..(245): n is a, c, g, or t
cccaccgggagggggagggggggattttcccaccctcctccccccggggggaaagaaattcttcccccccccccccccnganggagggggataaaggggggggccccccccccccccccccgtattggtttaaggaaaaaggggggttcccccaggtgggggggcggggtccccccccccccaggggggtaacccccccccgcccccccaaagggggggggttaagggggggggncccccccccntccgccgcccccccccccgggtgaaaagaaaatttccccccccccccccctggggggggcccccccaaaacccccgcccccggggggaaaaaaggtttttttttttttta

SEQ ID NO: 578225 - DNA, 702 bp, Homo sapiens
tgaacctgggaggcggaggttgcagtgagccgagatcgtgccattgcactctagcctgggtgacaggagtgagactccatcgcaaaaaaaaaaaaaaaaaaaaaaaaaaaaaactgtgtgggggcgcgcgccggggcccccggaaaaggtttttaaacaccttcggcggtggggggggggggccccagagggggtaagagggaacacgtggggccaaagagcggggttcccagagaggagagaaccgcggggccaaggacaaagagggcgggggattctctcccccaaattaaaaaggccccgggggggcacacacggagagggttctgggagacaaaactcccgagagagggggtccgggggggccacatcggggggcctctttctcaaaggggggggtcccaagagggagaccccgaaaatctcccaacatattataggcgcccccggaggcggggggggggaccacagaggaagcaggacacgacagggcggacaacacggaagaaacaacacagaaaagagcacgtcaacagggaggggaggcagagggcaggacactcccaaaagcgccaacgaggccagcgacagcagaaagagggcgcccgacaaagacacgcccgaccggcaaaacaaaaccagacgggacaaaggacgaccggcgaagaaacagcagaccggagaacaaaccacgaacccagg

SEQ ID NO: 578226 - DNA, 976 bp, Homo sapiens
acaggtggttgttacatgcggtattttgctccagggaatttacttgcggctgcctcgatcccctgggtgcgcgcccaaaaacaagaagtggtgtaaaatcatgaggacatttctctccgtgttccgataattcgcgatgttgttgtggccgcctcccaattgctcgaaggtgtagtaaccagccgtgcttcccggtggttcaccctttcggggcgcggctttggtggacgagcaccttgccgcccggtggccccaaattgcgcctcttattcatggggggcgccccctagttcggccccacactttggaggtgcggacaaccaatttttctctggaattagtcctggccgcaaaagaacactttctttattctgaccgcaccctatccaccgtccttgaaaatcgtgtgcgcaccaaaacaacccccggttctccccccctgataatcccggttgacctaaacatgctccaacaacaacctatgcctgcttccagaacctataaattgggctctcccctggcaagggcaaacataaccgccccccggttggcaacatcttgttttacactcgctcctcctcctatctataccccctttatacactcgctccttttataataaagatctcttcctaaccccccttgtttctcctctccacgagccacgacctgcaatattattactacccatcggaaaccacactgtgatgtcttccaaatattattatcttgttaacagtcccatagcattcaatactttttctccataaaccactcacgactatccacttcatgttattagtccacagcatatatcagcgagccacgcgtcgttttttccgcgggtcggacccttctgccttcccaacgtccccttcttcttttttatcacatttctctagaaaccacacgtggggtttcttaaaaaaaaaattttgggaacccccacaaaacaaaaaaaacagaacattaaaaa

SEQ ID NO: 578227 - DNA, 133 bp, Homo sapiens
tgtgatatatgtcgtgttgttgatgagtatatttggaccgtgtggtgatcaatatagtggggaaaatagaatgatcagtactgcggcgggtaggcctatggattgtgggtggcaatgtaatgaagcgaacagt

SEQ ID NO: 578228 - DNA, 1421 bp, Homo sapiens
gaaattggtcgtttgtctttctaattctctccacggtcagttccagatggtgccggcctgcatcgctgctgagtgtcgtccctggaacgcctctgacattctatgccttaagacgtgtctcctttccattctcccgacctgtgctggtgacgcaggcgatggatatgctcgctttcccgttgcaccgatgttttctgctgtcgctgccgtagtggtccaggcgcgctcgcgatcctcatatggaggttagctctgggaagcgtcccatgccatagggtagctcgtcgaatcgaagcagagagcccatagccctgggcgaatcattttatgacttccccaaggctgcgttagtacatattcatttgtctagcatgccacctggaaacgtaccgatctcccaacccgatgtgtgcctatgtagggattggcaacggatccaactcgcgtggcaggggtactggaaagggtgcatttcggcatcgatttctttcaccgcaagacataggcgtagccctggcgtaagactgggtctcgaatagggagccgtttggataccacattctaggcgattgttcattgttctcgaaatatatatcatcctcaaaaagattgggcaggcactggtcgagctttggaccacagattgacttcgagtttaacaaggtttgaaaagaggcctcggaagaggcacttaagcgggccagagggagtacccctgtgtggcgccgccattggattagtcttccggtggcgtctgacccagaattacaacgagggcgagaggtacacaaaggtctcttctaaagaaaccttattgggacacacttcggacaaggtttcggaatcggggaaccttgttaccggtacttggttggggaaagccaaagggtctttgggagcccatttgtgcgcgagggaaaagcaacgggaaggttaaccgaagcctgggtaagactcagggttgaaatacggaattgcttccctattgccttggggttcgccaccactttggttggacctccggttcagttgattagccccgggatggcagttactttgccttagccaccaaatccagtctaggtccgcagaaagtgggaactctagggtggcaggtatataactttttccccctttgtctgtaacaaacagacgagagaaaccaggggagtcttggcaacatcttggtgttccccctgtggcgaaggggggtggggacaagtcaagcacccttgtggggaacaccacggggcagagaacaaattctgcaatcacatttgaagttccccactgagataacgatagagcgtttaggagtggtatcacggacattataatagggaacgcggcagcgcgagagcgcctctgggtgttatataccgcgatatacgaacacggaagtgcaacagtatgtcaaaatg

SEQ ID NO: 578229 - DNA, 369 bp, Homo sapiens
tcggctttttatatacagaaggcatcatatctagtgcaagcgacgtcaaagagatcatcttgcatcagtgcaaccaggccgaggttatattgagtgaggacgttcaagtgcgagatgatgcctttgacaggcatagctttgtcgcgttcagctgcggagtctgcggcaaaagatccatcgaagcagtgctagacgtgatggccagatcgatcacccaagcacaatcaagatcagattaccaaggcctacctacaatttgggacaaaatcgatgagtgcttctttttagatctgcccgagagattgagagcaaaacaagcaaattttgactcgacaggcggtatacacgcagcggtatatttgatccgga

SEQ ID NO: 578230 - DNA, 334 bp, Homo sapiens
  misc_feature (54)..(54): n is a, c, g, or t
  misc_feature (58)..(58): n is a, c, g, or t
  misc_feature (60)..(60): n is a, c, g, or t
  misc_feature (98)..(98): n is a, c, g, or t
  misc_feature (158)..(158): n is a, c, g, or t
  misc_feature (164)..(164): n is a, c, g, or t
  misc_feature (282)..(282): n is a, c, g, or t
gatttcaagaagtccttggattatcctcgtttgggcgattcggtgcatggccanagtntnaatgccttccagagctgcagctggaggagtccagaggnctaccagaaggaccagttcttacagctccctttctctgtcagtggggacgcatcagcaantggaancattaatgaactaattcgttttgaccacatatataccaagccctagtcttagagataccctctgagacagagagccaagctaatgtggtagtgaaaatccgaggaatcacctctcaanccctcagagaatgatcacccctgaattcattgtctcaagtgaaggaagaacc

SEQ ID NO: 578231 - DNA, 316 bp, Homo sapiens
agccccccttttttaggatgggcccctgtagatcattaaagttcccccttgagagggtgagccggagccaggattggggagagcccttgtttttgggcagccctggggcatggggttgtgggaaaaaggagggggccccggcccagggcagggggcagaggcccgggccctgatttgggcttcccagagatctcccccccttagttaaggggaggggggggggaattccccaggggggccaggggcccgggatttttaaccccttttacaagggtaacgggtcagaacggtttttgggaacaaaccccgggtttta

SEQ ID NO: 578232 - DNA, 115 bp, Homo sapiens
actactattatgattgggggttggctactgactcgtacgctaataatcggagctcccgatatggcctttccacgtataaacaacataagtttctgactacttccctcgttaagct

SEQ ID NO: 578233 - DNA, 173 bp, Homo sapiens
tgaatcttgctcccaaagctccacctcactttctatttggcgtctttacgtggggtcttgatatcttttataatgctggaaatttctctctccttttcctttcacataaattagtcagtgggtatataatactaccccctttatttttttttggtctttttttggctatttcg

SEQ ID NO: 578234 - DNA, 728 bp, Homo sapiens
tggcttcactgtgtagggcgctgggcccctagtttctggagctgggaagttgggcggcgggctccgtccctgtccttcagcttccagcgttcctgggtttccttcggcggcgtggggcctcgccaaggactcgccggccctgtggggccacggctttagtggcgccttttgcgagttcacataaatacatcttaaaaccttcaagatggttctagcagatcttggaagaaaaataacatcagcattacgctcattgagcaatgccaccattatcaatgaagaggtattaaatgctatgctgaaagaagtatgtacagcattattggaagcagatgttaatattaaactagtgaagcaactcagagaaaatgttaagtctgcaattgatcttgaagagatggcatctggactgaacaaaagaaaaatgattcagcatgctgtatttaaagaacttgtaaagcttgtagaccctggagttaaagcgtggacaccgactaagggaaagcaaaatgtgatcatgttgttggattgcaagggagtggtaaaacgacaacatgttcaaagttagcatattattaccagaggaaaggttggaagacctgtttgatatgtgcagatacattcagagcaggagcctttgaacagtaaaaagaatggcacaaagaagaattcgttctatggcagtatactggaaaggcatccggcatcatggtctgaggagtggggaa

SEQ ID NO: 578235 - DNA, 121 bp, Homo sapiens
ttggcgtgtgtgtgatcagaggacatcgacagtatttgacgaaatacgaagtggcagatttacactacattgtccacgggaatgagcgtgtcagcgggtaaagaacgtctaagataggttc

SEQ ID NO: 578236 - DNA, 707 bp, Homo sapiens
gctaaaccatggtactgactgtttctgcgaagtcgggcctatgaaagcatgggccgtggagactgtattgactccttcaaaagaaaatacatctctgctggagcgtggcggcgggtctttgtaggcccccaaatagctcactgtctttctcagtctatgaagcgaggatatctctctctgcattttttttaaactaatactctattttaaataaagatgggggcttactatgctgaccaggctggtctcacactactgggctccctgcaccatgctgtctatgttgtttatttctgccctatatatacaagtctctgtcactgcgtcatcatatgcatgtaccaagcgtgactgtcctatgttattccaaggatgccctctctggcactctgtctctgcctgcgatgaggagctattagtcaacaatgcctcactgtggtgtcacacattcgtattagacctgtgagtagcgaccagggcctgcgaagcagacagctgcgcgatgaaggcgtgagctgagagcactacaggcttcgactatacaatgacaggtacaccggcagcagctacctgagcctgacggctgggcagcgagagactcgaagaagatacagatgcgggttcctccagatcggcacaccaagctgaggccgtgcacctcacaggatgataggttttgaagctttatgcccgtcgccagacttgcg

SEQ ID NO: 578237 - DNA, 533 bp, Homo sapiens
ctcctgtcgatcagcgtctccaagaacttactgcctcactgttcgtgtatctgagtggtcggtcctcttcggtgcctgtcggtctcttagatctcgtcttacatacttacatcacgccggtcatccctctgacggcgacggtcatccctatccctatcgtcccggcgacttgagtctctccagcttgaagattcctcaactggtcctcttctccagccaccttcatccctaggtcttctgaagcgatcctctcgatccacatctctctctctgtccctttctctctcagggtccttgtcattctcctcccgatcttgattatctctgtccctttctttttctctgtcccattcacgttcttctgatggccttgattctcgaggtggaccccagctctcctctctggctttttctttctctctccatccacctggcttgactaatggtctccaaggaccaggtcttgagtcatcaccccgtctgggaaaccgatcatcatcagcacgtcttgaaaggcgatcatcatccatgtc

SEQ ID NO: 578238 - DNA, 589 bp, Homo sapiens
ttcccaggagtcgggaccccaggtaaatggcttgggtgttctgaatggtattggctctaagcccgttccactggggaagtgtaccttttcgctaggacgatgatgccgtggacctcgactaaggtgtacggtttagcaggatattattctgggagaccctaatgtgtgtagatgtccagttctgagggagtccatccttggatgccaagggatgctaattggctctatctaggactctgcttgagaaagatgggagggatatgcctagatcccagtgggcgcatccggtccgtgctgcatgcagatgagatgtgagtctggaacagaccttcctggcccacttcctgatcacaaggaatcctgggcttccgtatggctattgcttcccatctgggattcctaacttaggtgtctgccctcaggggtccatatcacttcaggacaccccaagagatgtcctttagtctctgcctgaggcatagtctgcaatttgatattgaaatatatagagaagggtaaccatcaataatacatatcatgattaatgtaatcttgttgaattttatatacctcattagggtaatcaggg

SEQ ID NO: 578239 - DNA, 186 bp, Homo sapiens
taggtgatctctagcaggatccccacttgcgcttactttgtagcctacatcaccgttttgctgaacgatgtcggtctctaggctgagcaagatgcgtggtgacggttgatccgcgggatttatcgacttacagaacaggctcctctagagtgggtatgaagcaccgccttaggagcctcatgtgta

SEQ ID NO: 578240 - DNA, 127 bp, Homo sapiens
ccttggtcaagtgtaacagcggtgaacctggtgctcctggcagcaaatggagacactggtgctaagggagagcctggccctgttggtgttcaatggaccccctggccctgctggagaggaaggaaag

SEQ ID NO: 578241 - DNA, 840 bp, Homo sapiens
taaaggcccattgaaattttgggtttacaaaaaggaaaaaagggggtataaaaaaaaaaatggggggaaaaaaaaaaagggatgaattgtgccaaatgggggaaaaggggtttaggggttgcccttctattaagtgttaaaaaggagaggaattatttggacggggataggaatcaaaaaatgttgatggttgttaaggggcgcaaaattatttcatcgatgggtggtgtgaggagattatttggagacgaatggggatatatttgagcacaagataaagaagagattggatataataagggagaaaagggacgccctcccacatttgtgtaacgagcgaggtcatcgaaacatttgtgttgtagcgagcacagacataaggacaaaaaacacacctccgcgcgcgcgcccatgtactgaggtgcgcgcgagggcgcgtgtgccaaccagaggaggtgtgggcacacagcagctaacagaggcggggtggggggcccccccaaaaagaagcgtccgtcgccgacacacacaattctcgtcgtacccacccacctctacatcgcggcgcaacaaagcaagcgcaactacaaaacaatatacccgcccgacgagagggcgccacatagacagcgttgtatcataccagcggggggtatcagggcggctatcccacgcgcaacaggcagcgaggagtacacccatgggggggcagtataagaccccccccgttgcgggccaaaccacgtgcagggggctaacgagcatcaggagggccgcacacaaacgtagcggccaacaaagagcagactatggtacaccacaacctgcttagtgcgcgtt

SEQ ID NO: 578242 - DNA, 463 bp, Homo sapiens
ttctggctcggtaccctcattccgtcctcgctcttgcctccaagtgactgactatccatcctccacaccaggggcctgggtgggccgcactaccggtggcttctggctctgagtccctgtctgccactgccctggcctttgggctgtgactgggtgggtcactcacctcccccagtcgcttccttttattaaacaatacgttgttgtatatttggggtttttgtttgctttaagattttatttcaggggggcagggtggggagcagagggaaagggacaagcagactccatgctgagcgcagagccccatgcaaggcttgatcccatgaccctgagatcatggcctgagctgaaatcaagagtcagatgattaaccgacagagccacccaggcgccccccagtctcttcttccttcatctgttggatgaagataactccactttcatcatcacatttaagggg

SEQ ID NO: 578243 - DNA, 880 bp, Homo sapiens
  misc_feature (72)..(72): n is a, c, g, or t
  misc_feature (78)..(78): n is a, c, g, or t
  misc_feature (169)..(169): n is a, c, g, or t
  misc_feature (221)..(221): n is a, c, g, or t
  misc_feature (223)..(223): n is a, c, g, or t
  misc_feature (366)..(366): n is a, c, g, or t
  misc_feature (413)..(413): n is a, c, g, or t
  misc_feature (586)..(586): n is a, c, g, or t
  misc_feature (693)..(693): n is a, c, g, or t
  misc_feature (697)..(697): n is a, c, g, or t
  misc_feature (701)..(701): n is a, c, g, or t
  misc_feature (708)..(708): n is a, c, g, or t
  misc_feature (730)..(730): n is a, c, g, or t
  misc_feature (732)..(732): n is a, c, g, or t
  misc_feature (775)..(775): n is a, c, g, or t
  misc_feature (789)..(789): n is a, c, g, or t
  misc_feature (810)..(810): n is a, c, g, or t
  misc_feature (820)..(820): n is a, c, g, or t
  misc_feature (824)..(824): n is a, c, g, or t
  misc_feature (856)..(856): n is a, c, g, or t
tatatttaatataatatgtgtgattgtggttacagatacatatttggtgctttatttatccagaagcatgantaaaanagtacataaagtattgaatacaaaattctaaagataaacacaatttttcttgaatttaaaatatatgggataaatgcttacaaatggattnataaacctttcacttctacttcattctcctggctgtttttcccgaagatgantngctagtggcaacattaaaaaaaaatagctccttcaaatcctgaaactatatgaaaaaaaaagaacttttggcaaatatttattcagattgcttgtttccagtggcaaatttctcagcattcctctttgttttgtctatccctnagcctgtccatttttctagaaaggaagtaaaatgctttaaatgtatnaattattacattattgaagtgggacccaaaaatgtgaaatatttcctctggcaaagggagaagaggaagggaggaacaggggcaagggggggaggaaaaaaatacctaaggtgaaaaaacaagtaactggcaagaggctaataaaactgtatataaatgttgaagaggctganttgtagtttctctaccagaaaaataataagaggtattattaaaacgtgagtggagaataatattccaaatgtgtgtggtggtcgtggtggtggcggtggcctgtaantctntccngtgagtntccattcaaagccaggagtctntnctcagtcggaagagttgacctctttagtcttgggatgtgtaantcatgccgggaaancctttctttaaatagtcattnccctcgtttncctnaaaacctatttggtgaaaagtgtttctaacanaaacagtagccgccaaattgttat

SEQ ID NO: 578244 - DNA, 346 bp, Homo sapiens
tcttaaataacgttaattttaatatattgtgttaatttacagaatacgttaatcatttggagcacaatgtgtttaaaatatatatatattggcagatatatccgtgacttttgcctccatataaagtgagtatcagaccgaaaaatcccatattggttaggctctattagcaacctaaaacagtagggctagtgggcaaacctaaacgcatcacctagcagaattatcctcaatatatgcgtgactgactttcccccctttttataaaaacccatcagatttgttgttgtgtttgttttggaccagctattccgtatcaacaaattacagaacttcaagtcgacgc

SEQ ID NO: 578245 - DNA, 231 bp, Homo sapiens
cacgagggatgttttaaacacaccgatcttcgcacacacgttaacatgcaccgggatcagccatttacaccacctcactcacagcccagctttgacagtcaaagctccattacacacgacttcgcatggtttcaatctacagaacatatttctggccagaccagactatctatcataaatcgacatctcagggattttacagcacactcttgtctctttcgcccgagctga

SEQ ID NO: 578246 - DNA, 478 bp, Homo sapiens
ttagaggatctgagttagggtaccaggtatgggagatggatgaacaaaaataagtctgccttatgagctgaactaggtcgagagaaagataacaagtgaaataagtgaactatctaggtgtgttagatttttgagagtgttaaggagaaaacgtaaagccaggaaagggtgtgggcagcaggtgttcatgtctagaaagctcagcgtctgtcaacacgttgggtggtatccatgcctatcaggccctgggggctccagggtggagatggtcctcctcccttttccagactttcttgccccgtgggtcacatcctctttttgttctctgaactcctcaacaaggcataatcaccatgcaaacacccggggacaataatacggggggccactaaccccaatcttgaacttcagcaattcccatcacggtgctccaagccggccctgcagcagtacaggcaagacccaagaactaggtggc

SEQ ID NO: 578247 - DNA, 434 bp, Homo sapiens
tgctgctgactactttgtagaaatgtgaaacctcactatgaatgaatgtctattaatttcaaagatattgtatagatactgtccaaacagtgagggtatagaagaacattaatctctgacatacagacgggtgtgcagaactcgggccgatggttcagaggcgcctaacacatgatataaataggtaggtcactaaacaaatctgaataactggagagacctgaggtcataccaactatcttctctaagtccacagttgtactatgaaactaaacaccaataacagacggcaaggaagacaaatccacacatgtggaactccctaaacttactctatacccaaacaatgggtcaaagaccctaaaaaagaaatcatattaatatgtccggagacaagggggaaaacacaaggaggagccccacgtggggggagg

SEQ ID NO: 578248 - DNA, 100 bp, Homo sapiens
tcataccatgagtacagccaatatacatccctatctacatagactagatatcgaggagcatggagcagtaccacatccttctgtaaaagctctagggaac

SEQ ID NO: 578249 - DNA, 798 bp, Homo sapiens
tctggtagcaatgaaaattttaatatttgattaaaaatcacgtaagcatgaggttgtgggggaacacggaaaggaagggctcaaattagggggtgtagcacatttatcaggaggtaaaatctccatagtctcctacccctccgggccgggccttttactgtggtatccagcctcgtgggaagaccttgtatggacagtatctccacgggggctatcactaggtgaccaggtaggggacagagtagagcagccaatgaccttaactcaaaatcttttctctcccttcaacctgtgaaaaaagatgacggggcactatactcagattgtccccgtggcatagccacatcttgtgggccagtcacaaacaccagctctagttaagagggccgtggtttaaagatttcataaaccagttttctccatgtcccgttggttcccgtggagtcagtgatgtcggcatttgggaactgcgacctggctggagctgggattgggcccacattcaatcaatgcttctcccggtggtttcagagaaaactttcccataattaagcagctcaacgtgttcagcgatggacgccaggaataagctcctgtggcggccgtgggagctcacttagatgaaatatccctctttctcgctgcccttggccagtcactctccatctggacgatggcactgggctcccttcttgtaggctcatagggtgccgtagctgcctttgtccttgttcccggtaacgaagtctccgaatccgaccgtaagcggtgcggaagacacggggtcttcccaccgca

SEQ ID NO: 578250 - DNA, 259 bp, Homo sapiens
  misc_feature (79)..(79): n is a, c, g, or t
  misc_feature (88)..(88): n is a, c, g, or t
  misc_feature (99)..(99): n is a, c, g, or t
  misc_feature (139)..(139): n is a, c, g, or t
  misc_feature (148)..(148): n is a, c, g, or t
  misc_feature (204)..(204): n is a, c, g, or t
  misc_feature (236)..(236): n is a, c, g, or t
gcaacaagctctgcattccctggtgtgttgaacataactagctcctactccaggcaccaaatttggcgcagtagttacnctgcccagnagtgccactgnagtaactaccagtagtgccacccacagtgctggcagtgcngctggaagntgattgaactctgggaagtctgtggagcccatggattgggtagtggatctctattntctgtacgggaaaggttgactaccttcaccanaggatgtaattgctcaccaagga

SEQ ID NO: 578251 - DNA, 566 bp, Homo sapiens
  misc_feature (42)..(42): n is a, c, g, or t
ttctatctcctcaatggagaatccgccttcttggaaagaaanaaaaggggtccgggttgtccaatggtgggggaacaaaaaggaactggcccccgttcggcctatttggagtcatgcaccaaacatgatcaagggggttaccctggggttccgttacaaaatgggggtgggggatgctcccttccccccccacggtgttatccaggagaaggggttttttgttgaaatcccaaattttttgggggaaaaaaacacccgcaggggtgggatgagacccggggttggttgttcagtttttcaagccccgaaagatgaatttatccttgaagggaaaggcattggggtggttttaaattcagggggtttgattcagccagccccccccgtttaaaaccggggaatccgggaatttttgggggggatttatgtttttgaaaaagggaccggttccggcggggggtgaataagatttaagggtttccggggtccagaaaaaagaggcccgagggccctttagccccccttggggttttttaatgaggccaaaaaagcccctttgttttgga

SEQ ID NO: 578252 - DNA, 754 bp, Homo sapiens
ttacccggccggaattacgggatatcgacaagttagcttctagctctacgggaccatgcctctcaaggtgtgtggaagaccgagcggacctgtcctggtacacagatgactttcctgagaagctgaagagcttgcgccaacatatggcagcttatgaaacgtgtcattaggtggaggtctgaatgtgaggctgggacagagggagagaacaagggcctcccaggactctgatgtcagagtagtagtgttaagggtggaaggttgacctagttggatcttggcatgcacccacctaagccacttactcaagaacaagaacctagaatgaatatccaagcacctcgagctatgcgaaactctgttcttgtattcgcttatgatctctgatgggttcgttctcgaaaatgccaagtggaagactttgtggagatgctccagatttaaatccagctgaggctccctttgtaggtcagtaccatgtaacaatctggaaggaaacttcagcggcacaggaagactgctggagacgagaagcgtgttacgcccatcttgagtgtctggggaatcatgtaaatgggtacccagactcacttttagttatttacatcaatgagttctttgcagggaaccagaccagaattcggtgcaaaagccaaacatcttgggtgggatttcgataaatgcctgggacctgcagtgctgggattgtgaccagggaaagacgccgcagccgtggaacagatctgtcaagtca

SEQ ID NO: 578253 - DNA, 271 bp, Homo sapiens
tcacgcccatgtcacaagtatctgaagagaggcagtggatctttcattctctcttttttttaattgagatggagtttcgctcttgtagcccaggctggagtgcgatggcgccatctcggctcactgcaacctccgcctcccgggttcaagcgattctcctgcctcagcctcctgagtagctgagattataggtactaattttaaaattagccaggcatggtatcacacacctgtagtccaagctcctcgggaggctgaagcaggaggatcg

SEQ ID NO: 578254 - DNA, 648 bp, Homo sapiens
agggcgtacctgtttcttatggttgagactgcaggggtgaaataaactccagtctcccatagcgctccaaggcttattaggaagaggaaattcctgcttaataaattttggtcagaccggttgatctcaaaaccctgtctcctgataagatgttatcaatgacaatggtgcccgaaacttcattagcaattttaatttcgcctgggtcctgtggtcctgtgatctcgccctgcctccacttgccttgtgatattctattaccctgttaagtacttgatgtctgtcacccacacctatttgcacactccctccccttttgaaaatccctaataaaaacttgctggtttttgtggcttgtggggcatcacagatcctaccaacgtgtgatgtctcccccagatgcccagctttaaaatttctctcttttgtacactgtccctttatttctcaagccagccgacacttaggaaaatagaaaagaacctacgtgattatcggggcaggtcccccagtaagagtgagaccttgtctcaaaaacaaacagacaataattatgtttacactatactgtagtctattaagtgtgcaatagcattatgtataaaataacaatgtatataccttaattttaaaaatactttattgcta

SEQ ID NO: 578255 - DNA, 216 bp, Homo sapiens
  misc_feature (22)..(22): n is a, c, g, or t
  misc_feature (133)..(133): n is a, c, g, or t
  misc_feature (145)..(145): n is a, c, g, or t
caccacccgggatggcaggtangatggggaggaacaaagagagggagatattgagagagaggaagacgaggaagaaggcaacagaagcagaaaaagcagggactcaaggacgccaggttaaacgggctgcccnctacactcaagnggcagcaacgaaaccccctctgccgtgtgccccacgaacaagtccagaacacccaacgcaggactggggct

SEQ ID NO: 578256 - DNA, 538 bp, Homo sapiens
  misc_feature (256)..(256): n is a, c, g, or t
tggggacagggagtctcgctcggtcacccaggcgggagtgcaagggcccaatctcggttcacggtaatctcggcccccggggttcaagcgattcttccgcctcagcctcctggaggggctgggagattacagggtgcacaccacacacatctcagctggatttgggtatttttgggtaagagacggggtttcaccattatggaccagggctgggactcctggatctcaagatgatctggcccggcctacagcctcnccaaaggtggcggggattacgaggcggtgagccaccgagtacagcccttggtttaattttctaaggctctggctcggtcacccaggctagagtgcaggggcacagtcatagctcacggcagccttgaactcgggggctcaggtgatcctcccaggtcagcctctggagtagctgggactatgggctggtgccaccaaacccagctaaattttttaagtttaagtagagacgggtcttcaccaggtgggccatgcgggtctcaaatttctgacctcaagcaat

SEQ ID NO: 578257 - DNA, 636 bp, Homo sapiens
caaatggcatcttttcagtcttttttgtttgtttttttgagacaggtctcactctgtcgcccaggccggagtgcagtgatgcaacctcagctcaccacaacctctgcctcccaggctcaagtgattctcctgcctcagcctcccaagtagctgggattacagttgcacatcactactgcctaattttttttttgtatttttagtagagatggggtttcaccatgttggccaggctggtcttgaactcctgacctcaaatgatccactagcctcggcctcccaaagtgctgggattacaggcgtgagccactgtgcctggcctcatattttatttttaataaaaataataattctatctctctgcttaagtgtcttttaaaaatgtcacaaaaatcctaaaaaagatgattcataaaatagttagttgatacctctcttttgacagtgtatttctacctcatttgactgtttcttgtggatttgccttattttttcgatgagaccagaaattcccaaacatctgttttcttgcattgtcacaacagtgggaaataactccttcatattattaggtcctttaaaatggaggctcttagtttttaaaaatctttgtagcacctaatgcgcacagaggtc

SEQ ID NO: 578258 - DNA, 102 bp, Homo sapiens
ccccctcccttgtcagcagcatggtggtgggtgtctttcatcctggcatctctctgtgcacagcagcagcatttgtggccataattggcctaaattcatgaa

SEQ ID NO: 578259 - DNA, 170 bp, Homo sapiens
agatcatcattttaacttgtattcaactgagggaggtaacatgatatcctgggtgctggtggattgagactcaagcatcaattcaaaatttctgtggaaaatatgcactatttttttttttcccactctggctaaagtttagggcttgaaaggcaatttttttaggttgt

SEQ ID NO: 578260 - DNA, 454 bp, Homo sapiens
  misc_feature (15)..(15): n is a, c, g, or t
  misc_feature (20)..(20): n is a, c, g, or t
  misc_feature (56)..(56): n is a, c, g, or t
  misc_feature (61)..(61): n is a, c, g, or t
  misc_feature (254)..(254): n is a, c, g, or t
  misc_feature (257)..(257): n is a, c, g, or t
  misc_feature (343)..(343): n is a, c, g, or t
  misc_feature (345)..(345): n is a, c, g, or t
  misc_feature (405)..(405): n is a, c, g, or t
ctggaaaaaaagaangcatnaaatcccaacctgaacactgctgttcctcttttcgnccccnagctcgtgccttggccgaaagccggcgtcctccttgatctctcccgttcgtcggccgcatcctatgactggtatcaggccaaacagcctgccgctgactatgatgccgacccaagatccgggtgtgaaatccagtacgcaacatttacgaatactacaaacagcaccgttatcagacggtgatcatgggagcncanttccgcaaggtagagcagatcctggcattggccggttgcgatcgtctgaccattgcaccgaatctgctggaacaacttaagcacangnaccagccggtcgaacgtaactgacgccatccactgaagccttccaccaacctgccccgcntgctgaagccgaattccgctggcagcataaccaagacgcgatggcggtt

SEQ ID NO: 578261 - DNA, 521 bp, Homo sapiens
taatgtcagtactgtggtgggtgagtgagccccattgtgttgtggtaaatatgtagagggagtatagggctgagactagtatgttgagtcctgtcagtaggagagtgatatttgatcaggagaacgtggttactagcacagagagttctcccagtaggttcatagtggggggtacacggcgacggttacgcgacggcttgctacgacacgtcactcaaacacgctacttacgtgggaacgtcgacgtttgaccgtccttgacacgacggattactgactgcgacctgtgacgtgcgttcgtagtttgacgtttgctacggcagacatacgtaatgacggatgtacagtccgtgggccgacttatgacaatgacctgcgccggtgaacgcttcagggggtttggatgacaactggctgttactaccagggctactgtggctgacttgacacgagtatgcacatgagcgatttaagggtctgtttgtcgtaggcagactggagcttgtactaattatgcctcc

SEQ ID NO: 578262 - DNA, 178 bp, Homo sapiens
ctcccctttactgcaggcaatcccctttgttggccatcccaacgctgccaaatggatagacctcacctttcatatcgccctcctccacaatctcaatacattcctatggtactcacgtctgtgtttggatcaacacctcctcagtggggcgacattacatttgccacgcgtaacatgg

SEQ ID NO: 578263 - DNA, 113 bp, Homo sapiens
aagtcggtacctaatatcatctgctgcagaataatctacggtctttatttactaatatctattttcttggtacccagttttttaccctctgtgcctttagtagctttaagtgt

SEQ ID NO: 578264 - DNA, 363 bp, Homo sapiens
tttttcccccaactttccccccccccccaattttaaattggaattttggttccccttgacggcccccctgggtttgggccccccccctttttttgggggggtttccctagaaaaccaatcctttggccccttataggtttcctgggatttggtttggtccccccctgggcagagaaccgcgttttaagggggggtttccccgggagccccccccccccgggggggggggggaaaaattaatcccgtggggttgggaagcctttttacccggggggtctttgccttctttttttaaccggggggtgggttttttttttttcccccctcccctggtttttttttaatttttttcccaaaagggga

SEQ ID NO: 578265 - DNA, 530 bp, Homo sapiens
gtctgacagtgttcttaaaactggtagtcttttactaggactcataatgatagtcctcaagccgagaccttgagcttgcagctacgtacttatctcttgattaaaagaaaaaaagttggcttatttattttgacaccatttaagtgccttttgccatatgggcttcttcaggaatttgaagtccaatttgagttttattgaggtaaaatatttatatacataaaacgtgacgcaggcttacccattttgaaactatgcaatctcagggggacttaagatacattctcgtggttgtccagaccatcaccagtcatccatctgccagaaagttgttccatcttcccaaattctgggtcccatggaaactgataatttcccgctactgcccgcttgcccctaacaagagccatacttttggtctcgtatcatcaagttcactactcatatactcgtgtaagtgggatgatacaggtatttgtcctttggtgactggtttcacttagtcataaagtctttaagatgcatccatg

SEQ ID NO: 578266 - DNA, 371 bp, Homo sapiens
  misc_feature (13)..(13): n is a, c, g, or t
  misc_feature (132)..(132): n is a, c, g, or t
  misc_feature (137)..(137): n is a, c, g, or t
  misc_feature (160)..(160): n is a, c, g, or t
  misc_feature (177)..(177): n is a, c, g, or t
  misc_feature (255)..(255): n is a, c, g, or t
  misc_feature (319)..(319): n is a, c, g, or t
acaagaccagggncacacagtaaggaccttacttgacaagggtcaaagatcttgcaggcgtttgctgaggacttcaggaacagttctttcgggacagggccaggggcttcccttcttccattcgcggggtgnctggncgagggtgctgtctggggagggnctcaggtgtggtggggntcctccactcttcttacattcctttatttttacaaccaagtcacagcatgtgtaatctcctaggagagaagatttagnaatcccatttagagggcaccaagtgattttcacgtggctcctcaataccattggacacagaggncaattttaaaaataaccgccatggactttttattgggcctctttaagttacc

SEQ ID NO: 578267 - DNA, 259 bp, Homo sapiens
ccagcggggccaacctgcgggactcaccctcctacccggacagcagccctgaggggcccagtgaggccctgcgctcagcaggcgtagcgagcgacgcacagaggtaacgcacggaagatacacagagcacgcgaaaggagacgaagataacacaaagagaccaagacgacacgggagaaagcggcgaacaacacgggagagcgaaacgacaagaagataaagcaaaggagtaagaaaatagaagaggaagggcggaaaa

SEQ ID NO: 578268 - DNA, 941 bp, Homo sapiens
  misc_feature (1)..(1): n is a, c, g, or t
  misc_feature (89)..(90): n is a, c, g, or t
  misc_feature (155)..(155): n is a, c, g, or t
  misc_feature (306)..(306): n is a, c, g, or t
  misc_feature (309)..(309): n is a, c, g, or t
  misc_feature (359)..(359): n is a, c, g, or t
  misc_feature (385)..(385): n is a, c, g, or t
  misc_feature (388)..(388): n is a, c, g, or t
  misc_feature (424)..(424): n is a, c, g, or t
  misc_feature (445)..(446): n is a, c, g, or t
  misc_feature (455)..(455): n is a, c, g, or t
  misc_feature (463)..(463): n is a, c, g, or t
  misc_feature (470)..(470): n is a, c, g, or t
  misc_feature (472)..(473): n is a, c, g, or t
  misc_feature (476)..(476): n is a, c, g, or t
  misc_feature (481)..(481): n is a, c, g, or t
  misc_feature (484)..(484): n is a, c, g, or t
  misc_feature (501)..(501): n is a, c, g, or t
  misc_feature (509)..(509): n is a, c, g, or t
  misc_feature (513)..(513): n is a, c, g, or t
  misc_feature (522)..(522): n is a, c, g, or t
  misc_feature (525)..(526): n is a, c, g, or t
  misc_feature (528)..(528): n is a, c, g, or t
  misc_feature (540)..(540): n is a, c, g, or t
  misc_feature (542)..(542): n is a, c, g, or t
  misc_feature (553)..(553): n is a, c, g, or t
  misc_feature (577)..(577): n is a, c, g, or t
  misc_feature (614)..(614): n is a, c, g, or t
  misc_feature (663)..(663): n is a, c, g, or t
  misc_feature (703)..(704): n is a, c, g, or t
  misc_feature (795)..(795): n is a, c, g, or t
  misc_feature (812)..(812): n is a, c, g, or t
  misc_feature (846)..(846): n is a, c, g, or t
  misc_feature (913)..(913): n is a, c, g, or t
nagcttcgattggtctagtgaataataatacatggtgtgagtctcatacagtgatattgcttctccgtattatatagggaccgttgtanngtgctgagaacaaacatcgtatggctaaccaaagacagagggacaacaccaaggggccgacgggngcctcccccacccccacgccacgccaggtcaactcttgactcttaatgtagaaaaacaaatagcaagaaataaaatgttaccagagagatgtcacacagcaacacaccagaggcatctcaaagcgatttgtacaaaaaaaaaaaaaaaagncgncttttttttttttcttttttcttttttggtcaattgggtctctgtgaggnttggggaaaaaaatctgtgattgtgnggntgaacaaacaagctctagaaagatctaagacttggngcgttacagaaaatataaaannctgctaaantgtaaggngtgacananngcnggggnggnggggggggggggggggntgggcttntagngggttttcnggnngnttccgccacccngngggggcgtctngggcggttagtagtctggacaggngcgtggtgctacccgctctcaaggcaagcagcaaagngttattgcacaaacgcaaagaactaggtctcttattcaatgcgaagggntgtggggaaaaccaccttctttttacccccactttttttnngtaactagctattctccaatgttttaagaattttgggtgaattctcacatctccagaatacacgggattttttttttccaagaggtctcanatgggggtacgtgagangcccgttttctcaagggaagaggcagaagatggnttgagagagagaaatgcatagactaattagagaaaatgaaaagaaaaaaggctctggggagaggggncattgtttcggtggaggttctttcaaga

SEQ ID NO: 578269 - DNA, 138 bp, Homo sapiens
ccatcacgattaaatttaaactcctcaggcaggtattcaaaccctctccctggctcagcctcccgagtagctgggattacaggtgcacgtcatcacgcccggctaatttttgtatttttagtagagacagattgcagt

SEQ ID NO: 578270 - DNA, 178 bp, Homo sapiens
atacgggcggtagttgcagacggggggaagattgatgtggggaagccgtttgatcatcgcgcggaggagtagggcacagggacactatttctatagaggtgagccgtctgtgcaggcccgtgatagctaccgacacaggggctctgcagctgcacgtggccccggctgctaggcatag

SEQ ID NO: 578271 - DNA, 329 bp, Homo sapiens
taagtgtgcaaagaaaaataacatgaacctagacttctgtatccagtaaaattatcttacacaaaatgaaacagaaataaagactttctcaaacaaaaattgagagaattcttcaccagaaagtttgtcttgctagaaatagataacagataatctttacgagagaaagaaaatgatttcagtcagaaatttggacctacataaggcaagaaagcacattacagaaggaataaatgaaggcaaaataaaatctttttcttattcctaactgacagacaacagtttgttcaaaacaaataatagcaacaatgtgtcagtgattacagctt

SEQ ID NO: 578272 - DNA, 229 bp, Homo sapiens
gctgtgatttacctttgtccgtttaaaagacttcacggagccattctgtatacaaggtgtgctctttccaatgtagaaggggttatggaaaagggtgcgatcctttgctgtaaactggagagaccagtcccaaacagaggggaatccttaccccttccaatcaaccaattggattgtcatgcttatatcaaattcatgcaacataagtaaataaatgtgtgcaaaacta

SEQ ID NO: 578273 - DNA, 376 bp, Homo sapiens
tgctctagaggtcccggaggaaccttcacaccccaggccttcaggaactgggggctttgccttgcagccacatggccccatcccagttggggaagcaggtgagctctgacccttgggcctgggctctgcccctcccaacccagccgtcgtctccctcgacagcgcccctgctgtcttccccaccgcccgtggtcccacctctcgagaggtgtgagggggtgatctaagagattctttacgccggtttctattgatttgggttaatcgtgtgatcgcggtgggtggcacgagattgaccaagcctggggttagtatagcttagttagactttcgtttatggctaaaggttaatcagtgcatgtttcccgtgttccca

SEQ ID NO: 578274 - DNA, 856 bp, Homo sapiens
cgtggtggcaggcgcctgtagtcccagccacttgggaggctgaggcaggagaatggtgtgaacctgggaggcagagcttgcagtgagccgagactacaccactgcactccagcctgggcaacagagtgagactctgtctccaaaaaaaaaaaaggaaacacaatattgggaacttagaggcgggacaagggattattttggaagaatggtttcaaagaattctggacttttaattaaaaaaagcccctcaaggctaaatagttccttggtactcatttggttataggcccaattgaaattttttaaagctttatgaaaaatcaccataaattatttctctataacttctctgctggttctaaatgtccataaggctataattaacttaattttatttgacggatttaaaaaataaatagtggccatgctttcggtgggccatttttaaaaacccaaaataaaataacttaaaatgctgtttagagaaatgtgtcctacatactattatggaagattcaggcaacaggtctaagtttaatagcatcctcaaatggaaaaagttaaataccgaatttattattaatttagaaatagacatggggtctcgtgcatgttggccaggctggatcgaactcctgggttccaagtgattctccacttggctcccatgtgtggtatcaggctgagagcacaaactggcaaaaagcaattaggcttaagtcaaatgttttgggaagaacaccagcaatggggaagcgtttccaagtttgaaaggaaggggttcagggggaccaagaaggaaccgtgtccggagtagtgacacgattgatgggagacggcaaaagggggggggtgg

SEQ ID NO: 578275 - DNA, 909 bp, Homo sapiens
atgtggaatatgactagcgggtgttcgggcagctctacagggagcactgtgaatgatggctgaggatctccgatgactctctggatgccaggggagcgtgatacgcgtgatagctcggaatctactggaaaagaagagatagactgtctcaggagtggtcttagtgaatgtggaggataagagagcgtagtgacggtgcattgcagacacaaagagctaagtaggttctagatatgaaactggaatatgggtactaggaaaagtttgtgtgggaattttacaagagaatataatatgacaggacatgatatactctggggttcatgttatctaggatttaacgtggaatagttggctcggttgtctctttggggtggagttcctatacttggtgttctgtgactgaagtaggtaaaacatttcagcgtattgggttcaccggtttaaacacctatatagttagggaattctaatattggaagtaggaaaggtaattcctatatcgatagaagatgaagagaaaaattgataaagacgagaatgtatgcataaaagaagtgagttgggagggtgaaaatggtagaaactgatatgtatacggaatgaccagtggaaccaagagatgtctactggaactgtgatatgataaggcgatatacgagacctatggactgtatggtacgagaatatatgaacaaaggacgtttgtataatggtggatgacgcattgtggggtacaatagtgagatttgaatggttcagaaagcattttaaaaaaagatgcatttgggcgcgtggattaattggacgggggtaccgtaaaagggcaatgtgttaatccattctaaaggaaaaggtaaaactttaatggaacaaaaggaattataggtttccaaatatggaacgaga

SEQ ID NO: 578276 - DNA, 1281 bp, Homo sapiens
  misc_feature (923)..(923): n is a, c, g, or t
agagagccctgagcagccccaccgtccgccgccggcctagttaccatcacacccctgtggatggatgcctgcagctgcccgatgccgggccccatgtcaccatcacctgcaagccattgatgcatgctgaggcctgatgacccatgcatgcctgcctgctgacccccccctgcgaccccgacccctcaatgacaggcacaagcactgacagccaggactgcgccctgggcaacatatccgcagagcaaacgcggccacgcacgcgcgcacgcccagagttggcgcccccgcagtgcctgctgacaatcaacacaatacagagcacgagccagccttagacaccgcgcattcgggacctaaaagacatcgcgtcacttccagcaacccgcacaactcgcctatccgcgccggtcaacgccaccctcacacgagcactggcgctatccaaacattgctcacacccgccaccaagcttcgagtaacttgcgcatgtaacacactacaacacacccacggagtcaccacctgcacatcaccctcacagccgcgcacgccgcacatcagctcactcagccagataaacacaaccacatacgaaactcttgtaccccagctcacaacaccggcaacacggacaactaaacgagcccacccaaccccaaggtagccacacagccggcaaccaccatatcacatggcacacgcagccgagcgcttccaccacagacaagcagacatagcgtacacggaccagacaacgatcaggaacgagcagcaccagtgccagccagacgaacgcatacggcagcaacagacggcaccacgacaccaagtcgcagaacaaccatgcagcgcatagccagccagcaccaggcacgcacagaccaacgcacacaaacaggatactagagcgcacaagagtntcacccatcacgcaagcagatcacaccgagtacccgagatcgctccgcagcaacacacaagcccagctgcaaccaagcagatctcagagacgcagggcacagcagacgcgcggacacagcagcccacagcagcatactgcgagccagcccgcgaagctcgcaacacacagactatcaaccaacctagtccagtctccaaatccaccaagctccgacaagaacagcgaaacagcaacacacacaacacacgacacacagccatcaccgatagcgcacagagcacacgcaagcgcagcagagacagacacgcacgcagaaagcacagacaactccgctctattacactctatcgccccac

SEQ ID NO: 578277 - DNA, 1584 bp, Homo sapiens
gtgtcggtttgagatcctctcccgtgttgttgagcgacgtgtggtggtgttggtgtccgcgcgtttatggtgtttggttggtgtgtggcggcgccatgttggtgtgcgagtggttgtgcctctgttctgggtttatccctgctgcgggcgccggttgtctgatggtgtgtgtcgcgcgcccccctgtgtgttgtggtttgaggcgggcctgtctggggcggttgtctcgttgggccttgtgcggtggtccaccagggcgcgggggtagtcccgtggtttctgtggggtggggggggggcgctcgcccatgggtgcaccacacagggtggggggtcacagacaatgaaggagtggcgttgtgtttccggagacttttctttcgggagtggcgcccccgaggattgtcgtgcgggacaaattcgcccaaggggtccacgagatatatttgggggggccaaccccgtttcgcccaggagacacgtggttcttaggagccaagagcagggccccgatacgaacatgttctaccacccaagatgtgtggttcccacagcgcgcggactcaggataaatgggcggtgtttttccccagagaagttttctttgttctcaaacacgatttgtgacacactcaagattgtggacgcccagagtctctcactcacgtccaggggaagatgtgcgcagaggacacagtgctgtgtcctcacagacgaccgaaaggccgcacgcgccacagtgggggggcacacccagggaaatggtctcacccccgcatagtctccctcagagactcctccatattgtgaattatttggagtgtttctgtcgcccgacgatatcttgtgtgtgaatagataaaacagtgttgtgatcatctctgataatactctcttgtcgcgcggaaatagtgttctggtttgtgggtgagactcttgtgggatatctcagtcctctccacactccgcgtgagatacacacctccccaagagttgttgtggaatgtcgcttttgtcggtgcgcgctgttatgtgagaagctcctcgatgatctctcttgtcactaagctgctcccacgagatggtttatctctcgtgcgctctactctcgctttgcgcgcgaccaacgctaggtataagagagaaagctccggtgttgtcttcacagagagagtttaagggtggagagtttggcttctatcacgccgccacagctgtttatagtgtcctcgagggagatttggaaagagaccacgcggctgtcgtggtggttctctgtggtgtgttgtttcgcttcttgtggccctgtttgtgtctttcgtgggcgtattcctcgcacgatgagcacccgctgtccacactgccaccacgcaccaaggcgcctcccccgccccctaccgcccccacacaccctttcccctcttgggctcggaacgggaaacacacacacgctgtgtggctccacaggaaggaaaaagctccaccctggagctgtggcaaccccggccgaagggtggagtcttgggatccatttttattaaaatcgagaccgttctgtggttataatttaccaatttaagggcaa

SEQ ID NO: 578278 - DNA, 408 bp, Homo sapiens
aaaatacttagagatgaatgaaaacgagagcagaaactaccagaatgtatgggatggagccaggttgtgctcaggtggaaattaacgtctgtaaacactgattttttgtagttcctcagtgtgatgatttggtttcacactcatgtgagatgtgcttttctcaaaccttcttacaaagtcagcgccttacccatctgacccccaaaaacacagtatggtcccccagttccacttgccgtttctcttgtcctgacagaaacgtagggttccttgaccgctctgtgacctagccagctactcgggaggctgaggtaggagaatcacttggatccaggaagctgaggttgcagtgagccgagactgagccactgcactccagcctgggtgacagaggtagattctgtttca

SEQ ID NO: 578279 - DNA, 182 bp, Homo sapiens
gcgagagagagcgagaagacaggaacatctgtgtggtacatggcactgatcccttctatgctacgcagacggagggagacagggggatgaatgctagcttggctgccctgctgatgggcaggctctgcgaggtcagcagacagaaatgaatgcctggtaaagagagaggcaggtatgtgcaa

SEQ ID NO: 578280 - DNA, 139 bp, Homo sapiens
agaggagcagagaggacacgaatgtggagtcaagaattcagactggggcaaaaggggggtctggggtggaagcaggctggggatgaataaggggagccacagcccccaggatgtcagcccagggtaggcaacctggact

SEQ ID NO: 578281 - DNA, 917 bp, Homo sapiens
atgcggccccaagggggtctctcgaagacatgccgtatagcaagagtcttgtaaggttctctgcgccaccctgggggacccgccagtggccccccacgggccgctgagttccccgccaaggggttcctcctcgtcccccctcgcctattagtgcccccgttcgccccattgggggtccacccccggtatccttcaaggcaacgctcctctggcttcagaagagtagtgtcccccgctcttgcgttgagcctgggcgcggcccctcttttctagacagctcggcgagacccgccctctattatgatggtctcctggcaacgagcccacacgtggggcaggaacttttctccgtagtatccccccggtggggctccatgtatcccgtcgtcggtgaaactagagccgccccccttgcccgcgggtgttccctcaacacaccggcgtgctaccaccaagcgtcccgtggacacggccgagcgatcccctcgacttgtcccccacgtaagagctcctaagagaggcctcacgagtatattcttctcccgccagtagcctcgccgccgcccccgccgcttctatagaccgcagggtgcggacaaagaccggtgttcttacgcactggttttcgtttcgcaacattggcgccactatgatagattcaactcatatcacaaaacttcgtgttacaacaaatccacacagcctctgtctctaacaccccaccaataagcaatacacaactattttttgtgacaccactccctggagtatttcatttctgcgagtggccacctcattattatatcgatgtttgtttgtataacaccgcacgttctgttacttgcgaaccacccgtggccccacatgttctttcccacacactttcggaccccctccaaaaattcacccacaagaca

SEQ ID NO: 578282 - DNA, 320 bp, Homo sapiens
gggaacccctctgagatttttcatcgagaaacaggcatcccatggctcttgctgtacacaacctcctttctttccctgaaatgaacagaagcatttcttagagggctctaccctatctctctctgatttttctctgactacatgatacccccaacagacctatacctacccctactctggctacaggtaaaaatccagtgggcagaacaaggagatgttaggcggtctgcctgtcagcatgttcctggtggaagaactggaggctgaagtattgcccacaattgtccctggatcacgttaaaagggccaccaggagtggc

SEQ ID NO: 578283 - DNA, 302 bp, Homo sapiens
ccctagctagagtctccgatacagaatctcccttttcaagatagtcccatcgaagagaggccaagccagtgttgaactccgatgtctcattcgatgatttggtcatagctttcggctgacctgaaattacccctgcctttaaaaaccttgcttgcagccattggagaggttctgtcttaagcgggagctgctcaattctccttgcttggcaccctgcatatgaaggcccttctttctcctgctgtagatatttctccctccatgtagatattttggctttactgtgctgggcaatcaagctt

SEQ ID NO: 578284 - DNA, 266 bp, Homo sapiens
  misc_feature (109)..(109): n is a, c, g, or t
  misc_feature (113)..(113): n is a, c, g, or t
  misc_feature (240)..(240): n is a, c, g, or t
gaggatgtgaagcaattttaattgttatctttagatggggtagtaggagtgtcttaagtatagggctgttttaccctttgggagctgttcggggctagcccttcagttntggntgtggcaggttccccatcttagctccctggatctccatagggagtgttcagggaccctcaatctccagggccacttctgcaggagctcgggttcgaggttccacgtggccagaagagctcaggtctntgagggctggtgtgcccggtcgacgc

SEQ ID NO: 578285 - DNA, 399 bp, Homo sapiens
  misc_feature (67)..(67): n is a, c, g, or t
  misc_feature (198)..(198): n is a, c, g, or t
  misc_feature (214)..(215): n is a, c, g, or t
  misc_feature (360)..(360): n is a, c, g, or t
  misc_feature (374)..(374): n is a, c, g, or t
ggcagttttctcgataccttcatccagggtgatgaccggctgataacctaactcttcctgcgcacgngtaatatccagcgtaaagtcaaaattcaacttggagacgccgtagtgggtcagcggcggctcttttgctgacttgcggcctaaacgctccatgctgcgggcgatcatatccagcatcgggtaggggcggancgaatacgacagtcannattcactcgtcgatcagcttctgcacgatgctgcgcagtgtgcgatgctcgccgttggtgatgttgtacacacgccggaaggtagcttatcgcaggcttcctggcttgccagccacattgcgtgcacggcattttcatagtaggncatatcgccagcgnactgccgccatgggtaacagatact

SEQ ID NO: 578286 - DNA, 1717 bp, Homo sapiens
cgcctgccgccacccctgcccgcccgacagcgccgccgcctgccccgccatgggctcgacaggaaggcagcctggctgatccacggcatggcgcgtgagtagcactggcttcacaaccagtactcaggcataacacagtgtcattgcatacccgagatccaggtggctgacattgcgacgccggtaagctgggcgcattggcgtcgcgcaacctcccgtcccgattaccccataccgcgctagcaattaggctcatctaggtggacatagcgattggaggtaaccattcccccaggcgctggcggtaccagccgcccaaaaggcgggccacttctgggcttgggcaccacatcccaaaggacacaccaggaggcggaaggaaccgaagccgacgccagaataccggaggcagctgtgtccggcgcgctataatattccgcccactttcccgaaggtccaaccgaaaggagtatccgaatacaatgagacacccaattggccgggcacaccacacaatttgtatcatgtggcggcaacaccactatgacttgaatgagaccccactttgggctcattacgcaaaagccctgaatcatcccctgttgggacgcgtatggccagcacccagaatgtatatccacccccaggtgatacgaccaagaaaggacttttaccccgagtgtcaaccggattatggggcgggcgatacccagcacacaaaaacgcggcagcgggtgacgcttattccgactgatttacccccgactttgtgtacgtggacagcgccaagggtgacccctacgcccagccctagaaagatagacactacccccgatatttaggggcccgaacaaagaaatagaacccggcagcacagacaccaggtattgtggtgatcacgcccacaccccaggcgggtgggagacttcggtgggcgcaacaacaacgcatcgcccgcagcatttttagaaccttactagatgcggggtcgacctacatccacagcaaactagtgttagcgtgactcttttagggggcccccccagatttagtatgattcccagcgccggcgaggttttggtgacaatggaggatcaccagcgatattacaccacaggagagaacaattattatgggcggctaaacaaccagtgagagacccaaagtcgcagcatacggcagactattttgcggcggcacggcgtatcaaaaaaagcatattttatcccggaaagaacagcaacacgacataggggaagagcacccccactcgctattattggggggggagcaccccaaacccccaacaaccgcccgtagaaaacacaagggttttatcaccccgagaggctgtttataaaagagacgccccgaagagagaacgacccgacgctacacatcgagcaccccccagtctttttgggtgtgcaaggggaggacaccccccacagcagagagagcccacctcaaagcacccgcggcggacaaacaaaaacagcctacgcaacgaggtggcgaccccccccacacgattttattggagcagcacaagatgagcacggggccgcgcaaaaaaaccgcggcggtgtgaccccacgcagcaccgcagactgttatttactatattacctccccgacaggtgtcttctacaatttggtacaggcctagcgacacacggggagcgactttttatgtcgtgcgcctccccccagaatt

SEQ ID NO: 578287 - DNA, 859 bp, Homo sapiens
  misc_feature (587)..(587): n is a, c, g, or t
agcggggtctcagtcgccggtgccagctctcgcactctgtttttccgccgcgtccgccgtcgcgtttctctgccggtcgcattggatagaatgatgatcgccgtgcatggtctattgtacaatggctccggcatgtgccaatagcatggtcttctgctgggggacgatgctccccgaagcccgtgtttccgttctcgatcgtcagggcgccccaagcagaccagaggcagtcgatggatgagcaattggcgccaaaacatgcaatcctcatgttggatcaaggagcgcccactaacaacgcgtggcatattcttgaccctgtagaagtcacccctaattggagcatggctatcgtcgacgaaaatctgggacgatcgatgtgatcacagatctggctcctacatcgcattcatacgatacagagacttgcagcgttggccctcgggagcgtagccacccgaagtgtctgtcgtgcatcccgagagaccccccttgaagcgcaccataggggacgaacgaaaaggaggaacgtatcgcatcgtccaggatgtttcctgcttttgaacgaacccttcaatcatcctccngggcctcttgatatcggattggccagatcgccgaggaccgtgtgcttgatctcccatcgtcctgccgtcttggggctgcatctcgagctggggcggtctgttccattgggagcttcgatgggatgacccggcggtcgagccctaacgagcaggtgtccacattctaacgacggtggctaaccgctctttccgcccccaccgtccagttcccatgcggttctggaacccctgggcctaggcgccgggaacctttgaaccagaaaataccgtca

SEQ ID NO: 578288 - DNA, 472 bp, Homo sapiens
gatccccgccgacgcggtgggttgttcatcttggtgttttgatgaccagttataaagtttggtgcacacaggcaccagccagagtctacgcgcctacgtcttaccccttctgacctagctcctcatgagcactgttcatctgctcgtagttctcacacccgtgagcctgtcgctagcgtgcatgaatttgtgcttgaaaaaatatgtatgttatttttgtctattttatcggccaatgaagggttccgtcgtgtttttatgtttctcaaataaatccctttaaaatatgtaaataggctgggcgaggtggctcattcctgtaatcccagcactttgtgaggccgaggcggctggatcacctgaggtcaggagttcgagactagccatgccaacatggtgatgcccagtctctactaaaaatacataaattagccaggcgtggtgacacatgcctgtaatcccaccccgtcgt

SEQ ID NO: 578289 - DNA, 342 bp, Homo sapiens
gggaggagctctcaagtacaagtacttcatctgaggctcctgaacaggccaggaaattggggagtctcaagtaggtgtcttggggaaagagagggaaggggcctgccctcgcttcaggggagctgggcgcccgttggcaggcctaacagacctctaaggcacagacttggagcaggagagagctatttcctggacttcagatgctgggtaaggagcagctggatgtgctcagatggggctcatttgaaaaggtgggggtaggaaagagggcagaagagagtaagctcgaccaacggtagccttaccctgcgggcaccattaaatgcaacccctggtgatcac

SEQ ID NO: 578290 - DNA, 453 bp, Homo sapiens
  misc_feature (188)..(188): n is a, c, g, or t
  misc_feature (197)..(197): n is a, c, g, or t
tatgaacattaatctgtaagatttctttagttgttttcaacaaaataatggataaaaggaggaacagtttctttattctgtagtttatattcacatagtaaatataaattagggagattcaacatattttacattgcacataattattctattaatattctataaactgtttatttttcctttggtangtacagatngggaagttgaacaaaatctgcatacaagaatttctaaaaatagaaaagactttctaaaatctgcatagaagagactttctaaaattacattttttctaaaaaactaaaatgcacttttcttctttaggaaagaatgacttttattcagtattcatctacagtttgccaagaaagtacttccttatccatttttcctttaatttggaagaaacattaagagctatagattaatttgcaagattaatttgcaaaatta

SEQ ID NO: 578291 - DNA, 167 bp, Homo sapiens
  misc_feature (22)..(22): n is a, c, g, or t
gttcttaaccgcgcgtcctttntgaccttccaagagtccagaaataaacgagagagtgtaaggtccttaactgaataaattaattaggtagttggagagtatcgtttataaactcttttgtttacatataagtctaagaataaaagtcatcccttcattcttcaacg

SEQ ID NO: 578292 - DNA, 366 bp, Homo sapiens
tgagcacccatatccgggccttgacaggagcatgagtgagcagctgcggggccagctgccggatctggactccaggctccgtgctgggagcgtcagagtttgattcatagcacaacctaagctaagcaatgaagggcacagtctgaaaatacctggagcaccgcctaaatgagatggagagaactcaggctcagttgagggatgctgtcaagagcctgctagtttactccaaggacgcgggggtcgttggagtcaaccccgagcccctcaaagcaccctgcctcactggagacacaacctgagctgcccatcctgcctcatcacacgtggtctgggagcagagagatagccatcttagggggggtg

SEQ ID NO: 578293 - DNA, 1449 bp, Homo sapiens
gaggaatgagacgtagcaggcacgagtcgtatttcatctccgctaccataatcatcgctatccccaccggcgtcgacagtagtttagcctgagctcgtccacacctccgacggcaagctagactatagtaagatgagtctgtcgtgcgatgatgctctgaataccctaaggattcattctatacttattcgaccgtgaaagttggcctgagctgcgcaagtagtagtctatgcagagagctctagtcatcgtaggacagtactgtgagctatcgactgatcacgatactagcgtttgtatgtcccactttaccaactatgtatccatatcaagtcaggacgctggatataatgtcactcattatggagggtcttccattgcatcgtggatgtttcctctcgtactatcgtcagggctaatgacctccatagattcaaagatcgtacgtgccatagataatccacttattcatctaatcgagtattcccatcgggcggtaccagatcgtaaactattgcggttcctcaacaagaagttgtctacgggagctaatgcccggaagattgcgcactgaccggttgagctccggaactaatcgcctgatttggcattaacagctaggattgaagaggcattccttattcatcttaggaggggttccttccactttcttcttaacagatcgagttgatcctcttcccatgtccatcttgtcccatagggaattgggaggacagccgttacagggtttcggacagaccggaaaacaagtctccttcaaatccaatctcaggcagaagacactccgtgtccgatatagaaaacgttgggccgtttgagatgcaaatattgaggatatgtgccccccaccatagatcggcgtattacccaaggagtcacttttcgcgagacggataagcccccgttatttaacaacattttaaagaagtccttaagagaccgacgccacacgggggaaggacgacatttctcggagaaagcgcccgcacaagaatgtgcgtggggtgattccaacagagccaaaaccgccggatgtgtgggcatccccccatgtcagcattcttgttctcccacaggagacgacagaaagaatcagagcacgacccaccccgggagaggggcacactacctaaatctaccgcggcggcgacgcccggcacagaaaacacaagcagacaagcgccattgccgacgacaacgtgctggcgcccacttagttgccaacaaacagcgagtgagttcgacagacaacaaccacgccagaaatcaatatcgagctgcgccaacacgcagcggggagaacagatcgacacaggcggcgacccccccaataaaaccgagggagcccggacaatacaacacctcgccacaaaaccacaaggaggtaacctgcaccataagatacagccagcgagcacaagcaaacag

SEQ ID NO: 578294 - DNA, 296 bp, Homo sapiens
tctagaggatccgacattgtgtctcagtgggtcaggactcaaaacatgaggaggctagcagcgaagtacagttctggatacgcagcctgtccccaagcttggcaagtggtagacaccaatgcccgtggctgaaggacaatatctgcatgagcctacaccttgccaggcttcacctggatgctttgacctgggcgatcgtggttgttctaaaagaactgtacaccctcctgaatgagaactatgtggaagattgattgaccaacattgtccgattagattattccccgggagtatct

SEQ ID NO: 578295 - DNA, 630 bp, Homo sapiens
taaggtttggagggggaatgctggaaatggtaatggggtatggggacttttcatataagtaatgctagggtgagtggtaggaatgtttttccataggaggtgtatgagtgggtcgtagcggaatcgggggtatgctgtccgaattcataagaacagggaggttaaagtagggtctgggtgacaaaatatgtggtgtagagttcaggggagagtgcgtcatatgtggtccctaggaagatggtagtggtgagggtgtttattataataatgttgggtgtatccggctatgaagaaatagggcgaaggggcctgcggcgtatccgatgttgaagcctgagactagtttcggactccccttcggcaaggtcgaagggggtccggtgggtctctgctagggtggagataactcatattatggccaagggtcatgatggcaggagtaatcccagaggtgtcctggtgtgggcgaccacgggtggacgaggttcaaaggagccccttattacgtcaggtggactagtagaacttgagggctcagggtgactccctttgagatggttggggctactgctcgcagtgcgccgaatcagggcgtagttcgagttgatgccacctgatcagaggctcgca

SEQ ID NO: 578296 - DNA, 504 bp, Homo sapiens
  misc_feature (94)..(94): n is a, c, g, or t
  misc_feature (122)..(122): n is a, c, g, or t
  misc_feature (139)..(139): n is a, c, g, or t
tgacccattcactggcagtgtgatctcagaactcatctcgatgaagtacttggccgggtcacgcggtgggtctctccgggctctggagtagcantctcaggagtagtgtagcgagcaaattnctgaaagtagtcctcantcttcgatttccccagcaggactttcccagcgagcagatcttgcttgttgaggaacaggatcacagagatgggtgctcagccatctgttgttccagatgctcttgaagaggttcagagcctcctgcagggcggttggtctggtttgtcctcccggatgaccatgttgtagctgctgctggccaccacgaagatgatggcagtcacatcgttgaagcactggatccacttgcggcgttcatcgcgctggccacccacgtcaaacatgtggaagttgactttgtccacctggaacttggtctcaaagattccagaagtcaggacacggcagcgaagcaggtcctgatcgctcggcacatagtcagcc

SEQ ID NO: 578297 - DNA, 173 bp, Homo sapiens
cttacggtgacggtggtgtgtgctgtagtcccatctactcaggcgctgcggtgggcaggcattgtttgcagtctagccatgggtaccatgcgcagaccctctctttttttttttttttttttttttttttttttttttttttttttttttttttttttttttttttttttttt

SEQ ID NO: 578298 - DNA, 356 bp, Homo sapiens
aacctctgaccgagtcaaatgatgttcagcacccctggccatcaatgaagactaacctgtctccactagagcagagcagggttgagagttctgtgattccagactaggcatgggactgtcagtcacgtcggagtgacggagttacagaaaaaaagaccatcagtccctctgtctcacatataggacttacgtgggatctctgtctctcaagcggggaaatgaggcaggagaatacggtcgggaggcaggaaagctaaggccggttcatgtctcattggatatcagaggctactcttcaacacccccttttgctgcgcgagagctgctggccctcctttcgctgcctggcggttgaa

SEQ ID NO: 578299 - DNA, 598 bp, Homo sapiens
  misc_feature (247)..(247): n is a, c, g, or t
gtagcgggggaagatggcggcggacgttccacagcgggcgtggaccgtggtagcagaatgcgcagtgagcagctgcccaataaggacattatcattaggtttctgcaggaacacggttcatatgcgtttctggcacgaacataaattattaggacacattcatgaatgtggccacaggactagttaattcaaggaccacatggtggtttacgacgcctataacctagtcattttgaaactaagcgtntgtaagggtcatctgataatgtaataaggtaacagtgttctgagtcaatggtaaataatatgtgaagcttaactggtgattgaccctgggaaagcatacgtctgagagtataccctgtgtatgagggtccaccaataactatgatctagtatggtgtttctgacagatacgggatgataacatcaactttcccaaaccctgggagatgttgtgcatcatgctggtattcgggaacgtctacaatgatgggactgttatgagatgactaatattcgaatgtagtgcaagaagagaaggatgtcgagcttgagtttaaaggtcggagtgggcattggtctgaggctgggatga

SEQ ID NO: 578300 - DNA, 144 bp, Homo sapiens
ggcttggtttttttcccaaaaaaaattttttggaggcgggggattccttttttaacccctgggccaacccaaagcaaagcgatttccaaagttttaactgttcggggttggcccccccgggaaccctttttttggttccctgta

SEQ ID NO: 578301 - DNA, 730 bp, Homo sapiens
gcacagccaacaagatgaacggagctttggatcagtcagaccaaccagtacccagatgccagtataagatgtttgtcggacagatcccaccggtcatggtcgcgaaaaggagctgatagaagttgttgagccttacggagccgtctagcagatcaagcgtctctccggtgatcggagtcaggaaccctgccgcgagtagtacacatggttgtggtattccagtataccagttttattagcaacgtacaagagcatgctaccttggaggcaccagacatgcatctgtcgacaagtattaaagactttagccgtgggtatgcagtcatgccgcgattcaggagtgagacatcgcctgcaagactatgctgagagaaggtctcaaggcgcctcgtgcgtagagaccatggataacatttgttccatgaggcacatcggtcatccgaagcaaggctggtaatgacgaacgactatctagtggtcgatgttctcctctcattatggcccagataggaagaatgcccgtgatccgtccggggtacctgatgggctgagtcgagggctagctcttcgaccgtatcgtggtgaagtttagctagacgactcaggaaggactagagagcaagaggtctgcctccgagtggagcgagcctcgactcaagtcagatgcaggtgagctcaacagtgccagctgggggtaacctgacgaggggctgggccggagctgacccca

SEQ ID NO: 578302 - DNA, 746 bp, Homo sapiens
  misc_feature (433)..(433): n is a, c, g, or t
ccctttatttttgttttataatcagaagtgctgttatattgacaagatagggtgtcacaaatacatcatttatagggaaagaggggacatgaacaagtccaaaatcttatactctgcacagaagcccagcagggatgtcctactctagagatggttacatcaagggtaccccatgagagggcagtctccggatgcagctagccgggaagagcatcgcacaccggttcctctccggggtctctccccagggtatggtacgagtctggcctggaagtaaacgaggtccctgatgcgctctttgcagtcaaccttggcaaaatagttctgggcttcatggaggttctcgatggcagcctccagagcttctgtttctccgggatgatcgtaggaagctgctgaagccacctgggcactgggccactaagaacatggngacgaccttgtgtccaggatagccccgtcagccaagatgggctcgattggccatgtggagaagacttaagggctgtctgggattccaagaatgagctgggcaaaagccaagttcagcactggtgtcagaggcaagtactgtaaccggaactcctggggaggaggggcaaagcctgaggagcatgggcaagcgcgatggtacggggacgaagatcggcagtaaggtctggccggacagttgggcctggtcccattctgggtctccacgttctgacatgggccccatttggggcaagctatgtgccctacattgg

SEQ ID NO: 578303 - DNA, 778 bp, Homo sapiens
taaaatcgtttttggttaaaaatctcttcttcctcaggagtcagttggctcccttcttgcggcccaggggcagcgcatagtgggactcgtaccactgtcggtacggtgtgctgtcagatgagcacgatgcaattcttcaccagggtctgtggtacagaaccagctcgtatattaagatgctttgtaagacaacatcgatgatccttgtttacacgagtacaaaactctgagccccaggagaaattccccagtgtccaacctcagggcacggtattccttgtaacctccccgaacacggactgtgtgaatgcggcgggggccaatcattggtgttggcagttgggcgccccaactcatacttccgctacttgtggaagggcttactcttgcccccggatattatgcggcagctatgtgccatttgtcccgagaaatgcccatcagattcggccgccaaaattgggccgagttcgcaccaaaaccgtgaaaaatggcggcccgggtcatcattaaaaaagtctctacaggcgcctgggcaaaggatcttccacaggaaacaagcgcgtgtgcgaggaagatcgccatatatccccagaaaaaagctccggaacaagaatagcagggtaccgtacaggcatcttgattaacgcgacattcacgaagaggccccgttacagaggtatctcccctcaagctgacggaacgaggagagagaaagggagacgaccattatggtcctgaaagtacaaactatgatccggaaatattgcgcgagacg

SEQ ID NO: 578304 - DNA, 475 bp, Homo sapiens
aaaagtgctcaccactataatgtaccatattatacctgatgatattgtataattattatggagtatctctaattaatatgatgtagaaacctgtatggcaccttctggaaactaccataaaaatgacactccattgaagtgctgaaaagctgatctcataagaattctactggacctagtgtacatgcagaacaagaaaacagaacaatcgtgaaaaaacactcaagaatgtgtattctagacaccaaaaactaaacacaatcccaatccttttttctgtacctcacgcgcataatttggcggccccaaattttttccccgggtaaagtgtgtttaatggactctaagttaattctttggccaatatataaaatggtaattggtaaacttaatttatcaagaaggtcatctttttaaattaatatttacccaattggtccactctaataaatttttccaaatacaggtttaaaat

SEQ ID NO: 578305 - DNA, 156 bp, Homo sapiens
tacattcctatatgggcataaaatctcatgtagtctccttgtagtcaaacctgttcatggtgtttctggagagattcactgtaggcatgacacacacacacacacacacacacacacagataaataccaaccaggaatagtgcggaatgaatgaaa

SEQ ID NO: 578306 - DNA, 156 bp, Homo sapiens
tatacctgcgaaggctgcacggacgccggcgttcggcccttacatcgtctgggcgctttagcgcgttagtcggctgcgtcactgcgtgactcgtcgacgtccagccggatcggaggagttgagaaccacgtgaggctcgttcgttaattgaactac

SEQ ID NO: 578307 - DNA, 956 bp, Homo sapiens
caaagataagaaatcagcttccatgaaataaagatcctgcacaaagccttggccctgtgaaaatgtctgaaagagaagtctattgactacttaatctacactacagttaaaggaacacccatatgcagagatgagaaagaaccaatacaagaactccagtaactcaagaactccagtaaatggccagagtgtcctgcgagtgactgtaccacttctgcaacaagaattcttaccaaggctgaactggctgaaatgacagaagtagaattcagaacgtggataggaatgaatatcattgagattcaggagtacagaaaaatccaatccaaggaaactaagaatcacaataaaacaatacaggaattgaaggacaaaattgctggtataaaaaagaacctaattaatctgacagagctgaataacacagtataagaatttcacagtgcaatcacaagtattaataacagaataaaccaggctgaggaaagaatctcagatcttgaagactggctgtctgaaataagatagacaaacataaaaaagagttaaaaggaatgaacaaaagcttcgagaagtatgggattatgtaaagaggctaaatctatgaatcattggtgtctttgaaagggagggagggaaagcatacgacttacagaacatatttcaggatattgtccatgaaaacttccccagcttttgctagagaggccaacagtcaaatttcaggaaatgcagagaactcctgaaagactctatacaagaagatcatccccaagacacataatcatcagattttccaagattgacatgaaacgacaacaatgtttaaggtaggtcatctgcaaaaggaaccccatcaggctaacagcggatctctcaggtgaaaaccctaaaagccagaagaagatgaaggagggcttaaaaatacttaaggaacacaatggttccaaccaaga

SEQ ID NO: 578308 - DNA, 371 bp, Homo sapiens
  misc_feature (53)..(53): n is a, c, g, or t
accctgctctggtcaggcctagctgttttcacattagcccatttctgggcttntggtgtctgtatcaaaaatcattatgttctggctgggcgcggtagctcacgcctgtaatctagcactttgggaggccgaggtgggcagatcacatgaggccaggagttcaagaccagcctggccaacatggtgaaaccctgtctctgctaaaaatacaaaaagtagctaggcgtggtggcacacacctgtaatgccagctactcaggaggctgaagcacgagaattgcttgaacccaggagacgaaggttgcagtgagctgagatcgagccactgcacttccacctgggtgacagagtgagagtgtctcaaaaaacaa

SEQ ID NO: 578309 - DNA, 1093 bp, Homo sapiens
gggtccctcagtactacacgcttggatcaccagtctgtggctggttgcctgactctgctaggcctaccatgctgattatggcaatctgtactatgagccatagcacgaggggaccgagcgagcgtaagggtcagatgtgcatagctccctgtgtggcagcggtatttggcagtgtggcatcgagccatgtgttccctttgatgtcgcagaccggcccatggatcgttcttcaagcgaatcaatgggaaacagaggtgaggctctctgaccgatcaatgccgcatgtcacccaagatggattgatccctagccagtgggcatgcactcccatgggtgagggagtgttgcgggtgtgcatgtctaaatgtcctgaagcgtggtggcgtgagagacagacgagcgatagatgtatggttggagcattgtacacgagggatgaggatggcgggcgagggataacatgagtgtcgagagtctgttggtgacctcatggcgtggaagttgtcctaaacaggcacagtgggctagaccgtggccggtccgtgtggatcgttggagaggcttgtggaccagatcgcccacgggtcgacgcacaaattccaaggtcacacccgtgccgcaccaatcctagcatatgggtagggcttgggaagaattccgtagtggagcccttgatacgttagtcatcacgggcgtaccaattccggcgcccctggttagcctggcaccacacgggggtgaatgcgttatcatacccgccgcacatgaactccgaagtggcaagcttccgtgaggtttgctaaggagaccagccaaagacggaagtttgttcctggagacaggggcacctccttcaattccaacgtgcggccatcgccctcctggaccttgagcgtagccattggaactcggtattttccccattcagtcggcaaagttgcgactcaggatcggggtgcgggagaaccaccagttggtgtgggtgaaccacattggctctggggatcaaaaagacagcgggttggcacaccattgcttgggtgccctagctgcggcagcactcttgtccttccctacccagtgggtgagagac

SEQ ID NO: 578310 - DNA, 522 bp, Homo sapiens
tgttctgacccaccgatggagccgctcgccctggggctgtcgattctgctgcttgttcctgacggagggctgcatctgggcagatgctgctcaggagccgacaggaattaacgcggagatcttgtactccgtgcccctagaactacggagccctgccgggccctacttctccgattagtactacgacaggtacacgcagagctgccgccagtttcgtgtacgggggctggctaggggcaacgcctaactaggtttctacacctgggaggcttgcgacgatgcttgctggaggatataaaacgttcccaaagttcgccggctgcaagtgagtgtggacgaacagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaattccatcattttgctacagtccaaaagatgaggg

SEQ ID NO: 578311 - DNA, 743 bp, Homo sapiens
  misc_feature (509)..(509): n is a, c, g, or t
  misc_feature (526)..(526): n is a, c, g, or t
  misc_feature (538)..(538): n is a, c, g, or t
  misc_feature (549)..(549): n is a, c, g, or t
  misc_feature (558)..(558): n is a, c, g, or t
  misc_feature (565)..(566): n is a, c, g, or t
  misc_feature (574)..(574): n is a, c, g, or t
  misc_feature (658)..(658): n is a, c, g, or t
  misc_feature (688)..(688): n is a, c, g, or t
ttcacagttatttcatgacatggcatggatatctcttgaggttcactcagcttattggattcatctgcttgtgtcttgcagcaagtttgagaaggtttcaggcactactgtagtccttttcacttttcatggtttccattttctgcagtaaaatggttagaaaatattaaatggagaactccagaaataatttataagcttgccattctgagtggagtgattacatttcatgttcttgtgctctgacctatctgagacatgaatcattcctccatccagcatatccatggtgtatatgctatccacctgttagtgacttcatagctattttgtttatcagatccactgtcatggtatcacagtgcttgtgttcaagtaacccttattttacttaataatgacctctaagtgcaagaaaaatgatagtagcaatttggttattccaaagaaaaacagtgaagtgcttctttaaaattctcaacttaataaaagaaacttatatgctgatngtgctaaaatttacggnaagaacacattntatatctgtanaatcattangaagganntataattngccaagttttgttgcgtacctcaaactgggtataagcccagtgcttggatagagcttaggaagatgaacaagcattcaggtttnggttgacttaaccggaccttgtatcatttntggccattggaacaatccccttagggtttaggcttcccctgaagatgtggccttt

SEQ ID NO: 578312 - DNA, 404 bp, Homo sapiens
gctagcctcccaagtagctgtgcatcaccatgccgtgactaatatgtgtatcgtttatagagacaggatttgcaccatgtggctcgggcggtctcgaactccggggctcaagcagttcattccaccgtggcctcccagagggctggcattacaggcatgagccaccgcatccggtgaaactaagggtttaaatctgtgcgtttttcaaggaaagagggagcaaatggtaaatgtacctaggctaaggggtaggggtataaaagtgagaaaatgaaatagggaaagttgaaattcaaggagaatgagttgaagactactggtataccgcatctcttctacacagtatattgatttctataggagaatttgtctcaggccttaaggatgctgtcgggatgctcgtg

SEQ ID NO: 578313 - DNA, 471 bp, Homo sapiens
ttgatttatttcttgttgattcctctagaaaacactgagcttttaactgttgagaaaactgtgaggcattcttctcagcgattccagtattgcctggttgaattgctaatcagtgcttctgtacattttgcatgattttgctagctttgccacaactgtccaaacataagtggggtggagatatcctgtctctcagcttggcaggttccttggtaggaaggggatgacttgccctaaccctccctgccaccagggggctcacctggggccctccacagctcatcccgctcatggggccacttcgccagtgagtgttcgcccattcatgggcaatgagggaggttgaggcatggagcagtgtgggcgatggatgggcaaagggcaggcatagggttgatgctgttacatgaaggggcaggttccacgttgttagtttggctgggccatcgattgattggtaagggaccagtt

SEQ ID NO: 578314 - DNA, 201 bp, Homo sapiens
  misc_feature (182)..(182): n is a, c, g, or t
accggttggctttccaaaccactttcttcctgtaattcttaatgttggctagttctccttcctcagaaaaattcccctaagaatctcctaatagtgagggtgtacttccgaatagaagagccttcggctgaaatggcatctccaatgcctacagttcgaatggggtctttacacaccaatanctggtgtgaagttctctta

SEQ ID NO: 578315 - DNA, 124 bp, Homo sapiens
ggaaggggtgttgtttgatagacattatctgtggctgggtctttctggctgatgagagacatgtagattatgtgaagcaagtggctagaagatgagagagaacatgagagagcagagtgctctc

SEQ ID NO: 578316 - DNA, 316 bp, Homo sapiens
  misc_feature (268)..(268): n is a, c, g, or t
ctcggcccctaatttttatttcattttgcatagttcctggtacttttagaagtgctaagaagtggatttgcaatgacccatgacaccgtagcacctcttaggcctttcgtaaagtatcatataaattatcaccagatagcttttgagagccaaatgtacttttattcccttttaaaacatgaggacatgaactacgcagttcggatatgtaaggaccatggttatcttccacagtgggcttgttcgagggatttgagtgttctccagngggaaaaaaaaatttgtttaggtgtttttagagatattctttggatct

SEQ ID NO: 578317 - DNA, 977 bp, Homo sapiens
gctccatctcaaaaaaaaaaaaaaaaaaaatttagccgggttttggtggcacacacttgtggggccccgtctacttaggaggtgggggcaggagaaattggcttggagcccaggagtttggaggctggcagtggagctatgatcatggccactggcactctaagcctggggtgatagaacaagacccggtctcttaaaaaaaaaaatttggtttttatgcaccgggtccaatggtgctaggtaactgggggaagaagattcttaaaaaattgtgttttatacacccagggtacaatggtggctaggtggctggggagaagaagatcggggataaaggcaagagacaaaatttcctggtgcctaatgggagcttggtgggtcctaaagggagggaaaaaagagggcccatacaacacaaacttttaaaacagagagagggacatttaccacagaggtttatggtggggatgggggaattgcagtctacaacacagagagaggaaaaatcaaaagcagggggaaagagtatgagaacacttccgtggacaagacacagctgagggcccagtggtctccaaattgaggacagtggcccgaggggacaatgtgcccccacagtgtgagacaagggggtgaaccaccacaaagagcacaagagaacctcaacgaggagacagggtgcacaggtgggtgacaaccacatttacagcgtttccactaagacaagggaaggcgacctgtgtttcacccacgaggtcaaaaggggggaccagaacgacagtgccgaaaggggccaaacgacagagggggaccacccacgacgcacggggttggtgcttagacacaaaaagaggacaggggggggacaccccaaagacgggctcaaagtgctgggaaaccacagtgtgctacgacacagaaaatataacccgcgatacaggagagggacttgtgaaaccaaaccaaaccgtggggag

SEQ ID NO: 578318 - DNA, 989 bp, Homo sapiens
  misc_feature (792)..(792): n is a, c, g, or t
gagaagaagacaacatgtggcaccgtttgcctcaagtacctgctgtttacctacaattgctgcttctgggtgaggaggggtcgactgccccgaggcagacggggtggaaccggcggtggtgcagggtgagtagacgttatgtgtactggttgtaccatgactgcgtctggactgctctataggctagagggcatctgaacgactaggtcctcatcaacgagtgactacaatcagcctgctggtgctcaggcaccatacctggccactagcctacatcctggtggtaggaagggcactgtcgtcactagagcgacatggggttatttgggctgccttggagccaccttcaaggagcagtcaggaacactgcatgaagccctggatcaaggagaggcagcagggaccaacgagaggtgtggggtggtagccagatggagacacacagaggagagttagtaccgatgcacggcataagaaacactgtggacttgaactagtactacaacatgaggagagagagagactccacggaccttcccacaacaagccctaagtcactgatgagagtcacccaacagttccatgacaggaaccgagctagaggagaaagacaacaaaacttacagacaagaaaaaacattcagggaagagaggtgtggcggcacgatcaagacccacaaccataggaaagccatgaggcgagcacgcgaggcatggaagaagacatgcgtctaaccactacaacgaaaggcaataaacgacactagtgacaccagtaacaaatggttcgcnccttgattgacaggagcacgaagaagacaagatgactagctacttaataatatatctgatgctggaagacacacgcgcatgagatattcgacatacacctacagtcaacaagataaggaggcgagagcaggcaaacaaagacaggacctcaaagtgaacggaacgcgactatacggagcagagatacaagtacacaa

SEQ ID NO: 578319 - DNA, 444 bp, Homo sapiens
cgatggaagggcgtgcctggaatatctggagctccccctcccgcgatgccaaagcccgcgtgcagcagttcgcatatgcagttcgagataccttcgccgaactcgcaatacgcgacggtcaatgcaagtttgcacaaaaaccgggtatcatactccgaattaaaaggcactgctccctgtatgtcttcccctgaaaatacgttattccatatccattcaatggctgtggagtcagcttcgtctggagcagaaaaaccgtaatctgccagttgtatcccagcgaccgtggtgcctgagacttttctcaccttcctacgcttgaacgactctttaaattccaacaatgagcagcttggatcggcattttcattgaaaaaatagtatgccctcgcattcgccgatacctgctttaaaacaatgggattgccgcccatgtaccagtaa

SEQ ID NO: 578320 - DNA, 431 bp, Homo sapiens
  misc_feature (248)..(248): n is a, c, g, or t
  misc_feature (274)..(274): n is a, c, g, or t
  misc_feature (277)..(277): n is a, c, g, or t
gaaggttttttaatgctcatagtgctgtacacatcttggtctgttctcatgggcatcttaggaaatgtttcccgagcaccggatccagccatctgtgtgggtgtctccaggctgtgataccgtgccctgctgttccctcatgctcgtgatgaaccatgtgctgggatcctctactgccagcttatctgtgggcctcctgcagcctcgcctgccaatgcataggccccaggttaccatccgttttgcgnagtttcccccccctctcctgggtgantcntgttaggtggcagcttctttattttccctctccaacctcaacgggtaggactccttatgtctctccagaattataaaacatatacatttatttacaagtgcataaatatataaatatggctataatagaaaaataaataccaattttctctgtc

SEQ ID NO: 578321 - DNA, 312 bp, Homo sapiens
gggacatgattgttaccgacgaaactactgtagagaatcaggaacttctgggaaatgtggtctcggtcacgactaaaacagaaacgcaaaacggtggactagtggcagttcataacaagtagaatgacatggtcagatctgtcatatccagatagacagctactgacagcagaggacacacaatctctggactcatccatcactctctcctgcaccctctttaccactttagccccacctggacagtatcaccgacggcccgcctggccccaagcccctgcactgcagcacagcttggtggtagagaaatga

SEQ ID NO: 578322 - DNA, 406 bp, Homo sapiens
ggggcagtgtagtgacatgcgtggtagcggctctggcccttctgcaggtcactggtctggatggcaactacaggatcacgtgccacacggtcagtggaagtgcttcgggaacacaaggacagcgtcatggccgtgctggaagccttcgtctatgaccccttactgaactggaggctgatggacagtgagtagctcgtgcctgagaactggagtctgcacctcccaacgtgggagtgttggcgtgctccgtgtctctgacctgtccccctcacacccggagcctgaggcgctgcccagccacctgcgttacattttcacagagcagctctggtggctggaaatgaactttgcaagtatttttattaactaagaaaactccaatcatgagttaggaggaggaggagga

SEQ ID NO: 578323 - DNA, 139 bp, Homo sapiens
catattaggggttaatatcagatgcggttccggattgttttttaccaaatcactttcacctgctacatgatcgggggtatacgtacggtgcaggtgctctgaaatctgtgagagcaaaccacagtttcatgcccatcgt

SEQ ID NO: 578324 - DNA, 954 bp, Homo sapiens
taattaactgaagtgtaggagctggataagtgaggagggtgtgagacgaacacggatagtgggcttccctaggataataatgccagcgaccatgtgattgtgatgatgatgacttgtgatatcgtataccttcttgctgtaatcaaaatactctgactatttcgcgaaatactgggaaggatgaaaggggcagggcgtcgtccactgtgcgtgataggagaacgagtcccgtggagtgtacgacccgcgatatctgaaggggtccattttcacgagccgaccagaaaccgtgcaggtaaaatagggcatactaaaggtggaacgcagcccgaggtagataatactacgtgttgccgcgtattggggcatagcggtggggcggtcgcgtggctgatgctctcgaagtcgggcttgccgccctgaggcctcccattatccaatctgtgggcagtgcgtagagggaaaaggcatgcctggctgttgggtgagtcagggcatgtgatgctttttcgctcagagcaatcttgctataagccttgtagcctggtaaggcggaggattctgtccaggatagaatcctagtagtaatgcaaaaacccagcttagagaccaaaatctggaggtcaggcgaggggaaagtgcgacggttgcctaaagtcataggtactgtttggtatggattgacctatgcgggtcgattgccctgcccctgctttatgccgggtcaaccgcatgaacttggctctaggatttcgcgtcactgcgctctccgacgtggggccggtggggaatctgggacagtaccggtctatgtcaaatggcaccttgggatccgagaaatacggcgaaaacaatgtgggtgtcccggaaaagagagaaaatttggcgcggggaatcaaatgggcggaacatatcccgtgtgaatcaaccgagagttgtccactattctctctt

SEQ ID NO: 578325 - DNA, 219 bp, Homo sapiens
gtcagaggatcccggatcggcgacatgtcaagaaatactcgaggtcagccgtatgtattgagatccttacaagcaaagctcggatgtgaggaaaaacaggtatcgccatcccgtgttaacaagattattaagatgcagaaacttcatatccatgcagttagagaggctgccaagggattccaacagctcgtttgactcttgtaccatccaatagcttag

SEQ ID NO: 578326 - DNA, 290 bp, Homo sapiens
gctcagtcaactgtgaacgttgcggagcagaatagggtagtgaggatacagaaatcgctgggtctcggcgtgaccgcttgtcgactcgccttatctgaatgttgtttgaacagttggctacattagattggacaaaactcagtgattggcacaagtgtagtctgtttacacctccacttgtcacgatatacagacaaacctttaggccaaacttaaatatataaggaggcagctttaggctaaacttgatttcaatacctgtattccaacactttgggaggccgaggcgg

SEQ ID NO: 578327 - DNA, 875 bp, Homo sapiens
gatccgctgcgcgagtgtctcggtcccacgtgtgcgagtgctacgatggacgtaaagggaaaaagcaattcacaggagagagtaacaaagacagacaagacaaaaaacagatttcataaaacatagtgatcctggttcttcaaagacttttccacacactggaacgttgctaacagacggtgccctaaagtcacatctaggacaccttggagaaagagtatcacaaaaattgtgggacccccacgggtgtaaaagcagttcaagaataacgcagcacggggacaaattcacccaagagaacaatattccagccggcaaatcacatttcaccaagaccgagaaatattccagccagatggtagaagcgatgaactcagcagccaatgaagcccaaactgggctgactttcacaaagagacgacagaagcgaagtggaagcaaagcagacaactccgtggataaacccaattatgacattgttggtccgggccacagcagtatgtgggacgatttcaacgcaaggacacacagaactggttcacaagacacgcaaaggaagatcgtgacccacaaacacttgttgctgggcgcgccttgcggcccttgggagacaggtttatcagtaacaccaaatttgggttgtgtgcgcgcgtcgtctccctgttgacgtagcgttgacgtgtgcgcatatagcgtggtcacaaaagaagcatccgggccagtgaccaagggtgtgtaggttcctcgccaaattaaaaagggccgggggaaaccccgaccgtgttcatgaaaccatccacatggagtgtcagcaggccaaacggggcttattcaacggggaccaagcgagactgatataatacccgggtgggggt

SEQ ID NO: 578328 - DNA, 357 bp, Homo sapiens
  misc_feature (22)..(22): n is a, c, g, or t
gggttttaaaaagcggcagaancaattcaactaaaggcccaaatcatgaagatacaaaaccgtacatgcaggcggtgtctggttagtcaaggctgattgcttcaactgtctagatatgtatgtgcagcctgaaactggctccttaaaaggaaagccgggtcagtcatcttggaacaacacatgacagtgtaaacagtaaatcggataattcgtttatgaagagacggtacatgttttaaaggtcggccttaagcttcagtaacattgtcatttagtgacctttagtagtcacacctgtaccctaacctgacaggaattaactactgtttttttgtggggcagacaagcagaaaccgg

SEQ ID NO: 578329 - DNA, 133 bp, Homo sapiens
ttgcgtgtgcactgtctaagtatcggatagaccagtggacaccagcctctatgaactgcatatccattagccagtgacacttctgtactctccagttagtcatgcctcagctcattgtcagttcagctcggtt

SEQ ID NO: 578330 - DNA, 172 bp, Homo sapiens
cattcacacacacacacacacacacacacacacacaaatgcaacacatttatctttatagtagaagttgcttctccaagtttgtttttttgtgtttggtttttttgtttgtttgtttgttttagagatggagttttactattgtcgcccaggctagagtgcaatgtcacaat

SEQ ID NO: 578331 - DNA, 384 bp, Homo sapiens
gacccgctccccataaggttcagttccgtatgcagctgcaccccagtcaggcgagtaagcggccaggatcagattgcatgtgactctgaagctgagctgaacttccagtggtcctctattaatgagcactggtccccgaatccgaacctcctcggtgaagcattcgaaacagaaccttgttatttctcagacttaggaacaatgcattgtatcgatgtgatgtaagtaggccatgagctctgtctcagtgtagatagttactccagtgccaacaatcctagtgctttccttttttaaaaatgcaaatcctatgtgattttaactctgtcttcacctgattcaactaaaaaaaaaaaagtattattttccaaaaggggcctcttg

SEQ ID NO: 578332 - DNA, 648 bp, Homo sapiens
gcgaggccccctggggacgcggtggccgccgaggcgctacacccgcaggccgcggcaaggccgtcccaggaggccccgggccaacgggacccggcgcgtgagacagcggcctctgtggcggcggcggagggaggcctggaccgggcgacgggagaagccttcgcctgcggaaccgttgtccggggttggggggctccagttcctccgaccgcccggtggcgctggggagggagggccagagccccggggaacgccgctgtggccttggcttcggtccccccatttgtggcccgcgccagctccatcccgggccagcccgggttcccctggtccccccttccccggagttctcctcaggttcatcgggcctcaccataaacccccagagtgggagattagcccgaccgaggccgggaacaccacggcacagaagcatgtgggaggaaggaggcatgacaccctggctgaaaacgagcgcgcaggggatagcacaaaagagctgggggtaccagtagggcccggagaaggccaaggacggaggcgaaccaggcgaatgagtgcgaggagaccaaaagagggagagaccaggcacatcagcggggcccagaaccagtggaggggagacccaacatccagggcacagctagg

SEQ ID NO: 578333 - DNA, 623 bp, Homo sapiens
tgccaagcagcatgtgcccgagcagcaccccaaggtacaagccaatgcttcgtgcgggctcgggtgaagaagctgctggcagcgggtgtggtgtcggccatggtgtgcatggtgaagacggagagccctgtgctgaccagttcctgcagagagctgcgtctccagggtcttcttggctttagtggaagaggtagaggaccgaggcactgtggttgcccagggaggcggcaggggcgctgatcccgctgtccctggaaggcacggacgtggggcagacaaaggcagccccaggcccttgccaaagctcaccatcacctccaagccggagatgaccttccctggcgagcggatctatcgaggtggtccgggccccgtcgtctccctgtttgcacctcaacgtgctcaggccttgcagaacttcgaggcgctcatggccctaacaaaacttggctgggattcaggcgaagaggcttccgggcaagaaaggatccttgacacgagaaagggctggtgccctatgagtagaaggctacattgtttgagggagcatgagatgatccgccgggcaggccacggagtgcattgtgtaacttggcatgaggcaaggacggttgcaggactct

SEQ ID NO: 578334 - DNA, 134 bp, Homo sapiens
ataccaggaattatccatctcctcgagatactagtttatgtgcataaagatgttcatagtagccactgaatgatcttgtgtatttttgtgatattggttgtagtatctcccattttgtttctaattgatcttat

SEQ ID NO: 578335 - DNA, 329 bp, Homo sapiens
agatgcactgtccatcgaaatcttatatagatccatatagggactatacaaatattttcatcaaagcattgtaagtgggggtgagaacaatagaggcaatcaggatattcgtcactgggagacaggacaggtaaaaacatggaggatatacagggtgtgaagcactatgctctaggtagcaacactctagagataggtggataaatactatcaaaattttactgagtacactcagggacaaccacaaaatgacatctgtagcaccaatactatataatgtaactataaaaaatacaaggtactcgccggttgtgcagcactcacacctg

SEQ ID NO: 578336 - DNA, 113 bp, Homo sapiens
atgtagccagcatcactgtgataccaaaatctggcaaacacacaacaccaccaccaccaaactgcatgccaacatcgtgataaacataggtgcgaaaaaccccaccaaatatt

SEQ ID NO: 578337 - DNA, 370 bp, Homo sapiens
  misc_feature (77)..(77): n is a, c, g, or t
  misc_feature (321)..(321): n is a, c, g, or t
  misc_feature (335)..(335): n is a, c, g, or t
  misc_feature (357)..(357): n is a, c, g, or t
gtgacgaaatcatctgcacaacaaatctctgtaacacgagtttacctatatagcaaacttgcacatgtacccctgancctaaaataaaagttaaaaaaacaaaacaaaacactgtctttttgggattttttggaggtttcattacaccgacataattgatgacatcattggccattggtgatcaactcaaccttcgggcccctcttccttctcaggaggtggtggggtggggctgaaagttccaaccctctcatcaccagattggttcccctggtaaccagcgccatcctgaggccaccctggttccccaccccggaccgnccccagccactagncatctcattagcatacaaatgncacttatcacttt

SEQ ID NO: 578338 - DNA, 280 bp, Homo sapiens
tttaaagaggtcctttataaccagtttaaaattacttcagtgcaatcctacacaggatcagcattagaattttgagattagccgtatgtcatcttccattctatttttatctgcttttagctgctagcttcaaactgccagtgtttttccttttgcttttaaaatagttacaatatttttcatgatagccacagtattgccacagagtattataagaaaggtgttttatttgacttagccgattcaaagcttttttctatcacttttgagctcagaatat

SEQ ID NO: 578339 - DNA, 392 bp, Homo sapiens
  misc_feature (9)..(9): n is a, c, g, or t
  misc_feature (42)..(42): n is a, c, g, or t
  misc_feature (113)..(113): n is a, c, g, or t
  misc_feature (115)..(115): n is a, c, g, or t
  misc_feature (117)..(117): n is a, c, g, or t
  misc_feature (156)..(156): n is a, c, g, or t
ccgaaaccngctggaaaacctaggacttttggaggcccatgngaagaaagagtcagtggtagagtttctttttggatttagctcataatgatggtcagattgggcaagtgggntncncgcagtggctcatacctgtaatcccagcatttgggaggnccgaggtaggcggatcacttgaggtcaggagttcgaaactagcctggccaacatggtgaaatcgcatctctactaaaatagaaaaattagccagatatggtggcacacgcctataatcccagctactcgggtggctgaggcacaagaattgcttaaatctgggaggcggaggttgcagtgagctgagattgagccactgcacttcagcctgggtgagacaatgagattctgtctcc

SEQ ID NO: 578340 - DNA, 291 bp, Homo sapiens
  misc_feature (152)..(152): n is a, c, g, or t
  misc_feature (159)..(159): n is a, c, g, or t
gcccagagagggggctccaacagtgcagcggcgggctgaagggctcctcaagcgcagccagagtggacgctgaggccgaggaggcgccaagagtgagcgagggctgccagcaccctgtcatctctcaggttttagctcagggctgctgtccnagcaccngctcttgcttggatactttcggtggtgtggctgctggttactgtattgcacgacaaatgtttttccctctttctgttagtttaatagcaatcttaagccacctaattggttttaaactaacaaaaaaaaaaa

SEQ ID NO: 578341 - DNA, 1031 bp, Homo sapiens
  misc_feature (1031)..(1031): n is a, c, g, or t
caggctccagtgtctatggaggttggcacggggagctgttagcctgagcgctcgagttcttggggttaaacgcagggggtgtatgcagtcggaggattacgtttacttggctctcaaggtgggaccgttgggtaagccggcttcagggtctctgaggtgaggggtcgttgatgaggacgagtacagtttaggagtaaggtcgctagatacatgtaagtagggtgttaaccgtccatcttatgtgggtcggccgttgtcttcggtgtcttccggttagattggtagtatcaagagttctgtgtgatgaagtagtttgaagtcatctcagggcaatgacaatttagagggaatgttagtttatctaatagaataattccattggcgagtgtcttgtcttcacggtccctgtatgtgtctgtgcaagaggtcctctactagtgcaggaaaaggttgatatagttgttagtattagaagtcaacttagctatagatatttgtgtgattgggaaaggtggagtgcccagagataaaggtctgtgtgctatggtccaaggagagtagtacaagggtcaccgcggtgaagtttcattataactagggaagaaatacttctagcgtttgtgagtgcacatgttaagtgtttaatccctacttgccatgaaaaacctagagaggggccattgatggaagtggggagtgtatattgcgagggtgcttgttgccgcattgcgcttaatgtattggcagtccctcgattttattcgcgtctgcgagttgcatgtttaaacgtccatccatggtagcctaaggcattacgtttgggggtacaacttctcctcgtggttgttggcctggcaccccttgggaatttgggccgaattgccccgtggtggtccgatataatacctcgtggtactttatcccttgcccgtgtgtgggcacggtctcgggttcccttgagaggggccttgcccgtgggaggaccttcgggaaattgcgcccgagctatggccccgtggggcgcgaacttn

SEQ ID NO: 578342 - DNA, 304 bp, Homo sapiens
ttaaaaaaaaatgaaaggttaagggattttttggggtttaaactagtccacccgttttgaacccaaggcccttttttatacccccccctttgtttgaaaggaccaagtaggcccggaattttttttgggcaaatccttgtttaacccgtccgggccttttggcaaaaaatggataacatttttcccttttttaaaccccccgggggttttgccttaagttttattttgaaaaattttgggtgttcccggtaatgccaaacccttttatttttttttttttggcaaaaaaatgggccatttggga

SEQ ID NO: 578343 - DNA, 331 bp, Homo sapiens
cttctgttgagatggagtctcactctgtcacccaggctggagtgcagtgtcgcgaccttggctcactgcaacctccacctcccaggttcaagcaattctccccacctcagcctccaaagtagctgggattacaggcatgcgcaaccatgcccagctaatttttgtaattttagtatagatgggttttcgcttactagaaatggggtgtttgccaggctggtcccgaactcctgacctcaggtgatccgtccacctaggtcttccaaagggcttggggtttcaggcttaagcctccaagcccggcctaccttgttctatatttccattctcc

SEQ ID NO: 578344 - DNA, 1394 bp, Homo sapiens
accacaaagacattggaacactatacctattattcggcgcatgagctggagtcctaggcacagctcataagccatccttatatcgagccgagactgggccagaacaggcaaaccttcataggtaacagaccacatcatacaacgtaaatcgtcacagcccatgacattatgtacatcaatcgttcttcgatagtcaatacccaatcatcaatcgagcaggcattatggccaacatgcacctcagatatcccactaatcaagtcggctgcccccagcatatggacgtttccgccgcccatacacgacacatacagcatatcatagcacatctatacacccacactcatctcctcactcctagcgtcgccatcgtgcatatacgtaggacggaccgcgagcagagaacacggatatagcaacagatacgtacacctcacctataggcaagggcacacatagatcgccaaacacatgagagacacatccgaacagacccgtacgaccactctatacatccattaacacacatagacacggatgatctcttacgtactcatttaggggaccactcacatagccatcagcacaccaactatatcccaagtacatcaaaaccacacctagaacataagaccaaatcaacaaacaccgccaccctactagacgctcttgaatcccgcaccatacattcacacacgcagtcactacctatactcacctactctcataccacaggataccttaagctagctagggcgaatccactaaaagcgaagcgcaaacgaggaaccggaacacgctacaacaacaacaagccagaacataacagaagcccccagaccaggagaaaggagcaagacagaacacacgcaatagacacatagacccaaacgacacctaatgaacaagagatacaagacgggaccaccctaggacgagacacatcacaacacaaacacccaaacacaggacataccgaccacaataaaccctcgcccacacacagagctcaccatacactaacacacggacaacgaacaaacaaaaacacacgcgcaatcaacaagaggcatagcagcagaccagcgacacaacaaacaggcacacaacaggcataacacacgcagcaacaccctaagaagcaaacaacagcaccggactcaacagagcaaacacaaagggaacaacgaatacacaaccgacgcagaaaaacaacagaaaccccaaccggaccacaccgactcaaagagaacagaagacaacagagacagaaaaacaagcgcgaaacgcaaacaccagagaaaccacatcaccagcggaccactacaactcaacaccacacatgaacaagaaataaggaaacagaaaaacacgaacatacagcgcagcagccc

SEQ ID NO: 578345 - DNA, 935 bp, Homo sapiens
taaccccccaaattgtttttttaaaaatgcccaaaacaacaaaaataaatcctttaagggtaataattttttttcctaaattttttatagtctaccttttaataattatttcgtcgtttcacaatattacaaaaaagggaagaaaaacatacagagggaagcagcacgacccatttattttttattatctataaaatcctattattagaataaataaagtcgtcataaataagagggcccattgatttatgggtgggtttgtggcaaccggtcttgggcctacttgctttgggagggtaatttgaccaccaggattccccctcaggaggaggtcccagttcaaccaggacgacactgggaccctcggtgttcttataaacacctgggggggggcagtgaaggccttatttattcacagcacaatctgctgtcgctttaatccaagcctactgttttcacccattttctagtaagcctctacctgcacgacacaccctttatgaccccccaatcacttgccttttctatttttgttaaaacccagcccatgaacccctaaaagggggccctctcaggcctcttttaatgacctccggctagccatgtgttttcttccccctcaataaggtcttcaaatattagggcttattatcccaaccttatccttatccattgtgcggcgatggtagaccgagaagcgctttctgggggcgcgccacacctcctgttcaaaggggctctgatggggaatattcctttttttcccccaagttttttctcgcgcggtatctttgcctttcatccggctaggcctccccccgagttggggtggctcgcggtgctcctgctttctacatgctccccaccgtgttcgtctggtaattactcgctcggtctattatagcccactccggtgttgtttctccactggcgcc

SEQ ID NO: 578346 - DNA, 653 bp, Homo sapiens
tgcaacctgccgattcctttctgtcactgtggcggtgttttgttgccagcgggacgtgtcactgcaagcaatcgttggtgttatcactggggcgccgcttgttctaccactggcccgtcgtgttccacagtgagctcaaacagcgttgccgtatgggggctccacctattactttcgagctacaatgcctggaagaatgcaagtggatgtctcggttgccccgtatggcatgtcctgcacattttcgtgcccctcattgcgtgacatagtgtacagtcaactgtagtgtcagattcagtcgtctgggtgttgtgcccacttttcgtggttcaatttacatcgtaggctcccacagcacacacctgccgccgacgcccgagccaccgcgcagcacgccctgctgtgccacctcactgcgccaggtcggatcaagtggcttttacctgggacctgcccagcttttgagaatctcttctcatccacccgtctggccacccagcctctgagggaagcgagggatggggcatagtgggagacctcagccaagagctgagggtaagggcaatggtaggcgtgaggctgtgacccttttcggaatgttttggttctgtttttcttaaaccgggcataaccccgtgagttcaagcttagtt

SEQ ID NO: 578347 - DNA, 1330 bp, Homo sapiens
  misc_feature (94)..(94): n is a, c, g, or t
agcggagtggtgcgtgttcagtcgtagcgcgcgtccgctggctcagctaacagccacagatgctgctgcgaatctgctggcttctttccgtcangatttgcgcgcagatggacgattaagagcactgacttcccgcagggcattattcatataatacataggttcctggagaagctagaacatagtgtaccaaggtacgtagaacgtattatcatagagacgatgttcccttgtaaattacttgagacttagccatcacaggggtaaacggacgttgcggaataacacagcagacgctagtggttgctcagtacacaccttaacgcacttcagtagtgcaccgaagtacttagaaaccactttgaccagaaacagacatcggtcgagacggcagcaattggtagctccactaaaggtgacgttacactacgctgtgcttcgtccatctttgcggtgcgaaacacgaccccgtggttggggaacggcatgcatgcacaaagtttgtacgcacttgttaactagcagcgcttaaggcttttgcacttcttaccttgtacgttggacgtttgtatgcttatgtggagctataccttggggattttatgctcacgcgctgtcatcttcccctatgagaatttagagaggggccttgtacaccacgtttcggactgttacaccacgaaaggtaacggttatggcttaccttcacttacgttagcgtacgccctttagacaaagaggatattacccaaaagattaggccgtatgtcactcttggaagagcgacgggaatgagttaagccttaaaaccaagttacggaccttacagctgggtaaaatggcactggggcacagttattaacgacacattcgccatcaacgggagcagattagataacagatcgtgataaaggcggcgcgtttttaaatgtaaagacgcgaaataataaaagataccacaatgatgcgcgccacaaaacatttatatcctacataaatgcgggagcgaacagacatacacaccaaggattttttgcgcccattaagttggcaagcataaacaaacgttccctcaaacattggcctttgcctctgtgggcacacacattcacacctctaggcggatcttttccctcaagtgaacattcaatttgttgacaaacgacttctgacttgagttacagcacacagcatatcactacggacacgcgacattccaagagtcgaatagagctatataagcgtctgcaaaccacttcacggctcttgcttaaacaggggacagcaaattagattaatgtcccaatgagggaggacacgaaagcacaca

SEQ ID NO: 578348 - DNA, 1206 bp, Homo sapiens
taaactgggtatttaatcttggattctccttcagccactcacccctgtgttctcatctttctggatcaacagtctttttctggcctcgggtcccctttctcgtcattctcttatagcgtcccctccaagccgtggggggcaggtgggtggtggagaagccacgaggccgtgagaattgtcatcgtggctcctccttccgtggcagcccagcaggagggcacgcagacagggggctgtgtgtctcacaacaccccacagacacgagaggcaagaacggggactcatatcatcactttacacccctcaccttatactccccgtgtccccacaggacctgggccaacattcagggggtgggcgcagatggggtcccaggatggcgctcacacctgaagcaaagtgtcacgaaaccatacacacagcaaccaagtcagcctactataacacttaacacttcacggggtacatcacagagagacaacaacgacagccagagtagacagacaacgcacacacaccacaagaaatcaagacagaaaagaaagaaccaaaagcaagaacacgcacaaccagaaagcaaaccgacacaaataagtgagagaaccgcaggaagaaactcagcagagaaagagacaaacaaaagaaggaacacagcaattggtaaacaaagagcgacacgacaggcgcgtggataaaacaaaaacaggacacgaaacatacgagaagagacagagaacgagcaaaagaacagcaccacaaagacaaaagaagaacacaagaccacgcgggcgacgccacacaaagggacacaacaacgacaggcacacaagcgcaaccgaagcaggccagaacaacagaccacacgagaggacaaacggggtagacacaaaccaggcgcagatgacggacgcgccgcaaacacacaacgacgggcagcgcagcaggacacacacacacgagcgagactcaaccaccgtgcccgataagaacaggcgaccatcgggatggcatgcaacgaagggcagagggagaaagcacagagcgagagaggagaggagaaagaggaggagtgacgcgaggaaacagcaaagcagaggacagggacgagagagcaaaagaaggaggaagaagacaaaggcaacaaagacaagagaggaggaagcgggggacgaacagcagagaggagagcacgaaaaggacacgggc

SEQ ID NO: 578349 - DNA, 352 bp, Homo sapiens
cacgagggtgtctgcaaggctgaagctgctcaaccctgaattagaagcagtgcagatattaatgtctgccacctcatgtatacagctgaagacaatcagggatggtgcagcctctctgatctaccgcgacctgtgtggaccctgcctcgttccatttgtgcatgttgatgataacggctttctaggatcagggtctatgatcggcatacctaccatcgaaatgattgcacaagagccctttggggtcacgcaacccatcattgatgctgtcaaggtatcacctgtttcctacctgaaggtttccaggagccctgtcctgcacacccataagaacgaggtcctgcgggtcgtg

SEQ ID NO: 578350 - DNA, 312 bp, Homo sapiens
ggcaggcgggagcagagggtgaggacttcaggaacttactattcaggaataaggaatgaatcagcagacctgggccagcaggttgggaagcataaatgttactgcctgtctcacccagttaatcagtctcggtactggtttcccttttggaaacaagtgtctgggttaactaattctgttttatggttgtgctaaattcatagcaggtgccttattcttggcttttagtcaaaccattccatatcagaattttcctgggtttactatagatatttggctttaagttgttgtttgtgttttttaatgtacaat

SEQ ID NO: 578351 - DNA, 762 bp, Homo sapiens
ttttttgttttgggtgggcactcatagttacagttcattacagtgaaagggatccagattaaaatcagcaatgaagaaaggcacataaggtaaggtccaagagaacttccaattatcctctccgggcagagtcttcaggataaggcttaattctcccagcaatgatgtgtggctacaaggatgtggtggcacagagttattaccaaccagagtagctcaccctaggcctaggtggttccagggcttttactaagggattggatccactatggggctatggcttcatctggcccactatgggttaacttaagtctcctcagtctggaccttgcaaggtcaagctggatactggctagggcccagggcccacaggtaaacaaaaacgactcttatcaggcaagatattctaatgggcttacgaggttatctcccacgagagccaggcaggggcctattctttattgggaatggtccagggcttcaaacatcccaagttcatccggtatcacacaaaagggattaacttcaaaagtgggtatccctgggccaggtgtgggggttcacaccggtaatcccagcacctggggagcgctgatgtggggaatggactggctgtgagaccaggatttcgacaccagcctggggcaacctagttgaggatcccatctctatcggaatttttctaacaacggggtattctaaagtcaggttactaccctgtatggatgacgggagagagaactgggaaacccctgtgtggta

SEQ ID NO: 578352 - DNA, 135 bp, Homo sapiens
  misc_feature (113)..(113): n is a, c, g, or t
tgtgggtctggaactcgagggacagagggctaaatcatgaagtttgtggatggcctgatgatcacaacggaagccctgttaactatacgttgacactctgttgcgccacgtgntgctcagacagggtgtgctggg

SEQ ID NO: 578353 - DNA, 197 bp, Homo sapiens
cccccaaaaggttttttaaaccctccccctttggggatttaatgttggggggccccccctgggtttcaaaaattaaaggggcaagggggctcccggggcaaaaaaaacccaaaaaaaaggggggggggtgttaccaatttttttcaaaaaccccccgggaaaagtttgtttttaaaaacattttggggtttttttta

SEQ ID NO: 578354 - DNA, 399 bp, Homo sapiens
ttagaggattggaatcgggaagcctggtagaagtcgcgggtccagatcattcatggaatcacggcatgatgcaggtagatattatacgggcgtgggagtactccacgcctagtctactcggaaggagaatggtattcttgctagcgatgctgtgaattggaggttccttgagcggtccacgcctggtcatcagctggcaggaggctctccaggcacacgcagcacacacagcacatgcaccacacgtagcacacacactgcatgcagcacacacacaccagaggacgcaccacacagagcacgcacagaacacaccacacagcgcacgcaccacacagagcacacgcggaacacacagcacacacagcgcacgcaccacgcagagcacccacggcataa

SEQ ID NO: 578355 - DNA, 272 bp, Homo sapiens
cgtgagctcttttcctcagtcatggccacagttgtatccatatagcatctcttaacatttcatctaggattatctagtcatagatcgttactatattgtggggctatgttgtatacaatgtaaacaagaccatatcttctctgcttatatgtgtgaatcataaagaaaagcatgaaattgcacgtcttcaagtacaacacaacatgggtgaatctgtctcatgtgctcccaggtgtccgtggcatggggctcccccagcaaagcccattcct

SEQ ID NO: 578356 - DNA, 299 bp, Homo sapiens
catgagctgtgaaaccatcaccacaatcaattttaaacatttccatcactctagaaagaaatcccatactcattagcagtcattccccatttcaccagtctcccagctctactttctatctctgcgggtttgcctattcttgatatctcatatagatggaatcatacaatacatatgtggtcttttatgactgatatctttcacttagcaagctttcattggtcatctatgttgtagcgtgtatcagtacatcatttcattatcaaataccaaacattccattgtatgaatataccaca

SEQ ID NO: 578357 - DNA, 789 bp, Homo sapiens
acctccgtctccgccgcttcacacccttctctttctttctctcttcagagagggttgtagggcaggcagagcatcccccgaggaggacggtcaggcctaacggactcctggagtccagggacctgccgtacggctggttagcggctaggatgcgccctgtctttcgtgggtagagccaacatgaggtgtcagcccgacccctctcaaggctgaggggcacaggggccgaaagtgtggccgcccctgggggtctgcgcctctttgtggagcccaggcctggggcccagaatctatctaccgccggggagccagaagatggaggaagctgttacccgttgccaatggccacctcttccaagccaaagcgcttttaacaggagagcgtactgcggtcagtgcagcgatgaggatattggcggccttcgcgaggcaccggttcaccggttgcatcaactgcaaactgctggtcaataagcgctgccacgggcctcgtccccgcttgacctgcaagggaagcaatatggcgcattctagtcaatgccttccccagagagcctccagtaagacgacaagaacgaggactgccgaaccttcctttcccgaggagaacagatgggaatggcttaacaatttcctcatcccgggacacaatggacagcattaaaagacgactcgaaggaccttaaagccagtaatcgaatgggattggatggcaatccaaagtctcctcaggggcctgggcgcctcaaggaacttgggccctaatcaaagccaatcgggccgcggaaa

SEQ ID NO: 578358 - DNA, 387 bp, Homo sapiens
aggactccaactacttggtaggctcagttgggtagatcctttgagcctaggagttcaaggctgcagtgagctatgactacgccaccgcactctaacctgggtgagatgactgagaccctgtctctaaaaaaaacaagatagtcctggcgtggtagctcacacctgtaattccagcactttgggaggccgaggcaggtgaattacttgaggccgggagttcgagaccagcctgatcaacatggcaaagcgcatatctactgaaaataccaaaattagccaagcgtggtggcgtgcgcttgtattcccagctactcaggaggctgagacatgagaattgctttaacccaggaggcagaggttgcagtgaactgagatcgagccactgta

SEQ ID NO: 578359 - DNA, 369 bp, Homo sapiens
cgggtggtgggcctccccaaagcaggggatggcagatatgagccactacacccagcccatttactttaatttttagccggggaaacatagtgagaacctgtctcttaaaaaaaaaaagggcttaaaataaacgggacacttttaagaggtatgtgggcccggatcatgggtttaagaagatagagcaaaactggagagttaaaccctagggttttttgggtgggtgggttgggtagggtttttaagctctgattctactagaagtagtcatgtcatctggggcaattctcttaaggtaccattggggaactgggttccctggtctatatgagagagtggatgataccttacaagtggtccgggggatca

SEQ ID NO: 578360 - DNA, 161 bp, Homo sapiens
cctgcctctgcgatcggctttacgcggtgcgtaagctgacagcccagccaatcagtgcactcccattctctaacctctgctgattggtattagggcgctgcgctgacacagctacagccactcagcaacagccgcatagtctaactctctgctgatctggc

SEQ ID NO: 578361 - DNA, 346 bp, Homo sapiens
ctgagctctgtgcttccccaatgtggagatgaagggggtattccccagggccccccagggacccccaggccgccatgccatctcagatgggcagacaggaggaccccccacagataggattcgcccttacctgcagaaataaggggggctgatcccatagtgggactgccgaatctacaggtggcctgagttcagactggttctacctccagggactagagtgactcctctggggaccccccaggaccgcgcgaagttgatagcaatccagaggactgccccctccttttggcttggctcctttcgcgttcctatggagaaccagcctttcgtcctccctccccgg

SEQ ID NO: 578362 - DNA, 382 bp, Homo sapiens
gagggaagctgcttactttggggggtagacctgaagcccctcctccttcccccacagatggggacaaggaggtaaatggggtcctcagaaccctgcagctcccacttctttagccgggcagcttttttgggggccaagatagggccaagggtcttttcttcttgctcccggcactggtcagggagtcttgggaagattggagaagagcaggtcaagcctcacatctcacatccacacctccaggaggggagacactggtaagtctctcctctcactcagggccttagacctttctcgactagacgatattccttctgggtagacagccaggtttagttggcgtctaccagctgcagcagctttccgcggggtcacgaggacg

SEQ ID NO: 578363 - DNA, 342 bp, Homo sapiens
  misc_feature (115)..(115): n is a, c, g, or t
  misc_feature (128)..(128): n is a, c, g, or t
  misc_feature (235)..(235): n is a, c, g, or t
  misc_feature (248)..(248): n is a, c, g, or t
  misc_feature (291)..(291): n is a, c, g, or t
  misc_feature (321)..(321): n is a, c, g, or t
cgtccccttttttccttcagaagattgtgacctgaggttgagtggtgctgctttcttaccatttagccgactcaagattgtatgccaacttcagcgacgtattttgaatattttntcttcacccttantcaatattattctggcccacccccacccaatgtgtatattacctaaactattttggttattcgtaatgtgtgtctcttgtagaactcgataccgagaaaccctcgcnaagaaagcaacgnagacatatgcacattgtttttaatcgagttttatttatttcgnaatttttttccaaatagtcattttccatgnataaataaatatatctaattg

SEQ ID NO: 578364 - DNA, 1125 bp, Homo sapiens
gatgactcagaggctgtgatcatggtagatgtgacaccctcctttctagtcctctcggaatgccctgtgcccttaccctagaccttggtgcgggctcccgctccttgcaacgtgatttccgacgactttccgtgtcccggtccggtcgcggtgagccccgcttcttgctctgtgggctacgtggacgatacccagttcgtgcgcttcgacaagcgacgccgctgagtccggtaggatggtgccgcgtggtcgccgatgaatgggagcaggagtggcgtcagatgtattcgggaccgggagacatcgcgtatgacgccagggacgaccgtacagattttcccgacgtagaaagcctgccgaggacgctgcgcgggcttacactacatatccagagcgaggcccggatctcatcgaccgcttgtcaggtggagtgcttctggtcttgcagtagcctaggaggccacgcaacgagtgtcgtcatttactctcccccaggtgtattgaaccacgatatccgcccttacagacggtccaaggatatatctccacccgctgaattgagagacttttgcgcgtcgcttgataccctgcggggtagaatcaacgagtcggggtccatgactcttccggaagctagagatagtccaacattgatagccttcttgagggccgtgagcacctgcactagtccataagccctttggggaaacaagaactagcaattggcatatcggaaggtttgagccttctcgaccaacaatttcgccttggagcaggacaacgggtgggcatgtggaggacacagtcgcggctaagccaaccctttgtatggcccctccaatatggaccacccacttttgcaccttcacccaaattgccaattgccttcttgacactagtggaaggcgccaacaccttgcaacagcgctcggaggcccctgggggttactaacccccttgcgggtaaattggatcactggcgcccgggcacaggacatcggacgctggggacggcgccagatccccaaggaacgaccgacggctccgtggaaaaaacacagggcctggcaaggggcatctggaacaccctctcagaaatcttgggcaccattctcatctgaatgc

SEQ ID NO: 578365 - DNA, 1842 bp, Homo sapiens
  misc_feature (705)..(705): n is a, c, g, or t
tggaaaaagccagctaatcttaattggtcctcggggggcagggggctcagaagccctcggggggggcggggtcccgtttcctctctttcaccatctcacagggctttcttggcttgcccaggatgtggcgcttggccctgtgcggattggcttgccatgtgcgcagggttgggggcgggcactgtgttctctgtgcgggactcagtggtgctctagatgccgtgcagtgagcgtgtgggggcggaaggcatctctcgtgtggtgagaagtgggtggctccgaaacatatagagagggtgtggacagtgttccccgaatgtggaccggagaaatctctcgcggtattaatgtgagccaccacagaaaaacagcctttttgtgcccgggcgagagaaaggggccgggagatcatcagaagggcccccacaagagctcttgaggcgggggagaaatctcaagcccccaggtgtagcacacgcgggagaaaggagaacatgtgcgcggggcgccctctccaaaaagtatcaaagtgggggggccccaaaagggcgccctgatagagcgctctgcgagataaatatcctccctgctctttgtagcgagctcagacggggagaaatctgtcgggagcagcgaagattctccctcagacgatacagagccacaatctccacaattttttcgcgagatgattatctgcgcganaaaacagcatattttggcgcggagggcgaggggatgcccccctctcaccaggagaagaagaggaaagagacagcacacataacgggtccctcccaaaaggagtatttaatatagatatgcaatattaagtataataagatgatgtctaaacagcagaattatacacaccagcagaatgtcgggtatatacaataatatccgcggacaggacaataccccaaacgaagtagttgtgttgatgtggtccccccaacagaagggcatcacccagagggggaggggaaataacaccccacataaaaaagagggacgccgcccaaatgtggtggtgcccccccgtggtgcctacccaacaaaaagcgcgtataggcatccccatactgttgaccaccatttgatgcgatcaccacccacccccggcgctgggaagacaatacggaccaacgagagggagactccaccccccaaagatagagggaggggaagcggcggcgtgataaagagcgggcgaaccaccccaaacgaaaaggtagggatcacccccgaggagggatgtgagtagagcggacccccaccaccatgggggagcgtgcaggagcaggagaaacaaccccagagcgaccgatcgggaggggcgcacaaccaacagaggagcaggagaaacaaacacacagcgactgtcgggtggacacaaagagggaggagcgcccccccaccatggtctcaccagagacgtacagacgaggacatccacagggcgggctccgtcaacaagaagacccactattgcggctgtggagaacaagccgagcagaaaaacaacagccgccgcggggggggcagaacaacaccaaacgaacgcgcggcgataaaggaaaccccccccttgtatgtagtacacccgcgcggcgaacaaaaacaggcgcggggcccccacatgatcaaaaagagaggaagggcggacccccctcatcgatagaagaagagcacacgccaagcaaacaccaaacaaggcgagagtataaccgccgcctgggacaccacaagacgatggagactgaaggaagcaagcgtagagcacccataccaccacagaggagacagcggcaacgcaaccacgcagacagggaagtagct

SEQ ID NO: 578366 - DNA, 217 bp, Homo sapiens
actcctgcggataaaattgtgtgatttttcagttgatgcactctttctacacacacacacacacacacacacacaccatttatacacgaaagaaatctggagaatatatgtgggaatggatataaagtgtgtggcaccatggtggaagtaacacaaagtcggagtacgctatatttattaatgctaggcccactacaacagagtattctggtacttc

SEQ ID NO: 578367 - DNA, 500 bp, Homo sapiens
  misc_feature (25)..(25): n is a, c, g, or t
caacgatggtcctctagctacctgngaaggtgaggtgtgagaatcgcttgaacctgggaggcagagggtgcagtgagcctagatcatgccattgcactccagcctggaagccagggcaagaccctgtctcaaaaaaaaaaaaaaaaaaaaaaaatttggttaaaaaattaacttttttttaggtttttttatttctctcttaaatttaacaggattcaggagaattattatttaaagagagggcctatcacattatgaaaggggggttaacctacaggggattataaactttaacagtttattatctcagagaataccggagaataaacggggggggaatttttttcccgtgtaaaaggggagattaaggggaaggagaatgtgagagtataattgagaggggggagaaaaagaagagcaaggtgtcaaactgggaagatgtgcaaaagacaaccacatttaaggtttgggacaataagcctccaaagattaaaattaca

SEQ ID NO: 578368 - DNA, 1790 bp, Homo sapiens
  misc_feature (1712)..(1712): n is a, c, g, or t
  misc_feature (1724)..(1724): n is a, c, g, or t
cgggggagccagtcagtttccggccaaggcagcagggagaaagacaaaaaaaacggtgggatttatttaacatgatcttggcaaacgtcttctgcctcttcttctttctagacgagaccctccgctctttggccagcccttcctccctgcagggccccgagctccacggctggcgccccccagtggactgtgtccgggccaatgagctgtgtgccgccgaatccaactgcagctctcgctaccgcactctgcggcagtgcctggcaggccgcgaccgcaacaccatgctggccaacaaggagtgccaggcggccttggaggtcttgcaggagagcccgctgtacgactgccgctgcaagcggggcatgaagaaggagctgcagtgtctgcagatctactggagcatccacctggggctgaccgagggtgaggagttctacgaagcctccccctatgagccggtgacctcccgcctctcggacatcttcaggcttgcttcaatcttctcagggacaggggcagacccggtggtcagcgccaagagcaaccattgcctggatgctgccaaggcctgcaacctgaatgacaactgcaagaagctgcgctcctcctacatctccatctgcaaccgcgagatctcgcccaccgagcgctgcaaccgccgcaagtgccacaaggccctgcgccagttcttcgaccgggtgcccagcgagtacacctaccgcatgctcttctgctcctgccaagaccaggcgtgcgctgagcgccgccggcaaaccatcctgcccagctgctcctatgaggacaaggagaagcccaactgcctggacctgcgtggcgtgtgccggactgaccacctgtgtcggtcccggctggccgacttccatgccaattgtcgagcctcctaccagacggtcaccagctgccctgcggacaattaccaggcgtgtctgggctcttatgctggcatgattgggtttgacatgacacctaactatgtggactccagccccactggcatcgtggtgtccccctggtgcagctgtcgtggcagcgggaacatggaggaggagtgtgagaagttcctcagggacttcaccgagaacccatgcctccggaacgccatccaggcctttggcaacggcacggacgtgaacgtgtccccaaaaggcccctcgttccaggccacccaggcccctcgggtggagaagacgccttctttgccagatgacctcagtgacagtaccagcttggggaccagtgtcatcaccacctgcacgtctgtccaggagcaggggctgaaggccaacaactccaaagagttaagcatgtgcttcacagagctcacgacaaatatcatcccagggagtaacaaggtgatcaaacctaactcaggccccagcagagccagaccgtcggctgccttgaccgtgctgtctgtcctgatgctgaaacaggccttgtaggctgtgggaaccgagtcagaatatttttgaaagctacgcagacaagaacagccgcctgacgaaatggaaacacacacagacacacacacaccttgcaaaaaaaaaattgtttttcccaccttgtcgctgaacctgtctcctcccaggtttcttctctggagaagtttttgtaaaccaaacagacaagcaggcaggcagcctgagagctggcccaggggtcccctggcaggggaaactctggtgccngggagggcacgnggctctagaaatgcccttcactttctcctggtgtttttttttttggacccttctgaagcaaagacc

SEQ ID NO: 578369 - DNA, 422 bp, Homo sapiens
ggcggaccttcatctcctcccactcatcagtatcctcttaataataaatggaaccaccatcaaccaactgctcaagtcaaaaaaccaaagagtcagccaggtgcggtggctcatgcctgtaatcccaacattttgggaggccgaggcgggtggatcacctgaggtcaggagttcgagaccagcctggtcaacatggtgaaaccccgtctctactaaaaatacaaaaaaaattagctgggcacggtggcagatgcacataattccagctacttgggaggctgaggcaggagaatcacttgaactcgggaggcggaggtttcagagagccaagatcatgccatggcacttcagcctgggcaacaagagcaaaactccgtctcacaaagaaaaaaaaaggccaggcgcggtggctcacacctgta

SEQ ID NO: 578370 - DNA, 774 bp, Homo sapiens
ggttctttttcgtccttttccccggttgctgcttgttgtcctggtccgcgccagagcccagcgcgcctcgtcgcccatgcctcggcaaacattgaggcaacatcaaggacttcctgctcacagcccgacgaaaggatgccaaatctgtcaagaatcaagaaaaaatagggacaacgtgaagtataaacagtccgatgcaagcagatacctttacacccttggtcatcacttgacaaaacgagaaggcacgagaaactgaaggcagtccctgccccccgggttttgggccattgacacggacttgacactgacacccagacaacatctggatttggcacacctgcgtattcatatctcaacacttaccttaaaaaattcctttaaaacacaacaaatcatcacacatcacactacacacaatacaccaatcaccctttgtgtacgcgaacaccacatctgtcgatcatcgagagaaaaaaatttccgaaccacacacatgcggcatcatgacagcgccagcgtccctccagcttgattcattcaaacataagacaaccattgtggtccccaaatacgaacggtgttaaccaacacaagagagaaaaatcccatgagtggctactcagtgatacaaaagagcgactagcggaaatacatgcaccaacccaaagatgaagagaagcataaggtacgcgagatcgagacaacaaccgagacacgcagctagcgcgaaccacacatacactctcccaaagatgatgcgactatcatgga

SEQ ID NO: 578371 - DNA, 170 bp, Homo sapiens
accggtagagcggtctacccctgcagcgtatggaagttcccagctagggtcaaatcggagctgtagccgccggcctacaccacagccacagcaacgtcggatccgagctgcatctgcaacctacaccccagctcccggcaacgctggatcctcaaccagaccgctctacg

SEQ ID NO: 578372 - DNA, 356 bp, Homo sapiens
cggcacgagggtgaatttcaggtctgggttatcaatgacctaaattgagaaaatagaggggctgtgtggacaaggagagagaagagagcatacagctgccctatgccgttgctctgttcacagtgaggattgagccattctaatccccttggattttttatctaccaaaacagcttgggcccatcagcaaattgcagtggcatatggtccaggtttacgagtaatctggcacatgattaaggcaagggggatgtcatctttcagcaaatactgaaaatattgtagaagaatttggtagagtttttaaattcaaactgataaaattgtaactattaaatacttccccaaatcaaaaa

SEQ ID NO: 578373 - DNA, 349 bp, Homo sapiens
  misc_feature (21)..(23): n is a, c, g, or t
  misc_feature (69)..(73): n is a, c, g, or t
  misc_feature (79)..(80): n is a, c, g, or t
  misc_feature (103)..(103): n is a, c, g, or t
  misc_feature (106)..(106): n is a, c, g, or t
  misc_feature (108)..(108): n is a, c, g, or t
  misc_feature (199)..(199): n is a, c, g, or t
  misc_feature (201)..(201): n is a, c, g, or t
  misc_feature (203)..(203): n is a, c, g, or t
  misc_feature (210)..(214): n is a, c, g, or t
  misc_feature (221)..(221): n is a, c, g, or t
  misc_feature (223)..(223): n is a, c, g, or t
  misc_feature (229)..(229): n is a, c, g, or t
  misc_feature (245)..(247): n is a, c, g, or t
  misc_feature (258)..(258): n is a, c, g, or t
  misc_feature (267)..(267): n is a, c, g, or t
  misc_feature (290)..(290): n is a, c, g, or t
  misc_feature (309)..(311): n is a, c, g, or t
  misc_feature (317)..(320): n is a, c, g, or t
  misc_feature (327)..(327): n is a, c, g, or t
  misc_feature (335)..(336): n is a, c, g, or t
ccgacccgctgctagtgcctnnncccccaaaggaaccaccgcctccaccggtccctcggcctcctgtcnnnnnccctgnncccctgccggccactcccagtcngcnanccccaccccagccccagctgcagcttcgggtctcacccttcggcctccgcacttctccatatggcagcagcctggacctcagcactggcancncntcacggnnnnnccccaangncccggncccccccggggcacannnccccccctcancaacctctncgtcctcctcctcctcatctacntcctcctcgtccgcgcagnnncccacnnnnccccgangccctcanngcccctgcctttg

SEQ ID NO: 578374 - DNA, 619 bp, Homo sapiens
  misc_feature (311)..(311): n is a, c, g, or t
  misc_feature (364)..(364): n is a, c, g, or t
atttatattaccggatggggggggtgaaaaattataaccaatcactaacatagcagggattaacccctataccttttgaataatgaatcaactagaaataacttttcaaggagagcacaatctaagacccccgcaaccagtccagctacctatgaacagctatttttgcggggggggctatataacaaactacaccaaaaaaaaatagccacaagctacaaacctacttagcctgtttatagctatttttacaagatagaatctaatctcaactacaaaaatgcccacacaaccctctaaatacacttttnaaattaaatgatagggcaaacagcttcagctctttccacactaggaaaaaacntaaacgtaagcgccaaaaacttaacccttgttatacactaaaaggtgacaccaaataaataagaattcaatctcaccccccctacaaaaaagaatcatcaaaaaaccaatagaaaacttctctatcactccagatcctccccttttattttaacctttaatatcttcttccccattcttccttaatttccaagtcatccctacggacatcccctctttctttcctctctatatctaacactcttctccgatatca

SEQ ID NO: 578375 - DNA, 340 bp, Homo sapiens
gggtgagcttgagatcgtgccatggcactccagcgtgggaataagagcaaaactccatctcaaaggaaaaaaaacaaagaagtaatacagaagagaagatttccacgtcccggttctagggcgtagctaatgggcttcggcacgggatctgccatctccaccttctctctgcacaagggggcgtctaggcagggctctggagagtgtatgaacagctgcaccatgtgctctcggacttcctttcctcgcattggttctggcgtctttccagggcatctctgcaggagcctggtactcctagctcaccatcctgatcacgtaatctccttggtgcctctga

SEQ ID NO: 578376 - DNA, 225 bp, Homo sapiens
tgtatgcccaacactctgcctcttacaagtcaatgactaagtttatcacagcttttaaaaacaggaatggcttgctccctgacatctacacaataccggcacaaggttcccattaaactagcaagtcggaaaacttggaaggaaggagaagaaacaacaggacttacgagccgctgagttgttaacagcatggactagctgtgcaatggtgttgggcgataaata

SEQ ID NO: 578377 - DNA, 658 bp, Homo sapiens
gatcaaggaagtgtgtgtaagcccctgtctggtgtcctaccctcggtgtagaagagcgggaaaggtatctgatagtatctgtatagaggccctgtgcggattaagtcaaggagagcaggcccctaagtgggctgcagtcagcatgcgcctctcgtcactccccctagtaaggttagcactcacctacctatcacctatccactcagagtcgtccataaggccccacagtgccagctgcttccacctcctgcccacctaccttcctacctgagcccgtagagactccgaggtacccctaccagcccccctgagccccaggacttgagcagcagcgtctgcaaagaggagcaagatgcccagaggaggctcactggagagcgtacggctagcaccaaggagccagcctaagactcagccctgacggttgccatccgccgccacggccgcagaaaagtacaaacaccgaggggagggagagcgcaaagacattgtttcatcctccatgccaacggccaaacagagaggagcctgtggacagcccgacgcccgtgaccgagagagttagctgacttactacggagcaggaatgcaaagcaaaccaacaagaataaaggcagctgttgtctttactcccttaggggtagggctcgtggaacca

SEQ ID NO: 578378 - DNA, 351 bp, Homo sapiens
aggtcgcaacttatattaaaagtactttcaccacatcttgctttatgctcccagcgaaccctatggggagggtgggtctggaatacatccaggatccacggtaaaacacagttatccagaaccctaggaaaccagccattcaaggttcatcatctggcgtcaatgagcacatcctatgtgtcagacactgcgcttccaggatagaaagagaattgatggacacggccttggggactcgaacttggacagccgggttttaagagcagacacacatgaatgcatcttctggcttttttttcccgaaaaaaagatgcaccctggaatgctaccttcctaaactgtaggaaccca

SEQ ID NO: 578379 - DNA, 1113 bp, Homo sapiens
  misc_feature (1)..(1): n is a, c, g, or t
ncctttgacacaccacaattggggtctgtggggttttttgccaagcccctctctcccaaattctctacccagtttttcccgcccgttcctcaaagaagcctttcgccccctattgccgtctaaacttctcaaacccatggagcccacataagtaactcccacatgtgggttaccctccgtcctttgaagaaaacccacacttgacaagaagcctgcttgaactctttccacggtaacagaacgaaagttgggatcaattttgcctaaaatacttcactggaccccaggttcttaaaagaggctttcccgacttctcttccgagtcccaccccacggtccctggggccccccggggaagggtaattccccagaaaagggagcttcccagggacctctcttttcttccaggatatgccccccggatcaaagaggagagtgtgtgccctttttatagtccacaagagagagaaatatgtataggaggggaatagtatctttccccaggaactacccgccagtgtattggtctcttctctgttggcacaataggtataaaagtggaaaccccctgttttggagatggggcaccacagaaaagggaaggaacacttgttttgccagaagccaggcgtttctgtaagcccaccctggttatacgccacaatatgcgtcccctgcgtggcccgtgttctcagctctcccaaggcccagtccagagctggatctctccctcccagaaaggttccaggaataacatgcgtaccggaccaacacatcccatttctatgtaaagccctttccagaagattgtggttttctttttataaaagactgatagtttctggagcgatagaaagccaattactgaatatggttatataaggaagccaccaagttggctcaaaggccaaagatgttttttttgacccagatgaagaaatttgttgagtggttcaccaaaatagccagaagaagaatccgatatccggaaggtgaggaaaattaaatggcgtccaacaagccaccaataccttagggtacccaccacgaccccatttttgattgggaatgctgaaccctttgagaagagaaacttggcttctgtttttccca

SEQ ID NO: 578380 - DNA, 225 bp, Homo sapiens
  misc_feature (26)..(26): n is a, c, g, or t
tgtaatagtcaaatttagtttatttnttcatgccatgtgagagtacatagagtatctttaaaatgaaggcaaacaaaggattaatttaataacactatatatagaaaacattgctgatgttggagatggctcaagaatatttttcagatcttcgaattaggcgatgcctcctactgcgagctgatatgtagtattttcgggggcaaacacacactctcaggatga

SEQ ID NO: 578381 - DNA, 473 bp, Homo sapiens
agaagttcatttttattcagcaagaatttttagggtctattccatagagaccaataactccattcgttctaagtaaatgtctcggacagataacccaccaaaatctgcagtctgtgtggccctcaaacatttccatgctctgtatctgtgctgcagggggcgctattctcaggaaccacaggcttatctggctcatagtacttatcgactataacaattgctggctacaagcctgctactgggatgtcttgcacaaccataaccgtaaaacttagcgtttgattggtcacctgctccacataaatgaggacacgggtgttgctcacttatgtacggctcacagagctggatctttcaggcattgttactgttggattcaggggaataaaaccggatgccatctttacatatacagtcaccatattggccgcatgacggtttactgtgcaactgatggtcagtgacatccgaaa

SEQ ID NO: 578382 - DNA, 909 bp, Homo sapiens
  misc_feature (897)..(897): n is a, c, g, or t
attctagaggccgaggcgggtggatcaactgtggtcaggagtttgagatcagccaggccaacctggtgaaaccccgtctctactaaaaatacaaaaattagctgggcgtgatggtgggcgcctgtaatcccagctacttgggaggctgaggcaggagaatcacttgaacccgggaggcggaggttgcagtgagccgagatcgcaccattgcactccagtctgggcaacagagtgagattccgtctcaaaaaaaaaaaggaaagggaaacaaaaattagctttatacctcttccttgtttcaaccgcctgggaaaattctgaacatctcccaaatcccgttgaattatccagaaacaaattttatagggtttaaaaactaatttaccttcttataggaaatagtatacttaaaaaagcctcggggaaaattatcctctctaaacagctacacaatccagtgcagtaacattaaccaatatgtctctacgttgccgaaaccacctaggcctatttaactgcggtggtgccctcagtgcctaacaatgggtgcccacctacatattcgtagaatgaccctgacattgtaacagccatccgttttcgtttacatcgccaaccccaaaggtcgtatatgtcatgcttggagtataatcgattcagatacaagagaagacgatggtgggactagacctagtacccacatcataaagccacatatgactgttacacaaatctcctttccaagtatttcaaacatggggaccaaaggaatcatggcgaacaggcaaacttgcttagaaattgtaattgcgcaataagtacactctggcgcatgcaggacacaggtaactggggcgctgccagcacacaggagcacgtgtttccgctatacattcngacataaacaag

SEQ ID NO: 578383 - DNA, 256 bp, Homo sapiens
ggtctcagatacccaagaaaagaatcgtcacatataaaacctgggaaatgtagcgtggcagggagctgagtgtgggaagagggctgggtaggagtgggggacggaggagaggtgtcaggcgccttccgtgtgtacacctttactactatctcatcctcctccttgcggtcctcaagttcagagactgcttatcctttctagagcacaaatctcttgtcatttatagctgagaccagggaggcacagttgccctcca

SEQ ID NO: 578384 - DNA, 158 bp, Homo sapiens
gaatgtcaataaaaaaaggtttgttttttctacgcacaatatctttgggaacttggaggtgcagggtcaaacgtctgtgtgtgtatgtggcagggacaaaacagggattagggatgtgagggggtaaagttttcagaataaagggagagaaaattcca

SEQ ID NO: 578385 - DNA, 1239 bp, Homo sapiens
  misc_feature (552)..(552): n is a, c, g, or t
agcggagccgcgggtgttgtgctgtggggaatcggagaaggatttgtaaaccccggagcgaggttctgcttaccccgaggccgttgcatgctgacgtcagaccccccggagtgaacgtcccaccgttcaatcaatgtcatgacctcatgcgtagggtcaaacagccttcaagctgagcgacttcggggagagtaacgaacgagaagggtgaagtactattaaatctcataatgtcattggcacaagtgatagcatgtgagattcacgttcgaaccgttgaataaatgacgaatcggcatctctagcgtaatactcgaatgaatccctaactgtcaagagacagggttgtgtcctacaatgaagtttcaactcaaggttgtctctttctgcatgtgggtcagcagcacagtttgactgaatcataactcaattacgtcgctatcacagcacatcttgcgcgaattcgcgcacgagacacgaaaagatcgttcgatcttgacgaggtttaatcctagtggatacgcacatacgtggcgcgtggtccaagtatcngagaccccacgtttttcactgaataatttctttcttttgtaactctttcttgtataccctttttatgtctccccatcaagatccccgtatttgtacttcacatatgtatctaacagaaaaattaaggtatccttctttttggcattacagtcgttggggctcgtttcccaatccaaccgttgaaatttttggcttcacaaacctttgggctgacgccaccctaattcttttctatttcttgaaaagagctattcctttgagactaccattgtgtgcgcaattttccttaagttggctttccagctttaagtttccaattttaagtctcgactgcagcttttatctccacatttgtgggttggactttgcaagttttttaagtggcgcgttggaactctccaaaagggcccccttcaaagaggctccccccccgtttttccccaggttaatttttaagccccctcgtttccattgccccgtttttcttaggtcaaagcgcacacagtcttttaaaccggcttgatgtgggcccaatccacggcgaacagccaagaggggctccaaacccccttttgtgttgtggtaccaagggggaaacgcatattttggtcccacactctttcttcttcccaaggtcggaccctttgtggctcgggcgggtctggcacatctacaaggacttttaca

SEQ ID NO: 578386 - DNA, 243 bp, Homo sapiens
ataatctcttgaacctgggagaggatgttgcagtgagcccagattgggccactgcactccagcctgggcaacagagagagactctgtctcaaaaaaaaaaaaagggcttattttttgggccccccaattttttgtatttaaccctctttcgggggaaaccattgtttccccaggacccgaggggtttgtccaatcttttcgggggttcccggaaattaccacggggcttctgtggaaccccca

SEQ ID NO: 578387 - DNA, 495 bp, Homo sapiens
agttcaacgatcagctcgccattttcggcgcggattgatttcaatccgccgtcggcgcgatcgcctgttcggaaattccacaaaagttcaggtttttcgtccttccatttgtagatataaaccagttgaggaattgccgaaccgccggtttcaatcttgaggattacaacggcctctttggcgccgtcgccgtcaacgtcaaggtatttgatattaaccaggctggcacctatacggcgttcggccttggcggcagctttttcgtcggggctcatgtcgtcgcttacgtctttcattttcggctctaatttgccgtcagtcagcgtaatctcatctccgtcgcggtgctgccatccgcgcggaagcggataagtaaaattagcgaaatcgaaatgtcccagcggcgtgtcgggcggtatctcgcgtgtagtcagttcactttgaagattaggtaattcaggtgaaggttcggcagcgaatgcttttgataccgat

SEQ ID NO: 578388 - DNA, 462 bp, Homo sapiens
gtgggatacccagcacagtcagtccttaccacataaagacctgcccccatgattcaattacctcccacaacatgtgggaatttaagaggagatttgatggggacacagccaaaccatatcaaatagcaaagagcttaagtaattgacactggatgaactaggtagataattatagagtcaggactgaaacttagataacttgacatttaattcaattgtctctctagactagcttagtactaaaaggcaatactgacactccacataaactaagccaaaattgggccactaaatagtttcaggctcacatatacatactgagtaagaagcacagaggttgatctcaacatgtagcagatggcttctatattcttaagggataaaactttgagatttttcttttgctccttgtgtgttaagaagaaccaaaacactttagaggtcccagtcaatttgtgtttt

SEQ ID NO: 578389 - DNA, 407 bp, Homo sapiens
  misc_feature (103)..(103): n is a, c, g, or t
  misc_feature (115)..(115): n is a, c, g, or t
  misc_feature (300)..(300): n is a, c, g, or t
cttaccgtcacctgtatcatttatattttcttaactaatttatcatctttagtccaaaaaaatactttcttaagtaaagtcacctactaacccattcactagngactcctgaatntacaaacctggtcaaactcttttcctttgctccagttgccttgagatcaacatttccacaccagagcacttgtggccctggtgggaaacagatcgccatcccgcaaccccctgttatgttcatatacttccacggttctcgcgtcatgcctgtgcctccctttctatgctcatattcttgactgngccatgacttcagctctccatgatattgcccgcagcatttctcatcaagtcttctctgcttcagacctcgggtctgctattggacaggttcatctcggatcctctgg

SEQ ID NO: 578390 - DNA, 157 bp, Homo sapiens
  misc_feature (5)..(5): n is a, c, g, or t
  misc_feature (37)..(37): n is a, c, g, or t
  misc_feature (54)..(54): n is a, c, g, or t
  misc_feature (96)..(96): n is a, c, g, or t
  misc_feature (134)..(134): n is a, c, g, or t
gtacncccaggtctccactgcaagcagcaccctgggnccccactcgccagagcnactgggggtctgcagaaccccccgcccccctgctccccaatntggaggccagcgatgatgaggccctgttggctgttgancgctgggctcgctggtgaccgcc

SEQ ID NO: 578391 - DNA, 858 bp, Homo sapiens
ggtggcatagctgcggagcagaaggcggagacgttgcaacaacagttacagctcgttctgggagcggcatggagcgagagtgaggtgttcaggcacgagccgtgtgggcgcgctcacggcgtcacaagatgatcaagaaatagatactgcacttggggtgcgacatgcttgcccgatcagtcagaggacggagactgttatggtcctggctggtcatggtccctcgagccggggtacgtctgacagcccactcggcagcctgtgacaaggatgggcggacggatagtgctggcgataaggagatcagcaggcaggagacaagcagataggcctgggtcccaacatgtctcaacccccgcgacattaggttggcatgagaacctcagttctgttcgtccaattaatgaacccgaagacagctggaccgcccaagaggtcgggccggccccccaaaagccgggagagccatattacccccagtcacgagaggtcagtcctgtggggcccccccagcttcccatcatgagttccctgtgtcagcgcaagcggggttaggagcccccggcccagttcgagctcagacaggcgactaggtgataagtccagataatgaccccccaagtggacttagcagtccaatggcttcagcggtggagaaccatcccagtgaagaagagttcttggtataccgtaatgactgcagcttccccggagcaggttcagaactctgtagtccaggcaagcaagtagcaagttagcagcgcttgtttcagacccgtaacagcaaagtgcccttcaaaacagggcggtggcacaacctcgttctctcgggggcactttcccagagggacagcagta

SEQ ID NO: 578392 - DNA, 710 bp, Homo sapiens
  misc_feature (710)..(710): n is a, c, g, or t
cttctaggcatagtagggaggatatgaggtgggtgatctgagcggagtggatgcggaatgaaaccctttctctagaaagaagatacaaacattagctggacagtggtggtacagtagcgtgaaaggtcccaagcgtacctgcggggcggactagcagcccgcgcggaggcggcactaagaggagcacactgagagcacaagggctcatcgacaaggtggcgagcggaggagagagagggaggtagaaggaacggacatgcaggaggagagaggaacaaagatgggaaggcaaagagaaggggggaagaacgcgacaggcagtacaagcgagtctgtcgggcgacaaaaggcagtgctgagcagaaagaagtaacccgccggagcgacggtagagactggaagacgaagcaccagggatgggggacagcccaccaaaataggaggcagaaaacagagagccccgaggaaatagaactgagtgccgacacaaagagaaagcactgaaagaacgtagcaagttagaaagaagacgacgacgtgccacacacaataaaaggatggacacccacacaagaacgggcgcaaaagaactgtgggacaaagaaacaaggagccgacgagggcggcactagcgagaacgaacgagcacaataggaacagaggggagagcgctgtgagaggagcacacagtggaccgccgagaaacagan

SEQ ID NO: 578393 - DNA, 364 bp, Homo sapiens
  misc_feature (364)..(364): n is a, c, g, or t
agactacgtacataacctatacctactccaatgctaaaactaatcgtgccaacaattatattactaccactgacatgacttttcaacacataatttgaatcaacacaaccacccacaggctaattattagcatcattcccctactattttttaaccaaatcaacaacaacctatttagctggtccccaaccttttccttcgaccccctaacaaccccccttctaatactaactacctgacttctaccccttacaatcatggcaagcgcaacgccacttatacagtgaaccactatcacgaaacacaggcacagaacttcatattttatatcttcttcgccacacttatacccaccttggcttcn

SEQ ID NO: 578394 - DNA, 134 bp, Homo sapiens
cataacggcggagtgccgcggtctgctatacgatgtactccattcggtttaagctctgggcactttccaagtctctgtgtcctgttagttgtccagttggggtgtatggtcgccgtgccgttaggccgatctga

SEQ ID NO: 578395 - DNA, 119 bp, Homo sapiens
gtctagagatccctgtggagacgggtctcaggaacacataatggatacaatcagcatgtacaaagcattatcattctttcttctagattatggcaaagtcctgacttttgttcttcccc

SEQ ID NO: 578396 - DNA, 644 bp, Homo sapiens
  misc_feature (374)..(374): n is a, c, g, or t
gatgaaagccttgatagcaggcgcgccggagcccgagacatgtgtaagtaaatgaagcgcatagctacctgacgggagacgcacccaagatgacgcggctgtctacatgcagttcccagacgctgcaagccagctcacgctcgcacggcatggcgatcgtccgtccgctcaaacgatgcccgcacacgcagaaacggtctcgcaaggggcgcatgctagatggtgcacgactaagaggcacacggtgacaggacggtaaacctacagaatgatagccatcccgccagagtgcttagtctggctacaacgctagctcctaccaacaggccgacgagcccagagacctaaacgaacagtgtccacctgatacacangaagcggtagcagtaagagctagccacagaagcgggaaaaacatgggaaagagactgaattgcctggacaatggagcggcgagatacaccgcattgacatgatagattgggaagaatcgccactagaaatagcacgactcatggcgaattgagatatgctagtaagtgtggctcggagtattgcacataggtgaaaggttgtagttgcgatttgtttggataacttgttgttacttctggtgttgactggtacagttttgacaattagtg

SEQ ID NO: 578397 - DNA, 280 bp, Homo sapiens
cgctgctggaagcacgacttgccaccgtcaaccgcatggcggcagccaacgacctgccggatgccatcgtcaccgagtcgggcttgaagatcacgctgctggatgcggcggtgcccgacaccgcgcaggcgatgatagaccagacagccatggtcctgccgcacgtcaagatcaccgaactgctgctcgaagtcgatgagtggacgggcttcacccggcacttcacgcatttgaaatcgggcgatctggccaaggacaagaacctgttgttgaccacgat

SEQ ID NO: 578398 - DNA, 105 bp, Homo sapiens
catcggtcggtcgtgcaggtagaccggcttatagaagtgtgaaacgtgtcatctggctcgacacgaacaaatccctccgccccagctttccctctggtggtaccc

SEQ ID NO: 578399 - DNA, 117 bp, Homo sapiens
gatccccatggcagcacccaggtctgcagccagcagcactggcctcgccatcaggcaacaagggcacacccacatccttttccaggttggcaaggggtcacgcagctcgcacattcg

SEQ ID NO: 578400 - DNA, 171 bp, Homo sapiens
ggaaaaaagtaggatatgaaatgaaatctgtgtctataaaagaaaatggataggccaggcgcagtggcccacgcctgtaatcctagcactttgggaggtcaaggagggtggattatgaggtcaggagattgagaccaacatggctaacacagtgaaaccccatctctacca

SEQ ID NO: 578401 - DNA, 181 bp, Homo sapiens
tgccgtacaggcacagtacttgtttgattctgaactggggatatcaagacatttttaccaaaaaaaaaaaaaaaagggccttacggtttaacttcaaattcacattccctcattaagaagctaaaaccgggaattaccaaaattgacccaattgttcaaaccttcatagggaaaaagcaga

SEQ ID NO: 578402 - DNA, 218 bp, Homo sapiens
gtccccccccccttcccacttaaataaaggggccccctgttgggtgtcttttgtaaaaactgccaggcctaggctttttgtaaagatttttcaaaatcccggggggggagcgctttttcttggtgaaggagtttttttccccctggaatgtgcctgggggggtatgtaggggtaaaaaaaaaaatatatatatatataaccaagttttttgcccccta

SEQ ID NO: 578403 - DNA, 1276 bp, Homo sapiens
  misc_feature (226)..(226): n is a, c, g, or t
  misc_feature (456)..(456): n is a, c, g, or t
  misc_feature (476)..(476): n is a, c, g, or t
  misc_feature (615)..(615): n is a, c, g, or t
  misc_feature (1053)..(1053): n is a, c, g, or t
ggataagatgcgggtgatgggcctacgccggcagtcggaactatgctggccgctgggatgtcctgatccagcagggccacccagtgtcctctaaccgactgtccatccagcattgcgtgcccgctcaaagaaggacgcaactataatccttagactcaagacaaactgattatatgggatctagctccagtagactgaatacagatgagactctattgtgaaggcnttcgcagtcgcataatgctattagtataagtcttgtcccatatggacgtagggaccgtagagaagaccagtaaacagagtatcaagccgacatccggactgaagggaaggcgagaggatgtccgcgagattcattgctgggtccgttagaaatgaatagccaaacatgtcatcgctttgaccgacgaattggttcgcgtgcgcacgttgccgtggccatgaggggtctcnttgtttcgatgtgaggcatngcgagcagtggaacggaacgctgagatcaacgcctacgatgacggacaagtacctaacggacgagaaacggctcagtacaaggctgggagtcctagacccacggtggataaatcgcgcttttagacaacccagaacggntggtagcgtagagcttccgagggggtccgcaggggggcgatggggttggccggcttaaccaaagtctggctagttgcacatatagcccagaggaggaacccacccccttgggcatgagtcacatccggctgcggcaggactggccaagcaaaacacagaaagggcgcgcgaggagcaagtgcggagcgaacgcgaaagtggccacggatataccacagaattgcgaacggcgtttctccaaaaccccctggtgaaacgtaaagggaaacgaggatttgcgataagggcggatacagtaccgccctctctggagacattccaagcattttgctgtttgcggttatacaccaaaaatccattacctcccgtgtgctggaaataaaagacacaacttataaaaattcacccataaattaataccttagaaacgcgagtggnaagagcctatccaataaagcgggggggaactcccccaggcaaggaaaatattaagttacccgcctcaaggcccacaaggcgcacgctctattcaggaaccaccccattacacggccccaaaacttataagcgggcacgcagaaagattgcaactcggttttcacctaaattctccagggccttatacaggaccaacttgtccttccgggaaaatcccgcgccc

SEQ ID NO: 578404 - DNA, 326 bp, Homo sapiens
  misc_feature (24)..(24): n is a, c, g, or t
  misc_feature (48)..(48): n is a, c, g, or t
  misc_feature (131)..(131): n is a, c, g, or t
  misc_feature (201)..(201): n is a, c, g, or t
  misc_feature (255)..(255): n is a, c, g, or t
  misc_feature (277)..(277): n is a, c, g, or t
  misc_feature (322)..(322): n is a, c, g, or t
gcggacggagcgggcggccggcgnggaagacggcgcagcggcgtatcngggagccagcgggtgctgatggagccggacgcgggcgcaggggtcgctgtgatgaaattcaagaaccccccagtgaacagccntgagcctggagtttctgacggagctggtcatcagccgtggagaagctggagaatgacaagagcttccgcngatgtcattctgacctcggacccgcccgggtgtcttctcggccggcctggaccntgacggagatgtgtgggagganccccgcccactacgcttgggtacttgaaaggccggttcaggaagntttt

SEQ ID NO: 578405 - DNA, 552 bp, Homo sapiens
agatatttacgtttcttaaggtggataatattaatgcagctgcgatggatttgtcacaaaagaagatctgcacgctaagtgaagaggtcataatcggagtacatggaacaccattgaattgtctccatgctaaagactgcggtggtgtccttgcggaactggcgcaagcttgatttatatttgcatgcaactaaatctattgacgctgaaaaagctctatcaaatactatcaaaatgtactatgacattgaggccttcactgcttccatcatgtaaaagtgcacagcttgagactgaattacagaaagattaacacatttacatatatacacacataaatatgtatattattgagattaacatacatatttgttcaattgagttcgcagaaaaacttgcttgctaattacttagggaacattgttaaaagcatatagaaacaaattatgcctcttgtaaacaaaaaaaaaaattcactggccgccgctttacaacgccgtgactgggagaaacctggcggtacccaactttcgccttgcagctccccctttt

SEQ ID NO: 578406 - DNA, 85 bp, Homo sapiens
ttgtgctcttggggaagaggccttcccctccctactgggggatacgcgtatcctgaggcgcggggaggccgataaactcatcttt

SEQ ID NO: 578407 - DNA, 425 bp, Homo sapiens
gatctctctccgttgtatttttaacgacgtcagtatcaaggcggagcatcaacaggtatcatctttgatattttccctcagtcgcttgtagccaggttcccggggacttttcattatcatcatgagccaaaccatgtttactgaatgttctgtgggaaatgtctattctcctgtgtatctctgggctattgcttgatattggctgcctcctgctcagttcctctctttaggtatttagtacagcgttcatttcatgtcattcctgtggactgaaagtgatgctctttaacatggtgaacaatggtcactatatgttgggcaaacagttctgaggggctacgctgagactgagctgattgtatgtgctggaaaatggaacgaaactcctgttcctttttgttgctatggactagatctcggcaaag

SEQ ID NO: 578408 - DNA, 676 bp, Homo sapiens
  misc_feature (144)..(144): n is a, c, g, or t
  misc_feature (176)..(176): n is a, c, g, or t
  misc_feature (178)..(178): n is a, c, g, or t
  misc_feature (203)..(203): n is a, c, g, or t
gaaaattgtacattgatagtaatataggccagtgtatagtttcatgtacaatcaagcaagcagcatgtcaaacaaataacaagtgataccatgggaattcttaaaaatctacataggcgtagaacatgcccacagggacataantgtaatctttgtctgacagtattgataattancnctcttgtgtgacataacagtggacntaggaaatgagctgtacagcaacgtgtcatgctatgtagcttaagagagtatagtatacgcttttcacagcttaggtcatggtgaggccaatttccatgcagatcttgtgcgtctcagagtgtgtctcccagactactgccagctactgtgggtcatggtcaagagcatcagttggaatctccctcgttgaccctttggcaatgtacacaccattattctagaatcttttcatacgagtcctatcaagtctaatagcagcggggaataatatgagtgtttcattcaccacaatgtagaggtactccacctgtaccccggcaacataggtaggtggcgcattattgggcagaccagcagcgatctccatgtgcagtttttgctgcacatcagcgtgagtggccagttcatatacagtgaagcagagaactctgagggtggtgtctcgtgccgaattcctgcagccggggggatc

SEQ ID NO: 578409 - DNA, 191 bp, Homo sapiens
agagcagtctcagagaaaatgccacaactcacagcacctatatgcactccaagtgaaagttaaagcgaagagcacagggccaggaatccactcagggtccagcaggcaaggcattcacagggacatagagatccattacccagcgtgcttctaactccgctacggtgacaactggaccaacactaactccc

SEQ ID NO: 578410 - DNA, 304 bp, Homo sapiens
ggagctagaagcatctgaagaactagatacaattgtccaagctccaaatagaggaaggctcaagtgctgacaataagcttctgtgtgctcttatgaaggaacaacaggagcaaatgtggattcagcaacaattctggaatactaatagtactggtgttgaatatgaacattcgatatattggaggatgaagaagttcggcaaggattaaagcttactcaaattggccaccataccctcagctgtatgtgaaggggactggtgggaggattggaattttgtaaggaactaggaatgggaatttcc

SEQ ID NO: 578411 - DNA, 197 bp, Homo sapiens
tctgcactcgtgctcctccaccaccttgggcgcctcactcctgcggcggcacctccgaccctcacacagctgcagacgtgtcaacgggctgccaaggggcatctgagtcatccttggctggaaccacatcgtactcatagtcctcatagacctcgaaatgcttccatcgatgatacacgacgtggactttgactgtc

SEQ ID NO: 578412 - DNA, 511 bp, Homo sapiens
  misc_feature (208)..(208): n is a, c, g, or t
tccgtttgcgggcctttccactacaacccacattcagactttcacctgcatcagagagttcacactaatgagaagccctacacatgcaaagaatgtgggaaaaccttcagatataactcaaaactgtcacggcatcagaaaatccacactggagagaaaccatactcatgtgaggaatgtggacaagccttcagtcaaaattcccacnttcttcagcatcagaagctccatggtggacagaggccctatgaatgtactgactgtggtaaaaccttcagttataattcaaaactgattcggcatcagagaatccatactggggagaagccctttaaatgtaaggaatgtgggaaagccttcagttgtagctatgactgcatcatccatgaacgaattcacaatggggagaagccctatgaatgtaaggagtgtgggaagagtttgagttctaattcagttctgattcagcatcagagaatccacactggggagaaaccttatgaatgtaaag

SEQ ID NO: 578413 - DNA, 116 bp, Homo sapiens
caggactatataaaaaataatgcgtgtgcgcgcatatgaagtgtagggtgagatagcgggagtgtgtggggtaaatatatgaggcacgcgtgtagacagccagagcaaatgggggg

SEQ ID NO: 578414 - DNA, 1145 bp, Homo sapiens
  misc_feature (1145)..(1145): n is a, c, g, or t
cggttccgaggcagatgggaagagatacggcccctggacatctgtcgagcatgggggaacctggaggcaagctggaggttgcgtggagtcccagacggaggaattatcgatgcgagtattcgtgctgtccgcgtgtcgagtctacacggagcatcgcgcagagcgacgatcggcgctctgatggactgctgcggatgcacggcgcgagagccgtagccagtcgtcggacaccgagacggcaatgcataggtagtggacgaataggagcaactagtgactcaatccgagactacaaaaacggcagtgtggacggccttcaggagagatgaagcagcccgtcaacaccactcaatccagtacaccgcgtgagacgaagggcgagacctgagaggtgtcctgggacagagatcaacacgagagctgtctgcaagataggcgccgatgggacgcacagcgggggcccagaaggtaacaaactatggcccgacacgaactcgggcaacgacgttgactgccgtgggcctgggcacgaacatggggaatcacgggtaccgcgcaagatacgtacggacaagcacggcgcgcacgaattcgtgatcccgcattgaaggcccgacccgggacttccgagaggtacccgtgggagtgtatgatcctcccaagtacgcgctaacaaagatggggagattgattgtcctattggggaatcccaaaaagcggatggggggactaggcggcaatgtgcacgttgatgggtgcaccacattgggacagcgcacatcgcatcgagtgggtgccacagcgaaccacgaagcaccctgcggacagacgacctcactagaggcaacaagtcataattggggcacactccattagtatatggagagggagctatatattaaggagcaattattcaacatatgtatgtaacctagaattaccccacactattggtgtatgcctttataaagttttgggccattatacctatgggggatatgcaattagccaagtacggttttgagaaagagactaaaaacgattaataagcgagaggattaatgataagtacacagatagggcgattaaaacatcagggcgaggtagccatttaggagtatgagagggtgtttaaggggaagagn

SEQ ID NO: 578415 - DNA, 620 bp, Homo sapiens
ggataggtgtaaaaaagaaagctgtgaatttatttactatcatcatctctcttaggaagaagggaagtgtggaaaaaaattgtcttcaggagaggaagaagcttgtagatataattgaacagcatcttgatttcttttttgccaagatgttactgttggctggttattttcttgtattgttcaatgaaaatcataaaattattattcagtgattacttaatggacaccagaataaccaaacccttttccattcttttttttgcaaaggctggtctcctttggcctggacgtcctgatctttcccatagtagaactgggctgggtgtctcttttttttttttttgagacggcgtcttccactgctgtcgcttgggctggagtgcagtggcgcgatctcggctcactgcaacctctgcttcccaagttcaggcgattctcttgcctcagcctcctgagtagttgggattacaggcgcgtgcaccacgctcagctaatttttgtatttttagtagacaggggggttcaccatgttggccaggctggtcttgaactcctgacctcgtgatccgcccgactcggcctcctaaacttttgcaaagctgtatctctaaggaattgaa

SEQ ID NO: 578416 - DNA, 246 bp, Homo sapiens
gctgactctagagtgatcccccccatcgttacaaaaattacaaaaaaattagccaggtgtggcggcacatgcctgtagttccatgctactcgggaggctgagatgggaggatcacctaagcctggggaggtcgaggctgcagtaagctgagattgtgccactgcactcctgcctgggtgacagagtgagaacatatctcaaaaaaaaaagtataaataaaaaaggttaggtgccgatgaatagcga

SEQ ID NO: 578417 - DNA, 226 bp, Homo sapiens
cagaggtcagctggatggccacatcggcaggtcggagccctgcctgcatactcgaactggaatccatcggtcatgctctcgcctgaaccatgacatgcctctttgtccttgtgggttcttgcttgatgtaccatgttcttcttgggccacacttgggcttgagtgtggtgtacactgcagtgtctacaccatgtctcacttgtttgcagcaacgacttttgattgg

SEQ ID NO: 578418 - DNA, 361 bp, Homo sapiens
  misc_feature (353)..(353): n is a, c, g, or t
cacccctggggggtcccctacaattaaagttaatgggcacctcccctaactcaagtccccacaagactgccccccccacttcagatgcccaattacaaggagtgggtccccaacttggctacaaattgggggttccccacaaccctctcctctggtttgctaatttgctataacagctcacagaactcagggaaacacacttaccagtttattataaaggatataggtgtggctaagcatggtggctcacacctgtaatcccagcactttgggaggctgaggcaggaggatcgcttgagcctaggagttcaaaaccagcctgagcaacatagtgagaccccatctcaattcanaggattaa

SEQ ID NO: 578419 - DNA, 196 bp, Homo sapiens
tttgcgctccatcaggggcgtgatggtgtctacgctccccagtgttggccttaaacagcaggaatgaacagtcagggcatctgccagtggcagggtatggccatgccagccgtgctgatggcatgagctaaacaggcacaggaacagaaggcaggcagatctcacagtggcaaagctaaatgtctctggggtaccg

SEQ ID NO: 578420 - DNA, 718 bp, Homo sapiens
ctacaagatgcgacttcccctatcatagagaggagctgatcggctttcaggatcacgccctcataatcatgttccttatctgctgtcctagtcctgtgatggcctattattcctaagcactcgacaaggagaacactaactaatactaagatctcgagaggctctaggaaatagaagccagtctgaactgatccgtggccgccaatcgatctcgtagtcctcagcggccctcccatcgcctgacggcatccgtgttacgagtagacagacgagggtcaagcgatcccttcccgttgaccatcaaaatcagatgttggcctaccatatgtgtactgaacctgacgagtacagcgagctgacggcggtactaagtcgttcaggctccgtacgatacttcctcgccagtttagttgcctaggaacgcaggcgagctgcgatgtcctgaacgttgacaattcgagtagtactcccgtatggaagcgccccatttcgttaatacataagcttatcgagtcacctagaggaacgttcttgcaactcattgaagctgtgccccgacagttaggcgttaagaaagcagatgcaattgcccgggacgtctaaagccaaaccacgtttcaccggctacacgagcgggggtatactacggtcaatgctctgaaatctgttggatgcaaaccacaggttcatgcccatcgtcctagaattaatgccccta

SEQ ID NO: 578421 - DNA, 621 bp, Homo sapiens
  misc_feature (27)..(27): n is a, c, g, or t
  misc_feature (88)..(88): n is a, c, g, or t
  misc_feature (98)..(98): n is a, c, g, or t
  misc_feature (100)..(100): n is a, c, g, or t
  misc_feature (121)..(121): n is a, c, g, or t
  misc_feature (148)..(148): n is a, c, g, or t
  misc_feature (162)..(162): n is a, c, g, or t
  misc_feature (173)..(173): n is a, c, g, or t
  misc_feature (194)..(194): n is a, c, g, or t
  misc_feature (196)..(196): n is a, c, g, or t
  misc_feature (229)..(229): n is a, c, g, or t
  misc_feature (245)..(245): n is a, c, g, or t
  misc_feature (274)..(274): n is a, c, g, or t
  misc_feature (294)..(294): n is a, c, g, or t
  misc_feature (297)..(297): n is a, c, g, or t
  misc_feature (303)..(303): n is a, c, g, or t
  misc_feature (367)..(367): n is a, c, g, or t
  misc_feature (373)..(373): n is a, c, g, or t
  misc_feature (413)..(413): n is a, c, g, or t
  misc_feature (443)..(443): n is a, c, g, or t
  misc_feature (455)..(455): n is a, c, g, or t
  misc_feature (470)..(470): n is a, c, g, or t
  misc_feature (477)..(477): n is a, c, g, or t
  misc_feature (491)..(491): n is a, c, g, or t
  misc_feature (505)..(505): n is a, c, g, or t
  misc_feature (511)..(511): n is a, c, g, or t
  misc_feature (524)..(524): n is a, c, g, or t
  misc_feature (533)..(533): n is a, c, g, or t
  misc_feature (619)..(619): n is a, c, g, or t
aaaataaaaattataaaaaaatttaangtcaagttgtttccattaaaaaaaaatgattttaaaaaataataacttaaaaatgcaacangcaaaaaaananaaccaaagttttccaaaaaanattctcctttccttctgaaggttttangatgcattgttatnattaaccagtnttttactactaaacttaaatngncaattgaaacaaacagttctgagaccgttcttncaccactgattaagantggggtggcaggtattagggataatattnatttagccttctgagctttntgnacaganttggtgaccttgccagctccagcagccttcttgtccactgctttgatgacacccaccgcaactntctgtntcatatcacgaacagcaaagcgacccaaaggtggatagtntgagaagctctcaacacacatgggcttgcnaggaaccatatnaacaatggcagcatnaccaganttcaagaatttaangccatcttccagcnttttancagaacggcgatnaatcttttnctttagctcagcaaacttgcatgcaatgtgagccgtgtggcaatccaatacaggggcatagccggcgcttatttagactggatggntc

SEQ ID NO: 578422 - DNA, 860 bp, Homo sapiens
  misc_feature (1)..(1): n is a, c, g, or t
  misc_feature (94)..(94): n is a, c, g, or t
  misc_feature (97)..(97): n is a, c, g, or t
  misc_feature (110)..(110): n is a, c, g, or t
  misc_feature (127)..(127): n is a, c, g, or t
  misc_feature (158)..(158): n is a, c, g, or t
  misc_feature (166)..(166): n is a, c, g, or t
  misc_feature (246)..(246): n is a, c, g, or t
  misc_feature (467)..(467): n is a, c, g, or t
  misc_feature (530)..(530): n is a, c, g, or t
  misc_feature (534)..(534): n is a, c, g, or t
  misc_feature (569)..(569): n is a, c, g, or t
  misc_feature (786)..(787): n is a, c, g, or t
  misc_feature (811)..(811): n is a, c, g, or t
ncttgttaattttcagttcatcagcaatattgtatataacagaaatatgtttgtatacaccatacatgcacatacacatgcatatataacttcnganactattgattggngatgctctaagaatgtnctgtccaacactatagacactgactactggncacttganatgtgttttgtccaagctgcactgcactctataaaacaaacacaagactttgaagacttagaatgcaaacagagtaaaangcaacattaacaaatttgtgttattacatgaagaaattctatgtcaatatacaagaataaacattatcacgttaatagtaatatatgtacaaacatgtactataatatattgcatataatttattgaaatagtatgctatgtaattaacatcaatattgttaatattaatattaattataacattgttttgaattaaatatattatttaaatttatttgantgcttaaatgtacctattagaaaattttaaattatgttgtatttctattggacaaccctgctntagngtgttggaatcaacttggaaagaggaaatacaaanggagtggggatggccatgattattctttcaggaaagagaatatcccaaacactctcctcatagccccaggacttccttattcctcaggctgtagataatgggattgagcatgggggtaaggatggtgtagaagactgccaggatcttgtcttcagctggtgagcggagattcctgggccggagataggtgtagacaaaaggtgcatagtaaaagatnntacagttaaatgtgttgaaatggnggtgaaggcctttttctcccctcctttgagtgcatatgatagacagcaa

SEQ ID NO: 578423 - DNA, 147 bp, Homo sapiens
taccaagagaaccgcggcagtttggtagtaacaaacggcggagtggaacatgatctggatcagattgactacatagacatgctgcaccgcagaggaagaggaggccgaggtgagacagcccaagggaccagacctgagcaagccagg

SEQ ID NO: 578424 - DNA, 517 bp, Homo sapiens
gcttcacaaagggcagtacgggtagtgagtgccgtcatgcatcggtcattcagagatgctcatctaacgtgcactgagactccagaactaaatccttatgtatgaaattacctacaatgaatgttatgatgatgtatacaaaggtaaccagacagctctccttaagcggctttcggtcagtatttggtaccagtttatcttctacatattcagctcatggaaattacaagttatatatttccttccccatagtttttcaaaatgtattttcaacagagcatgcttaaaaatcatgtaactcattaaaaggccagagagcagagctaacacaacttgccttatcttgtaaaggccttaaaagtaaggcttcagatcgtttttttcttctgaattctgtcaatttggtatttgatggtgcctgcagttctcttaatgcacttttaaagcttcacagttctgaaactggaaacgcataaaacttttaaaattattaatattctaatttaacagattttca

SEQ ID NO: 578425 - DNA, 879 bp, Homo sapiens
  misc_feature (1)..(1): n is a, c, g, or t
  misc_feature (81)..(81): n is a, c, g, or t
  misc_feature (83)..(83): n is a, c, g, or t
  misc_feature (88)..(88): n is a, c, g, or t
  misc_feature (90)..(92): n is a, c, g, or t
  misc_feature (109)..(109): n is a, c, g, or t
  misc_feature (179)..(179): n is a, c, g, or t
  misc_feature (219)..(219): n is a, c, g, or t
  misc_feature (230)..(233): n is a, c, g, or t
  misc_feature (235)..(235): n is a, c, g, or t
  misc_feature (238)..(238): n is a, c, g, or t
  misc_feature (240)..(240): n is a, c, g, or t
  misc_feature (252)..(252): n is a, c, g, or t
  misc_feature (264)..(264): n is a, c, g, or t
  misc_feature (271)..(271): n is a, c, g, or t
  misc_feature (279)..(279): n is a, c, g, or t
  misc_feature (285)..(285): n is a, c, g, or t
  misc_feature (295)..(295): n is a, c, g, or t
  misc_feature (298)..(298): n is a, c, g, or t
  misc_feature (349)..(349): n is a, c, g, or t
  misc_feature (357)..(357): n is a, c, g, or t
  misc_feature (360)..(360): n is a, c, g, or t
  misc_feature (366)..(366): n is a, c, g, or t
  misc_feature (467)..(467): n is a, c, g, or t
  misc_feature (536)..(536): n is a, c, g, or t
  misc_feature (727)..(727): n is a, c, g, or t
  misc_feature (739)..(739): n is a, c, g, or t
  misc_feature (832)..(832): n is a, c, g, or t
nggcacagaccccacctgggtacagactcacatacagcgcacaagcccctcaccacagttacactcgattcatacagaccncnccccncnnnaggggtcgcgaagaaanctaatcacaaaggactggtcttgaagatgacaatgacgtaaacaagagtgctctctggaggccacaagcngccttaacaatgacgtgtgtctagatgcagtttggcagangcggggggtcnnnngnttngngggatcaagggncccccagggggntgcggcnggctgggncagggnacactcctgnggncaaaccagagccacttctgaggtcaaagccatcacccaggaaagctccgcnggattggnggnccaggncagctgtgccccacaagggaagggggagatccgcaccgtgggaccgtttctcgtgggggagtcggggcttcccacagagcgggctccatttttggtcagantcctcccggggccagtgcaccatctgaatccttgggcacgtggaggcagctttgtctttggctgggtgnaccccagcctggcccagatgcaggactctctcaccatagctgtctgggggcgtgggagcaggagggctgcaggagctgggtctccacacgctgacgagggataggactgagcagatgtcggctcacacaggcactgggaactgcacatcaacagcgggcaagcagcatggaaagtgctagcgtggggtctngggctgaaagcnagctcctcctccacgtgcatggggctgtttacacctcccaaactcctctgcaccgctatgccctgcttttggtcccttctgggtgctaagtgncccaccctgagggccgaggggcagacactcgggcccggccacactct

SEQ ID NO: 578426 - DNA, 168 bp, Homo sapiens
tgaccgacgaagaataagtctcagacatcttagcagtctaagcttgtatcatcgacttccacagccccacctacctgattcttggcactgtgccggtagccgtgtgtggttagggaggtggaattaccaggaagaattagatgaacatgttgcaaaacacatgtacat

SEQ ID NO: 578427 - DNA, 725 bp, Homo sapiens
cttttaccaactttaagggcattctatgcccagcaccccagggcctttttgggaggccctgcccccatcccctttccttgggaggcccccggggcccccccggggcggggccccgattttgtccccacccaagggggggtggagtttttcaaaccgccccctttttcgaaagatattgtggggggactttcggggctcggggcccccccccgagttccccgggcactttattttttggggaaaagcccggggccccccccaaatcccccaattttttccccagggaagagggcgggcccctttgccaatattttgtggggcaaatcccaaaacagcaggcaccccttttgtccctggggaggggggggggggccccttttcccccccccccttttgtttttcctgtttcctttgaaggagaatcctttttcccccgattgccccggcccctttgggaaaatttcccggaggtggccgggaaaattgggtcctgaaaatccccgccccccctgggtgggggggaaacccaggggatttttttacccctttttttttttttaattttgaaaaaaaccccccctttcctttggaaggggctaggaaattcccaatggggggaaccccgggggcccttcccttttccccgccccccccactttaaagcccagccctttatattttccttttagaaattccctaagggctttaaataaaatttttttgga

SEQ ID NO: 578428 - DNA, 459 bp, Homo sapiens
agcggatcgtcgccttttcttcttcgtcccgggcggtgcgttccactgctctggggccgacgccgcgcccagtcccgttcgggccgcagccccacgttcccctccccgggcggggctgccaggactagcccgttcccgccagccacctccttccccataggagcgcttctctgatcaggaaggaactagcgcagaacacaaaacacagttacagagtaagcccagcgatgcaagaacaaaaacactttgatgaaaacccaaagaccagcaagcgacaagtagcacagcgaatcacaagactagtggaaatgagcaggtagaaagagccaagagaccagacgcaaaaacctggcagcaagacgaaggacaccgcgatacagcgataggagaatagtaagtgcgcacagaccacgagactaccgagcatgacaaaaaggaacacgaaaagatcaacaagac

SEQ ID NO: 578429 - DNA, 630 bp, Homo sapiens
aatcgcggaatcggtgctttagtacgcctgtgacctttactctcgcggccgcgcgaacccgtttgagctcggtaatcctagtgcacacgcttgaaagcgaggggccatgagtctggacttccagttccagcgtacgagtgactggatcgcagcagttacccatggctgcttgggacagctgcaacatgtggtacatctagcttaccaaacagatttcatggtcaacaaggatcatcgcaaataaagctattgataaacccttcaccattccagaaaagacaaccccaagaattagtacatgctgtttgacatggcaggcgattgtgggagcactacacaggctggggtatattgccgtagttgggaaggtccacaaacaagttcccaattctgtgaatgggggcctcacacaacaacatacggaagcagccgtgcagacaattgtgggccctcttgatccatccacgcaaaacacgaacacttaacttggacaacttttgatggctgcaaactcagctctgtcggtgcaagttaccttgattgtttcacttagacatgatacacctctgttctgatacacttccgctgcttctaaagtgtatatggcacctgcggttccaattattgatg

SEQ ID NO: 578430 - DNA, 813 bp, Homo sapiens
  misc_feature (1)..(1): n is a, c, g, or t
  misc_feature (6)..(7): n is a, c, g, or t
  misc_feature (12)..(13): n is a, c, g, or t
  misc_feature (15)..(15): n is a, c, g, or t
  misc_feature (770)..(770): n is a, c, g, or t
nggggnnaaccnngngagggggccaaccgaacaggaagagggcgcggcccaccgggcacaaggggaaacgaggaagccgcaagaccagcccggacaacaagcaaccgggacgcgacaaagagagagcccgacaacagaccctcacccgaagcaaacgggacgccaacggcttatgacagcgggaacgcaccgaggacgcacaacacagaaagggcacccgaaacccggcaccccgaccaaggggcactagacagcatgcaccaccagccaaacaacaaggaaacgcccagaatagaaaaccaaacacacggagggcggccatcgagagaagagcgcaacagtaccgcaaaaacgccaaaaaaaaccaacgcgcagcgccaagaagcgacggaaatccagacggggggcaagcggaacggaggagcgaagccccaaaaaagcgcacaccggcgcaatcggccgatgacccagagagccgcccacccgcgaacggtaaaccgggcgggcccacaaaagcaggacggtacctcaaaaggagggcccgaaaagcggacccacaccgcaccaaaaagggcggccctaacccgcaaggcaaacgcacttaaaaagacgacacgagagcaaagacccggagaaaaaacgccacaaagagaccccaaaccaccaaacaagggcaacgcccgcggggagaggcacacaacacaagagggccacaggggcgcaagcggtcaacagcacacaagcagcaatggggaaaaacgaggcgacangtaacaacggcgccgcgacacaacacaggacacacaccaccga

SEQ ID NO: 578431 - DNA, 113 bp, Homo sapiens
tgtagaggatacagtagagattagtttctaagcaagctgttgatgagaatagcagcaggatggagatgaagattcccttgtttcacatttttatactaaccctttggccgaag

SEQ ID NO: 578432 - DNA, 853 bp, Homo sapiens
ggtgaattttcgacagccttggtatcttggagtatgaccccagtctgttataaactgcttaagttgtataattttacttttttgtgtgttaatggtgtgtgctccctctccctctcttccctttcctgacctttagtctttcacttccaatttgtggaatgatattttaggaataacggacttttaaagaagcaaaaaaaaaagactgaatttccttgcttacttggcatatacagactggatttttttttttttttaacagccatttccccaagggaatgtctggcatattacggaccttgggtatgttccatccatgggaatattccttaatttctacgtgtttggaaaagccggtaagaaatacgggattggataatatttggaaggcaggaaaaacccaaatggtttcttcttggagagtcatgactaccttctggtggtggagaaattggcctttggaaaattggacaatttggattctcactggtttgtttaaaacttgaataaagggaatagaattttttttggataagggttcacaaaacatttctaaaacctagtgtttttaaccatggaaattcaaatggggataataggttaacgtgtctagaaaggcatcggaaggttgttctgaacgcagttttgaagaagtgactgttagtggttttggtacaaccaagggaaatttccaaccgtttaacgcgggaagtgggggtcatatttgtgcggtggttgtgacaaatctgtgtggtgccttggggtgaagccttcatcgttgttggcactttgcgtcaagtcagggtgaaataagtgcacagttttgttccaccgaatgttgtcataatgtcgg

SEQ ID NO: 578433 - DNA, 290 bp, Homo sapiens
cacgtcccaacccctctcctgagtgtctgcgaccctgtgcgctgcctctgagagtgccccgcaccggctacccccccctcttgttcttcgagacgggggcttggtgcgatccccatgcgggaatacagcgccttgagcatagctgactgcacacttgaactcctgggcttaaagaaacctcaccgcctcatccaacagagactcttgggctacaggcgtgagcgcacatgcccatactttcttttggaggggccaccactcactgaggtgaggggttccgaatacactgc

SEQ ID NO: 578434 - DNA, 478 bp, Homo sapiens
cggatctcccggggggaggagagtggttcctgccacaagccacaagataggactctggacccatttggacttccacctagaaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacctggctcggtacaacttagatgaggagaccacctctgcaggttctggtgatgactttgaccagggtgacaatggctggaaaattatccatacagatgtcttccgctt

SEQ ID NO: 578435 - DNA, 374 bp, Homo sapiens
  misc_feature (7)..(7): n is a, c, g, or t
gcgtggntcaaccgcaataccctcttcactcagtgcaatatcaatctcgtcggcatcgaacagttcggcggtaaaacgccacaacttgttgatggcctgctgcatcttttgccctgatacgtcagtaccattgcccagtcgctccagccagccacgactaaaacgcaggtgatagcgcgcttctttaattgctttggcagaaatcgccgccagttgcggatcacggctttccatcagacgggtaaagagcgccacatgccatgcatcgatgaaatactggcgtgcaatggtgtcggcaaaattgccgtttggttgtttcaaccaacaattaagtttgctggaactggcgcgattgctttgctttcccccctgtt

SEQ ID NO: 578436 - DNA, 146 bp, Homo sapiens
  misc_feature (82)..(82): n is a, c, g, or t
gctcggtaccgacgctctctctgtggggggctgtatttattatttatttccgactgttgctcacttccttgtgaactcctgnctccacaggccctccagtggcagggacaggtcttgggtcttatgtcatcttggtgctgtgagag

SEQ ID NO: 578437 - DNA, 831 bp, Homo sapiens
tgctgtggctcacgcctataatcccaacaatttgggaggccaaggcaggcgaatcacctgaggtcaggagttcaagaccagcctgaccaacatggagaaaccccatttctactaaaaatacaaaattagccaggcatagtggcgcatgcctgtaatcccaggtattcaggaggctgagacaggaaaatgcttgaacccgggaggcggaggttgtggtgagccaagatcgcgccattgcactccagcctgggcaataagagcaaaactccgtcaaaaaaaaaaaaaaaaggggtgtttttaaaagcttttttcctaaaagggagaaaagggaggggatatattccattcaattgggcaagacaattacaacttttctcctcatggttttccctggtttgatctggaaagaccaaaatagacttcccttttatcacctaagagggcccctagggttagcggaacacaaaagtggctacaggcccggggctcagggccttggttgactggaattttctaaatttcctacggtacaagaaaaatcacctctgtgcgattgtttagaccccctcttagttctgagtttaacccaggacccgttgtgcttgtgatgtgccggggaccaggcccagaaacattctttctgatttgccaggtgcggatctaagccagttcccggccctttttggggttggccccaaccttggctttgggtgccatagtcgcctggcctaagagcaatccccttttctttgttttttctggacgatctgtcgtcccagtggtgcgggcatcggtccgtcctggggctgtccaaacactaaaatgtgccgc

SEQ ID NO: 578438 - DNA, 313 bp, Homo sapiens
  misc_feature (86)..(86): n is a, c, g, or t
  misc_feature (141)..(141): n is a, c, g, or t
  misc_feature (233)..(233): n is a, c, g, or t
  misc_feature (243)..(243): n is a, c, g, or t
  misc_feature (284)..(284): n is a, c, g, or t
  misc_feature (308)..(308): n is a, c, g, or t
tctgtctcaaaaaacaaaaaaaagggaagaaaataagaatccatgaatcaatggagggcaattgagttactgtgatataatatganatatatttagtccctggttcctcacagagcttaaactctcagaatttcccaagtnataagagtgtctattgttataataagcccttattagcacaactgaatttatgttaataaagtgactcagggtgggacactagctagcctcangatgaggctngccatcagaaagaccaagtgatttagaggatgagagggttngaacttttcaaccccacccaccanccact

SEQ ID NO: 578439 - DNA, 161 bp, Homo sapiens
cccgtatcccaccaacagctgtaggggaaaaataaggcagataaaggagcggggagagaaattaattggcaaccaggaggagttgggctggattttcaaaaggtggggagagtggagcacacacctttgagggaggaaaggcgagaaaagaaaaggaaaaa

SEQ ID NO: 578440 - DNA, 1124 bp, Homo sapiens
  misc_feature (670)..(670): n is a, c, g, or t
  misc_feature (772)..(772): n is a, c, g, or t
ggagcggtgcccgctcgtacagatgctgggggcgtgatcgctgccgtcccatctccgtgccgccggcttgtctgcgctgctccggtcgcccttatccctcgtgtcgtggacccttggcatcggcgcgaccggtggccagtgctcgtcccggggtcatcgaggccttgccccagtggctgagaggcccgtcgggtcccgggtcgacgactggctgcagtggtatgtaaccttccgttataggttgcggcatccgtagaggtaggtccgccacgcgtgtgtagctggcggtcagacggtatgcgtcgggcccgtggctccaggaccccattcgtcagagacgcttgcgtggcctggccgtcgcgtgcacactgcgtgagatcaacggaacgcgctatcccagagattcccgcgataccatgattcgcgccggttcgccacccgcgcagtcatttggtcggcaggcaccagccgaccgacggctgacttgactcggtccttacaagacagagcctagcggcgcacggcgaaccgagcccagcctacatagagcaccgctctactgtagacggctcggtagtataccgttcaattccggcacgcgctggtcagggaccctagcaaaccaatagtcaactgcgtgggttgccgccttgactcgggcacgtcccgnacgcggtccggagggctggtttgtggcaggaacgcgtcattccacggacccattgtgtgtcgcccattcggccattgggggtcgcactggaaccttggcccntttgggctggaaaggccgctttgcccgtcttgaagagttccttacacgcccggttcctcttttagaacagaacacgtgtttggcccctggtggaaccctgccgcaccaaagattcgcgttatcttatttacccaaggcggaaactggctgcccttagagtattcccctggtcagaagcaaaggcaccctggaggttaatccaatgggacaccgcctggagaatttccaccccatttcgctttgtgttaccccccttacaggttctcgctcaagaccacaggataccaggctgccgcaaaggacgtttcccaacacggaagtgggagtgccctttaagagggaggaaaacccc

SEQ ID NO: 578441 - DNA, 444 bp, Homo sapiens
acagagtgagaccctatctcaaaaaattaaaaagttaggtgaggctgggtgctgtttacacctgtaatcccagcactttgtggggctgaggcaggcagattgcttgaggtcaggggttccagaccggcctggccaacatggcaaaaccctgtctctactgaaaatacaaaaattagctggtcgtggtggctcacgcttgtagtctcagctacctgggaggctgaggcaggagaatcacttgaacccaggaggcagaggttgcagtgagccaagatcacaacactgcactccagcctgggcgacagagtgagaccccatcttaaaaaaaaaaaaaaaaaagagttataaatagtattccattaggcacttgcactgtgattagaattacagcacaattcttgcagtagcaaagatgttataaaaactcgttcagaaaacaaaaaa

SEQ ID NO: 578442 - DNA, 670 bp, Homo sapiens
  misc_feature (537)..(537): n is a, c, g, or t
  misc_feature (542)..(542): n is a, c, g, or t
  misc_feature (588)..(588): n is a, c, g, or t
  misc_feature (637)..(637): n is a, c, g, or t
  misc_feature (645)..(645): n is a, c, g, or t
ctcagtcagtttctgaatattgtgaattcaggcaggtgtgtgttctcttctgcatgtttttatgcactgccaattagcttctactaaccacggttcaacagaaaataaatgtgtatttgtgaataacaaactgcacaacctgcaaaccaggagagagggacaggttctgtcaggggtgacaccaggacacagggacaggttctgtcgggggtgacaccaggacacagggacaggttctgtcatgggtgacacgaggacacagggacaggttctatcatgggtgacaccaggagagagggacaggttctgttggggtgacaccaggagagagggacaggttctgttgggggtgacaagaggagacagggacaggttctgtcgggggtgacaccaggagagagggacaggttctgtcaggggtgacaccaggagagagggacaggttctgttgggggtgacaagaggagacagggacaggttctgtcgggggtgacaccaggagagagggacaggttttgtcagggggtgacaccagangaganggacaggtttttttgggggtgacccccggacacagggaataggttntgtccgggaggacaagtgcttgatcgggtcttcagcatcaggaaagganaaaggccnaaggagagcccttaaaaaacctttc

SEQ ID NO: 578443 - DNA, 157 bp, Homo sapiens
cacgacggttgccagacacacccctgcctcccactatatgacgcaaccgatcatgatggccactgcttttttgtttgtttgtttgtttgagatggagtctcactctgtcaccaggctggagtgcaatggcgcgatctcagctcaccgcaaccgtcgt

SEQ ID NO: 578444 - DNA, 239 bp, Homo sapiens
gctggagatgggtcatggaggcctacgagcaggtccatgaaggggacctcctgaagctgcagaaggctggatcgcagagtcctgggaggtgaccaagcggtaagtaagtaaataacgaatggagcaagagactcaagcgataactccctgagaatgcattactggagaacgagctaagaaagtaacgtaggatggagcaacgcggcagcgggctgagacaacgacggcacccccgggca

SEQ ID NO: 578445 - DNA, 309 bp, Homo sapiens
cagaagcccttagagcggtcccgtcccatcactgttcacctagaagcggtcatcatctctcactgattcacctagaggagaggtcatctccctcacgtgttcacccatgcggtcatctccctcactgtgcaccttgagcgctcatctccctcagtgttcatctagagcagaggtcatctccctcactgttcaccctgcgggtcatctccctcactgttcaccctgcggtcatctcccatcactgtacagggctgcggtcatctccctcactgtgcaccactgacggtcatctccctcactgtacaacct

SEQ ID NO: 578446 - DNA, 1870 bp, Homo sapiens
  misc_feature (392)..(392): n is a, c, g, or t
cgcaagaatcgcttgaacccggaaggcagaggttgcagtgagccaagattgccccactgcactccagcctgggcgactgagcgagactcttatatctcaaaaaaaaaaaaaaaaaaaggtctcaagaaaccgtgaaattctcccattttaggttctcctcaaatctcaggtgatctcgtgctcaaaattgggccttggttaactgtgaaattacctttacaaggccagttctctataacttaatgtgcaatgtggtgttttattatagacaaatttttataagtgtgaacacctttactattgtggtgaaacaattatattgtgccaacatgtgttattataagacacaaaaacaagtatattttatacatctcctgtgtgacaaagacacnctgtgtctctgtgtgtgatatgtggttcttcctcacaaagattgtgtgtgcgtacaggacaaacttttatatatatatattcgtgggattttacacacacatatatttgtgtgcacacattatacaggcacacgtatttgtataccacagcgggggtatacacatataggggcgcataattcgtgtgtgggataatatttacacagagattttttgtataaacggacgacagtggagacgggttctgtgggacaacaagaggccccctctcacaagagagcgtttatatgtcgtggctaaacaaagagacactctaaatctctggcgtcttataaatatacaagtgtgacacacaaactctgtgtctatcaacacagatatttcacaccaatctatttcacacagacgtttgagggcacccagttatattaaacccgaggggcaggctaatgggggctgcgtttgtgtcgacaaattttgggccgtcaacccaaagagacacagaggttcaccgagcagcaaagagagggcactatccacagttgtatagagggactatgtaggtatggcaaaaacatctttctcgagaagagtggtattaaccccgcgttggaaagaagaggatgcacattattacccctttaaagaagagcgcatagagtgtggcccacatggtggctggagaacaactcctttatgacactcttagggacaaatttgtgctgtgccacagaaacaatttacaagttgggcggcaattttcggagagggcgccacaccacaatttatcatttttggcgcgaggcgaaggtttagcacaaggtgctggcgcaacggcgggcataactacaactaggacccctaaccagcgcaagaagacacgaaaatttgactccctgggcacacacattaattgcgccctggtgcgaacagagaggcaacagcaaggtttttgtagtatacccttcagcaagcatatgaatagtgatggcgcatacaaaaggggaggcaccatcagatcggcgaggtgggacacctacattacacagaacatcctccatgtgaggcaccagcgggccacaaaaaaagtaggccacacccgaggagatcaccccacacaaggagttgcaagacaaactaacacacaaccgaatacaagacgagaccaagcatggagcgcgcaacaaagcaagaataagagaatataaaacacctgaataaccggacgggaaaaagaaacggcggaggagagtaaacacacgctagcaacatggagggagaggaggcacaagagcagatgatgagaaagagcagacgaaaatagcgtgcaggacaaacgacaaccaaagcgggggcagagagcaagaatgagagtaaataaccaaacaaaaagcaaagaaagcaggatgaagcaggagaagagattcgcaacactatgtacaggcaggcagtcagcttgtcctactcacacgagcgag

SEQ ID NO: 578447 - DNA, 314 bp, Homo sapiens
agtaacatatagtccaatggatgtctccatcgccaagtcggtgcatatcggtgagcactgtgggttggtcatcgcccctcccatgtctgatcatgtcagcctagtttccacagtttgccttgccttgctccagtgctatctgtagaagctagtgttacgagcgccacgtcagtgttcctacacgtcttgtattgatcgctatgtatttcctcggaccggcatgtcgagacatgcacaagtcactggacaattgtgtactctcgtcgcaagtgatcaggttgaactgatgaagttaagtatgactggcatctcgc

SEQ ID NO: 578448 - DNA, 666 bp, Homo sapiens
cacatgcctgggggggaggatgccctacattacgacgacttcataatgtcatatgcatgcatgctcaacaaataactgtgcagcattatccaatggacccatactgccagctgcagttcacaaccctctctggacctctccacatgggggacgatgcacatgatgttattctacgggaggaggcataatatgagccacacacagatgctgtaagattcaatacaaccctacacacgctgatgacctatctccttatacttcactctatcaatgcctactcaacttggattttcccccgggagcacggaactctacttacactcatgaactggtcgggataattacaactttttcaagggcacttaataaagacctgttgagacaaagccccgttgactgggtgctcactggggccaagaccacacagtcatacagcgtataatcagagcaacatgtatgcacacaatgcaatactagttaaagcactgcacctcttactggatgacatgcgggacatgacagtcactatactgtctcttgtcaagcatatgtcactctaaagggcctctccattatccaaaggtcacaccgtacccactaatgcaggagatgcctggtgactatcatataggcttgactgtggtctatcaccagccctgattgtat

SEQ ID NO: 578449 - DNA, 448 bp, Homo sapiens
ctacaaaaaaaaaaagaatttggtaccatgtggacatttactaagcaaatgtgatagcttaagattgagggtagccacctgtaatcccagcactttgggaggccgacacagccagatcacgaggtcaggagttcaagaccagcctgaccaacatggtgaaaccccgtctctactaaaatttaaaaaacaaacaaaaaaaacgaaagaaaagaaaattagccgggtgtggtggcaggcaccttgtaatcccagctactcgggaggctgaggcaggagagtcagaaaccacttacaaatgttttcacgatgcagtggtttctgactctctttgccacatgcctccctaaatcagaccgttttaaagatctgggatacaagtctactttgaaggtccagaaatcatcctaagggtgtcgctggcatatagtaatataagtccatcaccaga

SEQ ID NO: 578450 - DNA, 386 bp, Homo sapiens
ggaccttttggccttccctggtcacatgaaacatggaagccaacaggctgggccccccaaattctcctttgatggaaaggaaaggattgttttcctcccaggccaaggggccccttatgccttgccccaaggacaagagttaactttagggaaatgaccttttccactttgggagctcaccttccggggggcctctggcatacccttttccctgccagctgaagagactgccggcagcctggacgtcctggttagctgaaggcagctgaaatgtgggcctccctatgtggggtttagtactgaattatgtgtttgtggttttgcttctttttgtagacccacaaatatttttatttgaatagtaaagagctgtgctcagattgtaa

SEQ ID NO: 578451 - DNA, 565 bp, Homo sapiens
tcggcctgtgttgagcggcccttttgcaggggctggtttttgagaccttctgtgtagatggatcgcctcggggtctctcggattccctaggccttccgcgggagctcctgaggctgctatcggctcctgccgtgtctctgggtcggcgcggactctgtccggccgcgtgggttggtccacgctttgctcgtcctcagctttatggggcccctcacttttaggggtgggggcgagggtatctactgctacgttgaccgctttggtgaccggtggtagtggggcgggtcctggcgtaaccccggctccccgcggcagtgtcccccgcgggagtaacgcgaacggttgggaccgcacggacgtggtgagccccgggggatgggcacgcccgaggcggacggaggggaaacgggcccaccgtgccaagcggagcgctgtgagcgttcaccgcggcatgcggtgcagatagcagtgggcggcgagagggacgtccgacgcccgactagggctgcaccccaagccgccggagtgcgcgcgcaaggccccgcgggccagttgatccgcgcgt

SEQ ID NO: 578452 - DNA, 322 bp, Homo sapiens
tgtgtgaataggggcttcctttatttatctcatgagtaacacgggataatacctaacaggcaggctctggaagataggaaatcacatacacacacacacacagacacacacacacacgatcaatcatgtagctcatattagatgttcactaaataacagctactacagatgcctatcagaagagtaagtagttcattaaattgagctcacacaggtctcttctcttcacatccatatccgtttctgcagcactcacatagatacatgattgtatatctgtaagaaattactgcacagagaatcttaatctcctactaacagt

SEQ ID NO: 578453 - DNA, 215 bp, Homo sapiens
tgtcgactgtatcaggatcccccacatagatttgatagtgaggatagacagaccttcttacagggatcgtgactatgataaccctacggcagctggtgggcgtcttcttcatctcatggagattttgaatgtgaagaatgtcatggtggtagtatcacgctggtatggagggattctgctaggaccagatcgctttaaacatatcaacaactgtg

SEQ ID NO: 578454 - DNA, 135 bp, Homo sapiens
gattgtccagaagccttccataggaggaatgcatggtcattaggtatgccacagctccaaacaccagcaacaccactcaatgactattgaggtaatgacagtgacattgcagctccacatggctgtggagctgta

SEQ ID NO: 578455 - DNA, 190 bp, Homo sapiens
cctgcgtctggcgtcactgacgtcctcctgcttgtgagctcccttccgtcttcccacctcaacccctgagtagctgaggctacagatgcacaccaccatgcccagctaatttttgtattttttgtagagatgggatttcgccatgctgcccaagctggttttgaactcctgagctcaagcagtcagccca

SEQ ID NO: 578456 - DNA, 306 bp, Homo sapiens
catcttcatgttatacatacaatcaaggaggagagacagcgcaggatgttgtcagttcacacatgatactttgggggacatgcctttattttttttcccccccaaggtttaactaaaaactttttaaaaaactacagtttgttggtaacccagggtttccggttcccatgtaacacattattatcccagtatgtaaacagtatcaggtgtccagtacagtcacttaaaagggttctacactctattggacaggcctctccagtgaacagggtctgtccacacttgcaacttattttggcccctgaa

SEQ ID NO: 578457 - DNA, 751 bp, Homo sapiens
ggaaggcatgagcaacggcgtggcggtggggcagcagccgagcacggggctgtcgggacatcacgcgcccagtgtgcaggctagtaccatgctaatttatgggatgccgtctcgcgagcctctcgctgtacttcacgagagctcgacctccagggcaaggtgctgcctgagggcgtcgggcccggggacatcaaggccttccaggtcctgtaccgggaacactgtgaggccattgtcgacgtcatggtgaacctgcagttcaccctggtggagacgctgtggaggaccttctggaggtacaaccgtcgagccagtccagtgaggcgccagcgttggctggtacatgactgaggccgagaagcgacttgcccaaggccatcctggtgctccttctccgaagttcgagccctgtgctccgaatggaccaatgcactgtgacaaggtgctgtacctagggcctggtggaaatcctcattcccgacgtgctgcggaccatccccagtggcttgacccaagcgatcctggagctttgccaatgagcctggagagctgggtcaccgcgacgccatggtcaacatccccgaggagatgctgcgggtgaaggtggcctgcggctggcgccttcgcgcagacactgcggctgctactacgtcgggtcaaccagctggcgcaggcgggtgcgcgctggtgctgcaagaacaacggcacaagatcaagccagatggctgagcgacctccaagccgccgtgga

SEQ ID NO: 578458 - DNA, 338 bp, Homo sapiens
tctattacttaatatattccatgattgtcgatatggattataaggactcacaaaatagttttcagatgtctttaatttttttacttagtgtagatcctataaatggattagaagtattctattaactcccatgtattcagaaatcgaattggagtggcaaattctgtttgaagtaacaagggatatcaaaggaaaaaaataattttgtgactatgtcttctatacgtaaatttttcaggcatctttatcaatggcttatactaaagacattttctggatcatgggtgacacacagaagacctgtggataagtggcattgtgtacactactgcatttta

SEQ ID NO: 578459 - DNA, 386 bp, Homo sapiens
  misc_feature (194)..(194): n is a, c, g, or t
  misc_feature (304)..(304): n is a, c, g, or t
  misc_feature (346)..(346): n is a, c, g, or t
  misc_feature (360)..(360): n is a, c, g, or t
  misc_feature (379)..(379): n is a, c, g, or t
gaaagtctccagatgcagtagctcacactgtagtcacagtgactcaggaggctgaggtgagaggattccttgaggccagggttcgagaccaaccttgggcaacatggcaagaccccatttcttaaaaaaaaaaaaaaaaaaatttaaacttagctgggtatggtggcacatgcttgtggtctcagctacttgtnaggctgaggcaggaggattctttgggcccagggagtttaaggttacggtgagccacaatcacaccaatcactgcactccagcctgggcaattaaagttaactctttggantcaaaaaaataaaaaaattttagtgggtaggcctgtgtttanttgttttaaataanttttccccaagggggcttnaaggtta

SEQ ID NO: 578460 - DNA, 421 bp, Homo sapiens
  misc_feature (13)..(13): n is a, c, g, or t
  misc_feature (40)..(40): n is a, c, g, or t
  misc_feature (54)..(54): n is a, c, g, or t
  misc_feature (98)..(98): n is a, c, g, or t
  misc_feature (404)..(404): n is a, c, g, or t
  misc_feature (406)..(406): n is a, c, g, or t
gttaacaattttnacaacccataatgtgtagtgtagaganatccaacagccagnggaccccactcctaacacattaagtccctggtcaaataaaaganattcccctgttgaataacagaatttaaaacattttcagtggtaggcaagtgtgttaatcttcccctggcccatagtggaaataaaggccgtaaaagaactgagtgatgttattagcagtgcaaatagagttaaaaattgccatcatctagaactgacctcatgtgcttgggaaactgaatcttctcgccacagatggctctaatgagtcgggaggatggtgctgggcagaggtcagtgttggaagtcctttcttatggcaaagagtttgcagtctgtgcatgcatgtgtgtgtaagtgtgtgaaangnaattgcagttgtggg

SEQ ID NO: 578461 - DNA, 852 bp, Homo sapiens
accgctcccttgccattattgttcccccaagactttggaaacccataattgtgcctttacagtaggcaataaacatgttatggccttattatatttctataggaacactcattgtgtaataatcgtctccactgcctctagacaaccccccctcttgtaatatatagtaaccacgaacaacttagttgtgttttaagcccctcctcttataggactccctcaataatattattcacggctcttcttttatacagacaaactgtccgttaactctctcccgacataatacccccccggccgtgtttctatactacgcaccacgacgtaacttgtaataccaaaagtgataataagcccccacggtgccttcttagaaccaaataaaatgtgattgtgctcacaaatctctcttgtctctgtcatactttcgcacaccctaattacgaaagctctcacgttgttcgattcttcccgaatgtgcacgcaccctagaaaaccactattatgccccccccctgttacaaccaaaatacagaatacattcttatgggattaaaacaatatctcctctcaatataacacctgggggtcactcaaacatctcaccccttctttattaccatataatgcaaaaagaatctatgtgcgaaaccacgaactgggtcacaccatctttgatcatcaccagcattcttggcttgtcagcctcacaaagcattgtcacggcccccgttcttggaaccccctcagcgagcattacaaaaaagatgcaaaaataacaacatttgttttttatgaggacatggaatctactaaacatcccaccccaaaaaatgtctgcccccaaaaaca

SEQ ID NO: 578462 - DNA, 366 bp, Homo sapiens
tctaagttattacgtccacacatttatttagattgtcttagctttatctatttcattgttccacgattccatcatatcgacaccgacattatgcttacttgcatgtctccataatctcctcttcgctgtgactgtaaaggccctgctggtcaggtatcttgtaggatgcccctctactggaatttgtctgatgtttttcttattagactggggataagcttttgggagaacagtaattgtattttgtaatatgccagcttgacaatttctttctttctttttttttttttgggaccgggggaatggaatctcattctgtcacccaggctgaattgtagtgccgtgatctgggctcattgaaaattc

SEQ ID NO: 578463 - DNA, 428 bp, Homo sapiens
aaatagtatgacgtatgataaagtgatagagcgaccattcgtggagtaaaccttcatggagtgagagtaaggtgttgactggaatagccctgtcgatatatacttgatatctattctatatattgttctctcaccccatgtcttgtactaggagctgtcgcgcgcagtctcgtgaacgcttacatacctttagatgttgagatgacagagatctaacttctgagagcagaggtgtcaagtgacggtccccttggaggaatggtctttgcatctgactacttccttctgcaactgtgttcttccattagcttccatgacactctcctgctttatttttttctacatctctagcctttgctgtttcctctcctaccccacctttagattttactcagagttcagtctccagccctacaatctgagggaca

SEQ ID NO: 578464 - DNA, 359 bp, Homo sapiens
atattccctcttcattacattttttttttttctaaagtttatggccgggtgtggtggctcatgccatgcaatcccagcaccttgggaggctgaggtgggtggatcacttaagcctaggagttcaagaccagcctgggcaacacggcaagaccctgtctctacaaaaacacagtaattagccagagtgtggtggcgtgtgcctatagtcccaggtactggggagctgaggcagcaggactgcattgaaacctggagatccaggctgcagtgagccatgatcatgtcactgcactccagccttggtgacagagcaataccccgtctcaaacaaaaaaaatttaaagcctaaagcactctta

SEQ ID NO: 578465 - DNA, 352 bp, Homo sapiens
agaaagcttgccagagtccagatggtggtgacaataaggatagagagggggcagtcgatttagggaggcaagcttgccttggacgggtaaccagttgggatatcatgggtggcggagagagctggcttccaggatggtgatatgaggagccaagtgcccttggcaggagaaagacttcaggaggaagggtcatatttgaggggcagggaattatgcttacgattagggattgtcaagtggaggagccctgagcttaagctgggatgtctaccgcggtcgacagagcctcaaccaggagactttatctagatgagacttgggcacagagagaaaaaaggagctttgtatgccc

SEQ ID NO: 578466 - DNA, 427 bp, Homo sapiens
  misc_feature (9)..(9): n is a, c, g, or t
cgacagagntgtgccttgaggcaaaggtacctcctaatttgcttatgttgctgtccgcatgccaagcgtgctgcctggggatgttttcagctcagaggagctgccccccctaattttcccacaggtgccttagggtctagctgcaaccctgcctagtttgggaagattccccataccattcccactggtatgaaaagaaacatccaaggccgggcgtggtggctgacacctgtaatcccagcactttgggaggccatggggggcggatcacctgaggttgggacttcgagaccagcgtgaccaacattgcgaaatcccgtctctaccaaaaatacaaaattagccgggcgtggtgatgcatgcctgtaatcccagctactcgggaggctgaggaaggagaattgcttgaacccgggaggtggaggtt

SEQ ID NO: 578467 - DNA, 349 bp, Homo sapiens
tggcggaccaggcgggtctcgaactctgggccttaggcgatccttcccagtttcagcctcccaaagtgttatgattgacagggcgtgggccactggcgccgggcccaaacttcatgatgtctcttatcagcttaacttcctccgaggacttcccgtgtctcccagaatagagaccggaggtcttcgctggtgctctatcgggcctcggatatggacctgggcccctctgcacaccaacagctccggttggcaccattaagcccttctacctaggctggagctggagcctctctccagttccctcggttggcaaagaccgttcctggccttggggacctctggttgggcc

SEQ ID NO: 578468 - DNA, 195 bp, Homo sapiens
gcactagcccagctcaactttttcatttttattcctttgaaatttttatttatttatttatttaataaagcacaaattagctgggtgtggtggagcacatggtgtcctccttgttggccagaatgatccctcccccctgagcccaagttatcctcaaacaaaaacctaaattcaaaacaaaaaaaaacacaattc

SEQ ID NO: 578469 - DNA, 146 bp, Homo sapiens
ggcgtcacaccgacgctcggcttaattttggtatttttctttggtagagacggtgttttgccaggttggccaggctggtctcgaactgctgggctcaagcaatcagcccgcttcggcctcccaagtgtggtttttcggcgtgtgca

SEQ ID NO: 578470 - DNA, 349 bp, Homo sapiens
gggagatcattgagctcaggagtttgagtccagccggggcaacatagtgagaccctgtctctacaaaaagtcaaaaaaatcagcccggggtggtggtgcatgcctatggtcccagctacgtgggaggctgaggcaggaggatggtttgagcccaggaggtcgaggctgcagtgagccgagatcgcgccacggcactctagccggggtgacagagtgagactccatcacgcacacgcacgcacgaaagtgaatggcacctccctctggttggtgcttctggccatgtgacatgcccttcacctcccaccatcattttaaccttcctcaggtttcccgagagggtgaacag

SEQ ID NO: 578471 - DNA, 321 bp, Homo sapiens
accccccaaggttgggtaaaaaaattttttggtttaaaatttttaaccccaagggcccaaaagggggggggggaagggggggcctgaaaccaagatggtcccaaactctaaaaaaaagggaacaactttaacactagaccgtaataaaagttatgtgaatgggatctttcaaattatttggcggtttttagagacagacttttgctatgtcgcccagtgctggagtgcaatagcgagaactcgaccttcttgaaccttcaccttccaggcttaagctaacctaccacccgagctgggacaactggcacatgccaccacttt

SEQ ID NO: 578472 - DNA, 947 bp, Homo sapiens
  misc_feature (136)..(136): n is a, c, g, or t
  misc_feature (148)..(148): n is a, c, g, or t
  misc_feature (181)..(181): n is a, c, g, or t
  misc_feature (228)..(228): n is a, c, g, or t
  misc_feature (266)..(266): n is a, c, g, or t
  misc_feature (288)..(288): n is a, c, g, or t
  misc_feature (302)..(302): n is a, c, g, or t
gccaaacacacaaggtgtagaaaaattatcctgaaagggaagggggatataagctgcactttcacccccctgacacacgaaggtttcaccccacatagggcgccccgctctttaaggaggttattaaaccattggncttaatataatnggggaggacccaccgcccacagaggacacattnttggagactgcaatattggcctttctggtggcgcacaccacactccnccaagagacgctcgtgccgctctctatatagaggagangtcgtcacccacacatgagatntatatataggagcnctcgtttttgagaaagacgtttgccacacatatatatgttcatatatataattatatataatgttcttttgtgtgttatacacacatggaattgagaaacacttttttttgtgttgtttttggcgttgtgtttgagtaatatatataataccacaatggtgagacacccatggtatttcgtgttgtttctgcgagattcacacaatgttttatacccccttaaggagcttctggtatatttttgaatctggcacacaccacataattttctggagaagttgagagaatgttctcacgccttgtaaagagacccacacaaccacgagaaggagaataatgtaccacacagagatataattttttctgctccaccgagtgaggtttatgtgtgtaaaagtttaagagaacactctgagactttgaataagctataaattaaaccccacacccctatttgaaagagaattgaaataatatgctaacttcacagaaactaaattgagttcttcgtagaattattcttaataaaataatggctataattttcttctgcacaaatcacgatgtccgcactaagcgatggagtaatacctaataaactgccctcagttaatccctggttaataaatgtggtttttacaatta

SEQ ID NO: 578473 - DNA, 213 bp, Homo sapiens
tattttctgttatgtagtggacctgcagctgtatggctaggccggaggacattaggagggcagagagggcccctgttaggggtcatgggctgggtttactatatgataggcatgtgattggtgggtcattatgtgtagtcgtgcaggtagaggcttactagaagtgtgcacaacgtaggcttgcgattaaggcgcaccgcgcattctcaggat

SEQ ID NO: 578474 - DNA, 900 bp, Homo sapiens
  misc_feature (262)..(262): n is a, c, g, or t
  misc_feature (361)..(361): n is a, c, g, or t
  misc_feature (436)..(436): n is a, c, g, or t
  misc_feature (550)..(550): n is a, c, g, or t
  misc_feature (576)..(576): n is a, c, g, or t
  misc_feature (602)..(602): n is a, c, g, or t
  misc_feature (614)..(614): n is a, c, g, or t
  misc_feature (626)..(626): n is a, c, g, or t
agcggattcctagttaaggcggcacagggccgaggcgtagtgtgggtgactcctccgttccttgggtcccgtcgtctgtgatactgcagcgcagccatggcagaaccgcagcccccgtccggcggcctcacggacgaggccgcctcagttgctgctccgacgcggaccccagtaccaaggattttctattgcagcagaccatgctacgagtgaaggatcctaagaagtcactggatttttatactagagttcttggaatgancgctaatccaaaaatgtgtgattttcccattatgaagttttcactctacttctgtggcttatgaggatacaaaatgacatccctaaagacaaaggatgnaaaaatagcctggggcgctctccagaaaagctacacttgagctgacacaccaatttggggcactgaagatgatgngacccagagttaccacaatggcaattcagaccctcgaggattcggtcatattggaatgtgctgttcctgatgtatacagtgcttgtaacaggtttgaagaactgggagtcaaantttgtgaagaaacctgatgatggtanaatgaaagggctggcatttattcaangatcctgatggntactggattganattttgaatcctaacaaaatggcaaccttaatgtagtgctgtgagaattctcctttgaggatttcagaagaaaggaaaccaatgtgatgcaagatatttcttcagaaggtttggctgtgggtactgtcgatcaatattttttgcacatttccttctaattaggtgctttacaactgtcgcctctggttagccggcgttcggtgaagtggcgtttgtagaagagaagccaaggggtttggcaaaattcgcgggcaaaaaaaggggttgggcgaac

SEQ ID NO: 578475 - DNA, 243 bp, Homo sapiens
catccacctgtgtgctcatgagtgtatttcttcacatctgtgtccctggccctggccgcggggagccccgcgttcatcgccgtgggctacgtggacgacacggcagttcgtgcggttcgacagcgacgccgcgaggccagaggatggagccgcgggctgccttgtcataagagcaggaggggccggagtattggggcaccagggagacacggaatgtgaaggcccagtcacagagtgaccgag

SEQ ID NO: 578476 - DNA, 178 bp, Homo sapiens
ccgtataaaggggcgcccggcgccccgggcccccccggcggactcctggcctgactgcggggcttttttaatgcttccctggacttcggggaggggcggggggagggagggattttttttcccgtttgttccctttttaggataataaaggtgtgtgatttggtttgggcccaccgga

SEQ ID NO: 578477 - DNA, 140 bp, Homo sapiens
gtgatgggactggtgcgctcagtgccagatgacctgatatccttggtccatccacagtgaggaccccatcagatgacaggaatgaagtaactggtgagagggtctacatcagcctgggatccggtattccctgtggaact

SEQ ID NO: 578478 - DNA, 219 bp, Homo sapiens
tctgtatgggggatctcggagatcccccatacagagtacaaatacgaaattagctgggagtgatagcgcatacctgtaatcccagctattcgggaggctgaggcaggagaatggctcgaaaccaggaggtggaggttgcggtgagccgagattgcctcattgcactccaacctggcgacagagcaagattccgtctcagaaagaaaacaaacacaaaaa

SEQ ID NO: 578479 - DNA, 218 bp, Homo sapiens
  misc_feature (110)..(110): n is a, c, g, or t
gggaaccccccccccctttttttttcctcttttaaaaaacccggggggtttcccccctccggtttttttttttggcgggggggggggtatatttttttcccagagaaacnttttttcccttttggccttttttttttcccttttaaaaaaatttttttcaaaaaaaagggttttttccggtccggtttttccgggtttttttttcccccccgttttta

SEQ ID NO: 578480 - DNA, 99 bp, Homo sapiens
cttccccttccgacgaaaatattcccacctctgtcgcccgcccgcctcccctgcctctgacagccatggcccacctccagctcgcggcggtcgccgggg

SEQ ID NO: 578481 - DNA, 383 bp, Homo sapiens
gtgcctggggattagaaggaggggagggatacgctgggcctgagagaagtgtgctctgacaggtatcacagcactctagaattagcctagaggccatagactggagcagagggcagggatagccaccgaacaggtcagagagaatgacagaatgacgtggacaggccagcatggaaagagtctggatgggtggattgctccatccccgtagagggagggaggcggtggggcagcacaacgcaaaatgcacatcaaggtttagcaggggcagtcacaggcagaggtgagaggcaccttggtgtgtccaggaatagaaagtggaacttgaagggcatagaaaggagacgcggagagccagagccagacagagccctcagggcttg

SEQ ID NO: 578482 - DNA, 107 bp, Homo sapiens
atggaatattccttcctgtcagtcacagctttcttcatggcttaagattcagagacttcctgggcacagtggctcacacctgtaatcccagcactttgagaggtcgg

SEQ ID NO: 578483 - DNA, 179 bp, Homo sapiens
tggtgcagtgtgactgtgatgatgaatacgttacattagggatttgccaagcccacagatcacgaggagtgaaccttaatgtaagctatggactttcgttaataataataataatcactattggctcattaattctaacaaatgtgccatgctaacattaataggggaaattgtgtgtg

SEQ ID NO: 578484 - DNA, 438 bp, Homo sapiens
actggaggctgcaatatagcctcctgtagacttgttcagcaccaattgtctgttcatctgtggaatgacttgaatgtgtctattatggtctccatactttctcaccttcctagagtaaagttgaataaactgtgctgactatcctcacaagatagtaattgatcaccttaggtgggtcatctgcttttcctaacaagtctgctttgctttgaattgaatacgtctattccgaggcatattcgccagctgtatgctccaggaaatggagcaactaacagtggttttccttatgatgtcatagtcttatcatgtcctatctttttttttggaaatgcaacttatgagatcaacccaaaggaaattgtgcatcagtgtccataggggtggttcacagagtggcaggagtctctgagcaacaatctaagctgtatatgaatt

SEQ ID NO: 578485 - DNA, 391 bp, Homo sapiens
  misc_feature (103)..(103): n is a, c, g, or t
aacaagctattaaagacgccgactgcctgaggggcggggcacatgagagaggcgtctgattgggctgagaagggcggagagaaacaaaacagatcgcacgccnctcactaaaaacacgctagccaggaccctggtggggaggagcattgcttggaagagacagggccgcagaaagtagaaacggtccagatgagacttgcatgggcgggaactagagatggaggactttcccgcgcaagggggacaggcttgacttgaaaggaggacacgggaaagaacaaaggaactttagactcgcgtgagacaggttgtttgaaatcttgaggagaggtccctggaaaacccgaagaggttcttggatagggccttaaggggaggggagcgggggcta

SEQ ID NO: 578486 - DNA, 211 bp, Homo sapiens
gttcatcttctccatgtgttccaatttgagtccaagtgtgggacaaggttttaactgtccaagcagagatttctccaagtggaaatccatatttttgtgagatctccatgctttgctctcaaggcttggagaggtatgtcccacctccatgggttgctcaccgcctgctacacaggcaggtaatgcggattggaggcaggtcggatctgca

SEQ ID NO: 578487 - DNA, 183 bp, Homo sapiens
ggggacgtcctctcttgcggataacccatacatccgagccctagtcctaatcacataacctattcccccgatcaatctcaattacaatatatacaccaacaaacaaggttcaaccagtaactactactaatcaacgcccataatcagggaaagcccccggaccaataggatacagtagggaga

SEQ ID NO: 578488 - DNA, 358 bp, Homo sapiens
gactgcaggatatgccccggaaatacgcagtagatgtgcagcctatcagaattggagatggaacgacacgcccttttgcggaggacggtgaacggccacctagtcctgcaggttatcgacgggtacaggctcgccgtcttgcccctatttttcgatgggccattcccattatgcagatcacatgattgggattggtggagactgagatgatatggaaatattcatggaggagatgagagaaatcagaagaaaacttagggagctgcagttcaggaattgtctgcgtctccttcttggggagctctctgatcaccatgaccatcatgatgaattttgccttatgccttcccctccacca

SEQ ID NO: 578489 - DNA, 432 bp, Homo sapiens
  misc_feature (228)..(228): n is a, c, g, or t
  misc_feature (370)..(370): n is a, c, g, or t
acatggaggctggtgagggtgacctggagcctctggtcatgatcaaatgagataaggaagttaggctgctctgaaaattgacacacagcccaatccatagatggtgttattatcatcaatatgattattttgtgtaattccacaatagctgtttcattaacttcaaaatgtggaattgcatatatttttaaattttgtgtccatttttaaaaagtttacctacctttntaaaacgaatcaaccagaacggagtttcacccacgggaggtgcctgccttcctcttgcccacttgctcccagcgtgggtttgccgtttctcacctcgacttcccgacagagacccgggatctgtcgccatcgctcctgtctntcgggcaaacgaccgtgaacatataacctttcaggtttttaacaaattgcaagatttcagtg

SEQ ID NO: 578490 - DNA, 255 bp, Homo sapiens
  misc_feature (61)..(61): n is a, c, g, or t
  misc_feature (119)..(119): n is a, c, g, or t
  misc_feature (243)..(243): n is a, c, g, or t
aggctggtctcgaactcctgacctcaagctatccacctacctcggcctcccaaagtgctgngattacaggcaggagccatcacgaccagctatttctggaattttccatttaacatttnggaccttaccaactgcggtgcaggggccaagggaaaacttcccctttaccctctgaaggtcactgaaaagtcagctcataaaagcagaatagaaattggatacacattcattagcatgcaaggngaaatcagagtg

SEQ ID NO: 578491 - DNA, 778 bp, Homo sapiens
tcccccccccccccccagggggccggccccccccgaaaaaaaaaggggggggggggggggggcccccctctatatcccgcgggcagaattaacaccgcgttcgaggaaagagacagaagccatcaacatcgtccccccgcccaaggtggcctattttttcacaagaactcccgaggaaatataaagcggagcccattatttctgtcgaacagaaagaataagagggtaacaactcacgagcgagagataatatactaataggcgcccctattatataagaaccccccggggggtaataaatatatttggtaagcccctttatagggcgccgagtttgtgtgtttgagaaaagcgcgcctcgtgtgaaaaaagtctataaaaatagtgtgaggcgcccccaccactgtagcaaatgaatgaagggcgccccggggggaaacactcgcctccaaaaaaatgtttgtttctgtaccccccgaaaaagatgatttagtccccccccccacgaggagggggatccacacagatggcgagagaaacaaatgcggtgggacccacaacaaaaaaaaaacaccacagagagaatcccgacgaaacaacgaggggcttatggagcacttgagaggaaaaacaaccccccttttaaaaccacaatgtgctcacacaaaaaagagcgcgagaccttgaaaagaacaaaaacacacgaagaaacacaaaacaaagaaaagaaaccacagaacacacgcgcagcaataatagtggggggcggagacaacat

SEQ ID NO: 578492 - DNA, 951 bp, Homo sapiens
tttatgcgtaattttcggaatttatatctgtgtgatcttttacatatcttagtacttttagatgggttgctccattctttatagtatttttattatctcgtatatggagtttactgcatgttttcgatgggcacttccaacggtttactggagataatgtgatctctgggcaactgtatttgtgagtttaagggagttctatgttcgagcatggttacgtctgacttgtatgccgtaggttatttcatttgtatttcgatgtaattatgtagtgtatttattttcaacatattgttagagtatggttgtaagatactccagttaacttatctttttgtcctttgtgaagtgtacctggaattctttgatgtatgttagttgcatcaatgaattaaaagcgagaatgcttgggggaagaagatttggctataatcgtataaaatatctgctcatagttagatacagcagtataattcatgcagtaaagcatctagaatgcaaatgaatagccttttgtatcagttattaatcttttctaactctgcttagctgctaatgatcctgaggcatagaaagtctgaagaaatttgtaataatagaattgccttaaaggatttgaagtaagaacataattattggggagagttcttttagtgattgcacagtatccctacattagcattaatttaaggtaaagagtgcagattgattttccctctttcctggtaattcctaagtaattaagaataaataaggttccataaagaaattgtagctggaatcgttaataacaattgtgagtggactgtcttgagttgcccctcaccatgtccttagatctaactctgtgctaccttattaagctgcatcagcaggcttagctgaagtggcttcattgtcagatgttagttgatatctccacctaaatgcatgtcatgtattctcataggc

SEQ ID NO: 578493 - DNA, 300 bp, Homo sapiens
agtcactgacattacgatggatggacgaggagccggtggcgagggacgattgccatcgccattttggactcttccctgccccttatgtcaagcttctggagtgactagacgctcactgtctactgctactatttatttcccatgtacaaggtggctctggcatccaacacctccctattccttctgcaaatatcttaccagataacgttctggacaaatccttcctactaactgtcttcatttttggcttggggcagacacagcttgccgaaggaggtccccctccccgagagtcctctc

SEQ ID NO: 578494 - DNA, 1043 bp, Homo sapiens
agaggagatggagagataagagaagaggcggtaatatatagagattgaggacgattgaaagattggggagaaggagcaacaagaggttaaataaggtttggggaaaaaaaagagagatcagactgttactgtgtctatgtagaaagaagtagacataagaaaccccattttggtctgtactaagagaaattagtctgctttgagatgctgttaatctgtaaccctagccgcaaccctgtgctcacagaaacatgtgctgtgttgacccaaggtttaatggatttagggctgtgcaggctgtgcttggttaaaatgtgtttgcaggcagtatgcttggtaaaagtcatcgccattctccagtctcgagtaccctgggacagaatacactgtggaaggccgcagggacctctgcccaagaaagcctgggtattgtccaaggtttctctccactgagacagcctgagatatggcctcgtgggaagggaaagacctgaccatcccccagccagacacccgtaaagggtctgtgctgaggacggttagtgaaagagatagccctctttgcagttgagataagaggaaggcctctgtctcctgctcctcccctgggaatggaatgtcttggtgtaaaaccaatcgtatgttctgtttacagagataggagaaaacttgctttatggtgtaacgtgagacatgctgggtggccatactgctgtttactggactggatgtctgcgtcaagtcaacattaaatctaccctaatggccctctagggtcgaggatctttccttaaagtttttttggcacacaaaaaggcctggcgtacaaagaaatccggcagagacatatccccaccataaacccaaagagagttaaaaatccccctcgaagaaggggggacacagcacacacaaacaggggggaagcagaacaaaggaggatcgtaccacaactgaagagagaagcttgacagcgcagcttagacgaagacagggctatattagccacccacgcgacaagaagaaaagggcgagataaagtg

SEQ ID NO: 578495 - DNA, 221 bp, Homo sapiens
  misc_feature (91)..(91): n is a, c, g, or t
  misc_feature (159)..(159): n is a, c, g, or t
  misc_feature (201)..(201): n is a, c, g, or t
cgggaagagatgcgtgggaagagatagcgtgggaagagatagcgtgggaagagatagcgtggtgtaatacaatgaagggaagagatagcgntggcaaaaaggcaagacaccatccgtccgtgccccactttccagttccagcttgcatggaggcccgcnggaacgctgttccctgctccgtcttatgcagtgagacgtcangcattctggtgccacagcct

SEQ ID NO: 578496 - DNA, 134 bp, Homo sapiens
ctgtctcactgcagcgggtctccctgcctcaggccctgcgccctgaccaccttgcatccgtgtcatttccgcctcccctctgcgcgttgcccgctagcatgcttgtttctgcacccccatgcgttgattgccag

SEQ ID NO: 578497 - DNA, 932 bp, Homo sapiens
  misc_feature (35)..(35): n is a, c, g, or t
  misc_feature (72)..(72): n is a, c, g, or t
  misc_feature (170)..(171): n is a, c, g, or t
  misc_feature (185)..(185): n is a, c, g, or t
  misc_feature (190)..(190): n is a, c, g, or t
  misc_feature (206)..(206): n is a, c, g, or t
  misc_feature (210)..(210): n is a, c, g, or t
  misc_feature (250)..(252): n is a, c, g, or t
  misc_feature (271)..(271): n is a, c, g, or t
  misc_feature (278)..(278): n is a, c, g, or t
  misc_feature (285)..(285): n is a, c, g, or t
  misc_feature (299)..(299): n is a, c, g, or t
  misc_feature (314)..(314): n is a, c, g, or t
  misc_feature (344)..(344): n is a, c, g, or t
  misc_feature (386)..(386): n is a, c, g, or t
  misc_feature (411)..(411): n is a, c, g, or t
  misc_feature (415)..(416): n is a, c, g, or t
  misc_feature (425)..(425): n is a, c, g, or t
  misc_feature (428)..(431): n is a, c, g, or t
  misc_feature (433)..(433): n is a, c, g, or t
  misc_feature (437)..(437): n is a, c, g, or t
  misc_feature (863)..(863): n is a, c, g, or t
  misc_feature (900)..(900): n is a, c, g, or t
cttaaattacaaaacagagaccacaaagaaggccngaggaaaaaccccaggacttccaagggtgaagctgtnccctcctcgcctgccaccctcctcgaggctcattgagtcgtccttggagaggggcagaggactcagaggggatcagtgcgccaggggccctgggctgnngcgggtgaggcagngagtnctgaggccacagagcngggnaacctgagccgcctctctggccccctcccccaccactgcnnnaacctgtgtacagcgcctncgccccncccctcngaacccgtccatcngctctgcacttcccnggcaggtggcgctgggcaaggcctgcagcnatactcgctgggcgcgggtgtcggtgagcgtagcgcacagtnccacgcaggtgatagcaaggccganccgnngcagggggntgnnnngnaganagagtggggaaaatgtaaatggggacagtggccaacaccgatgcaggcagatcccaaagtcagggttaagccatcctggccagcagaagccagctccccactccaccaccacaccctgtcacttccgtccctccccaatatccagaggagggtggactctgttcttgctagcaggaggcggccttgggaagttgtccgagtgggccagagaggctgaaggctgctgccttcctgcctggctcagtctctgcccagtccccagtccccagcagccagtggcccgtggcagggccctcctgggggtcacagcctgcgctgagctcagttcagggaagaacaaagcagagaggaacagagtggagccgtggcaccttacacgtagttgctggcagcagcagagcgggcagcagaatacttggcggagtnaggcttgtctgtgcggggtggacagttgcagcaaagnaccccccgccaaggagcagcagggcgggaggg

SEQ ID NO: 578498 - DNA, 310 bp, Homo sapiens
cacttgaggttgctatcggtcggcctatcccagttctggtagttgaacggttcgcggatctgggtcatgtaaccgtcgagggtcatgcgttcaattgctcccgtagtcaggtttagcttcgggctgacggtgaaggcaggcccatagtgaaaagaggataatgggctcttcgcaaggtattcgttacccggttgcccgatccaaggtccccagcacacgccatcctctgggcattggccattcgttctctccaggcccacgctatactcggcgaggtaagggagcagctggttctccaactttgcggccg

SEQ ID NO: 578499 - DNA, 613 bp, Homo sapiens
  misc_feature (345)..(345): n is a, c, g, or t
  misc_feature (502)..(502): n is a, c, g, or t
gaattatctaagttaatgctgagaaaataaaacagaattaaaaataacaacagagtgtagcatggtggttaacagggcttcttcgcagtgttttattacagctaacttctactcctcagagtctgattcaggggccatctttcaggctagtctagcttcactactgattattctggctaggatttaataatgactgtacattgtaagagcagcaaacctcataggtgcccaagttctgatgccaagcacaatcacctgcatcatatgggcaagcccttctgctcccatctaacctggacagggataagcacactgccaagtggaacagcatacttatgatggacntttacccacagatttgaaactgtggccggttccaatatatttttaacttgaaggctcgtgccgaatttggacgagacatcatgatcatcgagaaatgcaactacagggggattcattaacttagtaaaaggctctaatcaaaggaaataatgcctgngatacttggaaaatggaaccttataccattatggggaaggaaattttccattcttagggaaccgttgaagtcctattcccaaaggattcaggttgaaagaatactgttccc

SEQ ID NO: 578500 - DNA, 368 bp, Homo sapiens
  misc_feature (294)..(294): n is a, c, g, or t
cagcggaacaagcaaggggctgctgagaagcagcagagtgacacagggaagctggattcttgctcatctgtgacaaaggctgaatccaaaagtagatagcaacagttaaaggattttaaaaaaggcaaatgaagattttttaaaatggcgactttaggcttcaaacaacctcttcttagtatccttggcaaagccttaataactctccccactaaagatgaagaaacagagagaaagggagctgacctggatgagtcaaatcgcaccctctacagagccacctccagctatccntggcctcaaggagctaattaagtagcagagataattaaattctgagaaaatccccaactgtgcttgttccgctg

SEQ ID NO: 578501 - DNA, 121 bp, Homo sapiens
agcgatcttagcactgttcggatgatcagattgctcgttagctaaggaggaagttgaacccatcgcaaagaagttaaaaacctgaaaaacgattagacgaatggctaactagacataacca

SEQ ID NO: 578502 - DNA, 567 bp, Homo sapiens
tgcgactcgtgaccaacatgctgtgatgtgtgcgagggaggaatggtcagctacacaacctggatcttaccacagttggatatgactgaggctctccaatgggccagatatcactggcgacggctgatcagaggtgcaaccagggatgatgattcagggccatacaactattcctcgttgctcgcctgtgggcgcaagtcctctcagatccctaaactgtcaggaaggcaccggattgttgttccccacatccagcccttcaaggatgagtatgagaagttctccggagcctatgtgaacaatcgaatacgaacaacaaagtacacacttctgaattttgtgccaagaaatttatttgaacaatttcacagagctgccaatttatatttcctgttcctagttgtcctgaactgggtacctttggtagaagccttccaaaaggaaatcaccatgttgcctctggtggtggtccttacaattatcgcaattaaagatggcctggaagattatcggaaatacaaaattgacaaacagatcaataatttaataactaaagtttatagtaga

SEQ ID NO: 578503 - DNA, 860 bp, Homo sapiens
ctccccccgtccgtcgtgtcgtagcagactaaggagtagagacaagcgaagacatgcccgccgcatgggcttctatactatgtccgtgccatcggtccccctggatgacacaccgtgttgggccggctggccccagtgtttctctaaaaggtgaccccgtctaaaatgccactggtcagaatcctgccgcaggttcacgcatctaagctccagttttacggcattcgacctttagggctcccctgggagcaaaaataacgggtttcaaccccgcgggggtgtagtcacttcttccggggcaaattgtctcttaacgccgtgtgtgagagaggtcctccgtcgccctcggctcttttccccacatagccccctgctcttttgctttcaaaatgagggtgaatctacaccacgccttaaagttttgtctaaaaggtgagggtggtcacaaaacattttgagccggatcttcttttagaaccgaattgaacacccgaggcggttcataagcccccccctgaaattccctacccccggggaaatccgtcctttcacccccgcagtagcgccactctcttcatccccgcgacgcaatgggaaccaattatcttggggcgggcaggatgaaaccccctttgagagagacataaattctcaagggtgcatactcggctaaaccccaagtacctgggaggctcaaacaaaaaactatagtacaaattttggcgcaatttagcaagagtaaacacaccttctttttaaagagtagacaaatctaatcttagacccccgaaagttgtggacccaaaacccaccttgggccacataggcccaaagcccaacaagaaaaaaatgaacaaaac

SEQ ID NO: 578504 - DNA, 135 bp, Homo sapiens
cattttgtccatgagtagactgtctgtcacagggttaggtgtacagataatatcgtcactcgaggtaatcagcataatatctgataggtagtttttaaatccctcacactcctcccaacttccaccctcaagtcg

SEQ ID NO: 578505 - DNA, 486 bp, Homo sapiens
  misc_feature (233)..(233): n is a, c, g, or t
ggctcgcgtgcgagcgcgaggaaccgccggtatgcgcgatagacggccgcgaccgagccggccggcgcatcgagcggcccgcgcaggaagttcgcgacgcgcacctccgtaacgttgccgcgcgcatccagcccgatcaccggcgccgaacagcggtagtcgctgttcgcactcttgttccagaactcgatacggcgtcgacgccaggtgcccgaaatcggccggaatgcttncgccgtagcgcatcggcaagcgcgaagccgtcgaggaagatgctgtctccgcccgttgcttcgttggccaggcaatgcaggaactgcacgcccggctgcaactcgcgcgtcggcaaatccgtatgcggcggcaggttcagcgacgtgtacgcattgctgtccggacgcggcttcgattcgacgtcaaacaggacgccgaaattgctttcgcggatcaggccgatgcggcgcgcgatttcgtcgacgcggccgc

SEQ ID NO: 578506 - DNA, 1014 bp, Homo sapiens
  misc_feature (368)..(368): n is a, c, g, or t
  misc_feature (374)..(374): n is a, c, g, or t
  misc_feature (508)..(508): n is a, c, g, or t
  misc_feature (513)..(513): n is a, c, g, or t
  misc_feature (523)..(523): n is a, c, g, or t
  misc_feature (556)..(556): n is a, c, g, or t
  misc_feature (589)..(589): n is a, c, g, or t
  misc_feature (594)..(594): n is a, c, g, or t
  misc_feature (632)..(632): n is a, c, g, or t
  misc_feature (859)..(859): n is a, c, g, or t
tacacggagacccggtggcagaagtggcagaacaaggatgaccagggcagcaccgatcggcaacggggaccagcacccactggggctggacgaagacctgctggggcctggggtggccgagggcgagggagcaccaactccaaactgaccatgggccgtggctgcctcgtgagcctcccagagcccaggcctccgtggcctcctcctgtgtgagtcccaccaggagccacgtgcccggccttgccctcaaggttttttgcttttctcctgtgcacctggcgaggctgaaggcgaggggtggaggaggccccagcacagcctcatctccatgtgtacacgtgtgtacgtgtgtatgcgtgtgtgtacgngtgtangcgtgtgtgtacgcgtgtgtacgtgcgtgtgtacacatgcgtggccgcctgtggtgtgcacgtgtgctctgggctccgaggcttctccagagctgggagctggctggcgtggcaagggcatgctctggggcagngtgtncctcaggaancagggtcctccctcccctttctgcctggtcagncccgtggcctctggcccaccaagctcctgtcanccagncatggtgtggtccaggcagggacatctcggtacccttnctgactccgtgggccctgggtgcgctgaggcctggaggcgtctacactggctccacatccacttcccccgcagctcgtgtgggcgctcgtccacaaacactccgtggctgagaggcagcggatccaggcagcgatgctgagccacctcctccgagccttcctttcacacagaccaccccggaggacacgtggatgatggggtcagagatcactgagctgccctcaanggggctggaacccgggtgctggggtcatgctgctccgtggtccaagtgaggtctcttcacgagcaagagaacataagggacagacgtcaaaaaaaaaaacacccacaaaacacggcggcccagacacgagccacgagaaggacaaaaaaagggcg

SEQ ID NO: 578507 - DNA, 462 bp, Homo sapiens
  misc_feature (71)..(72): n is a, c, g, or t
gctcgacctgaaggtgaagcgtttctgattatcgggttattggtcgttgccgcgtgggccatgggccgacnncttcgctgcgaaccgggtattgctggttcgggcggtcggcgaagaagcattccagggtccgtccgacggtcctgaacgccagttcggaccaggggatctcgtgttcttcgaacagccgtacttccaggctttcttcgccggcggaaattccaggtccaccagttcggcacggtagaacacatgtacctggttgatatgcggcacgtcgatcaacgtatagatgctcaggttgcgcacctgggggcaagcctcttccagggtttcccggcgagcggcctgttccacggtctcgccgttttccataaaaccggcgggcagggtccagtaaccccggcgcggctcgatggcacggcggcagagcaggacctgggtgccccagaccggcagcag

SEQ ID NO: 578508 - DNA, 427 bp, Homo sapiens
gcaggggaattgcttgaacccggaaggtgaggttgcggtgagccgagatcacaccattgcactccagcctgggcgatgagcaaaactccgctgcacaaaaaaaaaaaaaaaaaaaagaattgatggtggtcgggtgtgcgggtgtggtggtggctcacacttgtaatctcagcactttgggaggctgaggcaggaggatcgcttgagcccaggagttccaagaccagcctgaccaacatagagagaccctgtctctgctaggaatgcaaaattagctgggcatggtggcgcatgcctgtagtcccagctactggggagactgaggcaggggaattgcttgaacccgggaggtgaggttgcggtgagccgagatcacaccattgcactccagcctgggcgatgagcaaaactccgctgcacaaaaaaa

SEQ ID NO: 578509 - DNA, 212 bp, Homo sapiens
ctctagagcataaaacaagcacccatttattgaattagttgcatgcaggagcattcctgatcttaccatgagcagcagagacgagtgtatagagtgcaggatccagagcggggagaggctacacgcagttgggggcctgtaggctgtttcctggttacttggtgacgtgcagagctctctctggggggctgcagctcgtcttgcggggactg

SEQ ID NO: 578510 - DNA, 287 bp, Homo sapiens
caacggaacctgtcacccaggacgctgaggacaacacagtctctctcctgcagaccaatggtgccatctccgaaccttcactatcagttggaccagaggctgacaacttcacagttctcaatctggctgtggacagatgcatccccatatctcatcaaaatcaatttgttccacacatgcatcctccaattccacttcattaacacagtctaacaatcttctcatgttcccaagtccagcaactttgcagcagcacactgttcatggaggctcatcagggcatccca

SEQ ID NO: 578511 - DNA, 235 bp, Homo sapiens
gaagggcaactggaccagaagacagccatgtactcctgtggaaagtccgtagtccccttgttttgattgttaaaggaacttgattccagaaagccactgagaaaatacttacggaggaacagacgacactgtcaaaaaagaaagacctgttcctggaccttgatcagcagactgtgatgctatggtgtcccactctgtgatttgtggcccgggaaccacaagagattgcttggac

SEQ ID NO: 578512 - DNA, 548 bp, Homo sapiens
  misc_feature (90)..(90): n is a, c, g, or t
  misc_feature (133)..(134): n is a, c, g, or t
  misc_feature (548)..(548): n is a, c, g, or t
ttgctctgtcacccagattggagtgcagtggcacaatctcagctcaccgcaacctccgcctcccaggttcaagcaattctcctgcctcancctcccgagtaggtgggactacaggcgcccgccaccacgcctnnctatttttgtatttttagtagagatggggtttcaccatattggtcaggctggtcttgaactcctgacctcaggcaatccacccacctcggcctcccaaagtgctgggattacaggtgtgagccaccgtgcccggcctgttttgactcttttatgaactcttttgtttgttgggtttatcgacctattaacctttttaggatttttttaccttatgcatcttttaacgcttttgcattactcttgttttggattaggtgtagtatttaagaacatatcttccttatacaataaagccatctagtagaaatcaagtgcaggtgactggaatgtatgctcaacaagggcaagttatggtctagttcagaggtgggaaactatgggtcatgcattggctgttttcataaatcaagatn

SEQ ID NO: 578513 - DNA, 1028 bp, Homo sapiens
  misc_feature (692)..(692): n is a, c, g, or t
gagccgcctgaccaggcctcaacacccttcgtttgtcacgcacgcactttcatactccgtcctcgcgccccttttcctacactttcctcttctccccgagctcggatggagcacgcgtcttatcctgcgcgattgcacttctgggagcccgaggtcgaagcccggcgctgccgcccgtcggcctgacgggaagcgatgaagaggcctgcgacgcggcagagaaacaacgtcggatgtcgtcatcggagagaagtcgactccctaccatgcatgccggcggcaggagtatggcccgaccaatcgcaagttccgcccggtccccactgacccccgcttcaacaagatgtaagaacatgctttccttgcaaaagtcgtgtaccgagtcgaaatggtgactactgttctttcacttcgaaattatttgttgcttgaacgacgacataaatggcactgctttaaatcgcttcgagtctcccagagattatactcctaaaaggtctagcgatatacggtgtctcgcttctccccgtaggcgacaagctgcactaaatttataacagccattgggtgggacccggaaaagttggaatctacggtttgcaacgttgccatatgattccacgttctcaatatcccacaggacagtgctgctcgaatagcttcgatgcgacgaatgttcaagactttgcttnggagaatccggctgttgacagcagaacttgagcgaagcaccgtcccttggagagccatgtggtccgaattggtccccacaacatgtgtcaataccagcggaggaccatgggacccaacagcggttgcctcattagggcttgctatccatttggggtctttctaaggatgaaatcgcaaccgttgcgccacgttaaactttgcgtcgacagaacggcaccgtggtgagttaaatacgacctcgacttaccccggaccttgaatgggtacccaattggctcctcaaagtgtggtcgcgaaaactagtaaaccgcgcctgacaatattgactggcttac

SEQ ID NO: 578514 - DNA, 356 bp, Homo sapiens
cccttatttatttttaatggggaaaggggtttttttaccaagcatccctgccctcctggagacaccacctgctttccggggggccctgtgatgggagttggtggggactgagtccttttgtaggggcaactgggaaacttttgtcctttgaggaaaggaagctccccgcccctcggggggggttttttatttgggggaaaggaggggggaagggttgggggaagagctccagccggtttgctccccagctttgtaggggcagaccagggtcccctttgaggtaaaggtgagagaaaaatatttacaaaggctttatttttttttttaaaaaaaaaggccccggtattttaaaagca

SEQ ID NO: 578515 - DNA, 606 bp, Homo sapiens
agcggagctgggaggctggagatccctaccgtactagcctcctctgccgtcgcgtgagcttcccgagacctcttcaggccgcccggagccgttcccggagcccggccgtagaggctgcaatcgccgccgggagcccgcatgccggccccgaggcccgccgcgcgaccttcgatggcgcctcccatgtcgacgccatggtgaaagctgactttctaactccgctctggcccagaacggagggcaagaacggacggaaccctaagagcggcgatgaggcactcatcatccccctccaacgccgtcgtccgcgtggtactgcaatggactacagatgatgtggtaccagttggccacaaagaagaccctggtgttggtgcactgtgctttgggactatgcactttactgcttgcacggtgtaagttctagagaggacgcactacattgttagcaacacctatttttgcaccttcagagccatgaatgaccgctggtactactgatgggaagtaaacgctacatcatacacgaatgagtgtcaatcttaaagtgatgcccatcgtgcatagtgcctccaagctgctctctaccaaacaagttgacagaaa

SEQ ID NO: 578516 - DNA, 308 bp, Homo sapiens
aagcccagcgtgctcaagtccaaggcagagggactgagctgcactttctggccttgccttccagctgccctgaccctaccaagtacttggccttcccttagactctaaccatatatcatgaagggtcctctgatcccaagctgcctgaccattcctaaccctacctgcatatgcctgcatagggtctcaagaaggccaccttcctcagattgaaccaggccagtgggaagctagagcatactgcgtactttactcactaggcctcgttagctagcatgactggctggagaactagcccatgctactga

SEQ ID NO: 578517 - DNA, 171 bp, Homo sapiens
aaaaatatgtagcagcatagaataattatgaccggagaatcatcaggttgctatcgatagcatcctacttgatgcgtgcgcttatgtatgactatagacattgacttagtcatagttactggttgaacattgtttgttggtgatatatattgtaattgagattgctcagcg

SEQ ID NO: 578518 - DNA, 405 bp, Homo sapiens
  misc_feature (313)..(314): n is a, c, g, or t
  misc_feature (316)..(316): n is a, c, g, or t
  misc_feature (318)..(318): n is a, c, g, or t
  misc_feature (321)..(323): n is a, c, g, or t
tttgagagagtatttcggcacaaacaaaactgtgtggagttttatcctatattcataattacattgtggatggctgggtggtatttcaaccaagtttttgctacttgtctgggtctggtgtacatatatggccgccacctatacttctggggatattcagaagctgctaaaaaacggatcaccggtttccgactgagtctggggattttggcctcgttgacccgcctaggtgtcctgggaataggaaacagctttctggatgagtatctggatctcaatattggcaagaaactgaggcgggaacgctaagttnntntnttnnntttaatgcttgcagaagctgttcccaccatgaaggtaatatggtatcatttgttaaataaaaataaagtctttattctgtta

SEQ ID NO: 578519 - DNA, 1192 bp, Homo sapiens
cggtttttgtttttctgttcttctttcttcttctttatttctgttctcattttgctttgctcgcaccccctgtgtttctttatactctgaataatagttgtttcgccgctctccttttttgttctgatttttcgatttggcaagacgtttttaaacccttcgggtttctccagtggaaatctgttaattttcgttattatacctcccttattaccatagattttaccttgccgaggcttttatagagattgtccgccaccccccccgccgcgcccgcgtgtttggagaaaggcctttttcgctaatgtggataaatgtaataaggttaagatatgaggataatcgctcacaacttgtctagatttcttagatatgggtaacctatagtctttggaaatgggtatttgttaaaatatccccgtgtaattccaaattggaccagaagatttgatataaaaagttaacctgagtttgaaccctaaaggtgttacacgtttttaaagtttgccataatagacgccacttttttgttttttgagtttcccccccaattctttatttacccggaaagagcctttgccaaatagattttacactgttctttggccacctggaagaggtagattcttgtgaaaacctatcccttttgtttgtagaagatcttcccagttcttgtccccctgggagattaaatagagagatgggattccacccaaactttttggggtttttctccctccatgccaaagccatctttctttaagaggcctcttatctttaaagccccatattaaagactctgtggttctcgccctctcttagaagctttaagaaaattgaatattccattggatcccacaattaaccttagataaatattcgcccaagtgaccccttgagattgaatatttctcttattgataataatttccccataatttccaggtggaataaaattaatattaaatagcacccaaaccccgatcttagtccactgggccataaatagaccatatttctttaaatatagactctattttgaattaaaagagtgtttattataaaacccgtggtggtttttggtgttttctaagatgataataagaaagccttgtataaaatccagatttatccatttcctgatttaaagtagactttgacttttttattaaaaacccttgtattaaagcca

SEQ ID NO: 578520 - DNA, 202 bp, Homo sapiens
cagatcgaatcgagctcggtccccttagttttagactgttcaatagcactgctgcctggggactatggttatgtggatgagcgagctaaggttcggacgggtgggatgaagacagagaggaggtcgagtttaattatgcctttgagggtggaggtgatgatggaggtggagatttggtgctattgaaacttctaaaactagg

SEQ ID NO: 578521 - DNA, 172 bp, Homo sapiens
  misc_feature (156)..(156): n is a, c, g, or t
gcggccgcctactactactactgctcgaattcaagcttctaacgatgtacggggacatgcggataaccagtaattcttcgagcctgacctctacaagtctgagatggaggtccaggatgcatagctaaaggccctactccagaagttctgcaagtncgaaaaacccaaaaaa

SEQ ID NO: 578522 - DNA, 647 bp, Homo sapiens
agtaggtttcagagtgattcattcaataaacacttactgaatagctaatatgaatgtacaaagcactgcattagatacctacagtttcatgggggagacaagtccataaacagagcccaatctgaaggtcattccccaaaaataaggcagttcattcaagatctctgaaatggttctcttcaaattccagctgtgacctgacaaacatttctgacattattcactttacctagatccttgacttcattaaaggcatacaacggagaatattagatgaggaaaaaagaaattgtccaaaaaaaaagagatcaaacctgaaacaataattgacactatctagacagaagcaaaataatctactgtaggccaggcatggtgattcatgccagtaatctcagcactttggaaggccgaggtggaagcatcacttgagctcaggagttcaagaccagccatggcaaaacctcatccctacaaaaaatacaaaaattagccaggcacagtggcacatgcctgtagtcccagcttcttgggaggctgaggtggcaagatggcttgagccagggaggtggaagttgcagtgataccagattgtgccactgcactccaacttaggtgacagagtgagaccatgaccaaaaaaaaaa

SEQ ID NO: 578523 - DNA, 283 bp, Homo sapiens
  misc_feature (32)..(32): n is a, c, g, or t
  misc_feature (42)..(42): n is a, c, g, or t
  misc_feature (65)..(65): n is a, c, g, or t
  misc_feature (113)..(113): n is a, c, g, or t
  misc_feature (242)..(242): n is a, c, g, or t
ggagagctttcatgtgggaggattgctacatnggaggatttncttgggcctgggagcagaggttncagttagccgagattgcaacactgcagtccagtctggaccacagagtnagaccctgtttcaaaaataaaatatataaatgacatccaataaagtatgcatatttgagctgcaggataagtcttgaattttctttttcttttttttgagacagcctcgctctgtcacccaggctggantacagtggcataatctcggctcactgcaagccctgcctcct

SEQ ID NO: 578524 - DNA, 400 bp, Homo sapiens
gtagtctttggtgggtagagagtttgttatctttaggtcagctgaggaatctttttagaaatgtgattgctcatgaatattagagaaccttgaggtggaagcagtttatcatactttcgttgacctcttctttaatgtattttactgtcttactggtttcatcattccccataccagctgtggggccatcttttatccacgcatccttgtttagaagtatggaagccgtggccaggcgctgtggctcacgcctgtaatcccaaagtgctgcgattacagacgtgagccatcacgcctggctgaagcagagaatttcttaaacctgggaggtggaggttgcagtgagccgagatcgtgccactgcactccagcctgggcaacagagcaaaactcggtctca

SEQ ID NO: 578525 - DNA, 224 bp, Homo sapiens
tctgtggatacgttgtatcctctggaggggaggaatggcaatgtgatgtgactctgagtggcaaatgttaagatttgacaaagtaggtgcatgagcttggatattcagtatgtagttcacatatctagaatgtacagtcacaccaacactattagccagatgctgttcatatacttgtgccctgagcagatgcatctaggattggtcagtgacagccgtactct

SEQ ID NO: 578526 - DNA, 250 bp, Homo sapiens
tcataggttcgcaggaggtccaggctgcaatgagccatgattgtaccactgcactgcagcgtgggtgacagagtgaggccctgtcctccctccctcaccacaaaaaaaaaaaaaaaaaaccagtaaaaaacaaatacaaaaggtcatactaagagtgtgggttaatttccaggtgatttgaaaatcaaaaagcttccttgggaagtgacttataacctggcagcttggtaaattgtgcaccttaacccct

SEQ ID NO: 578527 - DNA, 302 bp, Homo sapiens
gaactaacataatagctagggagcacagcaccggcagcatcctatggagcacagctctctcctctgccacgtgcacatcattaacaccttccccttgtggctggttagctcggctgcaaacgggccacagaacgtcagtagtttcagtcatacacagcacccgttgtgtatgacaagtcactttctggaattctacaagaagtcctggtcctgttgccacgagtatctaatttgaggctgattataactatttcttccaccccggaggcccactccgggttaccgaagctcgatacttcgat

SEQ ID NO: 578528 - DNA, 229 bp, Homo sapiens
cgtcttacacaggcggctagatgtacgagttccttttactttttttaaccttaccttatgagcatgcctgtgtagggttgacagtgagggtaataatgacttgttggttgattgtcgatcttgggctgttacttgtcagttcagtgttataatctgacgcaggcttatgcgggggagaatgtctccatgttacttctcctacacccttacgttcttctactacggtgac

SEQ ID NO: 578529 - DNA, 193 bp, Homo sapiens
gggcaggggaaggaggctgggctggccaggccagccgatcacccttgagccattgccttttgcccgcagggggaaaattgcacttacaaggccgtccacaacacggctgtgctctttctgacagaacggccctgctttgcaagtggggcgccgacgctgaaacgtctgcaggagctggagtgctgcctaccgg

SEQ ID NO: 578530 - DNA, 1293 bp, Homo sapiens
gggatgcctgctccctgtgagccctggctgtagatggctgcaatctgcagcctgggagccctgcagccctgtgccctgagccctgccgccgcccttcgatggtgctgccccatggcctgctgccatggtgaatgtgtgacgttcaactcctgctctgtgcccagaaggaggccaagaatggacgatgcccaatgagctgtgcgaggaggcgctcatcatcccccccgacgccgtcgcggtggactgcaaggacccagatgatgtggtaccatgttggccaaatgaagagcctggtgttggtgcatgtgctttggactagcatttatgcttgcaggtgttatcctaggaggagcatacttgtacccactatttcgcacttcaaccagatgacgtgtactactgtggcctacaagtacactcaaagctgatgtcatcttaacctgagccctctgcacgatgccccaggctgctctctaccagacaattgaagaacctattcacacctctttgaccgcacagaacgaggttcgacatcatcagtcgtgcctgtcccaggacgtctggcgaacttagtgaatccttgccaaccatttgtctcattgactttacccacgcacaacttacctgcctatccaccatcttacccctggcactccgtgctcatgtgactcccctctgcaaccactttccaattggtcctggccaaccccagaaaaccctacttgcacgctaacgttattcacactccaagggcctggcacccctactttggcccacatgctccctaatactgagattccggacgcaccactcgcgctaactcacactgagctcgccatctttgaccacactctttgcatataccaccatcgcgcctattaccctcaccactctcctcgcgcgcccttgtttgtgtccaatctaacccactcgggacaacaacatacagcaactgttgatcgacgcctcccagctgctcaccgcctactatctccacggcctcattcccgccatgctccgtttgtagccccgctccgatctaccttctgcttgccggcccaatcactccgtgcccattctgctcacccacacgacatgctgcgcgtcggcttcccacacatctacactcctcgctccctgtctcacaatcgtatctgctcataacactctcctgttgctggctcgacaccgtctatctacctcgtcattgctactcgctctcccaatcgggtacgaccccacatccctatgcgaacaacctgcgatcaagtgcggactgacacccgcatgctc

SEQ ID NO: 578531 - DNA, 199 bp, Homo sapiens
tccggttaaagcacacccggttgacgctcaccccgtagttgttcgagataaagctctcattgaggctgacgaagtcgcggctcaagggcggcacgaacatctggatcttgaccgggtctttcgggttggcgacgaactcgaccttggcgtcgatgttccacaagtcgtcggtggcatcttcggtgacgggaattcccag

SEQ ID NO: 578532 - DNA, 692 bp, Homo sapiens
cgccctgccgcagccgcccgagcccccagccccgggcggccccgctccagcatcccagctcctgcactctcgcatgccgccgcgccccccgcccggaacatggactctgactcttgcgccgccgcttccacccggaggaatactcccccagttgcaagaggcgcaggagcgtggaagacttcaacaaattactgcacctattgtctatggcctatagctggctacataccctatataccgaagggagggaactccctatataaggaggcagccccaggccctagctaaacgagcactgctaggtaccatatagacagcgacggctagggacgcgggtttctcagacatcgcgtcctcagtgcccttgccagtctctagaccgactgcttaagccaccttgcagcctaactctcttggcaagcggacccaagcccagtaaacttccttgctggacagaaagaacgacggacaagctgaggaagaagacgaagaggaagcgcagggacatgtgatgcgcctgtggacaagcagggggctacgggggggggggctagcctggaagcttgtaaggcctgctgacccctacggtgtaggaccccccacgagttccaacctttcggggatatcccccagggctcccggtgaaccctgctcgggctgggccctcatatcccctcgcgggattgtggcgc

SEQ ID NO: 578533 - DNA, 145 bp, Homo sapiens
tttgcccttcgttctggttcctcttagttcttccacaaaccattctcaagtaaagccaaaaatctttctcttgctccccctcaggccacctcctgtcctcactcctgtcctgttctttctttcaccattgcaacacggtctctca

SEQ ID NO: 578534 - DNA, 228 bp, Homo sapiens
  misc_feature (122)..(122): n is a, c, g, or t
tccgcaccacgcaggatcggtggagaaatgatgcatgtctcacataacatatctctggagttaagaaagggccaactggtcttgtcacattttgagaatgaaagattgaaaatgccgttctnggatattacgctttaggggctcatgtacctattcatctaccagccatttcagagtaacacgagatagggtcattctcatatgacactaaatttctaacaaagtgcg

SEQ ID NO: 578535 - DNA, 124 bp, Homo sapiens
tgcccttctagcgccggaagactcttttatcgtacacgactcacgcaggcactcgactttagcgacgacactgtataatcataacactgtgcgcctagacagcggtactagggttcactgaatg

SEQ ID NO: 578536 - DNA, 838 bp, Homo sapiens
gccatggtggtgacgctcccagaccctgcaagagaaactgcaccttatcacccggaacctgcagtgagtgttctggagggaagagaagctgaaggagatactgaatgtgagcgtggaacttaaaatttacttggtgagaactggcaaccactgtggacaagaccagcatgtgtgctatacattttgttgccctatgtcaagacgctttgcatgacattcattaaatgtgcaagtggatgtgacgtgtaacagattcattgtatttgcaggacactccgacgcactaccatgtgatagacatgaaatgccccgatgggaaacttctacgaacatccgacgtacagttactactgagacatgtgatcagaagcaagtgctgcgagagcaattggattggtgcccttggaaggaaactcaaagttacacccccctctcggcagctgattaaccagactacagcaagaagagtacaacactagactgtgtacaagacatctcactcacgtggctcacacagagagcgaattcccaagacagggcatggagcatgcagggtgggataaacggccggtagggagccaccccgttatgcatgagatgagctcttataccccggacatgcaggctctggaactgaaagagtatactcacaacgtacgcatgcgcaattaggcggcattgaatcaggagaaagataattcagctattgcagagaagtactaccatgcacattggctatacaaaacgggtccatctgataatcctattgaccaggatcaccaggcaggcaatagacatcaaagaggatcaactgagccatgactgaataggattgagc

SEQ ID NO: 578537 - DNA, 336 bp, Homo sapiens
  misc_feature (12)..(12): n is a, c, g, or t
  misc_feature (33)..(33): n is a, c, g, or t
  misc_feature (114)..(114): n is a, c, g, or t
  misc_feature (130)..(130): n is a, c, g, or t
  misc_feature (142)..(142): n is a, c, g, or t
  misc_feature (172)..(172): n is a, c, g, or t
  misc_feature (178)..(178): n is a, c, g, or t
  misc_feature (274)..(274): n is a, c, g, or t
  misc_feature (287)..(287): n is a, c, g, or t
  misc_feature (332)..(332): n is a, c, g, or t
ccagagcccatnccttgctagcagctgcccatnttcccttggcaattgaaaccaccctgcaaacatcaaaaccccatctcttgctaatagatacaaccgttaacacctgaaaangcactctccgccttcnaaaaagagctcngtactaaatgcaatatgcaaagggggtttnacaggnaccaatctcaatgcaaagaccagtaccagatgtctgagttttggttacaggtttataattagacacaaaattcactccacactggagttttacttncaagctggaagcnagcattagttctacttggggggaaaaaagcaaagtcaagtcaacntggg

SEQ ID NO: 578538 - DNA, 1303 bp, Homo sapiens
  misc_feature (557)..(557): n is a, c, g, or t
cctcgctgctccagcctctggggcgcacttccaaccttccagcctgcgatctgcggagaagaaaccattactgtgattttcttgccccatacatatccttgaggcgagcatgtaaaattaagagtttgtaaaccactgagggaaattctgtgcacatccatgcgctggttcatgtgtggctagacctagattcggtgccaagttctgggaggctgatcagtgatgaccatggcatcgaccccaccggtcacctaccagcggggacagcgacctgcatctggaccgtgtctcctgtgtactacgaatgaaggccacagtgtgggcaaatatgtttcctcgatgccatcctggtgtgcatctagaaacctggtgaccgatggtatctctggttcgccgtcaggttccttttggaccaggatctttcacaccagcagcaacgtttgatattcgcgtgcagttcgtggcgtgccacggttataccacaacatcgtggcccaaaggggctcacgttagcgatcgagagcgtgcagcctggagtcgttgcgtacgaacttctngcttcgctcgggaaatgatggatacagcgaacgagagagaccagtacgagcatagtcgaacgtgctctgcaagggggctctccctaagactgggtaaccccaacttgcatcttgtgatgcgtgtgggtgcaaccaaggacttctgatggtaaatttgcgtggcaaccttcattaccacttttatacaaggccacaagaaatgctccggtacgcaaaagcaaattacagcacccttggaaatacggggcccattccgattagataatcacccttttcacaatgtgttagtcgaggtttgcaccgtgttcccaaccccctaacaatggttgttactggggatcaataccagtctgagattccagaaagtcccgcgtaaataacaattggcccaaccaaccgtgtcatcaccgtgtacaactttcaaggttgtggggccaacaaggaagagttcacgttgcaattggaaagaaagccataaatataggcccactttgtgtacacacaccggcacggggcccccctacggtcattaggaattactccattgggtatatcccgacagatcgtcctgtaggaacggcattgcaacctgtcatgctgagaacgataaccggggggacatccataggtataaccgaaccctatgcatcatcacgaggacgagacacaaatggttaagcatgagtgttgcatcaacacagatcctgtgccacgatcctaggattatccccattgtgaacaccagc

SEQ ID NO: 578539 - DNA, 211 bp, Homo sapiens
tatcgatggacgtagtgacaagagaggagggaaggcaagctctggagccgctccctcaggccatccaggagtctctaaacaactcttcccctggggctttcgaggaagttgtcagatggcacctgaagatgctacagaggaaatcagtggatttctttgcgctaggagaataacgatgtctgtagactgtgcggccgtcacgttcggcctc

SEQ ID NO: 578540 - DNA, 458 bp, Homo sapiens
catggggaggctgagctgagcagaggttgtgccactgtactccagctgtagtcccagctacgggaaggctgacatggtaggactgcttgagcctgggagtttgaggctataatgagccatgataggaccactgaactccatcctgagtgacagggcaaggtcctgtttcttgtccctgtgcatctctttcattggctgttcctgagatggagccattacattgagccagtaatagaaaataaggtggccagatgcgctggctcatgcccgtaatcccagcactttgggaggcagaggtgggcggaatcacttgagcctaggaatttgagaccagcccgggcaacataagaggaccccatctgaataacatgttgcccagtcagtttctcttcctggattcagaagtctttcatggtaggtccagaatgaaaggtgatgtttgggactcaggtggtgtg

SEQ ID NO: 578541 - DNA, 263 bp, Homo sapiens
ccttgtgttggtcccgccaaacgccctgcgacctgtcgtcagaagcctacatgctgtccattgccgtgatgtgctgcctgcctgtgttcatggacattgctgtgagagtgcggtgagtgccagggcttccagcctcgtgctgtctcgggactcctgaccgtggtgtgctgtgtgttgccctgtcttgtgactttctactcaccacggttgaagacaggaaacggggaaaatcacaacgtggtgttcaaaaccccccaaccgtc

SEQ ID NO: 578542 - DNA, 496 bp, Homo sapiens
ctgagaaatgacgacctagatgtgggaagatggtctcaacgtattgttctgcaaaggagaaaaaaagcaggttgcaaaacactgggaactgtctgcccatcttcgaaaagtaagtcatatatctagaaaaatctggaagggtagtcacaaaaacatcatcagtaggtactgtggagagggtggatttcacgttattgttactttccccttttatattaatttttgtgcaataaacatgtgtatttgtaatcaataaagccaacttcttttctcttttcaagaaactgctctcttgcttggcctcatacctcccccaatctccttaatacaaaatgaaagattccagtggaccctgagagggacacccccgcagccctctcaggggcccccttgctagcacagagcaggtctccaccacccaaggggcaggtagaccagggatgggggtcgttgacagaccctcaccctgccccatgctttttttggatgatacaga

SEQ ID NO: 578543 - DNA, 116 bp, Homo sapiens
ttggagatttgccatacagcacgaaaaaaagaaaagaagaaatgttgaagaggtgcaccaaaaagttagggaaacgttaagaataacagaagagcaatataggatagaagctgatg

SEQ ID NO: 578544 - DNA, 392 bp, Homo sapiens
agcggggctcgcccccaagcaggagggagggggcggtggcgagagcgcgcgagggggtgagagggctcgagagagaccccggcgcgcggcgcgaaaagaacgaactgtgaagcagccgaggaaggaacgccaccggagcaaacgaccaggcgaagcacagacccggacaccacataaagaggagatctaaccaagtagaggtaggaagtagagagctagaacaacgagaagaaacaccgcaaaagagccgcgacgagcaataaacgaagagagacacctcccccgggacgaagcgtgaaaatagctgacacgagacaacagcagccggacaaacacgaagcgaggagaacaggaacaaagagcagcagctccaagcaaaacagggaacaact

SEQ ID NO: 578545 - DNA, 333 bp, Homo sapiens
ttttttctgagacagagtctcgctctgttgcccaggctggagtgcagtggtgtggtcttggctcactgcaacctccacttcctgggttcaagagattcttctgcctcagcctcctgagtagctgggattacaggcatgcacccccacacccagataatttttgtattttagtagagatggagtttcaccatgttggccaggttggtctcgaactcctaacctcatgtgatccactgttttgacctcccaaagtgctgggattacagggatgagccactgcgcccagccagccatgttttaaatgaacagacattttggttaacgtcgacgcgg

SEQ ID NO: 578546 - DNA, 218 bp, Homo sapiens
aggatctttggatgaggaacgtcactgtggatgaggaacgtcacttggatgaggaacgtcacttggatgaggaacgtcactggaagatttaatgtacccatccgaaggtatacatagagggtaatttatttgtggctacttgattttgcagcatacgaccccataactctctgtgcataactgctggtcggggttattctttactcccaacactgggc

SEQ ID NO: 578547 - DNA, 195 bp, Homo sapiens
  misc_feature (36)..(37): n is a, c, g, or t
gggttgtgacgaggttttctcgctctagggagattnncttcaagcaatcactatgtcaacagacacagggtagtttcccttccttcatatgaggaaccgatcagggatcaataactcattcgaaatagctacaagaggcaccagttcgtacccgtttggaatagcgggttttgcagcaattgttgcatatgggac

SEQ ID NO: 578548 - DNA, 112 bp, Homo sapiens
tgccttggacgtggatacatcgagccgtattcgtcactgttatacaatggaagtaacaagagtctaacctgggtaaaatttcagacttcttaggctactgtacacccaatac

SEQ ID NO: 578549 - DNA, 210 bp, Homo sapiens
gcccccgctcgacggtgcatatcctgcgtgtgtggtgtgtgtttccgtgtggtgtgtagtgtgtgtggtgtgtgtcctgtgtgtgtggtgtgtacgttttcacattggttgtgtgttgtgtacgtggtggtgtgtgatctgggtatgtgtgcatgtgtttggtgtgtgtcctgtgtgtgtggtgtgtggtgcatgtgggttgtggtcgac

SEQ ID NO: 578550 - DNA, 156 bp, Homo sapiens
cttcacctactgaagggcatcttgatatcagggcaattatgagtaaagccgctgtagtaatacaggaaaaaccaaagatgcatttttcccactctagtctccaatctcacccttcttgccccatcctcacacacacactactttccaccatacttc

SEQ ID NO: 578551 - DNA, 391 bp, Homo sapiens
gtgaaagacggtcagtaaagattataaaaaaggagagtccgcgatgacatggaaacactatgatcaaagatcagactaacagacatgcaaacaggctggcacgaaatagagtgtccatttctttcagatgagcctctgatctcaggctcttgcagcaagcacttcacaatgaacagaggtctggccagctcatttcattagcggagaggcaaaggtatgatggcagaatcatgagaagatggaaataaggcctgaggatatggcttgatctctgagagcaattatctttgagttattcaggccaggatagaagcttagagaggatcgaggcaaaccatgaaggggagggaatgcaggacaatgccacattactggctttaccacaaactcc

SEQ ID NO: 578552 - DNA, 165 bp, Homo sapiens
tcaacagaactctcttcctatcgggagatgatttgtaatacccaagagtatcatcttttgccgtatttcactttttaaataaaattttaaagacagaaatcggaaagttcttttttttcatagttgttgccaaactggaaatttggacacagaatgacatgtaca

SEQ ID NO: 578553 - DNA, 605 bp, Homo sapiens
  misc_feature (26)..(26): n is a, c, g, or t
  misc_feature (35)..(35): n is a, c, g, or t
  misc_feature (195)..(195): n is a, c, g, or t
  misc_feature (200)..(200): n is a, c, g, or t
  misc_feature (203)..(203): n is a, c, g, or t
  misc_feature (205)..(206): n is a, c, g, or t
  misc_feature (210)..(210): n is a, c, g, or t
  misc_feature (218)..(218): n is a, c, g, or t
  misc_feature (222)..(222): n is a, c, g, or t
  misc_feature (227)..(229): n is a, c, g, or t
  misc_feature (234)..(234): n is a, c, g, or t
  misc_feature (256)..(257): n is a, c, g, or t
  misc_feature (262)..(262): n is a, c, g, or t
  misc_feature (264)..(264): n is a, c, g, or t
  misc_feature (266)..(266): n is a, c, g, or t
  misc_feature (285)..(285): n is a, c, g, or t
  misc_feature (298)..(298): n is a, c, g, or t
  misc_feature (301)..(303): n is a, c, g, or t
  misc_feature (306)..(306): n is a, c, g, or t
  misc_feature (317)..(317): n is a, c, g, or t
  misc_feature (322)..(322): n is a, c, g, or t
  misc_feature (327)..(327): n is a, c, g, or t
  misc_feature (334)..(334): n is a, c, g, or t
  misc_feature (349)..(349): n is a, c, g, or t
  misc_feature (351)..(351): n is a, c, g, or t
  misc_feature (367)..(367): n is a, c, g, or t
  misc_feature (376)..(376): n is a, c, g, or t
  misc_feature (384)..(384): n is a, c, g, or t
  misc_feature (414)..(414): n is a, c, g, or t
  misc_feature (420)..(420): n is a, c, g, or t
  misc_feature (426)..(427): n is a, c, g, or t
  misc_feature (447)..(447): n is a, c, g, or t
  misc_feature (452)..(452): n is a, c, g, or t
  misc_feature (459)..(459): n is a, c, g, or t
  misc_feature (469)..(469): n is a, c, g, or t
  misc_feature (497)..(497): n is a, c, g, or t
  misc_feature (504)..(504): n is a, c, g, or t
  misc_feature (507)..(507): n is a, c, g, or t
  misc_feature (511)..(511): n is a, c, g, or t
  misc_feature (513)..(513): n is a, c, g, or t
  misc_feature (519)..(519): n is a, c, g, or t
  misc_feature (537)..(537): n is a, c, g, or t
  misc_feature (599)..(599): n is a, c, g, or t
cccgttgccagttctgcgcgtgtgantctctttcnccttgctccgggctttcttcgctcgcagcgcggcagggttatcaccagatctgggctttccccttcttgccgtcaggtgctacggccacgtggcccgcggcttcccgctcgcgcagtctggcagcccggagccttccgcggtcccccgcccgcccggggnccaangangnnctantgggcgancacnatttnnnagganagggggtaagggaaaaaaaaannaaaanananaaggaaaagggtaaggggnaaaaaggggaaanaannnaanaaaaaataaanaaaantaaanaaaaaanaaaaaataaaaaaantnaggaaaaaaaaaatantgaaaaaanaaaaaaanaaaaaaaaaaaaaaataaaataaataatanaaaaanatatannaaaaaaataaaaaataaaanaaaanaaaaaanataaaaatantaagaataaaatagggtatatatatggnatttctnctntacnancacaanatattatccttgcatctnatgtgttctttgaaccagaagattttgaagacattttggctacaatatattttttgatgcanaagaat

SEQ ID NO: 578554 - DNA, 677 bp, Homo sapiens
cctagaagcagccattacaggaatctcttaatctcagcatccggagctccaggagggaaaatttcaagtcagatagaatctatatataccatttcttgtggaacccttcagccctcaagattccaacatcatgacctcagtttcaacacagtggtcctttaagtcctcatgtcactgcatttggagggcatgcctgtttgtgagaagcaagtagaaagcccggttgatgcaatcgccctttaggtaaggtgtggtccctcagcattaccaggcatttggtgccctggctggggggtatatgcaccggaaaagcgaaatgggaccagatgtgacctttgaaaggcctacttgagtcaaacccttcacccctgaaaacctttggcgcttaagaggctacaacctgagatatgggtggtgtgacaagggttccccaaggacatcaggtacacatcaaggggaggttccacaattttttccatgggtttccaatgaaaatggccaacaaacatacattttataaaattggactcaacgacattgttttctttacaaccaagataactgcacagacaaatggcagcctataaattggcttagttcaggtagtcacacgaagtaagatggctgaaatttacataaggtaatatttcatactcttagaattctctccacagctg

SEQ ID NO: 578555 - DNA, 208 bp, Homo sapiens
ttttaatatctggcatgcaaaggacagaatctgtttgaacactactcagaacacagctaggtgttaaatacattaggctcactagagtattcttgactggtggcgacctatagaccactttctacagtctattcatttgcctcctggagagcaggttcacataattcgcagcatggtttcccatttgtaaaactcaccttcataaagt

SEQ ID NO: 578556 - DNA, 297 bp, Homo sapiens
gttaacatttatccctgcttctactttctggttctccttcccgggctctcacttttcttttttttggagatggagtttcactggtggtggcccagcctggagtgcaatggcgcgatctgggctcaccacaatctccgccttcggggttcaaacgattctccggtctgggcctcccgagtagctgggattacaggcatgtgctaacaggccgggctaatttggtattttaagtagagacggggtttctccatgtgggtcaggcgggtcttgaactcccagcctcaggtgatccaccgg

SEQ ID NO: 578557 - DNA, 618 bp, Homo sapiens
  misc_feature (26)..(26): n is a, c, g, or t
  misc_feature (35)..(35): n is a, c, g, or t
  misc_feature (195)..(195): n is a, c, g, or t
  misc_feature (200)..(200): n is a, c, g, or t
  misc_feature (203)..(203): n is a, c, g, or t
  misc_feature (205)..(206): n is a, c, g, or t
  misc_feature (210)..(210): n is a, c, g, or t
  misc_feature (218)..(218): n is a, c, g, or t
  misc_feature (222)..(222): n is a, c, g, or t
  misc_feature (227)..(229): n is a, c, g, or t
  misc_feature (234)..(234): n is a, c, g, or t
  misc_feature (265)..(265): n is a, c, g, or t
  misc_feature (401)..(401): n is a, c, g, or t
  misc_feature (403)..(403): n is a, c, g, or t
  misc_feature (407)..(407): n is a, c, g, or t
  misc_feature (510)..(510): n is a, c, g, or t
  misc_feature (517)..(517): n is a, c, g, or t
  misc_feature (520)..(520): n is a, c, g, or t
  misc_feature (524)..(524): n is a, c, g, or t
  misc_feature (526)..(526): n is a, c, g, or t
  misc_feature (532)..(532): n is a, c, g, or t
  misc_feature (550)..(550): n is a, c, g, or t
  misc_feature (612)..(612): n is a, c, g, or t
cccgttgccagttctgcgcgtgtgantctctttcnccttgctccgggctttcttcgctcgcagcgcggcagggttatcaccagatctgggctttccccttcttgccgtcaggtgctacggccacgtggcccgcggcttcccgctcgcgcagtctggcagcccggagccttccgcggtcccccgcccgcccggggnccaangangnnctantgggcgancacnatttnnnagganagggggtccgggcccacccctttccattctngcgaccacccgcggctccgcgcgcgcgcccgcacgcgcgcgcctgtcctgcgaaggtccacgtcccgcaaattggagctggagtaagccttccaggaattttggctgccacaaatgtggctccacaactaatactntnaganagctcaaaactgcctcactgtctggaagtctgtcggcaaaactgccaaatgaataacctgccacatctgcatgttttaggactaacatgggtatatatatggnatttctnctntacnancacaanatattatccttgcatctnatgtgttctttgaaccagaagattttgaagacattttggctacaatatattttttgatgcanaagaat

SEQ ID NO: 578558 - DNA, 389 bp, Homo sapiens
agaaagtgacagagtgtatatataaaagctaaggaaagcacaaaataaggttcagagataaatgggtaatatgtttaacagttggagactgtgcaatgtacgacttggaggagtttgtttggcataatgattttgtcggtctgtcagcattttgatatattgtggattagccaggtgaatgatccttgcaaacatctctttcaggtctggagaaagagacagaatgcccttaaagtgtgaaataaccttatacctgaattacagttttgtgatataaaataaagctgagtataaaataaaaccaatcaaacacagaattggatgggattggttattcatgggtatacaacaatttttattcttatgtgtgctttaagggctgtgtattg

SEQ ID NO: 578559 - DNA, 354 bp, Homo sapiens
actttgctagctgatgggaatttggagtggtcacaggttaaagcctggactcttctaagtgacattaacattttcacctgagtcttttcacgccttcagtcaaatagggaacataggaagggagcccatttggctattctcaaattgttcctcattatagacctgaagatgacgccatattgatgactgccattttgtgatatctgtagagggtgtttattcgccaatattctgttgaagaggtgagaaacaatcccaaacatgtatgtacatgatctccacaaaggctctcagtaccatatccatgtttcacaaggggatcattttgccaagtaagtttgaggagaacaatgt

SEQ ID NO: 578560 - DNA, 184 bp, Homo sapiens
gacgatctgcacggagatgctgcgatcagcccacagggattcccaacattccaaaacctcggcgactcttgcgctcggccgtggggcagcaacccttacttccgcggctcctatatcatacacgcaggtgggctccagcggggcgggatgtgacgaagctggccaagggtaccgagctcgcaat

SEQ ID NO: 578561 - DNA, 461 bp, Homo sapiens
gtctccgtagtatctagcctgactgagtgcggagctatctcactccgtgtgaccctgtagagtgaggcctctgactagctcaatcgtgtctaccgtcgggtttagtataaactaaatgtatacacaatatcgggcagcatgtacagagtagcagctagagggagcttgggcagataaacaattacgcttacaagatataaccaaaagctgaatctaaatcctaaaattagaatatcaacagagccccctttaaaacagtcatataacgcttgtgtgggccaacagaggggcagtgtactctctctggaaccataaatgtcaaataatttataacctgcagtaattgagcaaacttaaaataagacctgtgttggactttagttacttgaagaggtcgagggataggttagtaagatgtatagtaaaacaacaggttaaaggtaaagcataataattagccc

SEQ ID NO: 578562 - DNA, 975 bp, Homo sapiens
ggaatcagaaggtggagagacttgaagttgctacatcaagggacgcctaaagaaagagtttcagattttgaagactgaaaacaagtaatcgtgctgagattgaaacccagacagagggtgagcactatgtatgaaagagagatgagtggaagtaagaatagtgccggagactgttggaagtgaagtggaagtattgaaccgtctaggtgacgtctctgtcctaaggagtttcgaaagatggctcatactaaaatctcagcgaaagtttgaagtctaatgaagaatgagactctgcggaaaaagtggtatgccgtttgtaacgggaaagaattcttggtaaattccaatctagagtttgaagtgaaaaagcaaaggagcttgtttatagtatgaaaaaagttagatgtgactaatgtgggaaatgctattgtctatgcagcacattcaatttggatctatggtgtataaccagatgtatgatttaggtcctcattacctgtgttacagaatgaccagcactagagaaagcttacttttagagaatgtaactgattgttttgaacaatccatgtggagtgaattagctggacaatgagtccggatataaggtgggacccggctgggtgttaaaggaacctggcgtggaaaatacctgggaagtggcatgagaacggctctggctattgtggaaagtctgcgaaggtgtgtgaaaagtgtaagcaagacgtgggccatgcggatgaagaggcctgggatgcatgagccatccctacactggttagaatggaagagttccgttcgtttacatgctgagggagggcgagggggacaattgctgaagaaaacgagcagtgggattggcagtgcgagttgctgaagagaaggaggttcaaaaacgggggaatgtttgtgggagtcaatgatgggaaaaaagagttgggagagggttttacgggggggggggaggggaagaat

SEQ ID NO: 578563 - DNA, 371 bp, Homo sapiens
tgcgcgcgggactgctcgaggtgaccgcacgctcgcggtgtagggaggaagacgcggcggcggcgttggtccccctcgcggcgagatgtgcgcaacttggcttgatcagacccctctgcgacgagggggcgacactgacacagctggtgcgttcgcttcgagaacggctcctgcacaaccagtggcccagcgagtggccgacgatcgatgagcggttcttgtcggcggtcctgcctcggccgaacagaccgagccgccagtccattgaagtgaatctggactccggggaacgcatgggacgtgccgtgcccccgacggaacacggcacgtcccagtgatggctgccgtggaccgtgggggtgagcggccgc

SEQ ID NO: 578564 - DNA, 118 bp, Homo sapiens
atttccttacagcaagttttaccgtttcggtagttccttttttaaggttttactgcttacctaaaccctgtaccaagggctcttgaaccctatttttatgcttaagtccggaaaaaag

SEQ ID NO: 578565 - DNA, 152 bp, Homo sapiens
gctgcttttttgctgcggcgcgccgccggcccctcttcttttttttttttaatttttccccccctttttttaaaaaaaattaacacaatttttaaaaaccccccctttttggaaaaaaaagggggtttttcccccggggtaaatttattcca

SEQ ID NO: 578566 - DNA, 136 bp, Homo sapiens
taatggctgcacctgaaacatatggaagtccccaggctagggatccaattggagctgcagctgcaggcctatgccatagtcacaccagatcccagcagcatctgcaccctatgccgtagctggccctcgttacgct

SEQ ID NO: 578567 - DNA, 308 bp, Homo sapiens
aagcaggtagtgttacgcagccgggcggtcatcagacaattaggggcggaacgagtgaccgaggattggccgagtacagggctgaggacagaagccttgtcctgaactccatccaggccctgaagcactgggagacttctgtcccattgttgcgtccctggccagctctgggtgtcagtggagcgtgtcctcccttggccaagctctgggtggtcagcagagcgttgccggtgttgaaggacagctgggcccggatccctcctcgaagcttgatgaggccctcggtcctccggtggtccagggtaccc

SEQ ID NO: 578568 - DNA, 836 bp, Homo sapiens
gagctctgtggtgacggtggccgaggtggagggccggtctgaagagtggcgggactggcttcacttcctccgcggttcctcggagccgcctcgcatcctcttcagggactttgcgtgagaagggctctcgggcgtcagaccccaccgcaaaggtgttgggcgatccgtcgagaagttgttggccccaggagcatccctcggggccgaatgcgcagtggacgatgccccttctgacccaagcagatccaagaggaggatgatcagtacagccttgtgggcagccttgcaacaacgttacggaatctctccactatcttgaaagctattcatttccgaagaacagttgccacgtgtttcgcaactaacaatgggtctcaaagtcacagtgggaaatgcaaagtggtgtgcgagcaaaatgctttctattcaggctgggaatatttcacggagtttaacggttcccggacacgaagtctgttacttttcgaattaatttaactggtccttttagactgtttatctatttgtggtcaagtcctatgccaggactttaactggccttcgaatgtgttcctagggtttatggttactctttgatgcttgtcctggaacgaaggaggagtggtgacagtcctgccaaatcatacacgggaacctgtggagacctggtctttgattctgcggcccagtgttctcacttaacctttccgcggccgaggcggcgggaagccttttggaggggttccggtggggcccaatacctgtccgggggcccttcggggtccttggggcggggcccctgttcccagttgtttgggtctttgtccccgaatttg

SEQ ID NO: 578569 - DNA, 112 bp, Homo sapiens
ggaagagtcatgttggtaaacacaagccactgaacagtattatgccatgaagatcttagatagcgaggttgttaactgagcaatagagctactttgatgagaagatatacag

SEQ ID NO: 578570 - DNA, 310 bp, Homo sapiens
tgtgtacttgagaccaaaagttaattacaggaagatgatatctggcgtctggaagaggttgaggtccatgattttcagattgattactgaactgctctgctctgagaggatgctccctctagagaaggactggggcgtggggcggttgtggcagggcggggagcggctggcctgggatagaggtttggtggaccctacttcattttcagccaattagtacagtactttcaatgagtactttcaatcttatatcattttatatagtaggccctagggtaacattttatttaatgagcctttccttccttgt

SEQ ID NO: 578571 - DNA, 167 bp, Homo sapiens
gtgtgttaggagctggatggccctaaagacagagctggaatgacacactggacagcacatgtcactcagcagggagctcatgggccaagagggagcagtgaggtgacggtgctgaatgaaggccctgtgatgaatgatgacgcgtgtcccagtgagtgctcagtgtc

SEQ ID NO: 578572 - DNA, 636 bp, Homo sapiens
cctctcttccgacactatccaagccaggtgtttgattccagcttgcttatgtaccacatttggaaatcaagatcgcaggagcatgtccgctgcagccattctgaaggatttggtctcctccttagtgggcccatttagcatagccagcgtgatggcccacaaagattaagttccctatcttcgggaaggcaaggctgggagggcccccagggctttccattagttttttctttggttcaggccaggccaaggttaggtccgaaaccccaaaaagttttccctctgtttttaaatgggccggtggaccttaaagggtttttaaaaaaagggttaaaatttttttacgggggccaagggtgggtttttaaaaaggagaaccccaatgaaattggaagccctggtttttttttcctttccccccaaaatttataaaggggaaggttaaatttttccttgtaagggttttttagaaactctataaaagatttaaattttttgaacctcccaatcccctttccgaggatatggttttcctttagaaaccaaattggtactcaaatttttgatggtagggacattagccaacttgaaaattctttgcccctggccaaaaccaaaaaagccacctgttgtgga

SEQ ID NO: 578573 - DNA, 118 bp, Homo sapiens
cgagctcggaaccggtcagacgctgaactatgtgatcactgatctaatccacaccatcgcttccaatactaatgtaataatatccacaccatgccctaccacatagttcagcgtctga

SEQ ID NO: 578574 - DNA, 958 bp, Homo sapiens
gctgcgtaaagtgtgggctgaagcagtgcactatgtgtctggactaaaagaagactatagcaggctctttcaggggacaaagggcagcaatgtaagtcttcttagatataatgctaacttaccaaaaaatgacgaacacttgtgatctcagcatcacaccaatgaaaggcttaaatgggagtttttcaccaaaaagtattcagctgtgactgtggagagatacagcgagcagatgaagtatgggatatcttcagaaaaaatgctaacaagccatgcacaacgaactggacaggaaacaaggcatccactatgctgagggcggtgtcattgactacctggaggctcagatttatgtctatgcagtgctgacaactccatggacgctacagaaagagccccctatggaaagcacggtcagggcagactgtgatgagaaattctctgaaaacagcgttgcccactgtgaatctatataagcaggttagaaaacacaagaatccttcagataactccatacaagttgacaggcaccacggagatgggtgaaacattcattgtgcacacactgtgccgacgtcaggaccgtgtgctcaaagcagctgtcgcgcatagagcagtaagaggcggaaacgagaaccgactactgaatcaccccaaaggggaagggagcgcaggcatcaaaagaccggaaacaacgcacgctctgccggcaaaaggcaaaacgaatagggccgtctaaaaatgccgtacacacgctgcccagtcctggagcaccctcacaaggggaacccctagaatagcgtggcccgactccaaaaggcacccacgatggggacacccccaggggaagaacagtagaaaatgccggcgcaacagacatctaggcagctaggcaacaccgtcggcgacagcgcacagccaatcaggtaaaaggagacgacacaagaacagatccaag

SEQ ID NO: 578575 - DNA, 659 bp, Homo sapiens
  misc_feature (176)..(176): n is a, c, g, or t
  misc_feature (254)..(254): n is a, c, g, or t
  misc_feature (302)..(302): n is a, c, g, or t
gcacggagggtgtgcccccgttgccggcttggggaagaggttatcagaaggcgccccttgtggtggaaagcgcccacaagatagcccgcggttatgcttcgtgagaagtgtggtcccccacacgcgcgggcttgtaatacacaggtgagttgaaacttgccggggaggagtttggntttttcgaaaacaaatggcgcagccgagtgacggccgcggttcttgttccccaacgccaaaagtgggataaccgccanttgttctctatatacaaaacgacttcggtgagggttcgccctctaccnaaaaaagaatacgacgatacgcacgtgtctgtaggcaccgcccacaagatctctataacatgctagtagcgtcgccgacattctagtatgttgttacaagtggcgaggaggcacaccaccaatgacttttcaatacccgtgaattggtaggaaaagcagaggccgttggtaggcatggagtaaaactagggcagctacactctgctgaccacgcaaacgagcataacaatctttacaggccctgggggtccccgcatagaagattactatgttggggccacccgaggttaaaaaacatatgtcaagagttggtcccaggacccaagggaaaaaattcatttggcgccccacaagaca

SEQ ID NO: 578576 - DNA, 350 bp, Homo sapiens
ctacacacagactcacacagacacacaacacatcctgacacacacacacagacaatatacaacacacacacacacaatcgaacccacatacacacacgcggacaacacacaaaacacaacacatagaacacacgctaacccacagacacaaacgccagacaacacacagagacacacaacacaccctaacccatatacatccacaacacacacaacacacagaccccaatatcgacacccatcaccaccaccactacggtgaccccaaccccaacacccaccggcacagagaccccaaccacgacacccatcaccagcaccaccactgtgaccccaaccccaacacccag

SEQ ID NO: 578577 - DNA, 1065 bp, Homo sapiens
cctggcttcggagccttaggcgccggggctttccttgtttccgccagtccatgccgccatggcaagtggggccagggaaccccccactggatcgtggaggagcgggaggacgggaccaatgtgaacaactggcgctggcgcggtggggggctccttccgggatctggggagtggcctgtgtgcctgctgggagccggggctgcctggggtctgtgcggggccgcggggcagggggccgcccccctcagctgctggacgcagtgctcggccttcgcctctcggctcgggagagtccttgagtacggagaccggctaggaggtttgcagctgcctctttttgacacgtcgggttggggcccaagagtgactttccgacaagacctttccactcccaccgtctgtggcctgaggggccttccccttcttcgctcacgaccaagccctctggatgtttcggcggagttacgaagggagcctggattcgagagacgtgttgtaacgcggagcggggggatatagggacaagataagatgaaaagaggcaagaaacaccggaggataatacattatagagcgatacaacattctaacgagcggccatacacggtaagtcctagcaacacatagtagggaatgagacaaaaaagcacgcactctcgataatcacaagcatagcgcggcggcgcggcggaagagaggcaggcacacacgccacggcgccccaagacaaccggcaactggaagaaccatggcgtgtgataggacgagggatgggaggcgcaggggtagcaagtagtagagagagaggacgaagaggggaagatcaggatgccgacagatacgaggatggaataagatagaggaagcaggcatagagagggtaagtgatgggataaatagagatcgagtactgaagtagcagaagcagtgaagatagtcttcagagagagagaggggaggaagagaacggtgctcacgaaaggtaggagcagtctccagaggagagaaagacgaaagactaaggaagagatagggtggaggaagttctagtattagtatcggtgt

SEQ ID NO: 578578 - DNA, 958 bp, Homo sapiens
ggctgccgagcttaatcctgtgggggaggggtgctgaccttagtgtgaggagcccactgtgatccttgagctgacctgtcgcacgcctcccctccctgtagcaacacctctgggtgtttggagtataagtcttttgtgggtttgctctccctatcccatctcctgtactacacagttcatggtagggtggggaagcgcggtggggttggttcgtgcgtgggtcgagggtcttaatctcctctgtgtgcgtgttgttatctgacagttctccgtccctactggccttactcctcgtcttcatatttgtatccggctacaagcaataaagacactcatttgcagtacacaggtcccagacctgctaactcacgccagtgccaaccactctgggctttgccttggtgatggagtcagacccctgggccccagctcctcctgtactagccgttcccttcagcaaggagggcactgagctcagggtgagggcagctggaggtgtgtgcatgtagctcaagcggctggagagtggtgggtggagctggtgctgtggtgctgaggggtatgggatggctccccgcatgtgggggtggggtggccacagacgacctctccgatgccctcattgctgcttcaggctagagagaggtggggtggcagggacagcgctggaggatctgggtagccaaatgacgagggtgcctgtgctgtcccttgatatgacaggtacgtggtcattgcacccgggtggcgagctcagaggggggatctatctgccactccggtttgttgccctgtagtctgaggcgcaattccgttgaccgtgtgtgtctgtgcttgtgtgcacggagctgacgttggtaacctgttttgagtagctcccaaactgcttaagtttttgccaatcgtaaccggagccgagggaagaacccagggaagcctccaccgtaggggaaatcgg

SEQ ID NO: 578579 - DNA, 540 bp, Homo sapiens
cgccgcgctatcaagtgactgtgcgctggatagcatcttgttcacaatctcatgagagatccaagtgagagacaccctcagtaaaccactcccaaatttgtataaataacttatcccaaaacttagtgtcacaagaaacaatatctacttaataaaaagttagtccagtaaaagaatatcccaaatatatctatataaatttaacaacattacataccacatctatatcagcatgatcttagagtacaatcatccttaacaatgtcggcttgtattcttgacgaaaacaataaggtttttttgaaaacagtcaaattcagcaacaacagaaaccaggcagacacatctacaacaaatcgatggcaaaagaggtcacaatatataaaaccacaatcttatcatgcagggcattgaagactacagaaatagttgtagcaatagaatggtcatcttatgcacaaaccatgacacaaatatcacatacaaatgataagccgtaactcaagaaaacagcatagaacatccctagtgagtgctgta

SEQ ID NO: 578580 - DNA, 680 bp, Homo sapiens
  misc_feature (97)..(97): n is a, c, g, or t
  misc_feature (117)..(117): n is a, c, g, or t
  misc_feature (135)..(135): n is a, c, g, or t
  misc_feature (251)..(251): n is a, c, g, or t
  misc_feature (256)..(256): n is a, c, g, or t
  misc_feature (264)..(264): n is a, c, g, or t
  misc_feature (282)..(282): n is a, c, g, or t
  misc_feature (287)..(287): n is a, c, g, or t
  misc_feature (387)..(387): n is a, c, g, or t
  misc_feature (451)..(451): n is a, c, g, or t
  misc_feature (588)..(588): n is a, c, g, or t
acttcaggacatatttgttacttcgtgagtaagttgggagggctcggagccctttgtcgtgttcacaggtgatactttgtttgtggttgggtgcggnaagttctatgaagggactgnggatgagatgtgtaaagntttgctggaggttttgggtggtttccctctggatataagagtctattgtggctacgagtacactattaataaccttaagtttgcatgctatgtggagcctggcaatgctgccatcnggganaagttggnttgggccaaggagaagtncagcnttggggagcccacagtgccatccaccttggcagaggagtttacctacaaccctttcatgagagtgagggagaagacggtgcagcagcacgcaggtgaganggacccggtgaccaccatgcgggccgtgcgcagggagaaggaccagttcaagatgccccgggantgaggccgccctgcaccttcagcggatttggggattaggctcttttaggtaactggctttcctgctggtccgtgcgggaaattcagtcttgatttaaccttaattttacagcccttggcttgtgttatcggacattntaatgcatatttataagagaagtttaacaagtatttattcccatatttacggtcgcgggatcctgattgatcggatactaaatgtagcttct

SEQ ID NO: 578581 - DNA, 361 bp, Homo sapiens
  misc_feature (20)..(20): n is a, c, g, or t
  misc_feature (348)..(350): n is a, c, g, or t
gtggaccccctcatgaatgnggttggtgttctatgaaagaggccccagaggccaggtgcagtggttcgcgcctgtaatcccagcaccctgggaggccgaggcaggtggatcacctggggtcgggggttcgagaccggcctggccaacatggcaagaccctgtctctgctgaaaatacaaaaattggccgggcgtggttgtgcacacctgtgattccggctgctcgggaggctgaggcaggagaatcccttgaacctgggagacggaggttgcaattaactgagatcgcgccccaacccttcaggcttgggggcaaaagtgaaactccttctcaaaaccccaaaaaggnnnggaaagaaaag

SEQ ID NO: 578582 - DNA, 744 bp, Homo sapiens
  misc_feature (97)..(97): n is a, c, g, or t
  misc_feature (117)..(117): n is a, c, g, or t
  misc_feature (135)..(135): n is a, c, g, or t
  misc_feature (251)..(251): n is a, c, g, or t
  misc_feature (256)..(256): n is a, c, g, or t
  misc_feature (264)..(264): n is a, c, g, or t
  misc_feature (282)..(282): n is a, c, g, or t
  misc_feature (287)..(287): n is a, c, g, or t
  misc_feature (451)..(451): n is a, c, g, or t
  misc_feature (515)..(515): n is a, c, g, or t
  misc_feature (652)..(652): n is a, c, g, or t
acttcaggacatatttgttacttcgtgagtaagttgggagggctcggagccctttgtcgtgttcacaggtgatactttgtttgtggttgggtgcggnaagttctatgaagggactgnggatgagatgtgtaaagntttgctggaggttttgggtggtttccctctggatataagagtctattgtggctacgagtacactattaataaccttaagtttgcatgctatgtggagcctggcaatgctgccatcnggganaagttggnttgggccaaggagaagtncagcnttggggagcccacagtgccatccaccttggcagaggagtttacctacaaccctttcatgagagtgagtggccctggttcctccggtgggggtggcttggcacagcctacagcccggtgttggcctccgcagggagaagacggtgcagcagcacgcaggtgaganggacccggtgaccaccatgcgggccgtgcgcagggagaaggaccagttcaagatgccccgggantgaggccgccctgcaccttcagcggatttggggattaggctcttttaggtaactggctttcctgctggtccgtgcgggaaattcagtcttgatttaaccttaattttacagcccttggcttgtgttatcggacattntaatgcatatttataagagaagtttaacaagtatttattcccatatttacggtcgcgggatcctgattgatcggatactaaatgtagcttct

SEQ ID NO: 578583 - DNA, 474 bp, Homo sapiens
  misc_feature (97)..(97): n is a, c, g, or t
  misc_feature (102)..(103): n is a, c, g, or t
  misc_feature (112)..(112): n is a, c, g, or t
  misc_feature (115)..(117): n is a, c, g, or t
  misc_feature (121)..(121): n is a, c, g, or t
  misc_feature (124)..(124): n is a, c, g, or t
  misc_feature (126)..(126): n is a, c, g, or t
  misc_feature (141)..(141): n is a, c, g, or t
  misc_feature (164)..(164): n is a, c, g, or t
  misc_feature (174)..(175): n is a, c, g, or t
  misc_feature (180)..(180): n is a, c, g, or t
  misc_feature (183)..(183): n is a, c, g, or t
  misc_feature (187)..(187): n is a, c, g, or t
  misc_feature (189)..(189): n is a, c, g, or t
  misc_feature (191)..(192): n is a, c, g, or t
  misc_feature (195)..(196): n is a, c, g, or t
  misc_feature (204)..(205): n is a, c, g, or t
  misc_feature (209)..(210): n is a, c, g, or t
  misc_feature (216)..(216): n is a, c, g, or t
  misc_feature (221)..(222): n is a, c, g, or t
  misc_feature (227)..(227): n is a, c, g, or t
  misc_feature (244)..(245): n is a, c, g, or t
  misc_feature (247)..(248): n is a, c, g, or t
  misc_feature (250)..(250): n is a, c, g, or t
  misc_feature (257)..(257): n is a, c, g, or t
  misc_feature (259)..(259): n is a, c, g, or t
  misc_feature (275)..(276): n is a, c, g, or t
  misc_feature (278)..(278): n is a, c, g, or t
  misc_feature (280)..(281): n is a, c, g, or t
  misc_feature (302)..(303): n is a, c, g, or t
  misc_feature (307)..(307): n is a, c, g, or t
  misc_feature (311)..(311): n is a, c, g, or t
  misc_feature (318)..(318): n is a, c, g, or t
  misc_feature (333)..(333): n is a, c, g, or t
  misc_feature (347)..(348): n is a, c, g, or t
  misc_feature (375)..(375): n is a, c, g, or t
  misc_feature (378)..(378): n is a, c, g, or t
  misc_feature (385)..(386): n is a, c, g, or t
  misc_feature (450)..(450): n is a, c, g, or t
tgcacacatatgtttattgcagcactattcacaatagcaaagacttggaatcaactcaaatgcctatcaatgatagactggataaagataatgtggnaaatnnaaaaaaaanaannncagnaananagaaaaaaacagcanggaagagaagggcaacccaaagncagcaacagnnaaaanaanaggngnannaanngaaaaaannaaannaaaaanaaaannaaagnggagaaagaagaagggnnanngnaaaaagnanaaaaaagccaaaaacnnancnnaaaagaaaaaaagccccaagnnggangggngggggantaggggagggatagnagtaggagaaatanntaaggtagatgatgggttaatgggtgnagnaaaaaannatggaaagtgtataaatatgtaaaagaaatgaaggttatgaaaatgtataaaagaaattaaaantgtaataaaaaaagataaaaattt

SEQ ID NO: 578584 - DNA, 1452 bp, Homo sapiens
  misc_feature (1336)..(1336): n is a, c, g, or t
ggaacaaaacgcaaggatgaggagggcgcgcggcctgcagcactcgcccgcgatcccggccgcggcgtgatgcgcgcggaccagcccgcgacgccctgggctgccgctgtccccgcacctgtgacgctggcgcgtgtggccgctgcccagactcgatcgctcgccgcggcgactgggggcccagggctataccggcgaccgggtgggttgtcctcgctctccactgggggctagaggggactgggctgagaacccggtgtgcatgctagcgtgccgaggtagccgacgatgcataggagaattagcagaggcgtgaagtcaccgcagccccggacgcaaaggcccattgggcgctaaccaatcttgggcaattagccaatctgatagaacctggacaggtgtatagaggacgcgtcttgttatgcacgtatactccttcctcgttaatcagtcctgatacgtctggatattccggtaagggcatgagcgaaggcctggcggcccttggtgcgcggggtgaaccctccttcaatgacagttacgattggcacgcagttatttgcccgggtgacggtaattatggcaccatggagcggactccatttggccgtggggaacccatatcgttttcgtcgtagccaaggagcagactcactttgtgtcccgaacatggggcacgccgactagcgctggttgaacgtggccaaggttttgcctatacgacttctaacccagacatttggccggacgacggttcacacggcgttatgcgacagcgaggtttaccgtattggccccagcgttctaaccggccagcacggggcacaccctttagggctccagcaggcaggacagtcagttgcggtgtcccacgtggctaatcagctttggcacgagagcgaaccatgatgacgcggggcgaacattgacgagcacagacgggggttagcacgtccccagcgttagggaagtttgggcatgggaacaaaaccagacggttggggacaacaggtcagtttagtagaaagttagtgtgtaagcagcagcaattttgtcgggccagccgttgccttgacacgattccgcggggggtcaccgcggcagacgctaaaggcgttagggtaagattagagggatcgatgggacattgaagaaaggaggacgtgggtgaacacgtatgcagaacaatgtagtagtgaacataagatagcagcagagagtggaggaccattagatatctagtagcgtaggaagtgtcccagcgaaggtgtgtgtgtatagcgacgataatatgtgcagatagggggcagaaggaaagcgcactggtgagtgtctngccagcgtgagattaacaatggcggcattggagagagaagccacagagatagaaagcatggagtgaggggtttcacgggggcgacaacttatgttcacatcagttctacggaaacg

SEQ ID NO: 578585 - DNA, 343 bp, Homo sapiens
agctatacctgtgcacagctctaacagaagaaacgctgatacgtgaaataggtataagacgagcaagaagcattaccagctaggtactttacactgagattaaaaaataaacatacacaaaaaatacaacaagtacagtcctataaggtacagatagcttggcacagataacagactaaactataagacacgaataaacaaactgtgtaataacatagggccacagattgtaaactgtcctattttcccatcctaagatgccaaaattgcactctcagttgtagttgggcaagcagcaagagtttaacgaagcaagcagtaggtaaggcaaaccagctgtcac

SEQ ID NO: 578586 - DNA, 792 bp, Homo sapiens
  misc_feature (49)..(49): n is a, c, g, or t
  misc_feature (62)..(62): n is a, c, g, or t
  misc_feature (93)..(93): n is a, c, g, or t
  misc_feature (134)..(137): n is a, c, g, or t
  misc_feature (145)..(145): n is a, c, g, or t
  misc_feature (185)..(185): n is a, c, g, or t
  misc_feature (231)..(231): n is a, c, g, or t
  misc_feature (277)..(278): n is a, c, g, or t
  misc_feature (280)..(280): n is a, c, g, or t
  misc_feature (285)..(286): n is a, c, g, or t
  misc_feature (291)..(296): n is a, c, g, or t
  misc_feature (299)..(299): n is a, c, g, or t
  misc_feature (320)..(320): n is a, c, g, or t
  misc_feature (342)..(346): n is a, c, g, or t
  misc_feature (376)..(376): n is a, c, g, or t
  misc_feature (418)..(418): n is a, c, g, or t
  misc_feature (421)..(421): n is a, c, g, or t
  misc_feature (424)..(424): n is a, c, g, or t
  misc_feature (429)..(429): n is a, c, g, or t
  misc_feature (455)..(455): n is a, c, g, or t
  misc_feature (464)..(464): n is a, c, g, or t
  misc_feature (484)..(484): n is a, c, g, or t
  misc_feature (502)..(502): n is a, c, g, or t
  misc_feature (513)..(513): n is a, c, g, or t
  misc_feature (534)..(534): n is a, c, g, or t
  misc_feature (559)..(559): n is a, c, g, or t
  misc_feature (585)..(585): n is a, c, g, or t
  misc_feature (647)..(647): n is a, c, g, or t
  misc_feature (675)..(675): n is a, c, g, or t
  misc_feature (698)..(698): n is a, c, g, or t
  misc_feature (706)..(706): n is a, c, g, or t
  misc_feature (709)..(709): n is a, c, g, or t
  misc_feature (715)..(715): n is a, c, g, or t
  misc_feature (722)..(722): n is a, c, g, or t
  misc_feature (779)..(779): n is a, c, g, or t
aaaaacctcatctccattaccctcatacatggctataatttgattctgntactaaattctgngaatcattatttaatcaaatctactaaagantagaaaaaattctagcaagacttataactcatgaaatacannnntaaaagtntaaacctaccaaaagtcctatggcctattatttagctgtnaatgagacacgtcaggagtataaatctgcacttttgactgtaagtnaaatttgctaatgcaggaagcgaaatagtgaaggaatactggagtnncnaaaannttacnnnnnnctnttttttttgcaaaatgcaacntaccttaaaagtgtctcacccnnnnngcctctacctgtaatcacattaatttttcnaaagacaatttggggttttgaagataaatgtcattagtctanganaanagcancataggacaattagccattttagacntgaccatantttctctttttagcataaanccatcttgatatttaggngggagactacnccaatggagcaacagtttcantttacatgattggatttagaaattnacaaattttaaactcataagaattcnaaaaaatttgaaaatggaaacatttgacccacagtctagcagcataaatacatttataaaanacttcattgttgatcttaggtcattganttaaaacagaatttggtgactangggcaggnggngggggncagtaangaaggtataaaaaagaaatctttatgaattgtgttcagattgattttgtataaacanaatatattcatgg

SEQ ID NO: 578587 - DNA, 135 bp, Homo sapiens
catacttcctccaaggctttatcatttctccaaggctttcatcattctccatttccatttcccgggtcatgcaatcaacagcgtggcaggcagtcatacacagcggtttgcaggggtcaccggcagctcgcacat

SEQ ID NO: 578588 - DNA, 232 bp, Homo sapiens
caaatattctgtaagaatcaattgtctatatggaatttaggataaagaatctttcccactaaaggactatttccaataaagagtttattattatttgtaagttgtgtgcaccaaacatcccctttatctctgtaaaatttatacccccaaaaattaacaaaagattctgtaagaattaattggctatatggaatttaggatagaatatttccaataaagagtatttccaata

SEQ ID NO: 578589 - DNA, 166 bp, Homo sapiens
ctggtgagcaagatagccagctgagcggctagaaagtaagccagggctacgaggtagatatctagaacgggaagtgtggacccacagctatccctaaaaccaagagagcggtctccaacggcgtagggtagtagtaaatcatatcctactactacctagtacagct

SEQ ID NO: 578590 - DNA, 921 bp, Homo sapiens
  misc_feature (616)..(616): n is a, c, g, or t
  misc_feature (629)..(629): n is a, c, g, or t
  misc_feature (632)..(632): n is a, c, g, or t
  misc_feature (637)..(637): n is a, c, g, or t
  misc_feature (639)..(640): n is a, c, g, or t
  misc_feature (661)..(661): n is a, c, g, or t
  misc_feature (667)..(668): n is a, c, g, or t
  misc_feature (677)..(677): n is a, c, g, or t
  misc_feature (690)..(690): n is a, c, g, or t
  misc_feature (696)..(696): n is a, c, g, or t
  misc_feature (698)..(698): n is a, c, g, or t
  misc_feature (702)..(703): n is a, c, g, or t
gcagcccagcaacaagcggccaccgcccccaccccggggcgggcaggttccgacctgaatctgaaagtgcttctaaaccccatgcttcacagaacgttcggagggggaggcgctccgtgggggctgctgcgtgcccatgtagccgaactgactcgaataaaagcgtgtccacgtctacatcacacatctgtgtaaatgcagaagcctgcggatgcgcggggctggccagacttcacagtgtgcagacacatgggctcatgcacgcgcacgcgcgcgctcacacacacaccccaaattacctccgggatggagaaagccgctgcggattggccagcagagccgtcactcacgcccagggggcagggagacttcgcaaagctgtttccttttttttttttccctccttctcctccctataccggtttcatttaatgggtaaaacaacaggcagagctctgaaaggttagccattctggggcaagagttggccttcttaaaggagggaggggtcaaaggatatccatttaaatattttgggtatttccaaaagggtgggaaggggaaattcacgaggggaggggaggcggaaggggagctccgagaaagaggaggggtnatccgaggggggnggngaggngnngcgggggccgacgcagggacngagtgnntcttaaacngaaaggggacttngacctncnatgnntccgaaattcacagacacgtttctcacccgggtccatctcgttccaacacccgggtcctaatttatggaagccgacgggtagaatcaatatttaagaatgcgccagaaatggtgtctcttaaaaagacactggcataattgggcgggagaaaaggctccgttttacggatataaaatagaaatcgggggtcttatggggggggaaaagcgtctaagga

SEQ ID NO: 578591 - DNA, 103 bp, Homo sapiens
  misc_feature (75)..(75): n is a, c, g, or t
tccggaaagaagagccggagaggatcaaagattgaaaaagtattattgataaccttgaaaaaaaacagtggatcncaaagtggaacgaaaatgaaagctactc

SEQ ID NO: 578592 - DNA, 173 bp, Homo sapiens
  misc_feature (4)..(4): n is a, c, g, or t
  misc_feature (7)..(7): n is a, c, g, or t
  misc_feature (92)..(92): n is a, c, g, or t
  misc_feature (116)..(116): n is a, c, g, or t
gganaanatggctgccccaacagtgtccgggctctcccggcagtgcgatgcttcagtacctctgtggtcataccatttgccaagcttgtgangcctcctgttcagtatacggtatnaaggtcgctatgccacagctctttattctgctgcatccagaataagctggagcgtag

SEQ ID NO: 578593 - DNA, 909 bp, Homo sapiens
atgggctcacggagcgggtggctaggctgaggagagctcgccgggctccgaccggcgcaggacatccaataaagaaaatggcagctcttactccaaggaagaggaagcaggattcttgaagtgtgacagcctttacagttcactgacaaatctgtggtccatcacctaataaaaagcactgtgttgatcatggacagtgataaaggcatgaagaaaacctggcatagactctcaacgagagcatgtgttttaagtgcgctcaaaacaactgaaataaatagactgccatcagcaaatcaaggctcacccatttaaatctgcgctctccagctgtatctttttactaaccaaaataagtggtacctcaatccactggagagaaagcctgataaggaaagagagtagatcgtacttgtctaaaagacctaatgatgaagataaatcttttccatggtgacagaagaagatgcaaggaaaaacagtctgtccaagaagaacaaaaaaaaaacaagaagaagttaaaatgtaagtatcaaccaaagtatagacacatccacgcctgtataagaattcgagaaattcaagcaaaatacgagggatctataggcaattgtggagaaggaaatacttgtatcaggtgacaataatccaggtcgtagagtcatgagtcgaaaaataaccaaagtcactccagggggcaggatttggtgaaaaatttcctaaaaacgtccggaatgagcgtgagggaggacgaaggggatcaagttgtagtatgaggtgaagggctaaacaattggaagaggaagtgtgtaacaacaagggagggacgattggacaagggtaaggaagcaggtgagtaatttaccaagtgagcatatttacaaaaaggaagaatattggtgggttctt

SEQ ID NO: 578594 - DNA, 262 bp, Homo sapiens
  misc_feature (33)..(33): n is a, c, g, or t
  misc_feature (42)..(42): n is a, c, g, or t
  misc_feature (59)..(59): n is a, c, g, or t
ctcattgaaaccttcacctcctgggttcaagcnattctcctncctcagcctcctgagtngctgggattacaaccgtatgccacaacgtccggctaattttgtaattttagtagagacagggtttcaccatgttggccaggctggtgtcaaactcctgacctcaggtgatccgctcacctcggcctcccaaagtgctgggattacaggtgtgagccaccgcacctggcttaggggccatctttgagtcggccctggctctgct

SEQ ID NO: 578595 - DNA, 81 bp, Homo sapiens
ggggaaggaggaccgggccatattttttcaccttctgggtgggggaggactgggggattttttctggccgataaactcatc

SEQ ID NO: 578596 - DNA, 224 bp, Homo sapiens
caggatctaacgtaatatgtaaccaggatcatctacataaccatcttccacctccagatattgtcctctggaaggtgtcaggagcataacatacatggaggtgtcatctcctattgtagcaattcttcttgttgattacctacctgaaggaccctgctagaggctgttttacagttgactatttttttttttcaaaggtagagggagtaccttctaaaattatg

SEQ ID NO: 578597 - DNA, 309 bp, Homo sapiens
tggagtttgctcagtgaagaagtgatgtgggccgggcaccgtgctcacatctgggatctcagcactttgggaggcaagttgggcggatcatctgaggtcaggagttcaagaccagcctggcaacatggtgaagccctgtctctactgaaaatacaaaaattggccaggcatggtggcgcacacctgtggtcccagctgctcgggaggctgaggcgggagaatcgcttgaaccctgtgaggcggaggttgcagtgggctaggatggcgccattgcactccagcctgggcaagaacagcgagactccgtct

SEQ ID NO: 578598 - DNA, 837 bp, Homo sapiens
ttgcacaccagtgaatcacatctggccgcgtgtgaaagggtcgggagcccttctactgagagttctctgtgtctgagttccacccgttgctaaggaatatgactcgcatggatatcatcaggttcgaaatcactgtacagatgtcttcatactaccgagactccgagtgtaacggaggatggtccatgtgtatcttctcgtgtggttcccttctgtatatgtcggtaagtgatgcgaggttctcctcacctcgggtttccaacggcgtagtacatgtatgattgagatactagaatagtaaagcatggtcttcgcgccatacattactgacgtctttgtgtgcaacccatcacgctttacttgctaccctcaaaggtaggtattgtttatttcaaggccccaggctgactggctagtccttcttcgaagtaaatgtgtccacctaggctttggcaagctcataggtaaggataccgctattgctcccatgttagatgccaaactccatgcgtataggatagaagggatcttggagcccaagtatgtccagatcgcagagtcattggagctaaaacaacccagggatcctgatatccgagacgactaagacccatgccgtgtcgtgttagaatcatttactgcactcactgcagaggtcgaaggttgtgagatttgggaggaatcgtgtattaggagagatctgtaagggtgtaggatgagatgcgggagctatgcgacaattggtattgagagttgtcggggccataggtggaagcggttacgtagtttatcagcttttcccccgcttgttcctcctttacagtgccgatacgccaa

SEQ ID NO: 578599 - DNA, 458 bp, Homo sapiens
  misc_feature (209)..(209): n is a, c, g, or t
  misc_feature (397)..(397): n is a, c, g, or t
taacttgcagaagatcacagaaaagtttgaaatcagctggttggattcgcagccaggtcctgcagactccagaccccgcgcctccccgccctacttctgggccccaagagcaggccgcggcaacttccagaagccgggtctctggggcaccgcggctcgcggacgcgacctcagatcccatcccagccgctccactgcctgggcagaantgggggtccccgctgggaacgacgatggtgctgccagggttcacagggcccgccccttcccctctgcaggtgccgggtacaccgaccgcatgagcgggcgccgtacctagtgggaggagcccagtaggtgcgggatgaggtgcggagcgggaagggcgcgggcgaaagcaccgcaggggccctcgctngacccctgccacacgcaaaagcaggagctgcaacggcatccttcacgactggagcggcccg

SEQ ID NO: 578600 - DNA, 487 bp, Homo sapiens
  misc_feature (2)..(2): n is a, c, g, or t
  misc_feature (34)..(34): n is a, c, g, or t
  misc_feature (49)..(49): n is a, c, g, or t
  misc_feature (75)..(75): n is a, c, g, or t
  misc_feature (84)..(84): n is a, c, g, or t
  misc_feature (99)..(99): n is a, c, g, or t
  misc_feature (101)..(102): n is a, c, g, or t
  misc_feature (113)..(114): n is a, c, g, or t
  misc_feature (116)..(116): n is a, c, g, or t
  misc_feature (166)..(166): n is a, c, g, or t
  misc_feature (204)..(205): n is a, c, g, or t
  misc_feature (207)..(207): n is a, c, g, or t
  misc_feature (212)..(212): n is a, c, g, or t
  misc_feature (214)..(214): n is a, c, g, or t
  misc_feature (247)..(248): n is a, c, g, or t
  misc_feature (307)..(307): n is a, c, g, or t
  misc_feature (414)..(414): n is a, c, g, or t
gnaggaaacgggagttaacggagagcgtagtaanccatacatgagcctncacaacaagcccaagaattaaatgancccagaagngctgcaaaagcgagntnnggaggaatttnncnccggataccactctctgttctcacacagtcagttaagaacaatacccaanttctcatcaactgccgcaacaataagaaactcctgggnngngtaangnccttcgataggcactgcaacatagtgctggagnncgtgaaggaaatgtggactgaggtacccaagagtggcaagggcaagaagaagttcaagncagtaaacaaagaccgctacatctccaaaatgttccatgcgcggggactcagttatcgtggtcctgcggaacccgctcatcgccggcaagtaggggccgcctgtttnttgacagaactcactcctcttttctatgaagaccgctgccatttgtgttgagaataataaagctctgtttttt

SEQ ID NO: 578601 - DNA, 468 bp, Homo sapiens
ctgctgctcgcggatactcctgctgctcgcgatattcctcctgatgctcggcaaccctcttccccaggaaaggagaaaagagaaaacaggctgggcccggtggctcactcctgtaatcccagcactttgggaggttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagatcttgccactgccctccagcctgggtgacagagtgagactccatctcaaaagaaaagaaaaaggctcccagaacaaagcgtaagagatggtggccacacagcaggagatgatggacgcgcaggtgaggctccagctgcggg

SEQ ID NO: 578602 - DNA, 989 bp, Homo sapiens
gcaccatgaagttcaatacccttcgttacctcggaccgcagtaaaaaccgtaaacgtcatttcagatgccccctcacacgtgctacaggaagatcatgtcgatctcccgctctccaaggagctgcgggatgaagtacaatgtccgctccatgcccatccgtaatgacgagagaggtccaagtattacgaggacactacataaggtcagtcaccattggcaatggtagtccagggtgtccagacatcgacatactgtcagtctactctcgacgcgggtgcatgcgtgtagcacaggccaagcggcacagactgtccacgtgggcattcacccaagcaaggtggttatcaccacgtgctaaccatctggacataggctcggacaataacaattcttgaacgctgaatgccatcgtctcgacaagttgcaaggagagaaaggcgaatatagaagaagaactgtagttgtagcaaacatgctggcattcaattgacacctgttgtgctaccacggtttaaccgtgggaattgcgcctgcgcgtaggagtgtcctcattaccatggttggtgacctgtacaggtcgctgctatctctaaggggtgatagccattctgggtccaattcatccctctctttggtccgcatcgagacatgaaagcatctgggtatctgacgtatcattggccttgaggtaagaagacgtgctctacagtgctcagtctttgacgtcccgagaagcgaactgccttgtagatgggataagtccggtccaagcagatccctttgcttgactgcctgttcgtgggccttacgctgccttaagttaaagcgctttgaacgctaatctaaagagggtttccttgccttttgacctgggatactggccctatacgagggcgccccccaagattttctctggaaaaagggtttgaaagaccccgaatgagagaagacgctccggaacaaggtaacgtccacaccggttgggccc

SEQ ID NO: 578603 - DNA, 242 bp, Homo sapiens
  misc_feature (28)..(28): n is a, c, g, or t
  misc_feature (33)..(33): n is a, c, g, or t
  misc_feature (106)..(106): n is a, c, g, or t
  misc_feature (120)..(120): n is a, c, g, or t
  misc_feature (200)..(200): n is a, c, g, or t
  misc_feature (212)..(212): n is a, c, g, or t
  misc_feature (226)..(226): n is a, c, g, or t
caggtgcaggcagcagcagcagcggcanaggtnggcccaggccaggctcaagctcaagcccaggctcaggctcaggctcaagccaggcccaggccaggctcccagnatcacagcagcagnagcagcagagagcagagcagagagcaacagcaccaccacacttccagtctcctggggcagcccccaggttggggttggtngggacagcaatnccaaaccctctaancccaagttgtttcttt

SEQ ID NO: 578604 - DNA, 395 bp, Homo sapiens
tggcttacgcctgtaatcccagttcttcgcgaggctgaggcggccggattacgaggtcagaagatcgagaccattctggctaacacggtgaaaccccggctctactgaaaatacaacttagccaggcgtggtggcggcccgcctgtagtcccagctactagggaggctgaggcagcagaatgccgtgaaccccgcaggtggagctcgcagcgagccgagatcgcaccactgcacttcagcctcggtgacagagcaagactctttattcaattgctagctcaccatcacacaacttctgccgcctgcttgccccaaccgactctagacccgagcacgcttatccatgcgaccggaattcgagcctacttgccctcgccccatagggccgcgctctc

SEQ ID NO: 578605 - DNA, 314 bp, Homo sapiens
cgttagccagacatgggactggaggacgagcaaaagatgcttaccgaatccggagatcctgaggaggaggaagaggaagaggaggaattagtggatcccctaacaacagtaagagagcatgcgagcagttggagaatgtgtaaaggcccggagcgctagagctctgtgatgagcgtgtatctctcgatcacatacagagaggattgcacgcagagctctttgactcttgcatcgagcacatgcgtgccacatctctttacactgaataatgtgtgacttattcacccatctcatcatctggcatcagatattct

SEQ ID NO: 578606 - DNA, 931 bp, Homo sapiens
  misc_feature (21)..(21): n is a, c, g, or t
  misc_feature (75)..(76): n is a, c, g, or t
  misc_feature (81)..(81): n is a, c, g, or t
  misc_feature (87)..(89): n is a, c, g, or t
  misc_feature (135)..(135): n is a, c, g, or t
  misc_feature (187)..(188): n is a, c, g, or t
  misc_feature (200)..(200): n is a, c, g, or t
  misc_feature (283)..(283): n is a, c, g, or t
  misc_feature (306)..(306): n is a, c, g, or t
  misc_feature (308)..(309): n is a, c, g, or t
  misc_feature (311)..(311): n is a, c, g, or t
  misc_feature (316)..(316): n is a, c, g, or t
  misc_feature (320)..(320): n is a, c, g, or t
  misc_feature (335)..(336): n is a, c, g, or t
  misc_feature (338)..(338): n is a, c, g, or t
  misc_feature (358)..(358): n is a, c, g, or t
  misc_feature (360)..(360): n is a, c, g, or t
  misc_feature (363)..(363): n is a, c, g, or t
  misc_feature (365)..(365): n is a, c, g, or t
  misc_feature (367)..(368): n is a, c, g, or t
  misc_feature (374)..(374): n is a, c, g, or t
  misc_feature (390)..(390): n is a, c, g, or t
  misc_feature (426)..(426): n is a, c, g, or t
  misc_feature (457)..(457): n is a, c, g, or t
  misc_feature (463)..(463): n is a, c, g, or t
  misc_feature (536)..(536): n is a, c, g, or t
  misc_feature (543)..(543): n is a, c, g, or t
  misc_feature (550)..(550): n is a, c, g, or t
  misc_feature (579)..(579): n is a, c, g, or t
  misc_feature (592)..(592): n is a, c, g, or t
  misc_feature (638)..(638): n is a, c, g, or t
  misc_feature (641)..(641): n is a, c, g, or t
  misc_feature (661)..(661): n is a, c, g, or t
  misc_feature (683)..(683): n is a, c, g, or t
  misc_feature (707)..(707): n is a, c, g, or t
  misc_feature (806)..(806): n is a, c, g, or t
  misc_feature (818)..(818): n is a, c, g, or t
  misc_feature (859)..(859): n is a, c, g, or t
  misc_feature (924)..(924): n is a, c, g, or t
taataatagttttcaaaatanaatagtgggacaaacaaaggatggatattaatatacaaaaaggaagaaagagannaaganaaatannnatgggactcgaagcgaagtacaaatcatagcaagaggaaacgtccnaacgatcttaagcgtctgcgtagaataatcgactttaagataatcatggccnncgtaggggcagnaccacgcgtcactcgtgggactccctgattggggctggaggaccacaatataaagaagtgggcagacaatgtactcctcctanaggcagggaaggcactgccacangnngnggctntctngtgtggccctgcccnngnggcaatttcctgtggggggngnggntncnngttcantgatctgctggccttntcttccttcactgatcccctgggtgttggtcctacntttagaaattaaaacagcacccctcccccancccatncactctgggtcttgtgcgtgggagaggcgagcgcttggcggatatctgaattgcctttaggatctctcttctnttgtctnggagaancatgcatgtttgcagtgaaattgttctanggtttggtcctgnggagtctaagaaatcgtgacagtctttggtcattttgtcctgtttntgnttgtttcctttagtctcggntggcagtgttaccgctggtgtnatctcttctctgttcctggctttnattgagatggttgatcatctttacacagtcctttgcatgcagatgtatgtatttggagttgaacagttttctatatagcctttaaagctcgaggcatanagtgcacagtcncccttctgcatttcaattattgttagtaggttgggtgaganaatggagccatcttcccactgccaagatccatttgttggaatgtgtactagtcccatccaatganatgactt

SEQ ID NO: 578607 - DNA, 888 bp, Homo sapiens
catgtgccagtcaccctaacggttataagtgtagcgaggccttgtgttgctgctcctgccgccgccacatgaccacctccatccgccagtatcacctcctccagctccatcaaggtgctcctccggcctgttcggtgcggctcgtcccgcacctcactgccggctgtctggcgtgcctggtgtgccggctcctgcagtgctgggatctgctggcgtgcctgggcagcaccctcgggggtagcagctactccagatgctacagcttatggctctggatggtgtgctatggcagcagctatgggggtgttagaccgggcatgcaacagactgacacggtgagaaggcacaaacaacgagaaaaaccacaaaagcacaaaccaatagcacagccacagaaggcggacacacagacagaggataaccccatgagacggacggaccagacagagagaagaagagacgccggccagacacggagcgcacgagaacacagaaagcagaaagaaagggaaaacaggacgcgaagaccaaacccagagcaggacaacaagggcaccaaacgaggaacacacagaacacaagagaccagaaaagaagacaacaacaacagagaaagaaaggcaacacaacagagagccaaacagaagaagaacaaaggcggaaagaaggacgagacagaagagaaccagaaggggggggcagggagagcggaggaaaaccacagacaaagaagagagggagaagagcagagagggagggcgcaggagggaaacaggagacagaggcgacgaaggagcggcacagcaagcaccggagggcacaggccacagagacaaaaaagagaaacgagaaagagagaaagaacaggcggaagacacggacaaaagc

SEQ ID NO: 578608 - DNA, 110 bp, Homo sapiens
ttgatctagaggctcccgatgaaatcaacaagctgtccatgctgagaatgagttggtgatgctgaagagggatgtagatgctgcctacatgagcaaggtagagagcctgg

SEQ ID NO: 578609 - DNA, 171 bp, Homo sapiens
ctgactcgccttacctttggagtagcaggaacacaacctgactggctccttctggaatgactcctttgccaggctctcactgacctatgaacgagtctttggtaccacagtgacattcacgttccttctggccaaccagctctacccagtgtcttgcccaggcactggttt

SEQ ID NO: 578610 - DNA, 1130 bp, Homo sapiens
aggtagtggcatttccgttctcaggcagcttcgaatgggaaaggtctcgaaagcttcaggaggagcagaataccagatcgcagggcggatggcgtgtaacgatctacaccgctcgtcctataccatcgaggtacccctgtttttggagaagtagaagtggtaggagggtggtgaagggacaccgaaatttgtaagaatcatcatttgtctgggaggaggggaagggatggtggttatgcagagcggtaagcgagagttaggaagaggcatgagcagcagagctctcgatggtagttcccacagcgtcaggtgaggaggtggtgagctggggtgaggcatgtggagtctgggatgattcccaccgctcgagtgaggaggtgtgagtgggggtgcagtatagagcgcagtgccgtgctgatgggggtcacaactggatgcagtgccagacgccaaagggacctgatcttgtaggggtcagttctcagccagcgtcctcccatcagcagatgacgagctccaagcgctaggaaggggctcagatgacagcggcgcaggacaaggccctcagggaactgtggcctcctgagcacccttggttccacctgtcaccatcaacatggtactccaacatggcatggcctggctgggctgtccctgtgtgtgtgtgacacacaggtgtgcacgtgcatgggcatgtgcccggggtggggaagggtgtctaatgtggcacgtgactgtctgagctcaacagctggtggatacctctccatggacccactgaacactttcacatcgctggtccttggttggtgtctaacctaacgtgggggagtattatccccctcaaggtcctggggtcggagcatgctacaggggactgacctggaggtagtcagggcaccctgtctggttccccatatgagtccttcggaggggtacccaaacttagacaggccgcgaaaacggaagagcccacccggggacagtccaaaaaggggaccccgagctgcccgacaggaggagacagcgcaagcgagagccccaataagacctgcgcgtggcgccacgggagaggagcacaccccagcaacggaggggaagacgacaacgcaaagcggcacacgatctgc

SEQ ID NO: 578611 - DNA, 525 bp, Homo sapiens
  misc_feature (14)..(14): n is a, c, g, or t
  misc_feature (92)..(92): n is a, c, g, or t
  misc_feature (121)..(121): n is a, c, g, or t
  misc_feature (125)..(126): n is a, c, g, or t
  misc_feature (129)..(131): n is a, c, g, or t
  misc_feature (139)..(139): n is a, c, g, or t
  misc_feature (151)..(151): n is a, c, g, or t
  misc_feature (161)..(161): n is a, c, g, or t
  misc_feature (165)..(166): n is a, c, g, or t
  misc_feature (173)..(173): n is a, c, g, or t
  misc_feature (176)..(178): n is a, c, g, or t
  misc_feature (189)..(189): n is a, c, g, or t
  misc_feature (198)..(198): n is a, c, g, or t
  misc_feature (205)..(205): n is a, c, g, or t
  misc_feature (223)..(224): n is a, c, g, or t
  misc_feature (310)..(310): n is a, c, g, or t
  misc_feature (315)..(315): n is a, c, g, or t
  misc_feature (332)..(332): n is a, c, g, or t
  misc_feature (341)..(341): n is a, c, g, or t
  misc_feature (405)..(405): n is a, c, g, or t
  misc_feature (421)..(421): n is a, c, g, or t
  misc_feature (423)..(423): n is a, c, g, or t
  misc_feature (476)..(476): n is a, c, g, or t
  misc_feature (490)..(490): n is a, c, g, or t
  misc_feature (496)..(496): n is a, c, g, or t
  misc_feature (502)..(502): n is a, c, g, or t
gaagctcttaaggngtatggagtgtttcttaagtccacagaagatgctcaagaaatggttaataggtaagattgaggaaacaatatgttgtnagtgacaccataacattattattatattntggnnagnnngtgttagngtgccctaaganggtgtgaganatgnnaattcanatnnnctcatacaggnactctaggnctggggnttagcaatctgtgctttnncacgtccttccagtgatttcgacacagcactagagctcagaactactagattcctttatcccatccctgtgtaatacacatgagtnatgcncagtaaatgttcttganatgtatttnattaagcctagtgggtatggactcaataatcctcaccaaaatcctgctattcttagtataaagngcaggccattcttctngncgtttgctagtctccgggtaaaggctatactaaggctaatcttagtgaaattnttttttgtggtaanagttanagaganagagttcatgatatacaaaatga

SEQ ID NO: 578612 - DNA, 528 bp, Homo sapiens
  misc_feature (65)..(65): n is a, c, g, or t
taccgagcagtggtggggttagtaggcaggcacgacggcagtggtggaccaggtgcaggagtgtngggctgcgtgtcccggcagtggaggagtgtaggagtttttggggagggtgaccctggctgggatatcttctggtatgcctccacctcaggcagttcaggcatgctccagcgcacattaacatgtacaaactcctgaaccttcttgcgaatcatagacataacatcaattctagtaaggacatgctggggagacaggccttctcgggagacaccatcagcaaaggtctcagccccgttctgcccccggctcactataaatgccgcatgagaagagagacatatgccttgaactctttctctgatttgcctcgcatgtctcttacaagccactgggtagtaaaagcatcctgaggtggcataccatatcgcataattggatagggaaaggcttttcgatgacgagcattaaaaccaagtactgtaatatgcccaccactgcctcgttgcctatcactgcctcgtg

SEQ ID NO: 578613 - DNA, 483 bp, Homo sapiens
cagctccgctcaaggagaattcagccgtaccgttcagataccacagcgtgacggatcagatcaactccccgactttattcgtcatctttaatgacacacaggcttatccaaaataccttatcacatgcaagaagatctacggttaatcacatgctttcagatcctaatgctggcatgcatttacagcaactgccaatcatgtacagttattaaactgattagagccactttaatttacagctttactgtattattatttgaaacaaaggtttgtctgtttgtgttttatttaattttattatttgattgttatgtttggaaagtgacattttcatatttagccatacgtctttattcatactatttttgttacaaatgaattaaatcataaagacactgttcgccttaatgctgtcagatacacatcattttttgaataatcattttttggctgtcaaataataaagtgaaacagcaacaaca

SEQ ID NO: 578614 - DNA, 556 bp, Homo sapiens
  misc_feature (422)..(422): n is a, c, g, or t
agtcaaggcccttggctcttataggcattgttcttttccagaagcccctacattacattcaccagtgcaacatgacaatccagcagataggcttgttgtcttccatgaagtagaagtgatggtagaagtgaatatggaaccttcatggagagtttttatactctactatcctatcacatttcttagaatataattgtctcacaagaacttactgcttaaggggaagaatatatcaaaatatatgcctgtagtatcagtgaatcccatatgtgtaggaatagcagatacatttccattttcatgtatcagaaaaatagatcaggcaaatagtataaattagacattgtgaatataccactacctggccagcttctcaggaattgtatcacccatttcatctaatgccccgtggagagccaggncagaaattgggaatgcattgaccctcaactgtggtcccagtaggtcagtgtcaggttcttgttttctaattaggcagacatgggtagggctggaaaagtggatccaaatgggatatcagagccaagggggctat

SEQ ID NO: 578615 - DNA, 235 bp, Homo sapiens
cgtcgcgacgtgtacccgagtaccctacttcaaaaatgagtaggagtatcaggaaacacgacatgtgaatatcctactcttcatgggctataccacaaagccagaactggctatggttacccgagtggtgtgagggctccagctggtatcaccatctccatatcattgagaccaaattcgagatgatcaaacttatagatattgcacgacagacggcacagggcatggattactt

SEQ ID NO: 578616 - DNA, 708 bp, Homo sapiens
gccactctaagattttgccaaaagaccaagtgcagcatcgtggacagtgcagtggagatggcccacaggtccaactctcacgaagagacaactcccttggcaccgacactgctatgaagagtggactcggaaagtgaagcgtgactagccccaccagccttcccctgtaaaaccggaaggttcatggataatgatgccgggccgcacggtatctagataatctgatgatcatcacaatgatcaattccagcatcagctcaagtgcgttcacaatgacagtctattctctgtgattgtctgactacttatgccagagagtgttttcaacaaattgactctgctgacctcgaccctcccacaggtccagactgacctccaggcctggaggctgggctgcaacgcgacctactcatgcactccaggaggggcacttaagcagcctgagtaggaagatgtgggcaacattggaggacgcaccgagaacagacacaagtgggacctgggacgcgcgttacacagaaggctggctgacatgcccagggctccactctaatctaatgtcacagccctcagaacctacatcgtactttgtatacactgccttcttatgtagtcagcttgccatccctcactcttcactagcagtctagatcattccagatacagtgggggagggcacagtctagcaacctctgagtgtggacaata

SEQ ID NO: 578617 - DNA, 662 bp, Homo sapiens
taaaagtccaaaatctttattaattctcccgggtcccgcccccgccccaggggatgcttgcaaggtcaccaggcctcaggtccagggggtccgaagcgccgacaggaagcgtgcttccgtggttctttcacaggtgtcctttccgcacctttcttgtgcgcatgtggtaaaaaagaatgtggggacagtccgcggctgtggtgtgcagatgtagacgtctcctcgtgtgacagagcgtgccctgtggacaggcgcgtggacacgtgcgttccagaagggcgcgagaaaaggcgctctcctctcacgagggcacattctcaaatgtgggatatacctctctcttctctgtgtatatacagctctcagaacctccgcggggcctgtgagacaaaaaacttcacacacagcgggtctcccctgggtgtggctgtgagccatcgtggtggcggagcagcccatagtggcagacagttgtggcgggcgtgtggggcgaagaggccacagaggaggcccgagccccaactctgtgtgccgcggtgagacgcaccgggtcttgtgcaagcgcggtgtgtgtggtcccccccggaaagttagcaacagcctttcggcacggggccacttcgccccaggaagggggttaaaaaattgcccaagagaggggg

SEQ ID NO: 578618 - DNA, 179 bp, Homo sapiens
atcgagctcggtaccatcatctccttaccgtcagcgcttctgtgctccaatttccaaacccagagcacactggatatcgatggcggttcttctaaacccaatcaatgatcaccagctaaagcgtggatatgctgtcgtgtcccacacctccatatatggagagcggctgcacttcctcc

SEQ ID NO: 578619 - DNA, 330 bp, Homo sapiens
  misc_feature (186)..(186): n is a, c, g, or t
cccccccccctttttttttcccccctaaaaaaacccgggccgggccccccccccgcctttttctttgggggggggggggggaaaaattttctccccggaaccaccattgccccttgggcccttttgggtgcccctttaaaaaaagtttgttccaaaaacccggggggggcggggcgggttttttcnggaaattttttacccccccccccccccccccggccgggacctttttttttggggcccggccggggggttttttttcccaaggtttttttttttttttggggtttttttatttgccttgttttttttatttccccccggggggga

SEQ ID NO: 578620 - DNA, 89 bp, Homo sapiens
cttcctgaaacctttgtcttaaaaatactcagctttcaatgtatcaaagatacaattaaataaaattttcaagcttctttaaaaaaaaa

SEQ ID NO: 578621 - DNA, 1017 bp, Homo sapiens
tgaatctgatgacagcaaatcatagaagaaaagagatgctgctgaccgaagcatgaaggattagccataggtcttgatcctgaacatcaataattggtgccacagacagccgttggagaatagatgtttctcatgaaatggatcgattcagatgaggcagacttggtgctggcgaaagaggcctatatgatgtgtcctcacacatcgtaattggctattttctatggaagaagcaggactaacttgcgccattcttgtcccaggaagcatgaagctcgaagtaattgtttgcacatagattctattatatattatagtattatatatcatcatcatatcacattgggctctgtcagcatctatggagtcttactatgtggtggaccagaaatcaacgtacaatccttaatgcaagaatcaacgcttcgaatatgctggtaatgaaacgtagcgtgggaaccagcttgtagagggtatcatgcatccatagcactggttagtgtgaacaacaatacataagagctatctgtagtatgcttcctttatcagaaaagaacattcgataccatggtatatcattacctcttcattaacgacacgaagtctcgtctaaatgtcgggggaccatgtccatacgtacatcatctcagtcactaactggtgttctcatgagtcctaagaccatactagattctataacgtgtcttctggagcgcagtgtgagtgtgagagtgtagtgtgtatccataacatagtcttgtaaatggtcagcgtaagaaatattcccccacatagcaagctcagaagtaacccccagttgtgagattcaatactgcaagaaagaacaaatagtatccttcgggctaactacaaagtaccgaaacgacctacgtggacaatcgtacctccaaacacacgaaacgaactacaggccaaatgagcgagcaatgaaaatcaacacaagaaaggaaccaacagcacccagaaacaacggttgcacacacaacaacacaagca

SEQ ID NO: 578622 - DNA, 457 bp, Homo sapiens
  misc_feature (32)..(32): n is a, c, g, or t
  misc_feature (53)..(53): n is a, c, g, or t
  misc_feature (67)..(67): n is a, c, g, or t
tgaggaccgatgcattgtcttcaactgaaggnacttagcattacgtaatcatnatactgcccatgcnagaatccttctattacatctctgacaaatcacatagtctccacttggatacaaggtctgacagggactcattactttggtataatgtctaatttattaatggacagctttaactgtgaagaaatgcttttctaaactaaaacaaaagctatcaccagcctcacaccccaactataactttcacataccggttttgattctgttctccaggacaataaaatctacttcccaaggatgatggaattttcatgcaaaattgttagacaaagcatttctttacataaacatttgttgtagatcagcatcatgatgttgttatgagccaaacagtggccttattttacaaaatcctgtcttatatcagtacttgcttgtacctatattcattcat

SEQ ID NO: 578623 - DNA, 1442 bp, Homo sapiens
actgcattccaagaagtgccgattatacccacatattgttgcgcatcctaataattcagacaccagtatttgaagtatctgtactcgctaattactggcacatgtaatgctcgtgcctgtgcgcatagtccccttatggatgtagtaaagtaggcttccttctaggaaacttgtacgatatggaccaattgcggaggttttccttacgtcagatcatagctacatcacattggtagactcctagtattgagaaatctctgtagagtatactagataatgaataactttgccttataaattgtcctacccatatagattgttgaggaggaattagctgacaatcgtggaaactaattatattcctctttcgatggtgccatgcgtgcgttaggatttgacgcagatgctgtttcaactattaagcctaatttctcaggcctccttaggctttggggaacatctttttcccattttacttagttgatcccttttggggttgtgaattcgagtcccccaatgggttgaaaagaagctctacaaaagactacttttccattacggcaagtacacatcaacgtgtggatcacaattttttcaatagcaaggttccacgcctattgtttctccgttaaggaacctataccttctacaagtcttgactatggaaaacagtccatcccctcatgatttgacattttacccctataatctaattagtgggatgcattgtgttcccgccgcactctttaacttgtggtgaggaacttatagttccttacaagacgtaattaaggaccccaaggtttaatccttttgaaatttgttcccctcatgggtggaaaccttcggcgggggacgtgcgcagttactttctacttttttcaacacaaccaacaaacattggctgcgttgacaatcttgtcgggaaggataatcaccgaaaaattgtccaagaccaaggtgattaactccttttcccaaagagatgaagtgaaacaaccgcagttgcgctttcaaccctcatccaacgttgtgtacaccccaggacacaggttttgtgtggtcacaaccatttaaagcacagttttttgtgctgaacgaggaacatgacaaccgcttcgggcgtcaggtgcttccacctctgttcagacagttggaagcacttttagttgtgagaccccagcaacattttacctggacgcttccccaacgtttgggtgggaaaccaacttggctctcaatccacagaagtgtaaaccctcaagcgggacagatcatttcatttcgtcgcggcaaacaacaacagtcttggtcaacaccattatttgtgttccaccagctgatttttggcgtgacgctaagacacgtttacgcaatcatttgtttggcccaacaaggttccactctatttgattctgccccaaaagtacctgggacatcaa

SEQ ID NO: 578624 - DNA, 2267 bp, Homo sapiens
  misc_feature (277)..(277): n is a, c, g, or t
  misc_feature (1024)..(1024): n is a, c, g, or t
  misc_feature (1098)..(1098): n is a, c, g, or t
  misc_feature (1170)..(1170): n is a, c, g, or t
  misc_feature (1228)..(1228): n is a, c, g, or t
  misc_feature (1254)..(1254): n is a, c, g, or t
  misc_feature (1334)..(1334): n is a, c, g, or t
  misc_feature (1369)..(1369): n is a, c, g, or t
  misc_feature (1441)..(1441): n is a, c, g, or t
  misc_feature (1564)..(1564): n is a, c, g, or t
  misc_feature (1761)..(1761): n is a, c, g, or t
  misc_feature (1856)..(1856): n is a, c, g, or t
gtcttgcgtgtatcagacagagtattgcgtaaagtatagcctatgcagtactctgattagcagttaccctaggattagtaccttacaataagatgcgagaagactttgcgcgttgtaatacttaccacaaacttagttgcgcatacagagagagtgactagctgtaggtgcccccctggactgtcctacatacctgcagtgggcgcctggcgaagctagaccgtactgtcctgccgtgtgtcctaggcacacgatcacgtctattgtcgtctatgcntccataggtacttagagcggcatgtctaggaattcattgcttcgtcactttggatggcgcgattcaatggagtagtgtatgtcgagtacactttgtgattgtcaacgtaggagggggactgaaggaagtaaaaaaagccgagattcgaccgtaatagtatacccttggggagggaaggtaatgctttgagagacattgtagaagttgaactcgaggggcaccggtgttgtggtgccgtatgggttggttgacgcattgtgagggggatgtagggaggcttgtggggggaattgtgaggtcgcgtagggtgagacgcgtttcatgaggggcagatgattggcttgtggccagtatagattagaacttcggaatgtagaatctatcgtctaggtagttgctattttgtaggttggtaggccattataagaaagcgagggggagaagcaaattagttcttttagcacttaacaacatataggggattgaagaagaagagttctcggcctcaatgggagaacaccaccgccgataagagaagacagagggctttgagggcgaacgcgaagatgtgtgcattgttgccgtccgtgactaacatgatgagaaacatgaccatggcaagacgacaagaagagagcgttgaaagttgaaggcgagggtggagggaacatagagacaacgatggaggtgggcgatggcaatacggcgctagtgaaggcattgatggacatatttggtggcgacggnacgttggaaacgattgtggagcgtgttggcacgtgtaaggacgtgaaattgagtagggcgacattatgttgaanaatgaaggcagacgtgtctgtttaggacaatcccagagcgtggaagagggtaagagggcaaatgagatactnatgaagcttatgtataacgaagctattaatatttgccgatggatagctgcgcacagancaagatgggttcatctcttccaaaantctgtgtttgtgctcaaacaccctcacacgttccatatatattccaagtgattcgtttatggagacgccactttactatnactcacgagagctagagaggagagacacacaagcnctatctttttcaatgtgctcacatgatggatacacattctcgagatagtagagcacctatgttggtctctcnaatacaaaaaattcccgacgaaacatcgttacacagcttggagaagattgtccggcgcagatgtttagggcagtctaatccatgttagagagtaaaccggaagagagaggtatatgagcgganggcagataaacggcagttcagagtggttgtaagtgaaccgtccctctgtggaggaagagctgatgagcagggttataaacgagggtgaaagcggacacgaataatattcatcaacttttctgttggtgagcgcaaacagacaaagccaaacgcactttgaggtggggaacagacacatgcgattagcataaatgtangagaaagacagagagtaagaagagccagcacgggcgagtcaaaattattagaagcacacatcaggaccgcgaggggcgcggggggagaccatacnccactaggaagtatacacccacaccagtggcatgggtggcgatagacaaatgaatatggaggacgatactacaaaccatagtagagcttatgttgtaaaataaggaggggggtgatcacagaagagagatttgcacatttaaaatgaaacatgaagagtggtggtgaggcgacatagtttataatatgaagcagaacatttgggttgagcgcccaagcacaataaaacgtgcgagtggagagtagaaagaaagaaagacaaacaatgcgagggggaagacaacaagagcgcaagaacggagaggagtgccatgtcattgtcatggaggatgacaaacaaagcagtctagttgtgtagtaacaagatcttgttaggttgataaatatggacgaaggataaaagaagaacagg

SEQ ID NO: 578625 - DNA, 131 bp, Homo sapiens
ggagacccataatgagtttccccgggaacaagtaattcagaggtgttggaatcacaaaaatgggtagcataccaggatgatccctgaacacgagcagtatgtaccaggagactttggccccaggattccaa

SEQ ID NO: 578626 - DNA, 144 bp, Homo sapiens
  misc_feature (135)..(135): n is a, c, g, or t
tgcccataagctgtataccaagataacaatataggccaggtgcagtggctcacacctgtaatccagcacttttgggaggctgaggcttgggccaggaggttgagaccagcctggtgcaacatgtgcaggcccctngtcgctacc

SEQ ID NO: 578627 - DNA, 146 bp, Homo sapiens
tgtctcttttacatcaactgacgtggtatattactttgctagaatccagtaaatcatattatggtagctctggctgtgctattcagtaaaaagatgaaagcaacacgttgattttttttaggtctactatatgatttgaacgcgga

SEQ ID NO: 578628 - DNA, 750 bp, Homo sapiens
  misc_feature (99)..(100): n is a, c, g, or t
  misc_feature (102)..(103): n is a, c, g, or t
  misc_feature (348)..(348): n is a, c, g, or t
  misc_feature (632)..(633): n is a, c, g, or t
  misc_feature (640)..(640): n is a, c, g, or t
agcgggcctgcgccccggcggtggacgggcccggtcgtgggcggggattggggcggagcctgaccgttacgcgcagccccgcccccgcggcctcgtcgnncnngctgaggcggtagccgcttttcgtcgactcttaccggttggctgggccagctgcgccgcggctcacagctgacgatgggggaccccagcaagcaggacatcttgaccatcttcaagcgcctccgctcggtgcccactaacaaggtgtgttttgattgtggtgccaaaaatcccagctgggcaagcataacctatggagtgttcctttgcattgattgctcagggtcccaccggtcacttggtgtncacttgagtttcatatcgatctacagagttggattccaactggtcatggtttcagttgcgatgcatgcaagtcggaggaaacgctagtgcatcttccttttttcatcaacatgggtgttccaccaatgacaccaatgccaagtacaacagtcgtgctgctcagctctatagggagaaaatcaaatcgctcgacctctcaagcaacacggaagcatggcactgatctgtggcttgatagttgtgtggttccaccttagtcccctccacgcaaaggaggaagattnntcttgcntctcacgtttctcctgaggtgagtgacacagcgtgggcatcagcaatagcagaagcgatcttcttgaacatcaaggcctgtggaaaccactttggaaaataatgaaggtg

SEQ ID NO: 578629 - DNA, 229 bp, Homo sapiens
  misc_feature (61)..(61): n is a, c, g, or t
  misc_feature (63)..(63): n is a, c, g, or t
ctcagtactcactcttcttgcttaggctctctgtgtgttgaaaaccatcccgttttgcatntnttttgacaattttctgtgaaactttcaaattatgtttgagaagaagtggaaagttttccttctgacctcatttccttcttgatcagtggacactaacattttggggacaacttaatcaattggttttccttaccccccaataaagtaaaatgtaccccaccccaaa

SEQ ID NO: 578630 - DNA, 346 bp, Homo sapiens
tggtattgtccatctagtagattcagtgggggtctgcagaggaagatgagtgcctgttgtgcctctcccagtggctcagtcattgacagctctgctgtgcctcagcctgcacattctggagtgcccgaaggtttgcccaggatgtcatcagcaccattggccagcgcttcgagttgcgcttcaaacaatacctcaggaacccacccaaactggtcacccctcatgacaggtgagccaggtggggagagtgtggagcagctcttggattaggattaggacaggagggcttgttcttcctacacttgagttgagaggttcagggagggaataacctgtgtgcctctgt

SEQ ID NO: 578631 - DNA, 779 bp, Homo sapiens
  misc_feature (99)..(100): n is a, c, g, or t
  misc_feature (102)..(103): n is a, c, g, or t
  misc_feature (348)..(348): n is a, c, g, or t
  misc_feature (661)..(662): n is a, c, g, or t
  misc_feature (669)..(669): n is a, c, g, or t
agcgggcctgcgccccggcggtggacgggcccggtcgtgggcggggattggggcggagcctgaccgttacgcgcagccccgcccccgcggcctcgtcgnncnngctgaggcggtagccgcttttcgtcgactcttaccggttggctgggccagctgcgccgcggctcacagctgacgatgggggaccccagcaagcaggacatcttgaccatcttcaagcgcctccgctcggtgcccactaacaaggtgtgttttgattgtggtgccaaaaatcccagctgggcaagcataacctatggagtgttcctttgcattgattgctcagggtcccaccggtcacttggtgtncacttgagtttctcatctccgcaacttccctttaaccaaaggcaaagcttcgcgactttcccaaactgggctcaatggtttcagttgcgatgcatgcaagtcggaggaaacgctagtgcatcttccttttttcatcaacatgggtgttccaccaatgacaccaatgccaagtacaacagtcgtgctgctcagctctatagggagaaaatcaaatcgctcgacctctcaagcaacacggaagcatggcactgatctgtggcttgatagttgtgtggttccaccttagtcccctccacgcaaaggaggaagattnntcttgcntctcacgtttctcctgaggtgagtgacacagcgtgggcatcagcaatagcagaagcgatcttcttgaacatcaaggcctgtggaaaccactttggaaaataatgaaggtg

SEQ ID NO: 578632 - DNA, 389 bp, Homo sapiens
ttaccctcctggacaaaccagtgtctccttatggtcagccttacagcatttctctacaaaagttgcgaattcatccatacacagctttcagttgctctttggttcgccttgggcttgtgtttcacaagctcaacaagtccagtttgtttcttgattgtgtctctccttctcagaaagtgtgcatatatgcgcatgaaaggtaagtgtttcagcattaacctctttggaaaggtatgtttcatcgacttccagagttgaaaagcatgttcgctgtgttcccagagtattctgtacacgcatttggtgtctctgtcactcagtggcgttttctcatgccacacacatatgtggctcaggcccgcatatatagagtccgcgtgccgtatcct

SEQ ID NO: 578633 - DNA, 369 bp, Homo sapiens
ccatatttaaccgtgtttgggactccgtgttttcaatggtttgttagttgccattacaactttgtttgggtaaagtttttgagtttttgcagttcagtatccctctgtctattcacccttcgtgttagtggtaactcagtttgtcttttaatagttacacaaagggaacgtccatttgttaatgcttttttgaaatgagttaaaccagctttttgtattttaaagctttagtgtttcagttttataaatgaaaattttattttaaaaaccagtgggaaaaagtggggggtttctttttatgtttgggtcattcaggcagtacattttaattaagctgaatgtagacaaataaaaaaaaaccaaacttga

SEQ ID NO: 578634 - DNA, 844 bp, Homo sapiens
  misc_feature (86)..(86): n is a, c, g, or t
  misc_feature (104)..(104): n is a, c, g, or t
agcggctctcaaaatgtccatgtgaataataaatgatacgaccaccataattatgggatctcagccacctgaagggtggggaaatnttaataaatgtaacattnacacactacagaaaacatgtctggctccctacaaatcatttaagtctggcccagtcttctccaccactcgttcatactcaccttatttctccatgagttccttaattagctgcaagcaagctcatcctcaggtcttccttatccttccactccaacatccacacatcatcccaaaatgtcctcactgctgtgcttgaagttttacattttatttccactgattagatatttttcttcctagccacatctcaatcgtggtttatgaatcaggccaacatcctcaaaaatgctgtccatgagcaccctgcctcattctgttcactctcctgttaacactccgtcaattcttgtggtcactttattcaataataatagacagtttatttgcacatttctagttctgcaaagagatattctgcctcccttggtgaggtccttaaaagcaaaagcccattttctaattcttttgtattgtccaaagcaactattgttctgcccatggcagggtctataaatgctgattagatcacctacagtgggaaaggcagcaaaagacaaaactttttcataacaggcaatatgtcaggattatagataataccttgtgggacagatgactctctctcaaattatttgagtcccatagagctctattaaaaactctcaaagaataaacatgcgtcaaagtacagtgaatccaggtagtgttggaaagggtcaataagatataaactagggaa

SEQ ID NO: 578635 - DNA, 402 bp, Homo sapiens
  misc_feature (260)..(260): n is a, c, g, or t
  misc_feature (322)..(322): n is a, c, g, or t
  misc_feature (375)..(375): n is a, c, g, or t
ctcattgagtctaggagtttgagaccagctggggcatagtaagatcctatctctaaaaaaaaaaaaaaaattatctggacatggaagtgcgcgactgtagctccggccactcaggaggctgaggtgggaggaccgctcaagcccaggaattgaggctgcaataagccaagactgtgccacaacactccagcctgggcgacagagcaagaccctgtctcaaaaaaccccccccaaaaaaaaaggacaccataaacagtcangccagagttagagaagatatttgcaatacacgttatggataatatcaagactatacaaaganttattagattaataagaaaaaatctggtagctcacgcctataatcccaacttngggaggctgaggccagcagatcgcttg

SEQ ID NO: 578636 - DNA, 103 bp, Homo sapiens
gaatgttacgctataactcttaggctatgcatagccccatgtctaatcaggcattcactgatccagcaggtctccaaggtgaacagcctctggcatgttggaa

SEQ ID NO: 578637 - DNA, 166 bp, Homo sapiens
ggaatttaaagccagtataccaaccctgattcaacgggtaagcgagcagcctagaaagtcaaacccttagttgcttttctctagggattcgccgccatctctgagagatatggtgtgtgctgccaggctctacgtgtacagtcaggtaatgtgggttcgagtagca

SEQ ID NO: 578638 - DNA, 1058 bp, Homo sapiens
taaagaaccctcatcaatagatggagacatacagaaatagtcaaaccacatctacaaaaggccagtatcagggcgggggcttcgaagcccaaaggtgagtgtttgtggatgtggtaaaggtgaaatattagtggggggatgaagcagataggtgaggaaagtttgacccaataagtgacggtgaagctccggggaagccgtggtggctacaaaaaatgtggttgagcccgataaatgccggtcggaaaatgtgggtaaagggagaactcgaaagttactcgtggagggctgtggtaggagagggtaaaattagaagaacccagttaaaagtggggtaaataagcaggtgctgtgaattatgtggggttcacgaggtgtggtattctcttattatagaacttatgtgggtgagccctcaggggtgagtgtgatatacctccgtgagagtgcgaaagataaatacggagtgtgtgtttaaggaaggtgggaacttctcataggggaatttatagccgggggggtagtgccgtgtgtggggggcccagtgtggcccccctccaaagtggggagggaatagggggcatagagcgtgggaggggggctaaacaagggcctccagaaaaaaactccgggcgaaaagaacaaacaacacgttcgtggaggggtaataacagtgagggaattatccccggataatcagaaaaggcgctttgtgggcaccaggggggcgttgctgttggggtgggcctgtggaatatgggtgcttaccctcgggggtcaaccatcggggccccacccaatggggcaatatgggcacaggggggggtgggaaaaagaaaggcccctaaaatataaaggaggcggaatggggaggcgggacggttgcaacctcacagtggggtaggggcggaggagcccaatagagagggggtgaaagaggcccccggtaaggggcacaggggcggggatacaccatatgacaccggctgtgaataagaacaagacctgggggaagaatccgggacaccaagaacacttatccacccggagggcacaaa

SEQ ID NO: 578639 - DNA, 815 bp, Homo sapiens
  misc_feature (51)..(51): n is a, c, g, or t
  misc_feature (328)..(328): n is a, c, g, or t
  misc_feature (346)..(346): n is a, c, g, or t
  misc_feature (348)..(350): n is a, c, g, or t
  misc_feature (353)..(353): n is a, c, g, or t
  misc_feature (374)..(378): n is a, c, g, or t
  misc_feature (380)..(380): n is a, c, g, or t
  misc_feature (383)..(383): n is a, c, g, or t
ggcatctgcccctcctcaagagcaaaagcaaatgttgggtgaacggctgtntcctcttattcaagccatgcaccctactcttgctggtaaaatcactggcctgtggttgacatggataattcagaacttcttcatatgctcgagtctccagagtcactccgttctaaggttgatgaagctgtacgctgtactacaagcccaccaagctaaagaggctgcccagaaagcagttaacagtgccaccggtgttccaactgtttaaaattgaatcagggaccatgaaaagaaacttgtgcttcaccgaagaaaaatatctaaacatcgaatnacttaaatattatggaanannnacnttgcaaaatataaaataaatnnnnnanggnaaggaaactttgaaccttatgtaccgagcaaatgccaggtctagcaaacataatgctagtcctagattacttattgatttaaaaacaaaaaaacacaaaaaaattgtacaatatacaccaaattatgttttatagaccctggaaaaagaattttcagcaacgtacaacccatttaaagcattcctttcttaaatttggtaattcttactgtggatagctcagatgtcagttctgttaagtacagacttgtactgagcagaaacgtacttggtttaaatctgctaataaaatctaacgcaaaaaaaaaaaaaaattttgggcctccccgaatttcaacctttgggcggccgagaaaaaaagcagcgtcagaaccggcgacgggggtccaaaccgggcggtgcaccaggtcgtctgtcagcgccccaccccgga

SEQ ID NO: 578640 - DNA, 531 bp, Homo sapiens
  misc_feature (51)..(51): n is a, c, g, or t
  misc_feature (328)..(328): n is a, c, g, or t
  misc_feature (346)..(346): n is a, c, g, or t
  misc_feature (348)..(350): n is a, c, g, or t
  misc_feature (353)..(353): n is a, c, g, or t
  misc_feature (374)..(378): n is a, c, g, or t
  misc_feature (380)..(380): n is a, c, g, or t
  misc_feature (383)..(383): n is a, c, g, or t
ggcatctgcccctcctcaagagcaaaagcaaatgttgggtgaacggctgtntcctcttattcaagccatgcaccctactcttgctggtaaaatcactggcctgtggttgacatggataattcagaacttcttcatatgctcgagtctccagagtcactccgttctaaggttgatgaagctgtacgctgtactacaagcccaccaagctaaagaggctgcccagaaagcagttaacagtgccaccggtgttccaactgtttaaaattgaatcagggaccatgaaaagaaacttgtgcttcaccgaagaaaaatatctaaacatcgaatnacttaaatattatggaanannnacnttgcaaaatataaaataaatnnnnnanggnaaggaaactttgaaccttatgtaccgagcaaatgccaggtctagcaaacataatgctagtcctagattacttattgatttaaagtttcctttccttttttttatttattttatattttgcaatgttttttttccataatatttaagtt

SEQ ID NO: 578641 - DNA, 1474 bp, Homo sapiens
  misc_feature (369)..(369): n is a, c, g, or t
  misc_feature (378)..(378): n is a, c, g, or t
gccgccatcttccagttaattcgccaacaatgacataacacaaagggaaacgaggagaggcacccgatcatactgttctctagcgccttcttagcatacacacactgggagttgcttccctcttggcgcacgacttactagtgcgaactctagtaagacagagcgtgcactattggtcatgacagtcatagggtacatggggttagctgtgtcagaaaaaggagatgaccccagcaagcgtcgttatccagatggcatagacaccgtgggaataactgtcgtaccacagtggttgaccccagtgcacttgctgagtattggcacttagtgtgagtacatagcaaaacacaccgttgaagcggagcacancgacttccntttgcccaagcgaagacacttacactgtcgcagtcatttgaagccacatttacaagccacgtcctgaagcagccagcagcattagcattcgcttggaaaaccgttgttgaaagcgtagacaattggatcatagcacataacacaggaacagaaagcccatcagagcacgtacaagcgctcacactcggagattccaagctcaaatatgccgccgagcctagactgcccaaccacacgagcaagcaacaactttctggtcgaagaaccgacatggggaaggtgacgcctggatgcgtcgctgggagagcctaatctcgcctcatggacctctgcatcggcataccataagggtcgtataaacgcaagcagacacagaggtcccataggggcagccttcttagcgaggctcacaaaacatcaagccacagattgacgcacgaaccctgtcggcagcgcacttaacaagagccaaacggggacatgagaagacaaagagaaggccaagaacaccatcgagcacatacgcacaagtaacagaccggaccaccaagagacaccccggggaagctatcgacacgcccagcaaagagtgaggggacacccacatgtccacgaacaccatacacgagaacgaaggtggacagccagaccgaacaatacccgccgggacgcgccaaggactcaacctccctgcgacatcaaggaaagcatacgagagaagacaggaaccagcaacttgaacaaatacccaagaaagctgagccacgccaaggtcagggcagtgacggcacggctggccaagaaacccaaagcagaaaacccacagcaccacaccccactaccaaaaaagaaactaccaccaaaaacaatacagggagagccagcacacagtgccaagacaagaatgcagcacaaacccaaagaaaaaaagccacaaaagagacgcaaacgagacacagaaaagaccaacagaaacagcagagcggaacaacagacccgcgacagagacattagccacagaaaacctgaagcagacacccagaacgcgaaagacaaaaacaccaaaagcaagacaagcagaagaagaaaaagaacg

SEQ ID NO: 578642 - DNA, 202 bp, Homo sapiens
actgaacgcctacagcaccggtattcccaggcggtctcccatccaatgtactaaccaggccctgacactgctttgcttcctgagatcatggcttcatgtgcctggcctggcttcatgtgcctgaccatggcttcatgtgccgtgaccagtgcttcatgtgcctggtggtacctgagctctgaattctgtaatcagtggtcag

SEQ ID NO: 578643 - DNA, 468 bp, Homo sapiens
cccccatcgcctgtagtaaggacagagagctgtaagactgcctccggtactgcttgtgaacgtgctaagcgtaccctctctgggaggagccaggccagtattgagatcgattctctctatgaaggaatcgacttctatacctccattcaccgtggccgatttgaagaactgaatgctgaactgttccgtgggcacctgggaccaggcagagaaagcccttcgagatgccaaactagacaagtcacagattcatgatcattgtcctggttgggggttctcactcggtatcccaagatacagaagcttctccaagacttcttcaatggcaaagcaatgaataagcagcatcaaacctgatgcagctgttgcttatggtgcagctgtccaggcagccatcttgtctggagacaagtctgcgaatggtcaagcattgcagatcatggatgtcactcctctttcccttggtat

SEQ ID NO: 578644 - DNA, 115 bp, Homo sapiens
aggtagtgcctagtgattgagcgttgaccagtgtgtgtcgagttagggaggggggtacatagtacaagagcgatggtaagagctaaggtcggggcggtggggtgcggatggaagc

SEQ ID NO: 578645 - DNA, 622 bp, Homo sapiens
agcggggtatcaggtgcctgcgcccgcggcggcggaggcgcacgcggtggcgagtggatatctccggacatgagataatgtagacagttggcaatgcagtgatgtcgactctttgcccacctgccatctccagcatgttgccaatgacgagcagattgcgttaagtggcgaaatcatgctttattatggccgctactttttgcttacttgaggacaatgagttctgtggtccctagacgtaacgcgcacagtaaaggggctccggaatgacattgagatcacttgtaactgtctcaatgtgactgggaggaaaagtaaccttattacatattgcccagatgccagcgaccttctaagactggatgaaactccgttactgaaagttgcatgacctgacgtgcgtagctatacggaatgctagcacggctcctctcgcgctcatttgctctttgaatacatgggtgagcgtgaactataacttgggtagccattaacctctctgcactgcgaacagcatgggaagttggggcgcagtctgcgagctcgccattattggtacctatcaaatctactacgccttaccagcgcacacgctgaaacctgaatactcttcttccttccg

SEQ ID NO: 578646 - DNA, 958 bp, Homo sapiens
cccacgcgtccgcggacgcgtgggctgtgataccaatcttgagggtccctatctagttttagcagtcagtgacttctcttgtaaatgttgttggtcttgaacaaagtaacaaggcgtctcattaattggcatatagaaggttgcattcttgcaaagttttatgaccaaatgtacattagagcgtgacagcaaggcatacaagatatttgatcatcgttaagaatccacagggtttgcaaaggcttgacaagcgacaggtatttggccacttgcaggctacagtgggagatgatgaaggcgacagctgccattcctctacgggcaggataaatttgcaatcatgtcaacgacatgatggctccattgaggacccacgtggcacgctgtgccgtgcgcctgttccaaaagtcaggaaatgtccccgtatagggcaatgtgagacacaggatgacgcgccccgtggaaagtgtacaatcgtctagagttcacgcggacctgtccattaaccgtcacctatcatgcacatcagaaagcttacttgctcccaccaaggggatggccacgggcaagggggactgtgtcacgacccactaagagcaggtgtgtagagaaaccagtaggcgataagaacaagctggttaccagtccacgtgcccgacacaacacgtaaggacaacacgcggaaagctgacaagtagcaacgcatggggcgtacgtcggaaactgcaatgccgttccggtataggaacaaggatcactagacgcatcgagagcgacatactgacggacgacgaaaacgtagaaggaagcccaccgtcgggtggacccgaaacacacagaaaaatgtcatggggaccacaggggaccaaaatgaagagacaaacaagaaaagagcgaccctgcggggacgacaatacaacagccagtagaacaaccgcaccccacaggccccagcccg

SEQ ID NO: 578647 - DNA, 654 bp, Homo sapiens
gactcccagtgaggcaagaccgaagtaaactacactcagctcgtcgacctgcacgcccgatacgctgagtgtggttgcgtgatcctggccttacccgtgtaaccagttcgggaagcaggagccagggagtaacgaagagatcaaagagttcgccgcgggctacaactgtcaaattctgatatgttacagcaagatctgcgtgaacggggacgactgcccaccctgctgatggaagtggatgaagatccaacccaagggcaatgggcatcctgggaaatgccatcaatgtgtgaacattacaccaagttcctcatctgacaagaactggctgctgtggtgaagcgctactggacccatggaggagcccctggtgatagagaaggacctgacccaatataactaagctaccacaaagtgtgatggacccgaacacgaaggcacaccatgacacccacagccacaatgaaagcacaaaacaccaacggacaactcatagaacgagcactgcactggcaaagaaacctgaatgggtgcggagcaagacaccagaaaaaacacaagcgaagaaccccgaccggagagaaggtccccaaaggcactgcaggaacatatgaaaacggaagcacaacacaccaagagcatacacattgtagg

SEQ ID NO: 578648 - DNA, 387 bp, Homo sapiens
acggtcttgctgactgagaccaggttcggctctcggactctgtcagtcctatacggcgcacgtggcagggctgaggtggtgcgtcgcgtcgctgcgtgctgtgagctgagcaattcaccaggtcgctgttgtctccccttgggcaccagagcttccagtttgacgaggacgacggtgacggggaggatgaggaagacggtgatgatgaggaagacgtggatgaagatgcccatgattcagaggccaaagtggcgagcctgagaggaatggagttacaggggtgcgccagcactcaggttgaatcagaaaataaccaacgaagaacagaaacaggtgcgcttaccagaaagccggctgacaccatggcaggtgtggtttattggcaaa

SEQ ID NO: 578649 - DNA, 369 bp, Homo sapiens
  misc_feature (293)..(293): n is a, c, g, or t
  misc_feature (299)..(299): n is a, c, g, or t
aactacaaaaattaggcaggcacagtggcaggggctataatcccagctattcgggaggctgaggcaggcaggagaatcgcttgaacccaggcggcagaggttgcagtgagctgagatcgtgccactgcactccagcctgagagacagagtgagaccccgtctcaaaaaaataataatagtaataagaaaaataaaatcttatgtgcctgcttaccagggaaattgctcgtgagaacattaaagcccactcccaaaagcaaactgcttgagtgggattgaagctccaatccaantatccnttaattcccttgttggcctttccgggcctttttgggtgaacccaggaggagttttttaaactttttggct

SEQ ID NO: 578650 - DNA, 90 bp, Homo sapiens
  misc_feature (21)..(21): n is a, c, g, or t
ttacgcccaagcttggcacgnagggacacctccaggcctccgccgtggttggttcactagccgtctagagctgtatagcctgcagcacag

SEQ ID NO: 578651 - DNA, 138 bp, Homo sapiens
ttaccatttattctactcttaagctgtattaggttatgaaaataaaatatctccactttacgtcagatagtgggcaatcatatgtattcattctacttaaatagtattgtcttgccttcctaaacgtgtggctagcac

SEQ ID NO: 578652 - DNA, 219 bp, Homo sapiens
  misc_feature (35)..(35): n is a, c, g, or t
  misc_feature (78)..(78): n is a, c, g, or t
  misc_feature (119)..(119): n is a, c, g, or t
  misc_feature (149)..(150): n is a, c, g, or t
  misc_feature (167)..(167): n is a, c, g, or t
  misc_feature (193)..(193): n is a, c, g, or t
ggttcccgacgaacgttacgaacggccaccttggncttttccatttccgccttcacgtatttaaccagttccttacgncggtcttcggtcagttgcggaaccaccagccgaatcgtttncccgtcgttttgcggcgtcaagcacggttnngattcgtaaatcgcccnttcgatgtccttctaaggtcgtcttntcgtacggcgagatacacgttggcgg

SEQ ID NO: 578653 - DNA, 125 bp, Homo sapiens
  misc_feature (18)..(19): n is a, c, g, or t
gtcccacagacatctggnngctttggagttgggagctcaggattgtgcgaagtctaggcagagctatcacccaatcttcagggtggctgctggattacagctgtgcccagaagaggcttatgctt

SEQ ID NO: 578654 - DNA, 166 bp, Homo sapiens
tcagcagaaacagcaatgttaaggttaagttcaagaccagacaagaagagcagtcacagagaatttaaaatgaagagaaaggggaagaaatggacatgagagacttatctaaagcctgattcacagacacttggacaactaactgcaacataggtggaaagaagga

SEQ ID NO: 578655 - DNA, 412 bp, Homo sapiens
ctgaaaccagaaggcctgagcaatatgccccgtccccaaaagatgacacagaggctggaaggggcagtgcaggggctgaccaccctgctcatgaaaggagggtccagctggacttcctgggtcgagtaggggttcagcaagctgtgaaacactcatttcctgcatcaggacttacttcggtcctggatgaagagtactgaagatacatgcctaaaatattcctaacaccaggattggtgcatgtgtttccttccccaagaaagctataaacagcaaaaattctgctgtaagcttccctgtgtcctctctccctctcttccttccccctcccctaaaactaaaaggcatgttaaaagaccctttttctgtgaccagcggaccttatctatgctcccaattccaattccttgtg

SEQ ID NO: 578656 - DNA, 240 bp, Homo sapiens
tccccccccctttttttttaaaaattggggggcccttccccaaaagtttttggggaaaagggtttagggccccaaaaaaagggccaaaacccgggttgaaaaccccccctttccaacccccccccccaatatataactgtttttcccttgggaaggggggttggggggggcttttttatttttccaaggtttttttttaaaaaaagggccattttggcccccccccctttttaattttga

SEQ ID NO: 578657 - DNA, 1272 bp, Homo sapiens
  misc_feature (72)..(72): n is a, c, g, or t
  misc_feature (163)..(163): n is a, c, g, or t
  misc_feature (205)..(205): n is a, c, g, or t
  misc_feature (236)..(236): n is a, c, g, or t
  misc_feature (383)..(383): n is a, c, g, or t
  misc_feature (388)..(388): n is a, c, g, or t
  misc_feature (433)..(433): n is a, c, g, or t
  misc_feature (446)..(446): n is a, c, g, or t
  misc_feature (536)..(536): n is a, c, g, or t
  misc_feature (539)..(539): n is a, c, g, or t
  misc_feature (759)..(759): n is a, c, g, or t
  misc_feature (855)..(855): n is a, c, g, or t
  misc_feature (860)..(860): n is a, c, g, or t
  misc_feature (913)..(913): n is a, c, g, or t
  misc_feature (975)..(975): n is a, c, g, or t
  misc_feature (1128)..(1128): n is a, c, g, or t
  misc_feature (1272)..(1272): n is a, c, g, or t
gtgggacccttggtgggtgtgggtcgactgttgggtggcggtgtctctggtactctattcatacacacattntaatgatgttatttatttaatctctatacctgtaagtcgtatctaatagtagaatgtcgcagtgatttctggaattcgaacagtaagaccnccccgactggcgtggagtgagtcgctcggtgcgtcgccgacntcgtgctcagcgggtctggttgcacatatgnccgatccagactctcgccgcttggctgtctcgctgaggacgctccgccacctctgacgagtagatgctgctcacggtcgcgtgtgagagtcagcgttgctgtctgttagtgcgtcgcactcctcctataatgcacgcgtcgtagcancacgntcagacgtgcaaggttgatattgtgttattccgtttattagccgncttctgctagctntataggatgtaatagtgagcggttggtatatgttgtaatgagatggagtagagagtacaggatagtatagtgtagagagcaagcggaganagnagagcaggatgaggtgcatctagtcgacgtaacacagtatagaacagccaactacatacaacgagtacgatctgaatgatgaaggtacacacaagtaaacacaagctgcagatagtcacatacgcacaacatagtgctcgagaacttcttgttattatgcatatcagtgtattttagtgaagagttgacggtgtgttgcccttgcgcgtgatgtacgcanagtgagtcgatgcccgtggcagaggtggtgcgtgtggggagagcgtgcagagcctgcacagcacgcgttggtggagcggtgacagcatacgtgatncgtgntgcgcctctctcggacgcggcatgttctggcggcgaactgctcgtcgatgaantcgtatcctgtcaatgtgccaagactagccatagtaaacgtaaatatgataagctacaagangatcatatattcatactggtgttatacggtacgttcgcggctgtaacggagtgtagtagagctatgtcggcatgcgagtgcaacgacgtggtaaatgcgggtctgtcgtgtgtcgcgcgatgcgaggtcgattgtgcagataatgactggtgncatatatgcagcatagcggcactatgcgtagacagtgatgatgatgacgcagcatatagacgcgagagcatatcaagcaatcatcgtagagcgcgagacgacgatgatataaagcgtacgatgagcgtcgcatcgcgtgacatn

SEQ ID NO: 578658 - DNA, 100 bp, Homo sapiens
gggtgctaacgacggactccccccctcttctcctaccggacgaccgacggggggtacccgacgctcgacacttcgtaactcacgggtcactacgctggtt

SEQ ID NO: 578659 - DNA, 484 bp, Homo sapiens
tcttagtagtcggtgttttgtcgtgataggatctactctgcatttcggcgggcgctgctctctctctctccgcgcgggtatatattttgtatctctttgtctcgcaggcgcctccgctcggttataatatatatctttcgtctgatatcactcgactccatcgcgctcatgagaggtgcctaccgcatctcgtgtgtgtgacagaaagatatatctcttgacgagagagtctggcgtgttgcgcggagggtatttttttatcgctcttcgatgctctctctctgttggtgtgttcgcccccgccgctcatttttttttttactcaaggtgtgtgttatagcgggtggttgccaccccctctctactccccgccctcgcgttgtgtacactcctgttgcccccggccccatttttctccccccccccctttttttgtgtggaaacggggggtttggggaaaaaatgtgttttttataaatagaca

SEQ ID NO: 578660 - DNA, 533 bp, Homo sapiens
aggcaccgtatccgcgagccgataataggtatttagatgccgtagtaataagtgcgtcctggccacaatagctagataagcctcttgttatgtcagctctactctttgtgtgccccttggttatggtgagatcggaatgatgagcatgtctctaagtgtatttagtgtgaccagcaaatattgccggtgcgagtcgcggccatccccgacatttccactatgcactgatgactgtcgtgggcctgtctgactccttatattagaatcatttagtcctcataataactctttgcagtaagtactatgattatgtccattgtcagatgtgttaggaggacagggatattaagtgatttgtccaaggtgacacagttcataagtaacagaaccactattggaatcaggtgctttgaatatgaagtcctgttatgaaatatgtcgggatgtgttggaaccccacttccttatttataatgagtgatttcatttcaaagatggctgataggcattaaatgtttccatctatggcaagc

SEQ ID NO: 578661 - DNA, 174 bp, Homo sapiens
gctagagaggctgaggcaggagaaatgcttgaacctgggaggtggaggttgcggtgagtcgagatcgctccattgcattccagcctgggcaacaagagcgaaactctgtctcaaaagaaaaaaagagttaaaaggctgttccatcttgcatactcctctcccccaagttgcgtg

SEQ ID NO: 578662 - DNA, 105 bp, Homo sapiens
ggcggcggcacttaagaccggccgccagatgatgcggtggtgggggactgccggcacgcgacttccccacggcccaaattgatattcactgatggactccaaagg

SEQ ID NO: 578663 - DNA, 212 bp, Homo sapiens
cttaaaaccaaacctctttgtggttttgaccaagggattttccaaatttggttggggttttggtttgaaggttaaaaaatttttccgcccataaagccccccgttttttgcccctctaatttttaagtttggggattgggggagggccaggggttttttttttttttttttaagggggggtggaccaatgggaataaaaccggggctgttga

SEQ ID NO: 578664 - DNA, 1575 bp, Homo sapiens
gggctgtgagccctacgtcgttctctttctttctgcatcaaaggcgcgcctctcttcgggttgtttttgttcgccgaccgcgccacgaatattgttgtggtgcgccctcccacccacacacatgtgtgtgtactcccctccttctgttgtctcttctccctcttgtgttgagttccgctgtgtggctttcccttccccttggtggttgatgaacactcactctctttagtggtgcgccgcggctgttgtcgttgtcgtcacacatatcgtccaccactgtgggcgctggcacctttcttcgttgggggggtgctcctctgcagcgttgttgaattgttgttgggtaagcggcttccacccacaccaaattttgtggcggcatacaatcatttgtgtgcgaccgcaccaacaccaagtttggggcgactacttcacccataagaggggggccccccccgtgcgtagtttgtcgcccctcctctgttgtcgccacccccacttttgggtgggcccctctgccaccacgctgcttcgcttggtgggggtaatattcttttggcgcgccgcgtgtgtgctacccccaccgcttgtctattagcttctcttctcgtcagttatggtccctcgcgtcgcgcgtgctcttctggtctgtggttgtagacaacaccctcttttcgcggggtggtgacacccccccctttgggccgccctctccatgtggggttttgtcccgacagagattgttggtttttctcgtcgcccccgcccccaccctctcgcggggtatatatttggccgcgtatatgctgctctctattataggctctcttctagggcgctctgttgtctctagacgctcgcgattgtgtgacatatattagggcgcgcggggagtatgtagtttgagagagatattgtgggtcttttccggcgcgtctgtggagcgcacatcatatctgtgtgtctctccacaagggcgctctcccctctggggccttcttctctttgtggtggcgtctctcctctgggagagagagtttgggcgcctcctctttgtgggccccacacagctctccactctggcaccactgtgggcgtctcacacacctctctttgtgctctctctctgtgtgtgtcaccacccacacagagcaggggagagtttttttcacacacgctaccacgctgtgagagtgtggggcttctgcgcgcctctctgttaaatgtctgagactctgtctctcttctccacaccccgcgagtgtttggggggttttatagctcgtgttgttcttctctcttatatttctcaccgctatcgccctcttttcacgcgtgtatgtacacgcgggtgtttcttcttgtgtccagggcgcccataactccccattctctccctttgaaaacagtatttaataaaccccactttgaatttttctcccccccgagaaatttaatttccggtgaataaaggcgctttatagaacttgcttgaatataaaccgggtctcgttttcacggaccctctccccccggggtacttccggaaagccaataatcccaaattatggccca

SEQ ID NO: 578665 - DNA, 173 bp, Homo sapiens
gactgactctggcatctctgccgaggctgctggaatcgactggggcatcttcccggaatcagattcaaaggatcctggggtgatgggatagactggggagacgatgctgttgctttgcagatcacagtgctggaagcagaaccagtgctcagagtcctccccagtgttcgata

SEQ ID NO: 578666 - DNA, 862 bp, Homo sapiens
gggggcgcggtgtggcggtggggtgggcgtggcggcgagtggtaagagttgggtgggggagggggggatgtgtgtggagcggtgggtgtcggacgcgcggtgggtatgtggtgcgcgggggcgcgggtgtgcgacggcgggttgtggcgcttggggtggcagtggggccgggggggggcggttgttggccgcaggggtgtggggagggggtgggtcagtatgcgccggacgcgggtgtgtggcgccgggttcgcacgggtggtcggggggcggtgtcttttgtgtgggtttcgccgtgggtgtttttgcgggcttgcgtctgtgggtggtgccctcgcgtggtggtggttgaggtggggggagtgacgcggcgccggcgggggcgtgttgtgttggcggggcgtgacggtgtgttgagtggggctcggactggatctgtctggaggagtagaggggatgatggcgggggcgccgcggtctgcgccgtctgtgtgagagggtggctgccgcgccgcgaggagtgagtcgcttgggtcgcccggtctgcaggggccgcgtggaggctcgccgccgtcggagatggtttgtggcgcctcccacgtgccggcgcctgtggggggcggagcgcgcctctgggcggggggcctgaggctttgtgtggggggcgagtggaggggtgtcggtgtatgtgtctatgagggatgcgggaggccgcgtgtgcgaggcggcgcgcgtggcgcgcgttttcgtgtggtttgttggccgcccgcctcgggggcgtgcgctttgggttccttgttcgtccggggtcaacgtttggagtcagaagggaaccccaaagaatattgtaagaaacaagaca

SEQ ID NO: 578667 - DNA, 969 bp, Homo sapiens
gaattgttcaacacatcttcaactcgccaatggctaccagcactccctatggctttgcaaacaattaaagatttagaacgacaggatggggcggtgggaagctactgacaacgaggccaggaaacaaagttccttttgacccgatgcgtgtcagagagcgtgcatgccatggacgacagagttagtggtatacacccagtttaatatacagaagcgcctaaggaactgcctgtgcaccgtatcggtgacactagtgatgggtgaacttccacaatttggatgccaagtattactgtgtacaacgacagctaactccttgccaacatcgtggctggacctgaaccagctggcgcactaatgcttaagccattcccagcttataaaagcccccatggcagctgcaacgtgcacagcatcagcaaacgtatagtcatgcacagacactggactcatgaccagtggcacattctttacacacacggacacaccacgaaactccaatacttggtaacacgtaataccaaaatataacatataatacatgtgataggcaccaacaattcaccacttactgaaaaccaatcttgccaggccagagcccggcgaaccagggaataccaatgcgacctgataacatacccaagcaacatcaggaggcaaggaccgaagagtggacaatgggaatcaagtacagaacgcacaagaaaggtcccaacgaccacagacacgtgggagcaaagaccgggatgaaaaaccgcccacggcaaatcccaacctacacacaagtaccaaaaaaaccaacaaacctgggaagcagctcgggcgggccgaaagatcgcccgagaaccagcgccacagcaaaacctagccgagagcggacgagacgggcacataaaacacaaaggcacaggagcaaccagagcgagcgccggaccagatgcaacgccgaaaaccgaagcacgggacacc

SEQ ID NO: 578668 - DNA, 855 bp, Homo sapiens
cgctcacacctcatatcctccctactatgcctagaaggaataatactatcgctgttcattatagctactctcataaccctcaacacccactccctcttagccaatatgtgcctatgccatactagtcttgccgcctgcgaagcagcggtgggcctagccctactagtctcaatctccaacacatatggcctagactacgtacataacctaaacctactccaatgctaaaactaatcgtcccaacaattatattactaccactgacatgactttccaaaaaacacataattgaatcaacacaaccacccacagcctaattattagcatcatccctctgctattttttaaccaaatcaaacaaaaaactaatttaagtggtggccaaacctttgcctcgcgaccgctataaaaacccctctctcataatactaatatgtgactcctacccctcacaatcatggcaagccaacgccattatccagtgaaacatatcaacgaaaaaaactctactctgatataatcctccctacaaatctccttaatataacattccacagccccagaaactaactcatatattaagtatctgctccgaaaacaagagtttatccccacctggctttcattcacccgatgaggcaccaggcagaacgctgaacgcgggccatacttcctatactaacccctagtagggtccttccctatatatcggcaatctcactcaacacctagcgccctaaactctggcactatctacccgccaacaacttaatctgagcaacactgcttgacggcaacaccggcttgtagagaatcctacgggccgatgaccagacctgttagccccacgcacta

SEQ ID NO: 578669 - DNA, 175 bp, Homo sapiens
actgtcaggtctattcctactgtgcccccccatctactagtgtctactactagtatatccaaatttcctacttagaagaggccactagtaggtagctcacacctgtaatcccagcaccttgggaaggctagaggctggtggatagttttaagtccaggagtcaagaccagcctgg

SEQ ID NO: 578670 - DNA, 235 bp, Homo sapiens
gtatagtgcacctcagtatgtggagaactttggtcttcttgacttgtttcagcttcttcccccttcttgggcgcctcatggagtttgtcctccttctgccttaccggatctggaggctactgatagggggagactaggcttcaaccagcagcttgctttcagcgacgtggcgcgaaagttctaatgaagttttgtacacagttttcaggatgagaagcgtcagctggcttaccag

SEQ ID NO: 578671 - DNA, 270 bp, Homo sapiens
gaagagtaaaggggactctgtcttacaggcagagtacaagctcaaccacagtggggtagaacaccaagtgtgctcttgaggtccctgtttctaggccttggctcctggatggtatttctggacgcactctgggccagaggggagcccgttgccctgaagggagatacccaggcctatcagcattgaccacaagctgaccaaagagcccttggaccttgagtgaatatcagcaacagccttgcagtacttgctgcaggcctggggcacctc

SEQ ID NO: 578672 - DNA, 814 bp, Homo sapiens
atccttgtggccgtctggctgcacagctgacaacggacgtcgtgagaacattgagtccagctgctcatgctagtagagtaaattaactgcaggctcaatcctctacagatctctttgaacgttatgtacaagtaataaagaagcagcagatgataaaagtgtagcataagcagcacaggagttcttccaacgagttggaactggggcgattgtgcaagcacggttcactgtgagcaaaaaatatcgggacgttgagcacttgacacgagtacactacgggtatacaaagcgtctgggagtatataaatgatgaatattcatggagaatcatccaaatcgtgaaaaatctcaagaggtcttacacagttagctggacgagtaacaggactcctactgagaacaataaaaggaacggctgtagtagatctctctgggaatggcgaccctcctcaattatgtactgtaatgcgaagtagatagggacttctctctatgcaaccagagatcttgcagctgcgtatatgatcggaatggacaagtattaatttgatacaatgatatatgtgacagataaaggagaaaaaaagcatttcagcaagtattccaaaattgctgcagatcatgggatatgactgggagcaaaggtgccacacgatgccttggaagtagtaccaggcatgagaatccagaagagagtgcctcccgggacgggttaacatgccatccatagttgtaaaattgttctaacaaaagaaaactcaacccaaatgacaggtcgctaacaaaaagacaggtcaatacagccggatcgtcc

SEQ ID NO: 578673 - DNA, 451 bp, Homo sapiens
  misc_feature (98)..(98): n is a, c, g, or t
gttacctcctcattatggaatcagagaagcatctcaaggattccatgataaggacatgtccaggttggagttgcagacatcagataaagatgcatatngcatatttagcgtctctagattctacaggaaagcctggttatttcagtgacacgtgaaactggatcaaggggaacatttgattatcgttggacggagtgattatgattgttttggcgatcgatcagagacctgtgctttgcgcagatttgaacggagtgtacctagtccttgctgtgacaaagcccgtcgaagatgatatggtcaaaaccacttccaccaagtgaacgcttggagcaagaactgtattctggaggaaacacggggattaactttgagaaatatgatgatataccagtagaggcaaccggcagtaactgtcctccacatattgagaatattagcgatattgaca

SEQ ID NO: 578674 - DNA, 210 bp, Homo sapiens
  misc_feature (112)..(112): n is a, c, g, or t
cacgctggcggttccgcatgtgtctgcgccctggtgccatgggccagagtcccaaggaacgaagagaggcaaaggctagaggctacctggacctggggccacgtgaccctanggtgcgcctcttgggacgcatcctcaccgtcatcctcccagggctcttgtagaccacgcagcacacttcttaggtattcctggtaaacgattatgcac

SEQ ID NO: 578675 - DNA, 250 bp, Homo sapiens
cctccataaagaaccgcctttttcggaactgaacttaacttttttgggcctggagcccctcgacacaacggaggtccctcctcaccccctcctgggccaaaacaggggccgcaggctttggggacccggacccccccttttgggtctcccctttccctccccagcccggcccctggaggggcctttggttcaaaccttcgcgtggcattttcccattatttaaaaaaaacaaaaacaactttttggagga

SEQ ID NO: 578676 - DNA, 329 bp, Homo sapiens
  misc_feature (43)..(43): n is a, c, g, or t
  misc_feature (60)..(60): n is a, c, g, or t
  misc_feature (91)..(91): n is a, c, g, or t
gcaaaagcaatttgacacttcataacgtctagaaatatttttncaaatgtgatgtatgantaggaagtagcatacaaaaacaaattactgngctatccctcccccaagaatacatattctctcttcacaccacgtggctgctgctggggcatgggggaggggtggcattggcagttcaagactgtcctaccctcttcagtgactcttttagcaatatgaagttaaaaaccaggtactgttaccactcacctgatgtttaattctcatgaagatgcttttttgtgtagatagttgtcaaatgtggatgttcctgcagggaggaccaattg

SEQ ID NO: 578677 - DNA, 1585 bp, Homo sapiens
ggagagaactagtctcggagttttttggtttttttttgggcttcaaaaagtctttatttccattgggtccaggggctggttaaggatagtttaaaaaagcgtgccatagtgggcgtggagggagaggctttaggcagaagcccttatatacttgtgcagggggccctttcagaaagttcgcgtgggctcagaaaggctctatagtcgggcgtggagagagggtgaggcctttttcgagaaagaagatatacctcgccacagcaccaagccttccgggggccaccacaggcctgtgtggggagggtggggctcaggggtggctcaccacattcttctttgagagataacgctctcacttctcctctcattcttaagagaagtgtgggtgtcttcacaggagagactgtcaccagagagagacttggcgggtgccccgtggcgtggcgcacagaaccccagggggcattggaaagactccaaatagggggcctgtggtctcacagcgttcttctctcccaggggggccaaagtggcagagcgcatctctacattggggcgcgtcctgggggcgttttaacacccccaaatctcattctttacacgcctgggggctactcctagagagtgtgtccctgtgagaacagaagacgcgtgcgagggccttgcacaactgctggtgtctctcggcgatccttctcaggagacagccacccgccgtgccgataaggcgcccctctccgcagagaccatttaccctcacgtgcgggccacaacgatcccggggcggcacaccacaagccggggggcacccaaccgccccttatcacgagagaagccccaacaccttcaacacggccggggcgccgaaaaataaaaagagccccagaaagaacaagcgcaggcggtcgaccacagcaaagggccacgaacaggcgtttcccccaaactgggcgccacccaaagaccgagcagcaacgcgcaacgaccctcccccagccccccgtcgcgaaaacaaacgtcgggaacgcacaactccgggctgcgaccccctcggggccgccgctgggcgcccaccaccgccacacgatcacacccccacaaccaagcgagtagccgacagaagcgtccccacacaacacgccacgccaagtatcccccccaaacaaagtggcgccccccgcggacgattggcacaccgcgcacaagcagcaaccaccaggcagcacgggcgcaaccgcgacgccaaaaaagaccccgcggctagggccccccgaccaacacactggcgggaccacaagcaacacacccaccgcgaacaaaacacggaggagcccgaccacacaacaagccagaagaatgcagcaccaaggcacgccagacctccgccgcgcagcgccacacgagaactccaagcaagcgagccacaccaccgtcccccccaacgcacccaacaggagagcctacacagtcctccgcaggagcagtacacagaccgcaaaccacggagcggggcagaacgacgaaagtacacacacaaacgcaaacaccactaccaatgatagccgcaccgcgaacacacaacaac

SEQ ID NO: 578678 - DNA, 139 bp, Homo sapiens
gtaggtcgattcatacaggatcccgagcagaggcccacgtcaaggatatggacggtggaatctggagaccgacatcttaataagcacagtccgtgcttgagtgtggtggctcatgcctgtaacgctagtctcagccctt

SEQ ID NO: 578679 - DNA, 406 bp, Homo sapiens
  misc_feature (154)..(154): n is a, c, g, or t
  misc_feature (160)..(160): n is a, c, g, or t
  misc_feature (185)..(186): n is a, c, g, or t
  misc_feature (214)..(214): n is a, c, g, or t
  misc_feature (216)..(216): n is a, c, g, or t
  misc_feature (236)..(236): n is a, c, g, or t
  misc_feature (316)..(316): n is a, c, g, or t
  misc_feature (344)..(344): n is a, c, g, or t
  misc_feature (357)..(357): n is a, c, g, or t
  misc_feature (360)..(360): n is a, c, g, or t
  misc_feature (362)..(362): n is a, c, g, or t
tgaatgggggacctgctttgagcctgcccaggggccaggcctgctccaggttaaactggacggaaggcccaggtttcagtttttttcaaccaggagaggccgctgcctagagcccctccccccctttttctggatgggtgaggcaagccagganagcaancagtgttgtcctcccgggaggaggnntgagcgactgggaaaactcggctttacntntcccccagaacggcttttanaaaccccccagctggagagtcctgggtgagccttgggagtttcagctttttggcggggggcccaggtgccatgcgatcancgaagcctgcgagttggcaggactttgnggtttcctgcagnccntnccatgagattgaaggggcggggaaataaaaaaaaatccccctta

SEQ ID NO: 578680 - DNA, 677 bp, Homo sapiens
ccgacgtggccattttcgatgccggtgatcagtcgagcgattctgtcagatcaggcagatgctgaggactctcttggctcttccacagattgctcagaggccgataagcactgcttcccgcaggcatcctacaagtaaagatccgcagaagcaatactgttccaggcaggactgatgaacttgcactgaatctaaagggtgggggagctgaggccctcctgtatagagccaccatgatctcttacagcatgagtggaacagcatatgccatatatgagctgggtggggcttcatttcccacgaagcgcgagtgacttcggacatcccagcactcgcttgggtcacttacattcagctctctatggaccagtgatcagataaccaaccgcgctctcctttgccgatcaatatttattggctcgtagtaactgccaccactaaagcactctctgccatgactaatctggatcctcaaagggaaaccccgccagctcgccttaggccaagctgctctactttcctgcaaggttatgcatccgaccgaagaccgagctcatttgccatttcgtcctatggggcggctattacaattgactggcctttattcacatcgtgatgctctgcgccaagtacggattagtcctggacgatcgccatcccatcgtcctgctacagat

SEQ ID NO: 578681 - DNA, 1642 bp, Homo sapiens
  misc_feature (292)..(292): n is a, c, g, or t
  misc_feature (586)..(586): n is a, c, g, or t
  misc_feature (647)..(647): n is a, c, g, or t
  misc_feature (716)..(716): n is a, c, g, or t
  misc_feature (784)..(784): n is a, c, g, or t
tgggttaattctggccacttttaatgtgggtgaaagagtgatcttatctccttaatgtgacattttatactgtggtttaaaaaagtttctccttagcccatgttaagcccgtgctacgtgattttagacaaggttattagtggctcatttactttgtgtaaccccttattccttctccaagccactttcgtggtatacttctcgaggctgcgtttttatcactgtgatctccaccaaaccacctataaaagagagctctatagtgctatacgagctctctctatagctatanagatgtggaaaaacaccacaatttcaattccttctctctccctctcgtgaagcgtgcttgtgggatctcatctcaatttatatgtgtgacattctctctatataaactatacatttttctctataacaaggttttgggagatgtgtgggcgacccttttcacgagggcgtcctcttattgtgcgaggagggggcacaagaggacatgtgtgcccaaggcatcttctctctggtggggagaaacactgttgtgtgtttttttaaaaatatcttcccaaagagacactgtggtganacacccaaatttatctccccctgtgagccacagtgttgaacaccgtgttgtttgtgcgcgnttttatataactccgccttttctctctgctccaagtgtgtgtcctctccctttgtcgcaccaaatcttnttatagtatcccccccatggtggtggtaagcgtcttctatactacacaacccatttttctgtggggcnatgtttcttttaacaaagaaaagaggcccatttttttcttatccaccccgcaatatttctatcaattttgtctttatataaacacagccgtctttctccaacagagaaaaaccgtgggctcgttgacaccaggtttaactgtgggggtgcgcacaagttgtttagcggacggttctatttaacaaaagacgctcttgtgtgaaaacacagatgttgtggcgcacaaatttgttttgtggacacaggcggcacaataacacatgaaggggagtagaatcctgtagtggggggcgcgatgtataaaagaatcacacctttatataaagtggggaagaagagatcattgggagtacaattaattaagaggggaccaacaaagttgataatatttataaacacggaggagtattattgtgtgtaaataattccatatataagacgacgaacgaaaagccagtctttctaaagatggttgtgagtcacccccataagtgtgttgtaagagggggaggataacaacattatcccaccggggggagaggaaatattattctcttccacctatggtggtgaacacccgcgggtgttcaataattaaagaggtgggagaacaacaatcagaagcggaagtatgtaatctctttaaaacaagaaggggagggtgtgtcagaaaaaacatctgtctttgttgaaagaagatattcatcttgcaagctaagaaaacatggatgcgatggcaggaaaaaaaaccaagtagattgatgatgatgggttgaagtgaaaaataaaaagacgtttccaccaggagaattgttttatcaggcgggtacatattttgtgattattagcaacaagaaa

SEQ ID NO: 578682 - DNA, 292 bp, Homo sapiens
ttttcccccaaaccccccccccccccttttttccgggggggggggggggggtccaaaccggttgttttccttggccccttttggtttggggggaaaagcggggttttttttcccccgccctggttaccccccccaagggaagggggagttttttggggcccccctgggtttttttttttgggggggggcggttttaggtttttggttttttaacccgggcctttttttggggaccccctgcccccaaattttgcccccgattttttggccccctttaaaaggttttttggga

SEQ ID NO: 578683 - DNA, 1185 bp, Homo sapiens
  misc_feature (728)..(728): n is a, c, g, or t
  misc_feature (732)..(732): n is a, c, g, or t
  misc_feature (736)..(736): n is a, c, g, or t
  misc_feature (744)..(745): n is a, c, g, or t
  misc_feature (753)..(753): n is a, c, g, or t
  misc_feature (781)..(781): n is a, c, g, or t
  misc_feature (794)..(794): n is a, c, g, or t
  misc_feature (799)..(799): n is a, c, g, or t
  misc_feature (810)..(810): n is a, c, g, or t
  misc_feature (1069)..(1069): n is a, c, g, or t
  misc_feature (1071)..(1071): n is a, c, g, or t
  misc_feature (1076)..(1076): n is a, c, g, or t
ctgcctagcggactctcttgtttcttgtgtaacgcttgtgcttttcgtgcttctcttgcgtcctgttgtcttccattgggtgtttcctctttcattgtgttcctttctctcctttttctattgcttggtttgtctacggttcctttgggaagtttttgcctgctttttccaccgccccttgggggctttctcgctttatcgcttccttgtttaacgtatgggttgtcctactcgttctccggtgtgttttcgttgccctgtcattcgctttcctgcgctctggcgtttgagatggtcgcttcccttctcctgctggtttccaacttcccgggcatcacttggtcttgcggtttaccaactgggcttcctgtctgaagttctcccggatgctctggttttctcttgtccgtacttcgtgctcacgttctggctgtcatcggaattccacacgcactcgatcacgtactgcggtaaagagtctaattcttgccgatgggccatgttcgtcgccacgtccttgcggtgtcgaagatctggggtatacaaagccacgttttaattctttaagcttcacgtacagatactagtttcaggtcagggtctgaaggaatggtattggcccaacatcagacctgttttccaaggtgaccaagtcctggctactatccctagacctgtggttacagtgcagacaggccatgtgagccttccgctgcctagtcaccagngcgncctnccccctgnngactagtnccgtagggagtacctgctgccccagctnactgtggcccccnccgtnatccatccatntccagggagcaaaacagagacgcaggaatggaaagcggagttcctaacagtatgaaagttcccccatcagttcccccagtacctccaagcaagtagctttccacattggtcacagaaatcagaggagagatggtgttgggagccctttggagaacgccagttctcccagggccccctgcatctatcgagtttgcaatgtcacaacctctcttgatcttgtgctcagcatgattctttaatagaagttttattttttcgngnactcnagcctgggggacaagagtgaatctgtgtctcacccaaataaaataaagaaaaagaaagatgcttaacaaaggttaccataagccacaaattcacgaccacttatccttc

SEQ ID NO: 578684 - DNA, 808 bp, Homo sapiens
  misc_feature (25)..(25): n is a, c, g, or t
  misc_feature (72)..(72): n is a, c, g, or t
  misc_feature (74)..(74): n is a, c, g, or t
  misc_feature (92)..(92): n is a, c, g, or t
  misc_feature (98)..(98): n is a, c, g, or t
  misc_feature (140)..(140): n is a, c, g, or t
  misc_feature (146)..(146): n is a, c, g, or t
  misc_feature (160)..(160): n is a, c, g, or t
  misc_feature (173)..(173): n is a, c, g, or t
  misc_feature (179)..(180): n is a, c, g, or t
  misc_feature (183)..(183): n is a, c, g, or t
  misc_feature (189)..(189): n is a, c, g, or t
  misc_feature (196)..(196): n is a, c, g, or t
  misc_feature (222)..(222): n is a, c, g, or t
  misc_feature (224)..(224): n is a, c, g, or t
  misc_feature (229)..(229): n is a, c, g, or t
  misc_feature (234)..(235): n is a, c, g, or t
  misc_feature (243)..(244): n is a, c, g, or t
  misc_feature (252)..(253): n is a, c, g, or t
  misc_feature (257)..(257): n is a, c, g, or t
  misc_feature (260)..(260): n is a, c, g, or t
  misc_feature (264)..(265): n is a, c, g, or t
  misc_feature (269)..(269): n is a, c, g, or t
  misc_feature (288)..(289): n is a, c, g, or t
  misc_feature (304)..(304): n is a, c, g, or t
  misc_feature (318)..(318): n is a, c, g, or t
  misc_feature (327)..(327): n is a, c, g, or t
  misc_feature (329)..(329): n is a, c, g, or t
  misc_feature (338)..(338): n is a, c, g, or t
  misc_feature (340)..(340): n is a, c, g, or t
  misc_feature (345)..(345): n is a, c, g, or t
  misc_feature (351)..(351): n is a, c, g, or t
  misc_feature (355)..(355): n is a, c, g, or t
  misc_feature (359)..(359): n is a, c, g, or t
  misc_feature (367)..(368): n is a, c, g, or t
  misc_feature (376)..(376): n is a, c, g, or t
  misc_feature (404)..(404): n is a, c, g, or t
  misc_feature (417)..(417): n is a, c, g, or t
  misc_feature (422)..(422): n is a, c, g, or t
  misc_feature (433)..(433): n is a, c, g, or t
  misc_feature (692)..(692): n is a, c, g, or t
  misc_feature (694)..(694): n is a, c, g, or t
  misc_feature (699)..(699): n is a, c, g, or t
ttgccaactcctggaacactaactnggttgacaaatggcttcttttaaaatactcagagaacatgatcactntngaatcgaatcagaagtgntggctngaattccacgcaccgatcagtactgggaaaagatctaatctnccgtgngcctgtctttccantcctgtgggcganatctgnntanaaattnattttantctttaatttcacttaatatacaatntncatanatttnnttaattannttatgttnnaaanatnatanntttntcccaattataccaatccnntcaacaacccatccnttttaacatatcanacattccantntatccaccncntccancacagngcgncctnccccctgnngactagtnccgtagggagtacctgctgccccagctnactgtggcccccnccgtnatccatccatntccagggagcaaaacagagacgcaggaatggaaagcggagttcctaacagtatgaaagttcccccatcagttcccccagtacctccaagcaagtagctttccacattggtcacagaaatcagaggagagatggtgttgggagccctttggagaacgccagttctcccagggccccctgcatctatcgagtttgcaatgtcacaacctctcttgatcttgtgctcagcatgattctttaatagaagttttattttttcgngnactcnagcctgggggacaagagtgaatctgtgtctcacccaaataaaataaagaaaaagaaagatgcttaacaaaggttaccataagccacaaattcacgaccacttatccttc

SEQ ID NO: 578685 - DNA, 820 bp, Homo sapiens
  misc_feature (460)..(460): n is a, c, g, or t
  misc_feature (547)..(547): n is a, c, g, or t
tggcagtacgcagctgtttaaacgcgcccactgaggggcccgagaagaaaccagacaggtgttgtgtcaatataaagacggcattgtgcaagcccaaatggcgctgtcgcttgtgagatatagcccacagtggaagcagagcggtcatccactgttcggcgccaaattagtggcggctgtaccgttttccgcaaccagcttgtgggccgcggaatagcgctcccctgctcaggataaaagaaggggggcaccccctgggggtgatacccttgtgttgttcccccgctcgagaatttatatcgagtgaggttcccgcgtatggggaaacctgcgctcgttagaagaggactataatgaccacctgcgtctttcagcacagccgaataaattctagggccattgtctaagacggcgggttaacacccgcctcctgaatacagggtactatcggtgagtctcncgcgggggcaataatagacatgagataacaatcttgttgcccctgcggggtggcaacccagcacactctccgggaatttctcccgtngtagcgagaatactcctcgcgatcgccaatgcgcgtgtcttcgctgaagatgaacaccgagtgatcagtcctttgagtatggccgcgacctcgtggatcttcaagaagcacagtgggtaatctgcaccgccccttcttgaaaagtgctggcaatgactggcttcgctctctctagaaacagccgcctcatctccttgggcagatagcagcattgattggggccaaccgtgtgccccctccgctgttccaaaaaaaaatccctttgaaacatga

SEQ ID NO: 578686 - DNA, 1638 bp, Homo sapiens
tggtaaagcgctgatccggtatattgggcaggaaaacgaaaacaattccagcagcccaggagggacagggtggactataattcctccttccatcgatcgatctccgagccccagaccccaccgcttggcccttcatgggacattcttcctctttcacggcggtccgcggggcggcacacccccgcggataggcgaagaagcgcagcagaagaacagctcgagtgtgtgctttcgtgggaaactccgagggcggcaccaagtgacaggcacgggaagtgtttcaccacacgggcgtgggcggaacctctgaatatatgggcgccgtggcgggatatacagacactgccgaagagcgttgtgtgtgtgcacgtggcacctgtggtccccaagcccacagatttgtgaaaagaactcgtgggtcttgcagagcgcgttcttctctctaaacacatatctcgtttattaatcttattcacaggggcctcgagggaaagtggttttataccttccaagcatcgttctcacattcatgtgcactcctcttcaatatcacaagaaccatcacaccacaaagtgcgcgggaaaaccaagaacgcgactccgccagaaaccgagggggcgcgattgagacactttttgcgagaacacagagtaagcgcaccccatggtggggagactcccgtcttccctcaacctcccaaacgtccgtttcaacaccgagctttccctcgcgggggggggcagagaccccttatgacgcgatgaaattcactgggaggaccaccagggcgagtctaccaatcttgttttggaacccccctcttccacgaaatcaccatcctaccccaggtgttttgtcgttcatccagccggtgaacgatgcccccattaaccatccagccgcgagaacattcaagggacatacacagcagcatacacatgaggagacacagcaagcaacacacaacaacgaccataccctaccagaaaaagaggagtcactccccaccagcgggagcaggggcaccaccaaataacaagcgcgtccacttacggtgagacacacacaccaaccccacaaagaggcacatcccgcggagcgagcacaccatcgcggcgcaattactatcacgggacaccaccaggacaaatatccctctcgaccaccccgggaggcggcccacagatgctggcctgtgagagggggcactctcactgacagacaccacacctcaaccaaaccaggggcgaccctctgggacagcaacctccagacaaacgtcgggcggccaccacctccacaacagtgaggcacacgcggcagccacaccgtgccacaacgcgcttgccagcccctacacacaaacagggatgcacgccacctctcttcaaacaccactccgccctgggagcgaaaacccgccccacaactagtgtggcaacacgacgtggaccactgcaaaaacacacctcgtggtcaaggtgctcaccacgacaccaccccctcgcccgtgtcgcggccgcccgcctgtcgccacccccccctacctcacagcctgacaagcagccccaacaacatccacacagcggacccacgcagcaccactagcacgacctactaacgacgtgacactcagt

SEQ ID NO: 578687 - DNA, 92 bp, Homo sapiens
  misc_feature (40)..(40): n is a, c, g, or t
cgtgcatcgaggataagatggccatcgatgacaagtacanccggaggaggaataccgaggcttcacacaggacttcaaggagaaggacggct

SEQ ID NO: 578688 - DNA, 145 bp, Homo sapiens
gggtctagaacactaagaagtacttgcaacgtgatttttcatgcaaataagttgcgaggtagccttttcccttcgagtagaatatgtactattccagagagagggggtccagactattataggcatagtataatgaacctcactg

SEQ ID NO: 578689 - DNA, 214 bp, Homo sapiens
cgttaaggcaccacttgtgatggagttcctcagggatcctgaggagatgctgattcaatgagcgggaggcatctctcccttcccgtaacttctcccttaactgggtcagctcccgttcctgagagtgaaccaggactttatattgcctgagctcctcagcttgcttgagctgctctgcaagcttctcctccttgaactgtcgctcattcctcag

SEQ ID NO: 578690 - DNA, 848 bp, Homo sapiens
ggttcttcgccgagagtcgtcggggtttcctgcttcaacagtgcttggagcggaacccggcgtctcgttcctccaccccggccgggcgtccatagtcaggccctccgtcacctcttcagccgcagccctcggactgccgccaaggccccgcgccggccagcatccaggcgccgcgcgaggcaacgcgccgacgtcggcgcctcatcacttagtcgccagcatgacgaccagtcgtccaaccatcggaggtgcggccagaactaccatcgaggactcagaggccgccgatcaaccgccagatacaacctggagctctaacgcctcctacgtttacctgtccatgtcttactacttatgaccgcgactgatgtggctttgaagaacttgtgccaaagtactttcttcagcaatctcatgaggagagggaagcatgctgagaacacctgatgacagctgtcagagaccaacgaggtggccgaatcttccttcaggatatcaccgaaatccagactgtgatgactgggacagtcgggctgaatgcaatggagtgtgcagttacagtttggaaaaacatgtgagatcagtcactactggaactgcacaaactggccactgacaaaagatgacccccattggtgtgacttcattgcagacacattagctgaatgagcaggtgacacgccatcaaagaatgggtgagcacgttgaccaaactttgcgcaagatgggagcgcccgaatctggctttggcggaatcatctctttgacaaggcacagcctgggagacagtgataatgaaagctaagcctcgggctaatttcccccatagccgtgggtgaatttcctgg

SEQ ID NO: 578691 - DNA, 296 bp, Homo sapiens
gctatccactaatgcctatctgcagttagtcttttaatgcgccagtcatctcttcatgaagcctgacaaaccttacacaaattgcatatcgcctttggctttaaagttcgattttctccactttaaaggatttttaaagtataggtcacttttcttctgatagttggccagctatatgtatccatgtgagacaatgagtcaacccagaaagcagattgggtacttacatggtaagtttaacactaagcattttctgttgattccccaccccctgcccataagtaaatattcatagc

SEQ ID NO: 578692 - DNA, 201 bp, Homo sapiens
ggggtcaactcaaactgtgatgatccactgaagaagtagaaaaatccaaatgccttgtaatacagcatcaaacttaggctcaactcctggaaagtcatcagctattactctagggaagcctttgctccatggactggctattttcatcaaatctccagtacttgtccgctgcaaagaagtatgttttcttcttttccttgt

SEQ ID NO: 578693 - DNA, 131 bp, Homo sapiens
acgctagtcaaatgcaggcgattctgaggacgccatcccttaggagagtggcgatgagtgacgaagaggagcctatacaagcgcatctcgatctgctcctcttacaaacgaattggctgtaaggaagagtt

SEQ ID NO: 578694 - DNA, 123 bp, Homo sapiens
ggttccaacttcatttccacggtcactgccatctcgaccagttcggacctgcagtcgctggtggcagccccccctcgtcttctccggtgggcccattcgagaaccagaggcccctcacccttt

SEQ ID NO: 578695 - DNA, 451 bp, Homo sapiens
tagtacgtgaaacacatggatcaatagccaagagagggccattatgcagctctaatcactactatatacacgacaggtgtcaaagcccaaagaaaaggggctgcacaataataccagaagatggaggactgccctttgttatgtgttactacagcaaccagcccacaaaataagaagaaccttctctgtcttatgccaaggttctagtagtgtactgtgacagtgaatagtataagctacaaagtgtgggacgtttcacagggtgagaataggtcaagtagtgagaccaaatgcctatatcgattcaagagagtgggagtccaaaaagtaccctacaggctgggggcccaacccttaccacagctccctctggctcacacacagaaataaatagaggattcaagaacagaccccaactttgaaacagctgcagaaaattcatcctgattaa

SEQ ID NO: 578696 - DNA, 587 bp, Homo sapiens
  misc_feature (13)..(13): n is a, c, g, or t
  misc_feature (31)..(31): n is a, c, g, or t
  misc_feature (40)..(40): n is a, c, g, or t
  misc_feature (58)..(59): n is a, c, g, or t
  misc_feature (61)..(61): n is a, c, g, or t
  misc_feature (79)..(79): n is a, c, g, or t
  misc_feature (84)..(86): n is a, c, g, or t
  misc_feature (88)..(90): n is a, c, g, or t
  misc_feature (93)..(93): n is a, c, g, or t
  misc_feature (114)..(114): n is a, c, g, or t
  misc_feature (180)..(180): n is a, c, g, or t
  misc_feature (207)..(207): n is a, c, g, or t
  misc_feature (235)..(235): n is a, c, g, or t
  misc_feature (262)..(262): n is a, c, g, or t
  misc_feature (269)..(269): n is a, c, g, or t
  misc_feature (272)..(273): n is a, c, g, or t
  misc_feature (275)..(275): n is a, c, g, or t
  misc_feature (285)..(285): n is a, c, g, or t
  misc_feature (310)..(310): n is a, c, g, or t
  misc_feature (340)..(340): n is a, c, g, or t
  misc_feature (347)..(347): n is a, c, g, or t
  misc_feature (349)..(350): n is a, c, g, or t
  misc_feature (358)..(358): n is a, c, g, or t
  misc_feature (364)..(364): n is a, c, g, or t
  misc_feature (404)..(404): n is a, c, g, or t
  misc_feature (413)..(413): n is a, c, g, or t
  misc_feature (439)..(439): n is a, c, g, or t
  misc_feature (450)..(450): n is a, c, g, or t
  misc_feature (494)..(494): n is a, c, g, or t
  misc_feature (523)..(523): n is a, c, g, or t
  misc_feature (544)..(544): n is a, c, g, or t
tattatttaatanattttatattatttattngattttatnttatatttttttattttnntngtttattttataggtttngaaannntnnnatntttgtagaaaggataattttnataatataataaaatagattgttttgtttttgtttttgtttatgatttgatggtttatttatatangaggaggtggagggtattagatgatanggagttagttttatattggttttaaatnatagattggagggatgggggaggatanagatttnganntntttttttatntttttttttttagattttgtatttnagagaggaaatgaaaaattttaatttattngtataanannttatgaantttatnattttagtttttggagattggtttattttgagattatatnattaaatanattattggtattaattatggggtttnatataaatttnttttttttttatttatgatggagttgtgattttgtggttaggtnatttaaattttagtttttaaattggatanagtttattttttttattaagntgattattttttttttttattaggaaattttttatgtgtgttg

SEQ ID NO: 578697 - DNA, 217 bp, Homo sapiens
gggctggtctcaaactcatggcctcaaacattcctcccacgttgccctccgaaggtcctgggattataggtgtaagccaccacacccatcactttgagtataattttaaaaaatacatattgggttttgcatgaaaggagagaaggttagcactccacttgacaaggatggaagcactttgggcctgacaacacacatacaaggcattgccacctac

SEQ ID NO: 578698 - DNA, 354 bp, Homo sapiens
tgcaatgactttgatggattccaggggtttatgctaagttaaaaaagccagtcccaaaagttcacaaactgtgtaaatccacttatatggtagtctcaaaatgacaaatatagaaatggagagcatattggtgttcaccagggttcagaaattgggggaggcaggtggaggtgacagtagctataaaaggcaacacaagagtattgtggtggtggaactgttctgttatagtgactataaatttcaatatcctgattgtgatattgtactatagttttataacatgtatcatttcttgcaactgcatgtaaatctataataatctcagaattaaacatttaattaaaaactact

SEQ ID NO: 578699 - DNA, 113 bp, Homo sapiens
gtcaatggatattttatagcaagagaatatttataaggtgatattcaacctgcttcctatcaaatgcaaataatctcaattagaaattaaaatggagacattaccactgatac

SEQ ID NO: 578700 - DNA, 523 bp, Homo sapiens
caacgatggtcctacagctggtcgtcgctggaacattccagtgatgagatgcagctcatgaaggtctgagtgatgttcttcaggggaagcgatactcgtgagtaccacagggaccagccgtccttatcaaagtgctcccagaaatatggcagtgccacagagagtgtgtcctcgattggagtacttgcgctgaaattcatccaacacaaaggttactctagggcgaggtgagctgaaggggtcctgggggctctcggctctagctagccagggccggctcgcattcatccatctcctcctcaggagcaggggcagccgcctttttctcctccttccgctgcagctggggcttctgcttctcttccctgaggacccttctcgttccgaggtgtgtcctttttaggttgggtctctgcaaactttttagcatcaaactgggccatcttctcacacagtttcacttcccccaagacagcccggaactggggctggttaatgcagctgaggaccatcgttggggtac

SEQ ID NO: 578701 - DNA, 395 bp, Homo sapiens
  misc_feature (9)..(9): n is a, c, g, or t
  misc_feature (14)..(14): n is a, c, g, or t
  misc_feature (157)..(157): n is a, c, g, or t
  misc_feature (374)..(374): n is a, c, g, or t
gatcctttnacccnagcctcccaagtagcctagaacgataggtgcaaaccatcatgccccagctaatttttaaatttcctttggaaagacacggtctctttatgttttcccaggatggtctcaagctacttggctcaaatggtcttcctacgtcaanactttgggaggctgagggaggaggattgcatgagtccaggagttcaagactggcctgggaaacatggcaagatgttgtctctacaaaaaaaaattaaaaattagccagggatggtgacatgtgcctgtagtcgtagctacttgggaggctgagatggaaggaccacttgagcccaggaggttgagactgcagtgagctgtgatcatgccactgcacntccagcctgggtgacagagca

SEQ ID NO: 578702 - DNA, 187 bp, Homo sapiens
gcctccgccgctgcacactgcagcctctgctgaaccccgtgccgcgccgccgccttcgccagcccggaccggaccggcccgccttcccttcctccgctccacgccggcctccggccccgcaacctcctcctcggcgaagtctccctggccgccccatgtcggccgcccccgcctacagcgaagacaa

SEQ ID NO: 578703 - DNA, 729 bp, Homo sapiens
tctcattaggcagagtgacagagcagtggccagggctggggatgtcctgccttcacacttggtctctgccagtcctcagggatattctccgcttgagagtactatgtgatgcttactgtgggttaacgatacagtgacgaggcactcctgccacggaactgtaagatggtgggtgaagcatggttagtccacccttaagtcatctacttttcctgggtgtagacacagtgagtcggggcggagagttttccacgtgcttgagtgccaggcagcaatgggcggaacacgggtgtcatggatgtggaagtcctattcttcttaccatcctgacattggagcttcttcatgccaactatctctgacacactcccctgaccaacctgatctcacatttatcactatactgacgtctctcgggactatttctctcggtgactgcgtcctttgcgaagctgatagtaatacagtctacatcacggtcacacctggcactggccgctgggaggaacgtgacaaccaaagcctcggcgattactaccgacgtgcccatactcagagcagcatacagaaaatcctcgttctgtaaccagttctacccaactcgacttcccgcaccatgctggacgccagcccctcgtggatcgcgctcatacttcgaattcgccttcacccgcccttagggcacgtccaaacttgtacttccttagctccccttgatatgtacaacgt

SEQ ID NO: 578704 - DNA, 221 bp, Homo sapiens
aatgacaaagaaaagaagggaacaatggtcgtgccaaaaagggccgcggcacgtgcagccttattcgctgcactactgttcccaatgcgtgcccaaggacaaggccattaagaatttcgtcattcgaacatagtggaggcgcagcagtagggacatttcttaagcagcgtcttcgatgcctatgtgcttccaagctgtatgtaagctacatactgtgtgag

SEQ ID NO: 578705 - DNA, 518 bp, Homo sapiens
  misc_feature (51)..(51): n is a, c, g, or t
  misc_feature (61)..(61): n is a, c, g, or t
  misc_feature (63)..(63): n is a, c, g, or t
  misc_feature (69)..(69): n is a, c, g, or t
  misc_feature (76)..(76): n is a, c, g, or t
  misc_feature (78)..(78): n is a, c, g, or t
  misc_feature (95)..(95): n is a, c, g, or t
  misc_feature (97)..(97): n is a, c, g, or t
  misc_feature (100)..(100): n is a, c, g, or t
  misc_feature (103)..(108): n is a, c, g, or t
  misc_feature (116)..(116): n is a, c, g, or t
  misc_feature (119)..(119): n is a, c, g, or t
  misc_feature (123)..(124): n is a, c, g, or t
  misc_feature (145)..(145): n is a, c, g, or t
  misc_feature (256)..(256): n is a, c, g, or t
  misc_feature (268)..(268): n is a, c, g, or t
  misc_feature (271)..(271): n is a, c, g, or t
  misc_feature (366)..(366): n is a, c, g, or t
  misc_feature (387)..(387): n is a, c, g, or t
  misc_feature (401)..(401): n is a, c, g, or t
  misc_feature (423)..(423): n is a, c, g, or t
ctaaatgtccagcctctcaagcaacaatgtacagctttcttggtcctccangctaaggggngnaaaggnttagggntnaaacaataccaattgtntnggnttnnnnnnccatctangtnaggnnattctctagtttttgctaagntacacctggtacactgacaagtcatcacttacatagaataatgtgaagtaaattttttgaaaaataaattttagtggaacaatcctgaaggataaccccagaagaatagcnggttaccagtanggngtcagccaatttgttccagtcacttttgaatccatgttctttaatctaaaatttattctctttccctaagctgagagcttcctatcatgtcagtntctatgttatgaagaaaaggngacttaggtgggangtttttatttatcgcaactgcngcattaattgcctaggacctcaacagcttcatgaaagtctgggaaatgttcatgcataaggttattgccttagctgacttaaaattgccccatac

SEQ ID NO: 578706 - DNA, 284 bp, Homo sapiens
  misc_feature (142)..(143): n is a, c, g, or t
ttttttcccttcccaaatttttttttccggatttggccccgggggccaaaagccaccctggtagggggggggggacccccccggtttttccccgggggggggccttttaaaagggggttgttttccttccaggggggggtgnnaccattttccctaggttcccctgggggggggggggggggtttcctttttttttgggcccggttttagacccttgcccttttttgttccccccctttggggggtccctttttttaaaaaaaaggttttttttttaggcctta

SEQ ID NO: 578707 - DNA, 607 bp, Homo sapiens
  misc_feature (78)..(78): n is a, c, g, or t
  misc_feature (92)..(92): n is a, c, g, or t
  misc_feature (101)..(101): n is a, c, g, or t
  misc_feature (127)..(127): n is a, c, g, or t
  misc_feature (129)..(130): n is a, c, g, or t
  misc_feature (153)..(154): n is a, c, g, or t
  misc_feature (350)..(350): n is a, c, g, or t
  misc_feature (386)..(386): n is a, c, g, or t
  misc_feature (423)..(423): n is a, c, g, or t
  misc_feature (448)..(448): n is a, c, g, or t
gacatcatcttctggttggctggagttgtcttccttggagtcgggctgtgggcatggagcgaaaagggtgtgctgtcncgacctcaccaaangtgacccgngatgcatgtgaatcgaaccctgtggntnngctgtgtcccttttttttggggnnataacaccgtttttgggcgggtttgtgcgctgtggtgctttgcacttgcttttccgaaccccccccttgggggggttttaccagccctggggacctaggcccggttggggggggggactcccttgggccggggggcaacgggcacaatttagttcccttagggcgtttttggctttcccaaagcgtgtatgtttcnccttgtgtttgcggacacaaacccaaatacgctcgncgtcaagttcgtttatccgctttttcccattgttggnaggccgttgggcccgttgtgtgggnccagtgtggtcccttgggtcgccccatttttccccagtggtgttttccccaagggggagaacccttggggggctttggcaaggggggggaaacccccggggggctttttcccccgggggcgggcacggccttttcccttttttcccggcaaacggccaa

SEQ ID NO: 578708 - DNA, 486 bp, Homo sapiens
ctgtcgcccaggctagagtgcagtggtgcaatcttggcccgctgcaacctccatctccatggttcaagcgattcttgggcctcaagcctcctgaataactgggattacaggtgtgcaccaccatgcctggctaattttttgtgtttttttagtaaagacagggtttcaccatgttggccagaatggtctcgatctcttgaccttgagatctgcccgccttggcctcccaaagtgctgggattacaggcgtgagccaccgcacctggcctgtatgtatacaatattgagcttcattcacaggactcattttcaaagaaagtcctgatgtctgaatgaacgtttatatttttaaattaaaatgttcaggatgcaaatgtgtgtatatgtttaatagtttccctgttttactacctgtctttagccattcaaatagtgtttttgatcacatcggttaaaaggtattatcctgtttctggagcttttctg

SEQ ID NO: 578709 - DNA, 165 bp, Homo sapiens
aaaagtatctgctcttaaccaacatccccctcctttcaagtaagctgcaatacattaatcactcatcctcatcccataagagggttaagcaatgatatacatggaattacatcaaggcacttgcataaattaaaaaatacagatataaacactgtcccataaaga

SEQ ID NO: 578710 - DNA, 806 bp, Homo sapiens
  misc_feature (29)..(29): n is a, c, g, or t
  misc_feature (42)..(42): n is a, c, g, or t
  misc_feature (61)..(61): n is a, c, g, or t
  misc_feature (64)..(64): n is a, c, g, or t
  misc_feature (77)..(77): n is a, c, g, or t
  misc_feature (82)..(82): n is a, c, g, or t
  misc_feature (96)..(96): n is a, c, g, or t
  misc_feature (99)..(99): n is a, c, g, or t
  misc_feature (139)..(139): n is a, c, g, or t
  misc_feature (148)..(148): n is a, c, g, or t
  misc_feature (160)..(160): n is a, c, g, or t
  misc_feature (165)..(165): n is a, c, g, or t
  misc_feature (172)..(172): n is a, c, g, or t
  misc_feature (177)..(177): n is a, c, g, or t
  misc_feature (179)..(179): n is a, c, g, or t
  misc_feature (200)..(200): n is a, c, g, or t
  misc_feature (205)..(205): n is a, c, g, or t
  misc_feature (211)..(211): n is a, c, g, or t
  misc_feature (217)..(217): n is a, c, g, or t
  misc_feature (225)..(225): n is a, c, g, or t
  misc_feature (239)..(239): n is a, c, g, or t
  misc_feature (242)..(242): n is a, c, g, or t
  misc_feature (246)..(246): n is a, c, g, or t
  misc_feature (249)..(249): n is a, c, g, or t
  misc_feature (251)..(251): n is a, c, g, or t
  misc_feature (253)..(253): n is a, c, g, or t
  misc_feature (256)..(256): n is a, c, g, or t
  misc_feature (260)..(260): n is a, c, g, or t
  misc_feature (276)..(276): n is a, c, g, or t
  misc_feature (282)..(282): n is a, c, g, or t
  misc_feature (285)..(285): n is a, c, g, or t
  misc_feature (291)..(291): n is a, c, g, or t
  misc_feature (305)..(305): n is a, c, g, or t
  misc_feature (315)..(316): n is a, c, g, or t
  misc_feature (335)..(336): n is a, c, g, or t
  misc_feature (351)..(352): n is a, c, g, or t
  misc_feature (363)..(364): n is a, c, g, or t
  misc_feature (372)..(374): n is a, c, g, or t
  misc_feature (379)..(379): n is a, c, g, or t
  misc_feature (386)..(386): n is a, c, g, or t
  misc_feature (419)..(419): n is a, c, g, or t
  misc_feature (447)..(447): n is a, c, g, or t
  misc_feature (456)..(456): n is a, c, g, or t
  misc_feature (461)..(461): n is a, c, g, or t
  misc_feature (472)..(472): n is a, c, g, or t
  misc_feature (483)..(483): n is a, c, g, or t
  misc_feature (492)..(492): n is a, c, g, or t
  misc_feature (505)..(505): n is a, c, g, or t
  misc_feature (508)..(508): n is a, c, g, or t
  misc_feature (529)..(529): n is a, c, g, or t
  misc_feature (532)..(532): n is a, c, g, or t
  misc_feature (540)..(540): n is a, c, g, or t
gcctagagtcctggggagcttctgtccanctgtcctgcagangagtcgtttccagcccggntgncacaggatgggtnagttnaaagagaagaaganaanatgtggcaccgtttgcctcaagtacctgctgtttacctanaattgctgnttctggctggcnggccnggctgtnatggnantgggaatctggacgctggccntcaanagtgantacatnagcctganggcctcaggcaccnacntggncanancntanatcntggtggtggcgggcantgtagnaanggtgantggggtcttgggcngatgcgcaannttcaaggagcgtcggaacnngctgcgccagtacannaaaaatgctcnnaaaaaaannnctgcnggagaanatcgctggtatcctcgcctacgcctactaccancagctgaacacggagctcaaagagaacntgaagaganacaanaaccaagcgcnacaacaaaaanggccatgangctgtgacaaganctntggaccagcagaagcaggagnacnaatgctgnggcagaaacaaatcacagagactggcgagacagtgagtggatccgctcacaggaggccggtggcgtgtggtcccagacagctgctgcaagacggtggtggctctttgtggacagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgta

SEQ ID NO: 578711 - DNA, 1414 bp, Homo sapiens
  misc_feature (62)..(62): n is a, c, g, or t
  misc_feature (68)..(68): n is a, c, g, or t
  misc_feature (73)..(73): n is a, c, g, or t
ctccctgttcatcattgcctccaagacctttactacccaggagaccatcacgaatgcagagncggganggagnggttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaaaaaaaaaaaaaaaaaacaacaacaaaaaaaaaaaaaagaaaaaaaacaaaaaaa

SEQ ID NO: 578712 - DNA, 1391 bp, Homo sapiens
  misc_feature (62)..(62): n is a, c, g, or t
  misc_feature (68)..(68): n is a, c, g, or t
  misc_feature (73)..(73): n is a, c, g, or t
  misc_feature (1361)..(1361): n is a, c, g, or t
  misc_feature (1365)..(1365): n is a, c, g, or t
ctccctgttcatcattgcctccaagacctttactacccaggagaccatcacgaatgcagagncggganggagnggttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaancaanacaccaaagaacacctacacaacaaa

SEQ ID NO: 578713 - DNA, 1374 bp, Homo sapiens
  misc_feature (62)..(62): n is a, c, g, or t
  misc_feature (68)..(68): n is a, c, g, or t
  misc_feature (73)..(73): n is a, c, g, or t
  misc_feature (1329)..(1329): n is a, c, g, or t
  misc_feature (1331)..(1331): n is a, c, g, or t
ctccctgttcatcattgcctccaagacctttactacccaggagaccatcacgaatgcagagncggganggagnggttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcncnaagtctggttacaggcgtgagcacccgcgctcagcaaggcggg

SEQ ID NO: 578714 - DNA, 835 bp, Homo sapiens
agcgaaaggtgttaataaaattctattgcaaaaatttctttttctagaaaaaataaatacaaaaaaaaacaaaacgaacgaattcccaaagtaattaacaaccttttcttgagaccaacacaaaaaaaaagttggcttacctattggacttacattaacaattttaacttaccattttcctttaagggtattctaaactttttaaatggtctctgtgagagtacttcggtatgactcccataatggtatatttactgtaaaattcaaatttatctattaaaccagttacccaattatcatttatagaaaaacaattaaccattttaacaggtactactggtcctaaccaatcatattggtgaatccatttggaagctccataatagcgatattggataaactgggggaattggctctataaggtgttttttatattaaccctgacatttattttataaacccttaaccgttgagattgactcagcttacattccactcagtgggatgagctttggaagaattaactacattttcatttccaaactaccaaagtgtaatacggtattaaagtcccagtggttggacagatattctcaaatcacaattattaatttactcttggaacctggaacagttccctggtaatatattctggccttattcccacgtgtggcatagtgtatgtacgcagaacttgaagcagtttacattacccgctaaaattagtgggtacacccaggagcgccaatggtacgaacaaaagacaaacaaaaaccgctcccccagcggctgagacccggggccaatagggccgtgaaccccctcaaagggagat

SEQ ID NO: 578715 - DNA, 2371 bp, Homo sapiens
  misc_feature (2198)..(2198): n is a, c, g, or t
  misc_feature (2206)..(2206): n is a, c, g, or t
tgacatctggtcggaccatgtctaaagagttgaactgtgtgcaggtatgagcccttggttctgccagtgtctggggagttgagcctgggcatgggtgtgagaccctgggtctgtccatatctgaggaggtaggatctggtatgagtatgaggatctgggtgtgtccgtgtctgaggaggtgggccctggcacaggtatgaggcctggggtctgtccgtgtctgaggaggtgggccctggcgcaggtatgaggccctgggtgtgtccgtgtctgaggaggtgggccctggcacaggtatgaggtcctgggtctgctggtgtctgcagagacagggcccgacatctcagggaagaccacggtaagctcttcagtttgtcttgtggctgtggtcagtcatctgtagtctgccctgttggtcttcccatgtgttgccagcacctgcctgctgccttgcttcctggaggtgggttgggccagggccctccgagacgcccctgtgcaagaccagggacagggtttccggcaggaggtggggggcggggtgtgccggccctccctcagcaccttgtcctgtctctcctagtgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggttgtaggctcagcctctgattttttttttcctgtgatggtgctttatgtagcagagggcaggagcgctcagcaggacgcaggctgtgcctctgcggacacttaacactaagtggtgagcgggtctagagtggagcaaggtgccctgagaagacaatagtggggtgggggcacaatcagtcaggacggcaacttggcctgtgtcaccaaatcccaagactgttttccactcctcacctctgtgactggagaaattggatactctgttcactcgatggttctaaaaactgcattgagattatgtttgtttcgggtgaattcctggacaagaccgaggatgactgccatctcctggcaagacgctcaggtagttcttttgctttaaaaggcagatattgaaaactggaattttttttttttgagtctcgctctgtcacccagactggagtgcagtggtgcaatctcggctcactgcaacctccgcctcccgggttcaagctattctcctgcctcagcctcccgagtagctgggattacacggcgcacaccaccatacccagctaattttngtattttnagtagtgaaggggttttaccatgttgggcaggctggtcttgaactcctgacctcaggtgatctgcccgcctcagcctcccacagtgctgggattacaggtatgagccaccacgcccggcccattttaaaatttttgtagatcagtgtactgttgtaaaaaaaaaa

SEQ ID NO: 578716 - DNA, 2047 bp, Homo sapiens
  misc_feature (62)..(62): n is a, c, g, or t
  misc_feature (68)..(68): n is a, c, g, or t
  misc_feature (73)..(73): n is a, c, g, or t
  misc_feature (1874)..(1874): n is a, c, g, or t
  misc_feature (1882)..(1882): n is a, c, g, or t
ctccctgttcatcattgcctccaagacctttactacccaggagaccatcacgaatgcagagncggganggagnggttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggttgtaggctcagcctctgattttttttttcctgtgatggtgctttatgtagcagagggcaggagcgctcagcaggacgcaggctgtgcctctgcggacacttaacactaagtggtgagcgggtctagagtggagcaaggtgccctgagaagacaatagtggggtgggggcacaatcagtcaggacggcaacttggcctgtgtcaccaaatcccaagactgttttccactcctcacctctgtgactggagaaattggatactctgttcactcgatggttctaaaaactgcattgagattatgtttgtttcgggtgaattcctggacaagaccgaggatgactgccatctcctggcaagacgctcaggtagttcttttgctttaaaaggcagatattgaaaactggaattttttttttttgagtctcgctctgtcacccagactggagtgcagtggtgcaatctcggctcactgcaacctccgcctcccgggttcaagctattctcctgcctcagcctcccgagtagctgggattacacggcgcacaccaccatacccagctaattttngtattttnagtagtgaaggggttttaccatgttgggcaggctggtcttgaactcctgacctcaggtgatctgcccgcctcagcctcccacagtgctgggattacaggtatgagccaccacgcccggcccattttaaaatttttgtagatcagtgtactgttgtaaaaaaaaaa

SEQ ID NO: 578717 - DNA, 702 bp, Homo sapiens
agcggtagagacgggttttcaccgtgttagccaggatggtctcgatctcctggacctcgatgatccgtccgacctgtggcctcccaaggatgctgggattataggcgtgagccaccgtgcgcagccccgagtaatacattttcttaaaggaacacacaattaaagattgtagtgcatgggctatctcaagtagacttgtacagtatgaagtttgactatacttctattataatgcaacaatgctttgatagaaaaagaaagatcttgtcctctattatcaaacatgtagtatgactcaagcaccgtggccctttgcctgcgtgtctctctgtatttgcactgtagcttaaaccccaatgctgggcaggtcaggactcagccttgcagagggaggtggatattaagtctgggagagatgtgggatggtgagacggctattctgggcagagccggcaggccactatgagcttccccagcttgggactgcagaatggacatgccgtggctacaggggacattccatggaagatgggcatctggtgacagggtctacagagcccaaggcagagggctcttgtagtgcagattagagtggagcccagtctgggcatttcctcatggcgaacatctggatcagtcgggtaccccacatgggcatattctattaacagtcgtgatgagttgaataggagagtgagaatc

SEQ ID NO: 578718 - DNA, 920 bp, Homo sapiens
gcggtggctcacgcctgtaattccagcactttgggaggcctaggtgggcggatcagctgaggtcgagagttcgaggccagtctgaccaacatggtgaaaccccatctctactaaaaatacagaaaattagctgggtctggtggtggatgcctgtaatcccagctactcgggaggctgaggcaggagaattgcttgaacccaggaggtggacggtgcagtgagctattactccagcctggcaacaagagcgaaactctgtctcaaaaaacaacacaacggggggggggcacttaaacagagtggtgttgccccaatttgttgacccaattttgttgggggggggggtcctaagcggtggaaatcctgaagggtctataacagtgaactagctgcataattgaaagccaagcgtttctgggcagcaagacaattttccatttcttactggaattcctatgtgcggctcccaaaggtgactcgactttccaaggcaagacatgtccccatatggccgggttcaaaggatcggtgccaggcctcttatcagagtggcctaactggaaaaggctgcctacccttcagtgggaaattattcccgtgtttaaccagggtacgctctttcaacctgtctaaggacctttgggaatgcgcggaaatttctgcccaacacaaggggacgcctggtcatttaaaaaagggcgccgagcgctggtcaaccgtgccccagagttcctgaattaagcacactgtgtagagaccttctatgccggaagaataagccacacaataggaaaggggtatgcacgaccggcaggaaaaacacagagaaggataaagcagcgttgcaacagcacaaaagggctgcactagacaattgtccttcaatcccctgcccccctcgccgctccgtcacgggggtg

SEQ ID NO: 578719 - DNA, 921 bp, Homo sapiens
  misc_feature (7)..(7): n is a, c, g, or t
ccgccantccactagtctaattgtcgctatctctttcgctggacagtctcgacgcatcggctctattcaccctttggtcacccccctgcgggggtcaccccccctgtgtgtgggttccccccctctttgcgcccccccccctttgggggccttcgctccttttaatcggcgcgcctctcctcctctgtttcggaaccgccctcccccagggggtccaccggcttccctagcaaagggcaaccttgccgcttgtgaaggatcgccctgccttctcacaggggcgtttgtcgcctacccggagatgctgaagaggtctcccagtctgtcggcctcttccatcgtctgcgctccccttctgccatttcttctccgggtattttccctccccccgtatgtgccccccagggcccatgtacccacggcggtcgagcgtcgccgaccgcttggtgctcccccgcggctgccgcaggggcaacgcgaatccccttccccgccgccaccggcatattcccttgtgacgccccccctgaggcccccatttgctcgtgcaagtccgcctttacaccgcctctcccgccccacctattttgcaacgcgtcggtttgcttccccccacgtgagaccccccgtttctccacatatatctaaggctctttcccagtcatcactccacccaagagagttatcatacattctcgccctcggtaggaacaccttcctgtataagatatttctttggacccacatggtgacataatagtttcactcttccattcgttatctttccatcacccaccggaaacatccgcaccttccctacttataaaagcgcgaagcggagatttccccatcccctgctttcagaaaacattccgcccccgttctttaccaccaaaaagggtttcccccacatgtacgcaa

SEQ ID NO: 578720 - DNA, 1103 bp, Homo sapiens
  misc_feature (62)..(62): n is a, c, g, or t
  misc_feature (68)..(68): n is a, c, g, or t
  misc_feature (73)..(73): n is a, c, g, or t
  misc_feature (930)..(930): n is a, c, g, or t
  misc_feature (938)..(938): n is a, c, g, or t
ctccctgttcatcattgcctccaagacctttactacccaggagaccatcacgaatgcagagncggganggagnggttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacccaccatacccagctaattttngtattttnagtagtgaaggggttttaccatgttgggcaggctggtcttgaactcctgacctcaggtgatctgcccgcctcagcctcccacagtgctgggattacaggtatgagccaccacgcccggcccattttaaaatttttgtagatcagtgtactgttgtaaaaaaaaaa

SEQ ID NO: 578721 - DNA, 580 bp, Homo sapiens
taaagttaaaaagaaaaaaattatagtgagaatgagattcatttcaatgtaatgcactaaagcagaacacgaacttagcttggcctattctaggtagttccaaatagtatttttgtgtcaaactttaaaatttatattaattgcaaatgtatgtctcttttttttttttaaagtatttcagtgaaacactgggtgtaagtctgaacccatctttggaaatgtatttcttcatggcaggtccacctaatcatctggtgaaagtggttctctatggaaagcttggttggcttcctacaaatacatgcttatcccttaagggatgtgtagagttactggggattctctgtttcgggtcttacaagaaactggttctatgtcaccttaaatacttgggttaaggatgaggagtctggggccccctgtaacaggtagtctgacgttatttccctcttctgtcccttagtaagcccagttgctggtatcttgaacagttggagctctttggaatatactcctaaacctgtatttctggggtaataacggagatgccagaacccttggaaaaaaacaaaaaaaatac

SEQ ID NO: 578722 - DNA, 806 bp, Homo sapiens
  misc_feature (77)..(77): n is a, c, g, or t
  misc_feature (633)..(633): n is a, c, g, or t
  misc_feature (641)..(641): n is a, c, g, or t
cctccctatattctgaagtttggaaattgggtctcttttcctttcctcctgtttagcctggctaaaattttattgantttaatgaatttttttttcctgtgatggtgctttatgtagcagagggcaggagcgctcagcaggacgcaggctgtgcctctgcggacacttaacactaagtggtgagcgggtctagagtggagcaaggtgccctgagaagacaatagtggggtgggggcacaatcagtcaggacggcaacttggcctgtgtcaccaaatcccaagactgttttccactcctcacctctgtgactggagaaattggatactctgttcactcgatggttctaaaaactgcattgagattatgtttgtttcgggtgaattcctggacaagaccgaggatgactgccatctcctggcaagacgctcaggtagttcttttgctttaaaaggcagatattgaaaactggaattttttttttttgagtctcgctctgtcacccagactggagtgcagtggtgcaatctcggctcactgcaacctccgcctcccgggttcaagctattctcctgcctcagcctcccgagtagctgggattacacggcgcacaccaccatacccagctaattttngtattttnagtagtgaaggggttttaccatgttgggcaggctggtcttgaactcctgacctcaggtgatctgcccgcctcagcctcccacagtgctgggattacaggtatgagccaccacgcccggcccattttaaaatttttgtagatcagtgtactgttgtaaaaaaaaaa

SEQ ID NO: 578723 - DNA, 665 bp, Homo sapiens
  misc_feature (53)..(53): n is a, c, g, or t
  misc_feature (633)..(633): n is a, c, g, or t
caattaggtcttgaaggaagactttaactttggatttttcaatgtgtaatgangaagaatggaaaggccattctaaacagaaagataaagagagcaaaggaaaacagttcctcctgaggatttcagagaagagctggacttcctggctgactctcacattctcttcttctgaactgcttcttctggtagctccctgtcactttggacaagctcgcactgccctccttggctgttctggaactgtgtgatggacttcatcctactaggacacagttgcttcttgaattccccagataaacacccacccgtgtgaatgacaagccataataaaaattaattgtcaaaattaatcaacaaggtcccaaacaagattgagagccagggggacagaagtgccaccggtaattatatagtcacaggcagacctacgaggatgttcatctttcctcttaaggacaacttggaagttacagacgttttcttggaacttaaaaagttttgataggccccttaccccaaagaaatagaagcattggaaaatatgttaaagaaatttctatgaaattaagacaaaatgacttattttgcaagagaaaaaataagtaaaaggctaacctcttggaagtccacatncaatctaataggtgttcccagaatcagaaaaa

SEQ ID NO: 578724 - DNA, 595 bp, Homo sapiens
  misc_feature (311)..(311): n is a, c, g, or t
gtctcgtcagcttgaaatgattattcctacaagtgataacacgtaggacgtattatggatgtgtactatgggccttgtctgattatggcgggagtataatcctatgtatgtttttgatttacgtggcaataaggtttaagaggattagatatgtaatataggattcacactaagggagtataaggttgagctctagtgccctattataacacctgatttgcatccaagatatatttatactcgtgctgggtacccacaacatagagcatctactacacacccataatgataggaaaacatcattatttgtngcaaaagaaaaattcccaatgtttggtgtagaacattgtttattttatttaaacaaccaggggaaccaccctagtaaacaaggaggtggttttacaattacatcacgttttatgggtaaaaaagggcgaaagcaggaaagggtgcaaaatttggtgggcaaaaaaaggcataagttggacgctgagggagatcgcgcgttggaacttaaaaacaggagggggaaaatattttgaagaaaaaggtgttagacggggaatagaatagaatatttatagataacgta

SEQ ID NO: 578725 - DNA, 888 bp, Homo sapiens
tgttgtggacatggaagagtttagtcaacacaacactttgtccccgctccgggagatgagtcagatggtggcttgagtgtcacttggtcccctccgccctcgggtggcccctttgcagtccccattagcttagtgatcaggtgtgagagtggcacatattccttacctttgatccctgtaaagcagaacggactcctttgacaggcaacgaaactactgtggtgagcagaatgatttcctttttcaagacaacacctgcctggttctattaatgtgtgctggccatgataattgccaccaaatccggcccacctgaagtgttccctaaggaacagcatgctctgctcctcaaggtcaaccccgtaggccctagagcagtgtcacaaggcttcagtaaggcagtcagctggaagctcaggctaccggcatagtaacactgtattcaggtctacagaccacactctagtgtttgccatgaacaggtatacaaggtgaagaattctaggcaaaacatgtataaacccatcagtgctcagggcctctctccattcgcgcgagtcagtctactaaccctatgacaggtaagatactcctcacgctcaccccggcgggccggccaatgagggcgggcttggcgaaccacggccatccacttaaggccaggcaagcctacaggaaacaacgaggtcctagcgggacgagaagacccaagagataacgtccacaagcagcccaagaagggggtggcaacacatcagggggcacacagggaaaggtaccaaaggccacgtcggaagacacgacacaacaaggacatacacgagacgcaacccggacggaacaaaacgcacaagaaacaacagccgactaacagcctgtgttctgtta

SEQ ID NO: 578726 - DNA, 490 bp, Homo sapiens
  misc_feature (361)..(361): n is a, c, g, or t
  misc_feature (468)..(468): n is a, c, g, or t
  misc_feature (470)..(470): n is a, c, g, or t
ctaggaaacaggcgaactggcgaactccttggacgttgaccatcgaagtagtactcccggattgaagcccccattcgtataataattacatcacaagacgtcttggactcatgaactggccccacattagggcttaaaaacagatgcaattcccgggacggtctaaaccaaaacactttcaacggctacacgaacggggggtatactacgggtcaatggctcctgaaatctggtggagcaaaccacaggtttcatggcccatcggtcctagaaattaattccccctaaaaatctttggaaataggggccggtatttacccctatagacaccaaaagggaatctcaaagggaaatttggaanacagaaactggtataaatccaaaggtggactggtggatactgggagtaattcctgtgctctggaagacagaaagcagaagactcccacaggctggcagaagaagacnantgacagggagaccaacaaaa

SEQ ID NO: 578727 - DNA, 663 bp, Homo sapiens
  misc_feature (631)..(631): n is a, c, g, or t
tgctccctggtgtccccaagatttctcattttttgggttaccacttccttttcattttaagtaaaatgactcaagtccccaacccctgtgtttacaggaaaacagttcctcctgaggatttcagagaagagctggacttcctggctgactctcacattctcttcttctgaactgcttcttctggtagctccctgtcactttggacaagctcgcactgccctccttggctgttctggaactgtgtgatggacttcatcctactaggacacagttgcttcttgaattccccagataaacacccacccgtgtgaatgacaagccataataaaaattaattgtcaaaattaatcaacaaggtcccaaacaagattgagagccagggggacagaagtgccaccggtaattatatagtcacaggcagacctacgaggatgttcatctttcctcttaaggacaacttggaagttacagacgttttcttggaacttaaaaagttttgataggccccttaccccaaagaaatagaagcattggaaaatatgttaaagaaatttctatgaaattaagacaaaatgacttattttgcaagagaaaaaataagtaaaaggctaacctcttggaagtccacatncaatctaataggtgttcccagaatcagaaaaa

SEQ ID NO: 578728 - DNA, 321 bp, Homo sapiens
  misc_feature (305)..(305): n is a, c, g, or t
agacagcatctggctctgtcacccaggctggagtgcagtggcgcaatctcggttcactgcaacctctgccttccaggttcaagtgattctcctgcctcagcctcccaaatagctgggattacaggcatgtgccaccatacccagctaatttttgtattttcagcagagacggggtttcaccatgttggccagactggtctcgaacttctgacctcaaatgatctgcccatctaggcctccaaaagtgctgggattataggtgtgagccactgcgcctggcccttgggtaaacacttcaaatgcanccaaccattaaaggta

SEQ ID NO: 578729 - DNA, 630 bp, Homo sapiens
  misc_feature (7)..(7): n is a, c, g, or t
aacgctngatgccgggaggacgcattttgcctacccgatagacgaagagcgctttttaaacagcctcggtgttactaattcatgcgctccgcgggagcctctccaggggcccagaatgacatttcaattactgataaatcatgacccatttctaagggaaggagcagcccatgcatttgcacagtataacatggaccagtttactccagtaaaaatcgaaggttaagaagatcacgtattgataacagaacatggcgacttgggaaatggaaagtttctggatccaaagaacagaatctgttttaagatcgctcacttaaggaaggacgtttctgatccaagaccctgggaagtaaaaaatgcaggtgaaatatggagaacttcaaaaaaaactgcattgagagcttacgaaaaaaacattacccgaacggaggctgcactgagtatggcaaaaaaatagatggaccgcaaaccataatggcatcctaggaagccatcgggtccaccaaaaaatctctgggaaggccgtgggggtcagaaggaaagttacaataactgcttaaccactcaagggggggcaaccagaaatccaggtcataacaagaaaagggttggtcacctcggagccaa

SEQ ID NO: 578730 - DNA, 222 bp, Homo sapiens
cgagccgtacggttctcaggagtatgtcgcacaacctgggtatgacactcggaagcgatgactatcacctcctaaaggactagaggaagcatccaaacgctgatggggaggctggaaagacggcagccgccggactgggcagatcctcaagcagacctacagcaagtttgacacaaactcacacaaccacgacgacacgaccacgacgaattccgaacgacg

SEQ ID NO: 578731 - DNA, 919 bp, Homo sapiens
gaatctctgagtccgtgcttatgtacggccaatgcgcgaccttatatctctcgcacgagccgcacagacacccggtaatgatgcgtcagcttatcctacttgctacatcagcacattgcactgcagacagatatccatgatatctgcactcaccatgttcccagtctgtacatacttgaaattgggatcagtccgcagttgtgctcaatgcgcgtaggcgtggtgagaccatgacttggctatattagtgatcactctcaagcatataccgaatagaggaattcctactcgatttatgaagtagtcatctgtacatattactatgctcaatttcattataaccgttcacctagcctggataaaaccaagacctcactaataggtaccatggcttttagaccattggcaggcataggtgaaatagggacttgtgtacttggcgcaatatttagagacagaggccgattaacaaggtctacctcaggttcgtagctagaaatggcggcgtcatcgactattcaatacataagacaaaacattgaacttcgtgatgaccatactgttggtccaactctctttgatttcgattctaattaatatataaacatcatcatataagttgaaaagcgctttatctagaaattgcttgcagtaagtccaagcctgtgttctgaagagagattccccgcgagtataggtatactaaatggaagaaataggtctattcaagcttctgaaatcggattttcacccttcctcggcttgggattccttgaactttgattgatacttttcaatagatacgacttggattccagaaacataaggatgacccaaggctggtgataaacttttacggtaaaaggggccatgactttaggaatttttaaattccgtcgcttgaaatcaacatggtttc

SEQ ID NO: 578732 - DNA, 124 bp, Homo sapiens
ttgacatgatacgactcgagcttagtaccctcgataaggcaagaaagtgtgtgggaagaaagtagatttacgccgatgaatatgatagtgaaatggatttggcgtaggttggccccttatcgag

SEQ ID NO: 578733 - DNA, 881 bp, Homo sapiens
  misc_feature (5)..(5): n is a, c, g, or t
  misc_feature (80)..(80): n is a, c, g, or t
  misc_feature (114)..(114): n is a, c, g, or t
  misc_feature (123)..(123): n is a, c, g, or t
  misc_feature (133)..(133): n is a, c, g, or t
  misc_feature (278)..(278): n is a, c, g, or t
  misc_feature (335)..(335): n is a, c, g, or t
  misc_feature (490)..(490): n is a, c, g, or t
  misc_feature (553)..(553): n is a, c, g, or t
  misc_feature (583)..(583): n is a, c, g, or t
  misc_feature (590)..(590): n is a, c, g, or t
  misc_feature (613)..(613): n is a, c, g, or t
  misc_feature (622)..(622): n is a, c, g, or t
  misc_feature (652)..(653): n is a, c, g, or t
  misc_feature (678)..(678): n is a, c, g, or t
  misc_feature (681)..(681): n is a, c, g, or t
  misc_feature (691)..(691): n is a, c, g, or t
  misc_feature (693)..(695): n is a, c, g, or t
  misc_feature (697)..(697): n is a, c, g, or t
  misc_feature (771)..(771): n is a, c, g, or t
  misc_feature (810)..(810): n is a, c, g, or t
  misc_feature (835)..(835): n is a, c, g, or t
  misc_feature (843)..(843): n is a, c, g, or t
tcatnactgaggagttcgtccaaatgaattacctgaaggaccagcgcgtcccatacgtggagccgcccgaatacgagttnttttggggctcccgggccagccgcggaatcaccnagatgcaantcatggagtncctggccagggtctttaagaaagacccccaggcctggccctcccgaaacagagaagctctggaggaggccagagctccgcgggaggcaaatcccactgcccacaaccctcgcagcagtgtctctgagcactagcaaagtctggangcagataaatggtatctgaccctcaccagggctgtggaagggtgggggtgggtcatnatagtattcaggatttacagtgcagtattcacgtgtaacttttaagttttcagaacagtgcttttataccttaaatgcaatgtagaattcatttgggtactattgtgtagtatttaggatgtatgcatgtttgtttatatgtaagcttggttggngctttcgcttttgtgctacctttcttggatttttgtaccagagatgtgctaaactgatgaaanacattgagaaagtttccatctaattctttnatatggnactgatgatgtgtgttggggtanactgctccngcagagtttggaagaagtcaccagcaaaanncggcctaaccaagaaaagtcaaggnccntcatgacctngnnngnggcacaagaaaacatccctctgtggaggtacacataatttgaactggactggttctcaagtgtgagcacttggngcacacttttactaaagcacaatatacagaccccaccgnctgagtgcaaactttaaagctaaancattaaangattcttgtgatacaatacagaaaaaaaaaagaaaaac

SEQ ID NO: 578734 - DNA, 436 bp, Homo sapiens
gcatcttacaatacaagtacaaaaattatcagcagcgtagaatggcgcccacctatggtacgcagtttactatgggaagctgaggcaggcgaatcacttgaaccgaggaggcggaggctgctgagagccgagatcacgccactgcagcttcagcctgggcgagagataaagactccatctcaaaaaaaagaaaagactgagagacagcaaacgagacagtagggtttatcaggggaacttacttacagggatggtccagtggtggcaggttggacaggagaaccactaccatttgtaaaaaacatacagtttatatagcattttcacttagcaccctccacctagcaaactcctataacccaaaagaaaaaactcaattaaaaaatggaattagctgggtgtggtggtgcccgcctgtagtcccagctactcggga

SEQ ID NO: 578735 - DNA, 844 bp, Homo sapiens
  misc_feature (23)..(23): n is a, c, g, or t
  misc_feature (73)..(73): n is a, c, g, or t
  misc_feature (82)..(82): n is a, c, g, or t
  misc_feature (87)..(87): n is a, c, g, or t
  misc_feature (181)..(181): n is a, c, g, or t
  misc_feature (318)..(318): n is a, c, g, or t
  misc_feature (344)..(344): n is a, c, g, or t
  misc_feature (356)..(356): n is a, c, g, or t
  misc_feature (386)..(386): n is a, c, g, or t
  misc_feature (389)..(389): n is a, c, g, or t
  misc_feature (435)..(435): n is a, c, g, or t
  misc_feature (454)..(454): n is a, c, g, or t
  misc_feature (465)..(465): n is a, c, g, or t
  misc_feature (491)..(491): n is a, c, g, or t
  misc_feature (508)..(508): n is a, c, g, or t
  misc_feature (513)..(513): n is a, c, g, or t
  misc_feature (528)..(528): n is a, c, g, or t
  misc_feature (537)..(537): n is a, c, g, or t
  misc_feature (560)..(560): n is a, c, g, or t
  misc_feature (571)..(571): n is a, c, g, or t
  misc_feature (573)..(573): n is a, c, g, or t
  misc_feature (576)..(576): n is a, c, g, or t
  misc_feature (663)..(663): n is a, c, g, or t
  misc_feature (667)..(668): n is a, c, g, or t
  misc_feature (679)..(679): n is a, c, g, or t
  misc_feature (684)..(684): n is a, c, g, or t
  misc_feature (696)..(696): n is a, c, g, or t
  misc_feature (701)..(701): n is a, c, g, or t
  misc_feature (706)..(706): n is a, c, g, or t
  misc_feature (714)..(714): n is a, c, g, or t
  misc_feature (720)..(720): n is a, c, g, or t
  misc_feature (732)..(732): n is a, c, g, or t
  misc_feature (744)..(744): n is a, c, g, or t
  misc_feature (757)..(757): n is a, c, g, or t
  misc_feature (772)..(772): n is a, c, g, or t
  misc_feature (815)..(815): n is a, c, g, or t
cgccgccgccctgcccctaaacntctgccgtagctccctttcaagccagcgaatttatcccttaaaaccaganaccgaaccncggcncgggaaaggagtccgcggaggagcaaaaccacagcagagcaagaagagcttcagagagcagccttcccggagcaccaaccccgtgtcgggagtncagaaaccaacaagtgagagggcgccgcgttcccggggcgcagtgcgggcggcgggagcaggcgcaggaggaggaagcgagcgcccccgagccccgagcccgagtccccgagcctgagccgcaatcgctgcggtacnctgctccggattcgtgtgcgcgggcngcgccgagcgcnggggcaggaggctttcgtttttgccctggnttncaaagcagcgggctggggagcagccgggtcccctgggggaaatatngcgggcgcgctgttggatncttgctcaccnttggggctttggttggccttgcgttnttgggcggaggttgaanaggcngaggctgacatcctnataaaaganatcgtacctttgagcaacacgcnccatttgaagnangcnttcagggagttgtattcctatttgattgaggaatgactaacgctttctgcgttttgggctcggggagcccgattgagggattgtagnagannttcaagagctngacanacaaactccganccacnttccnaaagatanctgttngacttagtgctngctccaaaaagntggaaaccacgancgcttgaatatacangaacaagatacctgctccagacaaagttaccttgaagaaactngataaagagaaagttcacctctcttgact

SEQ ID NO: 578736 - DNA, 1398 bp, Homo sapiens
  misc_feature (221)..(221): n is a, c, g, or t
  misc_feature (304)..(304): n is a, c, g, or t
  misc_feature (570)..(570): n is a, c, g, or t
  misc_feature (1398)..(1398): n is a, c, g, or t
ggcctggggcacagggtagaggctatgggatgaggtgccatgcacaggattccccttccggatgcgaggcgaggcctgcggtccctatgagtcctccctgtcattccagagcaagagcctgtaccttgtccatcgcttcccctaatgcgcctgcatcctgctggtgcatagatgcacttcaagtcacagtggagctgcttggactgtagacgcgatgcatngtacatatggtgcctgctacgggttggctgtcgagaaacgcgattgtgcttgggcgacgatccacgagagtctgtcatcgttnctcttagtaaccgtgccacgctctcgcacgtagcctcatgctagtctcggtgcctcataacgaacctcactctatggcacggtaagactctatcccacatactccttggcctgaagacttccacccgggaccatgtaacgctagcatgacgctagacacctggcacttgagaccttgtcgtgcgtgccacggctggccctccctgggtgttcttgtcagctctggtaggtcggttcgtgtgggggccatctatcctagtgagtgcnctcgagacggcccttgtgtcatacgttgccaacaccgtgggtggtttacccgtgggggcggcacgggggttcgtgaggtcagggggatcccccgtccaaggggcaattactccccggacaatagcccgctcgctccgagaaccgccactattggccttttgtgcttttgacctttgtgccctcctgtgaagacacttggttggaacttcccagtcccacgggttccttgtctgcacgtgccccaggaaacgttacttgcgatatcttcgaggagcaaggtgcaatgggacctgttgcacccttgtcaccgaggagagcaacggcggcaaacagccaaggcctggcctgttgttaatctctctaaccacatgggctctattgttaaacccggaaatacatttatccctggggcgcgtcattgacagcggagactaggaggaatcccgatggattaaccgccagttgcggtgataggagggggccccatgggtgatagaatggtacgacccgtgagagattgcctggcatgaacaggcactggggaccatcccctattgagacatggttggcctgatggattgcttacccatacgacaggggtgcgaccccgcacagtaggtagcaaaggaggcacgttgtcatttcccccatagagcaataacagaggaaggccctctagcgcacacatgccccagaaccccaccgtggcctacacaggcatactatggacaaacgatatcatagacgacttacgcatatatagtgagctggaaagagaggcccgaccagataaacccaagactgtcaagggacccaccagataacgcn

SEQ ID NO: 578737 - DNA, 163 bp, Homo sapiens
ggtgactccccgagcttattatcccaacacccccccgtggcgtatccgcaatggcgttctgcagattggcgcactgttacttgaccttgtcaaactcggctctcagcctctggatcatccggttcatctcagagatctcatgcttggtgtatgggctataaca

SEQ ID NO: 578738 - DNA, 561 bp, Homo sapiens
ccgggcggctccacctccccggtttatcgtcgtggcgggggggggagttcatttttcccagggacccgttttgcctctcggccctttgttgggcccttatacacaagttttgcacaaaaacgggggggggccgggtcgggtttctccgggtattttttcacccccgggcccgggtttaggggagggccccaaaaaagggtgttttttttcccccccccccccaagggggtttggggttttttccccccgcaccaaaaaaggccccccaaaaaagggggggccccccggggtttttggggtttggggcccccccctttcccccttcccgggggggtgggggcccgccccccccccgtggggtttttcccttggggggtcccggggcccccccccggggggtttcccttttccccgggtttgcgggggggccccttttggtttcctcccccccggggggcccttttcccccggggcccccccggggggggggggggggcccccccccccggttttttttttttttggggggcccccccccagttttttaaggggtttttttta

SEQ ID NO: 578739 - DNA, 400 bp, Homo sapiens
cgatgcacgactgaaggagccagacacagcgtggagggcttcccagtcgtctgccttcttcctgactgctccaccccagcctgctaagtctgctgccagcggctgcacctccagggccagggtgacagtccccatagagccccactcctgcccggtccaggctgctctgggtgcgtcagtcgcaaacacgcacatgcacacttataacgctctacgcttacaaaaataagatgcatctccatcagatcatgtccttagttattcccttttttgaaagacaaaaataataagttaccttcagaagaccccctttgctcaaaaaaacccttgatttccctctgtgggctttactttcctttttaaaatacgttgctctttccgggaagctgctgactcgtgg

SEQ ID NO: 578740 - DNA, 335 bp, Homo sapiens
aggatctccggcactgcttcggatgaactcttaagcggagggggggataagctggagttacacggttgagtttaccagggttggaggctcaggaagaggtctgaagagttgaactcagcaactctgagagaaggggtgctgctgtgtgctgctagaacctccaaggagggggcttggcgggatgtgatgaggctggtcttgtgaataacaggcattgggtagcttggtgtcgttgttaatggtgatcgtgcttctcggcctcgaagagcaagcacgactcgaaggctggaggggcgttcaatgctaccgccgccgtcgcgtgcagagaccaaggg

SEQ ID NO: 578741 - DNA, 502 bp, Homo sapiens
tccttcttagtcgtgtgtacatcatggggaagggagggaaataaatgacgggagggtcgctgctttttaggtttcaaatggacattccagaacaaggcggtgcctgagcccgtgcctgtcttcagaatcttcagcagcacagttccggggaaggtgggagccaccagcctctccctgaataactgggggagatgaaacaggaagctctatgacacactggatcgattatgacagacactgaaaatcacgatctcatccccctccagcacctctacctgtggcccgccgatcacagccggaatgcagctgaaagattcccgggggcctgggttccaactggcccactggtggactctgaggcctctgcattggcgggtgggtcttgcctgtgatatttgggtcatggggctgggtctgggtcggtttcccatttggtctgggccagtctcggtgtgtctataatccctggtccttcattaaaagcaaaacctaaagaaacaca

SEQ ID NO: 578742 - DNA, 135 bp, Homo sapiens
aattttgctgatcctctcaaataacaaatttttgggtttgatgatatcggttattgttcttttttctatttcatttatttatgctctaatctttattatttcctacctcttggcttggtttcccttaacaatggg

SEQ ID NO: 578743 - DNA, 896 bp, Homo sapiens
cctatgcgcctggccgcgtttcatttgtctccgccgcggcgattgtggcgccatcttactcatatgttctgcggcgcaatctggttcccttcccggcacccgtgccaagccccggttctaatgccgctcctgggttccagcctggcgcctccccttcgtgggacgccaacccgtgggccccactatccgggccattcacacagcccccggcccagatcctgcggaaggggttttattctcccgggccctcttttacggagggtcctcttaacccgcgtctcggagggaccccccccccgcttgtgtgtgtgtgcccccccgcccagcccgagggcgccgtctttttccaagggtgtaccctcaccgcccgggcccgggctttttgtacggcccccctcccggatgtgccccccggatatgtgggccacttctcccacaaaatcctggggggccccagcacttttgcgcagcgctggtgaattcccttaggggccccccccagaacctatcacacgtgtgtgccgcttttaacctgtgacgagtgatgaaagaatacttggggcgctttcttttttaaatcggtgccacccacgaggacggacccaagagccacttgggaagtttttacaaggtttgaatgcgtgcgcaatttcccaatgccgaagtgcacagtacacgcgagtgggaaaaaggaataatagtggtaaggccccggggaacacccccgaaatgaggaggagaacacgaaggaagggggaaccctaacaacggagcaccaaccctgggacaaggagcacgagaactttggggcactccccgccccccccacaccccaaacagcccccgccttttccccccccgcccccaaaaaattttttttttgggcccaaaaaaaa

SEQ ID NO: 578744 - DNA, 124 bp, Homo sapiens
  misc_feature (90)..(90): n is a, c, g, or t
ggagttgggcaagatttgattcggagcaggtgtcaagacgtgtttgggaacttaggatccagttgaatagaagccagtagaggaggaatntagaggccttctagattaagaccgattctggaat

SEQ ID NO: 578745 - DNA, 220 bp, Homo sapiens
aaaaatttgttttggttaatgtcccccatttacacttttcggcaaatttggttgcaaacaaatggtttttttttatttttcccttggtttggggtttgtaaattgccaaaaatgtacattgaatttcaccttgtaaaagttttattttttcccttgtttggtattacccaaaaaatccctgtttttttgaaagggcttaataaatttttttggtttccca

SEQ ID NO: 578746 - DNA, 347 bp, Homo sapiens
  misc_feature (19)..(20): n is a, c, g, or t
  misc_feature (26)..(26): n is a, c, g, or t
  misc_feature (53)..(54): n is a, c, g, or t
  misc_feature (68)..(68): n is a, c, g, or t
  misc_feature (75)..(75): n is a, c, g, or t
  misc_feature (79)..(79): n is a, c, g, or t
  misc_feature (84)..(85): n is a, c, g, or t
  misc_feature (99)..(99): n is a, c, g, or t
  misc_feature (182)..(182): n is a, c, g, or t
  misc_feature (209)..(209): n is a, c, g, or t
  misc_feature (267)..(268): n is a, c, g, or t
  misc_feature (289)..(289): n is a, c, g, or t
  misc_feature (343)..(343): n is a, c, g, or t
cctctgacttacagcgcgnncagtgnccagttgaaagagcgcaacagctcctnntcccttccacaggnacacccnagtnctctnngcactccttctctnagtagaccttgttcccgttgccttgacagccccgttagggaaagagcacgcacttccccttgacagcttcaaatgcccagagntgaataaggctcgccaggggccccggnctgtgacaaagttgtcaccgttgcccatacagccgcggtactgaaatgtctcacagcnnatgatatgtaccattataganataccttgtgtgtcattcacatacagggcgcgccagagtagcacatctgacagntatc

SEQ ID NO: 578747 - DNA, 135 bp, Homo sapiens
atccttatttgttgtgggtagcataacgcaggacgtgtaggggcgctaagatccaggacactatggcaggctggggcgggaatccctgtggtctggacagtgagggcggtgaaaaaggatcctgtacacctccct

SEQ ID NO: 578748 - DNA, 454 bp, Homo sapiens
tttttttttcacactctgtttctcttgctctctctcatgcagagaggagacagagaaataataaagtgataaaggatgtcattaaaatgtcatgaaagaagaattgaaaatggcaaataagtgtatgaaaaaattttcattagcaatcaaaacaatgaaaattgaaatgaggctgggcacagtggctcatgccggtaatcccagcactttgggaggcccaggtgggaggatcacttgagcccaggagttcaagaccagcctgggcaacacagtgagaccctgtctctacaaaaaataaaaaaattagctgggcatagtggagtatacctataatcctagctacttgggaggctgaagagggaggagagcttgagcctgggaggtcaaagccaccgggaactatgattgcctcactgcactccagcctgggccacagagtgagaccctatctcaa

SEQ ID NO: 578749 - DNA, 341 bp, Homo sapiens
ttttgttttgggacccaaccccgggttttcatgaaaaaaaaaagccagacccttagtttgggaacggcggttggggtgccaacctttttttttcagtttggccgggctagcaaaaaggggcccttgttatgtaaataaatccccttaggtggtcaaaatcaaaatttttcccccccttttttcctttgggggggggtttttttttccccccccccccctttttgggggggattttacccccttcagggcccttgttccccatattttggaattttcctttggttttgttcaagtcaaaattggccaaccccaataggaaagggcccaaacccccaaaacca

SEQ ID NO: 578750 - DNA, 283 bp, Homo sapiens
  misc_feature (127)..(127): n is a, c, g, or t
  misc_feature (131)..(132): n is a, c, g, or t
  misc_feature (150)..(150): n is a, c, g, or t
  misc_feature (161)..(161): n is a, c, g, or t
  misc_feature (209)..(209): n is a, c, g, or t
acagtgcagtgtaagcattaccatgatctgtaggtaagaaggcagattattagagaattgtgaacatatgttgcagtgggcagctcagcatagaaggggctacctgcaggaggcagggctggagganagtnntatagggtcctggtaagngtgctatgtgngaaatgaggtcattgtgcccgcaggttgtttgtgattagctgtctctnacaattgttcatacaataattgttcattattgttctcaacttggggctctccccaacctggggacccttcctta

SEQ ID NO: 578751 - DNA, 165 bp, Homo sapiens
ttcatttctacacgattatacagtgagccggatcttactgctctcctctgcttcacgaagggccgcaggagtcatttggtaatcataagtgccatataatatacatgaagcactttgctggtggctctctgtgcagtacttgtcccgtaaacagccgatgggcgt

SEQ ID NO: 578752 - DNA, 1471 bp, Homo sapiens
ggggttttttataatgaatgtgtggcgtgctcgcttggtggtgtggtgttgttccacgcgccatcgtccgctcgagtttttgttctcctggtgggggccgcccccccggtcgcacgggtggtaaaatttttgtggtgggggctgcgcacgcgcccccacggggggtttttctcattggggggcactatcggataggtgtttctttcttggccgtcttgtagatcggccccgaaaagtagggtgttgtcgccccccatgtgtggagattatattctccgcgggagatcctttttttttttgggggcgcctcattgtgagagcctatgtctccggagagaccctgtgttgtggggggcgcgcccccctcgtatataaaattagggcttcccctcttgttttttgggggaaatataataaaatcttgcgcccgataattccccactggatataagaaaatcgtgattctttccgcccacaggatatacaggatatataagataaaaacaccttctatttggggtgtgtgaaaaatatgtgtaaagaccttctctcgggggcacatcgccccctctcttcgagaaattgggaaatattggctagacctcgttttctctttagagaaaaaatatatagatatatagtcgctcgccctctcttatggagccccttttactatagagaggagataataaccccgctctcatgggtgagatggtgtatgagagagataccccacatctgtataaatatatggccccccgctgataaaaatgtgtgtctcttctcagcactggtgtttctctctccaaaggcgggttattagcttttgggcgagtttctcctcgcagaagacaggatcttttggggtgtctccacagagtgtcccacacacacacacagagacacacacactgctgtgctctgtgtgtgtgttatgtagagccttctcacagtgtgttttgttgttttctcatgcagagaatatatagaggagatacatcttctgggctcacacacacacgcgccacacacatagattgtgtggtgtgatgacactctttgtggtgtgggtgacccacacacaccacacatactcacgtgttgtctctcacacacaatatatgagaccgcgctgtgtctcttatataaaagaagtgtgtatatgaatatatatcgcagggtgtagcctctctctaataaccacacacccaccctgcggaacccagaagggagaatggagctttgtggctttagtgatattcacctctgggatagcccagatgtttcgtgaataccactcgacatttatagtcgccaaactcggcgccacgaaatattttatttaacttcttttgccgtgttttggattacctgctttttgctttccttttggtttggttttgtataaaatgataaaacttccagaaaattaaatgtcccgtgcttgaattaaacaaaaataaaaaaaaaa

SEQ ID NO: 578753 - DNA, 360 bp, Homo sapiens
ttggataaacagcaccgttcggcggcggtattcttgcgcgaaatcacagctgaagatgtcttggaagtaacagacaagattgcggctgagggagcataaatggagccttccttcgtgcttgcccaaagtctgggcgagaactttgctcatgccgcgacgtctgggccactggtcttgggaatgctggcagccgctgctgcggacttagtttcctttgcttctccttgcgtggtcccgctcgtgcccggctacatttcctacctggccagcattgtgggtggggaggtaacgcatgacgtgaaacgtggcgcggtcgtcggcaagcgccccagtggtctgtggtgggttccgcgctgctgt

SEQ ID NO: 578754 - DNA, 104 bp, Homo sapiens
ggatttgctggtgcagtacaactaggcttaatagggatatataatgctctcagagattatatagaaaacccggattatcacaaaagccaaaggagaccaaaaaa

SEQ ID NO: 578755 - DNA, 403 bp, Homo sapiens
gagacggatctccctccgtcgcccaggccggagtgcagtggcgcgacctcggcccactgcaagccccacctcccaggtccacgccattctcctgcctcagcctcccaagcagctgggaccacaggggcccaccaccacgcccggccaatcttttgcatttccagtagagacggggtttcaccgtgttagccaggatggtctcaatttcccgacctcgtgatccgcccgcctcagcctcccaaagtgctgggatcacaggcgcgacgaccgtgcccggccaagtactgttaataggacaaaactggacagtgtgaaagagcctggggataggagcccccccccgcccttttttttctttctttgagacagagctcactctgtcacccaggctggagtacagtgg

SEQ ID NO: 578756 - DNA, 658 bp, Homo sapiens
cgtggtggctcacacctgtaatctcagcactttcggaggccaaggtgggtgaatcacttgagcccaggaattcgagaccagcctgggcaacatggtgagaccttatctgtacgaaaaatacaaaaattagttgggcgtggtgggcatctgtagttccagctacaaggaggctgaggtgggaggatggcctgaactcacaaggaggctgaagtgggaggatggcttgagcttgggaggtggaggttgcactgagccaaaatcgcaccactgcactccagcctgggcgacagagtgagaccctatctcaaaaataaatgtggtatatatacaccatgtgatactacgcagccatgcaaaagaatgaaatcatgtcttttccagcaaaatggatgcagtcagagactattatcctaagtgagttaacctagaaaaccaaatactgtctggtctcactcgcaagtaggagctacacactgaatacacatagccatttagatgggaacattaaacactgggcactccaaaaagtgtcagggaaagaggggtgagggctgctatctgtgagtcctatgctcatcatctatactcatcacttggatgacaggatcagcagaagcccaaacgcttagcttaccacattatccaccttcccgtggct

SEQ ID NO: 578757 - DNA, 354 bp, Homo sapiens
gggattattattttaagttttattaaaaattcataaactttagattattgtgtatatcagggacccctgggccatggactggtaccagtctgtggcctattaggaactgggctgcacagcaggaggtgaggggctggcaggggagcgagcactactgcctgtgctctgtctcctgtcagatcagtgggtggcattagattctcagaggagtatgaacctgattgtgaactgcacatgcaagggatctaagttgcacgctccttatgagaatctgatgcctgataatctgaggtggaacagtttcatcctgaaaccatcccttccacctcccttcagtctggaagaattgttctc

SEQ ID NO: 578758 - DNA, 910 bp, Homo sapiens
gaggcggagcgaggcttggaggcgcgggagggcagcgagaggttcgcgggtgcagcgcacaggagaccatgtccggggcagcagctgcagccagaccccaagccgggccatccccgccactctgtcgggtggtgctcgggacgggtgcagtcccgcccgggactacagcaacgacccccgggggcaacgctcttcagaaccacccccgggaggtacccaggatcattcatatgaccggaaattcctgatggagtgtcgagaactcaccttgtgaaccaaaaagaccccccaaggggatctgcccaccattcggggggtcaccagccctttccagtgaatgagcccccattgaaagccagcaaagagcaacctgtcgcaaataggcccagaaagataagcggggcgagcgcggtgaagaagtccacccagttggcgatggaacattttaacacgcaccagccatcggttgtggaaggcacctacccaaggggggcccttcgagggcctttcctggagaaggaggttccaccagcaaggccttatgaaagtgatcatacttgggccaggcagtagacgtgggtcaggacaccccaagcctttctccctcaatcaagggaacctgcccactcttcttcgtgaacacccagcagatacctctttgggcctccactgatgaagggagctgcaccccagggagtgaccctgcaggacaacctgagccaggccaggatgggcagacgaccttcttcgaatgtcagagtcagccctgtgtgggggcacaccatcttaggtgattgtggaagctccctctccagaaggataagcctgcagcaaaaaaaaaaaatgggcggcagatctaatggggccgaaacatacggaggaagttgaaaacgagtgaagtgtacgcacg

SEQ ID NO: 578759 - DNA, 450 bp, Homo sapiens
  misc_feature (124)..(124): n is a, c, g, or t
caggagaatggcgtgaacccaggaggcagagcttgcagtgagccgagattgcaccactgcactccagcctgggcgacagagcgagattccatctcaaaaaaaaaaagaaaagaaaatgaagttnctaatgtgagagttaaagaggaaagaaacaccaggcggggcacggtgactcatgcctgtaatcccagcactttgggaggctgaggcgagtggatcacctgaggtcaggagttcaagaccagcctggccaacatggtgaaaccccgactcgactaaaaatacaaacattagctgggcatggtggcaggtgcctgtaatcccagctacttgggaggctgaggcaggagaatctcttgaacccgggaggtggaggttgcagtgagccaagatcatgccatcacactgcagcctgggagacaagagtgagacttcatctcaaaaaaaaaa

SEQ ID NO: 578760 - DNA, 301 bp, Homo sapiens
  misc_feature (14)..(14): n is a, c, g, or t
  misc_feature (70)..(70): n is a, c, g, or t
  misc_feature (95)..(95): n is a, c, g, or t
aacggagccagggngctgactgatacactccaagcggagacagaccaactagaagatgagaagtctgctntgcagaccgagattgccaacctgcngaaggagaagggaaaaactagagtcattcctggcagcttaaccgaacctggcttgcaagaatccctaatgaacctgggtttcccaagagagagatgtctgcgcgctccccttatctctactctgggggccctcagagaggtgtcccaccccgagtgtctagagggagccctacaccctctctctactacagtagccccgtagagcc

SEQ ID NO: 578761 - DNA, 250 bp, Homo sapiens
  misc_feature (222)..(222): n is a, c, g, or t
accatagatgtgttccagaggcaaaagagacacattatcctagatggcagaacatgctttcaaaacatataaaacgtcaaagttccagatctttctacattttaaatcctgtctgaggatggcagctgactttatgtagctgatagacgactagagtttcatccaaatacctgaccacgacttcatggagatttgaataatctatccgatgagatttatatntaaacaactcaactcctgtcgaaacaaa

SEQ ID NO: 578762 - DNA, 1623 bp, Homo sapiens
ggtgccatgtaacgaatgtgcctttcaccacccccacaccctgccatgactctgagtgcctccccagtccacgtggaactgagtgcagctgtatgtgatgtgccaatatgcagacaacgggaagtaacctcaggcacttttgtgcgtggacgcaggtaacatgacaagaacgagaaaagacctgcaacttgactgccctgctccctcgcacacatacgcaaccttgctgacctatactgcttggctactaccccagcacacttgctctgtgcttatcctcttatctagaccacatacacagcttgtgccccactcctaactcctgcgctattgcgaacctagcaacgatcccctccaaccttgtccacccacactatgctcctctctagccactccctaactacctcagattctaccactatgcccccacctgctcccaacctgccacttcccaacccctcaatcccgcaccctccacaccccccccacgtaccacctcctaaccccctctaaccagcacaaaaatccaacacctctcccgccactcttccacgcagccccctgtccactcgtcacccccccccccccctcccttgatacttcaccaccctcccccaaacttcatcccttcctcttaaacccacatccctcacgcccctcgtacttccccgccctcgaccaacccatccccccaacccccccccctctaacccaccacgcaccataacaccctccctcccacccaccacccctacctacaccccaccatctctcccccctgattccccaaacagacatcccaacacccatactaccccaccgcctcatcacctcctccacccactcattcgaaacctcacctaccactgtcctcatgccccctacgcacacaacatccaaacacacccaaaccatccacaccttacccaaccctaaccactctaccttactcacaccatattccaccctctaccccccccatccataccccccattcacactcctccttgaccttcctcctacactatccaaattaacattctgtacgacacagtccatcacaactcccactcctatacctcctatacccctatacccaactcctcttacccacacccatcacactactatatacccaacaactacatcatcactcctccagcattatctatacaccctatgctccctacccctacacctctcaccacacctactactctcgcttcccacttatgctactacctctaacttcgtcaccatcctacaaaccccccacacaccatcacctacccaaacctaccacaaacacctcccctacccctcctcctcctcaccgctacccactactcctcccaaccacacaccccccccaccccccccctcacgcccctcatcccctcccaccccccctcacccctacccccacctccctccactcaccctacaccatcctaacctccatcacaccacacacacacaccacactacccctccccactcccccactcaccctaccccccccaccaccatcacccaccctaccctaccttacactccactcacaaccacctataccatccaccccatctcctcctcccactccttcctcacccccataaccat

SEQ ID NO: 578763 - DNA, 333 bp, Homo sapiens
cacgcactgactagtcctggtgtgtgcacctctagtcccagctactcagaaggctgaggtgggaggatcacccaagcctgggaaggcagaggttgcagtgagctgagatggtgtcactgcactccagcctgggcaacagagtgagactccatctcaaaaaaattaattaattaggccgggcgtggtagctcatgtctgtaatctcagcactttgggaggccgaggcaggctgatcacctgaggtcaggagttcgagaccagcctggctaacatggtgaaatgctgtctctactaaaaatacaaggcgtgcacctataatcccaggtattcggg

SEQ ID NO: 578764 - DNA, 858 bp, Homo sapiens
  misc_feature (9)..(9): n is a, c, g, or t
  misc_feature (12)..(12): n is a, c, g, or t
  misc_feature (18)..(18): n is a, c, g, or t
  misc_feature (21)..(22): n is a, c, g, or t
aaaacaaanaanacaaanacnnccctccccgaacaccacaaccacatcaatttttattattctcagcggccacttttagtggctttcaaaggtcattcattttgttcttcctcagttatgacttattccataataggagatgaaccgcccaaggttttccaggcctcaactgaaactcggggagctccatgaggaataaaggaaaccaggaccggaatgagagatattgactgaggactcaatttcatggtcccccgcctctcatccacccgtcagtgcctctgcttccggttgtttggccatctatttaatggttaatcaccaggtcctctcccccgtcaaccaacgacccctttttccggccttatattctcacgcactaaaatatcaaaaaataaacatcctgatattactaatattaccatacgattaataaatgtcacaaactaccctagttttccttttttttgcccccatctcttctccgtttttgtttttttcgttaccattctaatccattagtttttagcttccatcgtcccagcccccctttctttctttttttttcccgcttctccccccccctttatcgtactctatttgttatcccccacccccacaccatccctctcgatttcccccttttaccgtgcttcttcccacattttgtaacccctccgactaccgccccagtacaaaacgattaatcacccccatcccaatcctctctatcacgtcccccattcccttacctattccaccccttgcgtcgaccggggagatcttttatcccgcctttgcctcctttcttactactatttctccgaccatcctactcttgtgttttcccatcgcccc

SEQ ID NO: 578765 - DNA, 568 bp, Homo sapiens
tcaacgctttatacttcctacacatatcaagttggacacgttcacattgctaacgacggggtgggccgatagtacgacttcggtgagaactgtctgagatacgtgaacacggaggtgacaaagtagagtgtagctgtaaggaaactagcagatttgtgcccgtgctgtaggcaacgagtacggtggcaggggaacagtcagtgaggatactgaacaatggctcccatgttgtgtatcctgtcccggggaatctagaagaagaggaatgggtacgagcagtgcatgaagagggataagcaggttcttctgcactgggtgtactatgcgtgacagttacgacacgtggatgccatcgagtgctgttgatggatctgtggcggatgctcgaactcctgtagaacctcaggaaggttcgggcgaagtggatcgtggagagcgagagcttcaaggaatggttgaatgaggacgactatgaagtaaatgatgacgaaaaccctgtctcccgccgaaagaagatttcagccaagacactgacggatgaggtgaacagcccagattcagatcgacg

SEQ ID NO: 578766 - DNA, 929 bp, Homo sapiens
caagaaaagatatgtattatgtataattacgacgtgtataagttcattagtgttggctggttttctgggtaggtgttgtgtagtctttcctggtggtctgcagcaacaatgaccatgggaccccccctcctgttaccccgcgggtttttgtcctctctattggccttcttctcccgcaagctggtcgcgatcttgtgcgaactccccgaggttcgttaccagaccatatcgaggtttctcttgtgccgtcccggaccattcccgcgttttgttccctattgtcgggggcgacccacattatcgattgtggcccgcctcccggcacacacttagtgtcacaagattccccgccatgtggaatgtttcaaatgcatgggggaacaaacaaggttcctataatgagacgcgtcagcaaccccctttgtatccgcccccagaacaacgctgtgttagaaattacaattcaaggaaaaattttcttgcaggaaaatagtttgccgtagaacgccgcccaccaaaacgaatgctcgtgaagtctcccgcgtagtttacacggccctgaggacaacaataatgctcgccgcgagcacccacgcctgtgtattgatcccccattcttgtacccccggctccggctttgtttcgccgaagacaactctacggcgcctttgagttctcttgggccaaggtaagcgtgaaacacgaaatctctcttctctcacaataatactaaacagggagcaatttttctcccgtgattatctcctcagagaagagacaatggttctcaactcctatttatcagactacggaacctgtggggaaaagcctccttctattggacaaaccaccccaagagatttctcccaaaataaaaaaaaaaggggaaacttccataccccccaaaaaaacggggggccaaaaaaaaa

SEQ ID NO: 578767 - DNA, 736 bp, Homo sapiens
tagttgttttttgggctccggtgaatcctttattatttcccactgggacacaacatttttcccaagacagtagcacagtccttggtataaggcatggttaatatggtctattttggcagaaaagaatatggctacaggtcactggccattcacattttcacataggcattctggacagaaattaaagaacattcccatgggtggttcaacatttaatggaatagtaagttctactttctggccctggggtatattaatgggggtctttcaggtgaagtgggtgaaaaacagcattatggtgatgggctggcttcttaacaggggcccacgggtccaatgacaaggtaggcccctttgggctgaatttctcagactatcttctggtagttcccaaatcccttgggcaggccaagttttcgagattctttattctcggtctctctggtccaggggacatggctgggtcaccccggtccttttccatttctggctcctggtggggtgggtcccacggggttctcagaatcatagaagccgggcaactccacttaattcttcccggtctgaaagaacttggtccagttgtgcaaccgggtatatagggcttcagggtccgttgggggaccctttcgaggtgtccttttcataccccagttacatcttcgacgggttttctcaccagtatagtgatccgggagtttccggtcaggtccgacattctctccctcgttgcctg

SEQ ID NO: 578768 - DNA, 889 bp, Homo sapiens
attagtcccctggcccaacccgtcatctactctaccatctttgcaggcacactcatcacagcgctaagctcgcactgattttgatacctgagtaggcctagtaaataaacatgctagcttttattccatgttctaaccaaataaaataaggcccgtcggcccacagaagctgccaatcaagtatttcctcacgcaaggaaccgcatccataatccattctaatagctatcctcgttcaacaatatactctccggagcaaggaagccataagccaatactaccaatcagtacctcatctattaatgaatcataagggctatggcagataaaaggtaggaatagccccctttcacttctgagtcccagaggttacccaaggcacccctctgacatcccgggctgcttcttctcacatgacataagaagctagcccccatctcaatcatataccaaatctctccctcaattaaaggtaagcctgtctccgtcactctctcaatcgttatccatcatagcaggcagtgtgaggtggattaaaaccaaagccagctacgcaaatcttagcatactcctcaattacccacataggatgaataatagctgttctaccgtacaacgcctaactataacattcttaattaagtatatatatctaacgtatacgcattcctagtactcaatttaaactccaagcacaggacctatagtttctcgcactgaacaagtaatgatagaccttattcatcacctcttcccaggaggtgcccgtaacggttggcccatggccttcgaaatccaaaaaagtcgttcccctaataccaaaccttattttttccggattacacaaaagccttagaaaaagggggaaaccccccccaagggtccttaa

SEQ ID NO: 578769 - DNA, 243 bp, Homo sapiens
ggaagcgtgttgaggcagaaagattaagagagagatagaaacagccaggcgcagtggctcacgcatgtaatcccagcactttgggaggctgacgtgggcggatcacttgaggtcaggagttcaagaccagcctggccaacatggtgaaacctttccctactaaaaacacaaaaattagctggatgtggtggcgggcgcctgtagtcccagctacttggaaggctgaagcaggagattcatttg

SEQ ID NO: 578770 - DNA, 283 bp, Homo sapiens
ctgctccgcccctctctgaggactgagtagcggtggggtccctgggtagaagagtcaagctggggagcacgctggaggggaggccttctctatcctggtgcccagccagtgggctggcctcccaaggagggttgactttgtgcgtgtctagcaggctgagccagccgggaggctgtgcctctgtcctctaggggagctgtaaaaacactgttgctggaagcatcagatgcataagatagagttaggtttaaaatgattgcctgataactgtgaacagcagatg

SEQ ID NO: 578771 - DNA, 339 bp, Homo sapiens
taatctagtttattcacccaaaaattgaaagagaaggaaaattttgaaacaaacaaaggaaagaaaccagtttttaagattagcagtaaataaatttatacaacagttgggtctgaataaaatgatgaaataaatcaacatcttttttaatttgggggctttgaattaaacaaacaaacaacaattacagggatttgttcacaaagcatgaaggccaaaaaaaaggttttttaaaaccctaaacggcaattggtgaagggaaacactgattgcccaaaattggaatttcctttgcaaaggccaaaagttttgaacaaataattccccctcaacccccca

SEQ ID NO: 578772 - DNA, 131 bp, Homo sapiens
gaaaagttcgttatggactgatccctgaggaattcttccagtgttctgtatcctaaaactgagtgtaacaggaaccctatgtactcggaactagggcttatctagtacgctgtatccaaagaaatatatgt

SEQ ID NO: 578773 - DNA, 383 bp, Homo sapiens
taatttattaactttgacccaccctttttgagcctgcagcctttccgtgtggcctgagggctgtcgagtgagctgccccaggcccttccaagcccttgcccaacctgggggagtggggaaggtttggggcaaggcccccttggggggtttatttcctgttttgtttcttgtctttgtgttctgtgggccctgctgagagaaaaaaaaagtgagcccagcagaaggaggtgggaaaacggacccaaaccccagtgggccctgccccatgcctttcctttagtggtgggaaacccttatcttgcaaagtgaatgtgtccccttcccccccctctagtgtatttcccagaaaacaaaacctcccaattaaacggttggaacctgga

SEQ ID NO: 578774 - DNA, 451 bp, Homo sapiens
tctgttcagaggatcccgtcctaggataataagaatctcttagacgtgtttgaaaggaagggcgaagaggggcaacttcatgatctaatcaataaagataatttgggattacaatcaaatatgaaggaagttgtaaaaataataatgttagttgtttggtgtcttcaaaaagacttctctaaggggccttcaatgacaagtgtggtcaaggtcttggaatgcgccgttgaagtcgaaacaacttggattacaatttcatgagaaaacaaagacacgaatgaatgaatcatatgattccaatcttattgattttttcccataatgggagtcctatatatacacacactatttttacagtatatggaaagaaatcatgtttatctaaataacacaatttatgcctactatatttatctaaacaacacaatttatactatccatatttaccata

SEQ ID NO: 578775 - DNA, 136 bp, Homo sapiens
tatgaggagaaaatggaagtaaggccaaatattactgattgtaaatctaatgaatgcaccaagtgatataagtgttctaatagacaattagccagtagtgataaaaaacaataattgttacctatagaatgataaa

SEQ ID NO: 578776 - DNA, 146 bp, Homo sapiens
ctattccccgggattttaatgccccaaccctattgtgcccaaagatgagcctctgtcctgtaaataaaaaatgaagtagagaaatgtttaatattttatgagtttagaatatagtaaataaaaggtgatgtaaatgaatgctgcca

SEQ ID NO: 578777 - DNA, 195 bp, Homo sapiens
aaaccaaaattttgggccctaacctggggtttgcagcccgtttccgttaacctcggggatgtcccctcacccccagcctggggtttgacgtttttcctcaaactggagtaaggagtgatgggccgtaaaattctgtgtaatgataaaagggtgaaatatcccctgaatgatttaaacccactttaataatttgga

SEQ ID NO: 578778 - DNA, 217 bp, Homo sapiens
gacagggctagatttaagaggcaggagtcaatgtaaatgcacttaagtatcagcagcaggagggaaaaaaagtcaacagttattggggactgaggagcagcctgatttatactgacaagcaagccttgtgagaatgagagaaactcaactgagaggtagcactggcttgctttctcaattgcaccctcagtgttcaacacccttctggaggtcgacg

SEQ ID NO: 578779 - DNA, 257 bp, Homo sapiens
agatgaagacttaatggaaaatttagcccaagatgaaacatctaggcgggacctgggattggaggagtgggatgtagctggcctgcctgggtggtttttaggaaactggagaagcaactatacacctagaagtaagggctcaactgatttacagacaaatcaggatgtgggtacggccatggtttcagatactacagatgactgggggttttggaatgagtcagtatcagagcagtaaggtgtggggcgataacata

SEQ ID NO: 578780 - DNA, 668 bp, Homo sapiens
agcggaaaagttaagcactcccactttcaaaaaaaaaaaaaataataacccacacacacaaagagtgtgaggactggtagcttaaaaaaaataagttttaaaaactgactttctggtatttatgatagatatgaccattttgggtgtgagtagattggttggcatgggaaatgaactgaagcagtatggtagatttaacaaggaaaaaaaaaaaaaaaccctttaggtggtacatatgagcatcttgggtatgggcccagctagaaagcctccagctaattggagatgttgcgtcatggtaacatcccttaggccagatgtgataaattggcaacgccgatggaatacggcaataagcattttacatccccatggttcccctatataattcgccacattcatacttcactggtcccccattaaattcccaagttactcctctattccgctatctttcacacacactgctcgcgggatcgaataataatctcactccccactttaaagaggggatagcagttgaccttcatcaatctcttttagaaggggaagcatggtcagaaacagtatattgttataatacagaactctaaaagacgaaacgcaaatttccagggggaatacctaagggggaatcactaagagaattcagtacagacggattagat

SEQ ID NO: 578781 - DNA, 935 bp, Homo sapiens
  misc_feature (732)..(732): n is a, c, g, or t
  misc_feature (760)..(760): n is a, c, g, or t
ctggagcttccccaaccgggccatcggagccccagctgcaggaggaaaaactgattggtttaatggggcattctcagacttcttcttcgaactctgccaatggagagctacttccggtcgtgggggaccctgcagctgttgctggtgggcgaatcaaggtgcccaacgactctgacaatgcctgctgagggccaccatactttgggagcaatgtcctgcagagcccagcacgctgattgactcccacatctgaagctggagcagcgggtcatggccccaccgcgctgcaccatcaagccctctggcaccaccatctctgtcactgctagcgtcaccattgccatggtcccaccagaccagcctgaggtccagcatagtccagcatgacatatggacagcccgtactcagcgcgcaagatggctctaccgggggaaggaccatgcgcacgcagctggacctgcgcaggttccgaatctattccaaccacttctgcactggagtcgctggctctgatcccattacaggcccctctgaagaccatgctgcagattggggtgatgcccatgctcaatgagcggacctggcgtggggtgcagatcccactacctgagggcaatcaaactcttagtgcatagaggtgggtgacgaaccatagcgggattcctcaccgatcggggcgtgatctgccgaccatttgaccaaatgggctcgacgacgagcgtgatctcgangaagaacctggccatgcatgatgtcagnggcgtccactgcccccacaccgtccacagcagctgtaatgagccctcaatccccaagctggcagctgtcattcaggaccccaacccctctcagcccctcttttccacattatagcatgtagtgccccctctaacccctagtgccacagagaatacgggaggggaagctgtaccca

SEQ ID NO: 578782 - DNA, 145 bp, Homo sapiens
gcagtgaatcgagcccggtaccccaaagttgagactttgcagaccaggttctgttgacaaggatgttgcgagcagccaggtcgcggtgcacatagttcatctcgggcaggtacttcatgccggcagcaatgccccgcaacaagca

SEQ ID NO: 578783 - DNA, 236 bp, Homo sapiens
  misc_feature (97)..(97): n is a, c, g, or t
gccccccgggttttccctttttgtttccgggtttttttttttggggaattttgaggggaaaaactttttccccagggaaccggttttgcattttttnggttttttacgccccccctttaggggatttggcccccggggccaaaattttgggcaagggccccccccccccctttagggggggaaagggaaatgttttccctgtgcccccaaaacaaaaaatttgttcccccccccca

SEQ ID NO: 578784 - DNA, 825 bp, Homo sapiens
cacatgggagaggcagatttaaaggcagggtgagcccagaggagcagcgacacgagtcttgatggaggggcaaaatatgacatagagggggacccttcctggggtaaactaaagagagatgaagtatactgagaaatctgtaaggatggtgttaaaccaaaaaaagattgggttctaacggtccacgaagactgtcacagtgaagaaatggtggagatatcttggtgtcttgagccgccccacctggatgagtgacttcagggacagagcagagggaagccaaatggatttcccttatgttgaccccaaacttgttgactgaaattttgtataggtccgggagaaataagcctaaaccaatagttgtagccctagaaaaactgttttccccattctgttctgagttagaatccgcatagcctccctggtcgcccttaaatgtgaaaatcctattttgattaatacccccgcctaagagttatagccatacgagagactgaatctatttttgtttcgggtctttacctcatagtatgaaattaagtaagacactgcatagattttgccctgaataactggtgtgccccggtataccgtgctctctctctgtttcccgtggtggtaattttaaggcctaaagaagctggggttaatcctcgaagcttaaagtaaatgtttcttgaattgattttgttctgtggtaccaataacatctatgaatatcatatctgtataatatctgacccagttgtgtgcagagaggttgatataactataatttaccagaaatgatttttaccattaaagttcaccttttaaccatga

SEQ ID NO: 578785 - DNA, 116 bp, Homo sapiens
gctgacatacactattttggagaagttaccacacgcttcacagactaacatcaagaaatcgccaggtaaggtgaaagaagttaattgcaaaagaaaaatgaagactgtgaaagagg

SEQ ID NO: 578786 - DNA, 369 bp, Homo sapiens
  misc_feature (298)..(298): n is a, c, g, or t
ctttattttatttatttatttatttttgagacggagttcgctctgttgcccaggctggagtgcagtggcacgatctcggctcactgaaacctccgcctcctgggttcaagcgattctcctgcctcagcctcccaagtagctgggattacaggcgcccaccaccacgcctgactaatttttgtattttttagtagagatggtgaaaccctgtttttactaaaaatacaaaaattagccaggtgtggtgacacacaccttacagtcccggctacttgggaggctgaattgggaggattanttgagcctggggaggcattgcagtgagcggagactgcgccactgttctctagcttgggatgaccctgtttt

SEQ ID NO: 578787 - DNA, 512 bp, Homo sapiens
gggcaggtgatggcggcgctggtcgtatccggggcagcggagcaggcggccgagacggccctggcagaggtcgggcccctcggggccgcgtggccaatcagatcccccctgagatcctgaagaaccctcagctgcaggcagcaatccgggtcctgccttccaactacaactttgagatccccaagaccatctggaggatccaacaagcccaggccaagaaggtggccttgcaaatgccggaaggcctcctcctctttgcctgtaccattgtggatatcttggaaaggttcacggaggccgaagtgatggtgatggggtggacgtggaacttacgggggcttggcttggggttgggttgctttcccagcaaggcgcccgggaacgctgactctctgtggtgccactacggcacacagtgtgccgtgattcccaagtggacacactcgagcccaaagacttccgggatgctgtacgtctttgtggacatccggatagacactacacacctcctg

SEQ ID NO: 578788 - DNA, 88 bp, Homo sapiens
atgatgtcgatcaggttgccattgaattttgctctggtgaatgctgagacccagctttttcttacaaataaatatggaccctattttc

SEQ ID NO: 578789 - DNA, 87 bp, Homo sapiens
ggggcccccccccccgggggcctgctcccttagataattttaaatacgcctgtgggccccacccccttaaacccctgtttgttcgga

SEQ ID NO: 578790 - DNA, 137 bp, Homo sapiens
gccctaggatccatctttcttttcacctgtaggtggcctgcctggcatatgtataagcaacactcatcactagcacattgtactacactgacactgtactacgattgtagactcacgttccactcatgtccatatca

SEQ ID NO: 578791 - DNA, 110 bp, Homo sapiens
gtgactagtgagctctacggctagtagaacatttaaaaactacaatgtgattaactcgagcctttcgttttcatccatttacattgatcacagttttgctagttcaaacg

SEQ ID NO: 578792 - DNA, 141 bp, Homo sapiens
tgctttaattccaagttttatttcttccctaaaagttttttatgggaatgaggcggaaacaggaaaccccctatttcctctgtatttttgaagtggaatttctatttaaggggctcattaaagcatagtatttatccccca

SEQ ID NO: 578793 - DNA, 357 bp, Homo sapiens
ttaatgtaattgcaagtattaacagcagaatagaccaagctgaagaaagaatctcagagctcacaggcaacatctctgaactcagtcagacaaaaataagaataaagaagaatgaacaaaacctccgagaaatatgggattatgtagagaccaaatctatgactcattggcatccttgaaagagaggaggagaaagcaagcaacttggaaaacttatttcaggatatcatctatgaagacttccccaacatcgctatggagaacaacattcaaaatcaggaaatgcagaaaatccctgtgagattctatataagaagaccatccacgagccacatggtcgtcagattcttcaaggcc

SEQ ID NO: 578794 - DNA, 284 bp, Homo sapiens
actatcccaggtctaaatcactactgtagagaagtggaccgaggtcacactatcaagacggacttcctcagttaggcctggcggaagcaggcatgggagggtttgagctagggagccccaggaggggatataccacatatggagtatgggctagcccaggtactaggggtagcaggtagaatagtagcttggcctcctctgctagcccccaacccagcccctgtcttattgagatgatcagtgtgcatcctacaccaagaccctgggacccagcacaacctggg

SEQ ID NO: 578795 - DNA, 325 bp, Homo sapiens
attaataggaaagtctagaagaaatggacaagtacctcacttatatacaacctaccgaagactgagaccatggaaaaaacacagaacctgaacagaccaataacagataatgagattgaagccatagtaaaaaatctctaagtcaagaaaagcccaggactgatggcttcattgctgaatactaccaaaaatttaaggaagaaatgataccaatcctactcaaactattctgaaaaatagaggagggaatacttataaactcgttctatgcaggcccagtattacccgtgatatcagaaaccatgacaaatgacacgattccaaa

SEQ ID NO: 578796 - DNA, 156 bp, Homo sapiens
tagaggatccccgtgcagaatcacactcaaaaagctactaacaggactggtgtaatttaaaaaaaactaaggcagcaaggctttggcacagagttagcaagcacattggccaggccttcaacatcatagtcagcttcagtttgcaacaaatgtgca

SEQ ID NO: 578797 - DNA, 396 bp, Homo sapiens
cctgtgtacatggccgcgtgctgttaatactgacagcggaaatctggcgctagctggcaatgcgcgagagagaatagaaggacgggtccaacccggcacatctgctggctgtggccaatgatgaagagctgaatcagctgctaaaaggagtcaccatagccagtgggggtgtgttacccaacatacaccccgagttgctagcgaaggaagcggggatccaaaggacagttggaagccatcatcacaccacccccagacaaaaaggccaagtctacatcccagaagaagcctgtatctacaaaagcaggaggcaagaaaggggcccggaaatccaagaagcagggtgcagtcagtaaggcagccagcgccggacagcgggctcccgggggtaccgag

SEQ ID NO: 578798 - DNA, 1017 bp, Homo sapiens
tggaattcaacaagtttttattggagtgtctattatgtgctaaatactgaaacacttcagaaaacaaaaccaaaagccctgccctgtgtcgggcttacagtctagcactttaccgccagtttaaccgtgcaggctaccgtggagccccgggcaagtcaccgcacctcgtggtgcctcggtcctcagcgtgcccaatggggagaataagcagaccgtggctcagacttgaatcatgtgctggggtgtactgcagatgccaaacttgcttccccaaaacccaccacgttaaacgagcagacgagggcgtggaagtttgaattttaaatgataaagtcacaatgaagggagggcagaggggctaagcctagctgtctggggtgctgatggtggtggtagacgtggtctacaccaaactgtagcatgctagcatcgcggcagactaggaggaggcccgccttgactgggagaggcaccatgtggccttactctgaacgctgccagtgccagtcatccattggcctatactccctggagcttcctgtgagctagtactacaacaagttgttatggacaaggggcctcgccttgacagcttagccaagatattttcaaaacccttacatagtctgggtcacgtggctttggacccgggcaagaccaaatcctggacagctcttggagaccccaaatacgctagaggagacccaggcttccccgggcggattcagtcgcagccactggtatgtaaagagttcagcaccagtaaaacacattcgttcctccaaccaccaattaagccgggcgttggataagaagtccccacgcgaaacggtaggccatgggccagaatacagagagggtcccacaaaaagaagtcctccccaggacgtataccgcggattggagccaacatgtgagggacaaaagggccgatcggccccggcggggcactcccagttgggtcatgagaccagaaactcggcgagagcacacagacaccggaaagggggacgactc

SEQ ID NO: 578799 - DNA, 276 bp, Homo sapiens
  misc_feature (109)..(109): n is a, c, g, or t
cttatgcggaggagatgtgttcatgttacttacactaacattagttcttctatatgggtggatgattggtccattgtggtgtgaggagttcagtatatgttgggaattnaggtaagtgggtgttgaacttgaacgctttcttaattggtggctggttttagggctactatgggttttaaattttttactctctctacgaggttttttcctaagttcccaagagctggtcctctttggactaacagttaaatttaccaggggggctgcgtaaaagtg

SEQ ID NO: 578800 - DNA, 141 bp, Homo sapiens
  misc_feature (20)..(20): n is a, c, g, or t
  misc_feature (31)..(31): n is a, c, g, or t
  misc_feature (56)..(56): n is a, c, g, or t
  misc_feature (113)..(113): n is a, c, g, or t
tgttccctggctcagcctcnaatgcagtacntttgttgtgctctgttgtttttatngcagggctggggtggtttttgagccatgcgtgggtggggagggaggtgtttaaacgncactgtggccttggtctaacttttgtgt

SEQ ID NO: 578801 - DNA, 238 bp, Homo sapiens
  misc_feature (7)..(7): n is a, c, g, or t
  misc_feature (24)..(24): n is a, c, g, or t
  misc_feature (30)..(30): n is a, c, g, or t
  misc_feature (36)..(36): n is a, c, g, or t
  misc_feature (42)..(42): n is a, c, g, or t
  misc_feature (91)..(91): n is a, c, g, or t
  misc_feature (101)..(101): n is a, c, g, or t
  misc_feature (111)..(112): n is a, c, g, or t
  misc_feature (127)..(127): n is a, c, g, or t
  misc_feature (132)..(133): n is a, c, g, or t
  misc_feature (141)..(141): n is a, c, g, or t
  misc_feature (189)..(189): n is a, c, g, or t
  misc_feature (200)..(200): n is a, c, g, or t
  misc_feature (221)..(223): n is a, c, g, or t
gcctagncatcctgtcggaaggtnaaggcnaaaggnaaattnaagtccagactgtgacaaacccaggactgaggcctgccccatgaagagnctgagccccntgaaaccccnnccccgttggtggtanagtcnnagagacgnaggggcctgggggatatgaagctagggaagcccctgcttcgattcccnactgcccttgncctggatccaacaccaaatannnagaaacaagtgaagt

SEQ ID NO: 578802 - DNA, 220 bp, Homo sapiens
  misc_feature (35)..(35): n is a, c, g, or t
tctagaggatcccatcaggcgaagacttgtggggntcaggagtcagaaagtggttctatttcaaggtctctcacagggctgcaatcaagaggtgggcatggctggggtctcatcgtgaaggctggactggagaagaatctacttccaaagttatgtggtagtgggaagaatttagttcctcagggctgctaaagtgatggcctgtgttccttgcctctgg

SEQ ID NO: 578803 - DNA, 629 bp, Homo sapiens
aaacactacaatcaggcacagcctaaatctccctctaacaaatcagactttggaagtcttcagtccagagcataggccagagagagcaggaacaccagggttgtccttagcataaccagttgcaggttatttgcaaatcttttgctaggtggagggctgctcgagtctatttcctctgccacaaatttgagaggactcagccaaaggtcacatggtttctatctgacaccaatatcggggccacaccccacagactgcagcattgttgtgcaaaccatgttggctactgtcccctaagctggcaataccaatccacgggtggtgaagccactgcacattatcctgtgttgccctgctgctgattcttgaaaatgcttgctagcagcattccaactcgtctctgtaaccaggctttgactcgaaacgctttacacctcagcctggtataaacaagaccctgatcaaacccaactctcaaaaagcaagttcttgataaacttggttgcctccggaaactgaggggcacaggagctgtgtgtgttagccctggtgttagttaacccacagcaggccctcttactaaacagctcattcttgcactttaacatctctccttgataaccgtgtct

SEQ ID NO: 578804 - DNA, 125 bp, Homo sapiens
atcgaaaccttgcgggtactactatctacttgcgccaggtttcaatttctatcgcctatactttatttgggtacatggtttggctacggttgtctggtagaggttatgatgacaggatttgatag

SEQ ID NO: 578805 - DNA, 656 bp, Homo sapiens
tccacactagtcagagtgctggatacaggcatgagcacatgcagactttccatttactttctgcagctgttccctagcagctcctctagggagaggtgaattcttgcagtttgtagcagagcacacaggaaaaccctaaattttctaatacccaaccggctctttcccttttctgtcccgggatacctgggggcaagaagaatttctttggttatttggtccaatgctccccaagaaatcaggctaaattggccagaacaacggggatttgaagaagccaattcaagtgaaaccctttggcaaagcccccaattcaaacctggcactcccctctaccaaatccctggcaacagggtgttcctgaaagagcaggtgctgtacatttttaccagctttaacaatggggggctgtttgacagacaataattaagggagggcattgaatttatgcgtgctataattgcagagccctaaaattacaggcgggaatgaggggctggaggcagcaaacggaatctgccctatgagcgtggctgttgagtcctgtctcctgggtctgactttccgtaatatgattggggtacagtagaggtgattaatgggggctggcattctctctttggcctgaggttctgtattctgggaaaagtatacag

SEQ ID NO: 578806 - DNA, 426 bp, Homo sapiens
cacgaggggtactcgagggcctgctctagccctgccgccacgaaaaaatttcgcccgggcgagcgcttgcgcacgaagagctcgaacacggcggtcgcctgcatgccttgctccaggtaggcctggagcatggtgagctggtacaaatcggtgagcagggggctcatcgaggggagcgcttcctcaggccaggtccgccacggtgatgggcaccgccccagcccgctccatctcggtccgggccgcctctccgtctcctggcttcacgtccacggcgcggatggcgtcggtcaggagcagcacctggaagccctgggtcagcgcgtcttttaccgtgttcagcacgcagtagtcggtggcgagcccccccaccacgacccgcttgacgccccggcgcctgagcagctccgccagctcggtaccctg

SEQ ID NO: 578807 - DNA, 141 bp, Homo sapiens
tgatagagtttgggcgaaagatctcactatctaatttaatggtagaagccggtcgtggcgtgagcgggtgtgatggagtgctagtggcattttgtaagcagaatgcgctgcggatgaaccgaagcagggttagggttccgg

SEQ ID NO: 578808 - DNA, 385 bp, Homo sapiens
acaccacctgagtcgggtacacatgagggatcctgtgatggaaccgttctctctcttgactggggtgttggttataagttgtatagaactaaatacacacataaacgagagcctgtcaaactggtgaaatctgaataaggttggtagattttatcaatgtcagtttcttcgttgggatattatagttatgtaagatattaccattaggggaaactgggtaatgggcatacagaatctctgtgtggtattccttgccttctttctttctgtggttttatatttaatttgggaacagagttttttgacagagtttggctctgttgcccaggctgaagtgcagtggcatgatcatggctcacttgaacttctggactcaggtggtgtg

SEQ ID NO: 578809 - DNA, 438 bp, Homo sapiens
  misc_feature (23)..(23): n is a, c, g, or t
  misc_feature (38)..(38): n is a, c, g, or t
  misc_feature (292)..(292): n is a, c, g, or t
  misc_feature (295)..(295): n is a, c, g, or t
  misc_feature (309)..(309): n is a, c, g, or t
  misc_feature (313)..(313): n is a, c, g, or t
aattttaagcaaggtccctgggnaaactttcctgaaanccttcctcccccttaatgaatgaaaaggaccccagaacttccttgtttccacatacttgcctaaagttttgttcaaagatcaagcaaatgaaaggcttcctagctcttttgtgtctccctaatttagctttctgaggagtgacagtggcagagagaagagctggggtagagtctgttcgagaattcagtttttcatcactgaagctgaagctgttcctataaagtgaatctgcatctccgagtcctgaagccgnctntgtcgctgaacaanctgnctctgcgccgcttcatgcgctccaggtgctcctcgtagtggaagtggcgctcgtggaagggcgacgcgaagtcggccagcaccgcgtcagaacgtcacagcgcgtccgacaggtcctcccggccc

SEQ ID NO: 578810 - DNA, 889 bp, Homo sapiens
gacagtatggaagccggacccagagcctgaggtgggcagtgtgccaggctccctatgcggcctcctcaagccctgtacaggcgtatgggcatcaagacagcattgccggcggctgagctggtgcctctacgtctctggtgctgagtggggccctggcctatgctggccggggcctccttgaggcttcacaagatggggcccgacaggaaggccttccgggagtctgtgcgagctggcgtgggagtacagtggccggaagatggatgtggctgacgttcgagtgggtgagtgtggttcaccgtccgtttcagtcaacagtcaatcatcgtttgccgcatctccgggacatgtgctgtttgcttaaacgtctgcacgatggttgccccagagctccgctcctggatgtatgctgtgtacggggccttggctgtgatgggcacgaatgggcccttggtacctgctgctgctgcttggtcactgtgtgggcctctatgtggcctcactttggggccagccctggctctgtcttggccttggcgttggccagcctgtgcctccttcaagatggacccacctaatctcttggcagagcgggcttgtaacaggcactttagatcttcaagaggtgctgtgtcatgggggcagcagcttcacagtgctgcgtagcaccagctttgcactggagagctgtgtccacccatgagcgacgactactccttagctgagctggtcaagtacaagttctaagcatgacccttcttccttcgtacgggcccatcagtgaccgttggatcggcattccatgctcagggtgagccaggtggagccagtggagacgcgaagggtgagctgtggaaaatcgaagcccagggcaggctacagcgtggtg

SEQ ID NO: 578811 - DNA, 180 bp, Homo sapiens
taatttctattttgtagttcgagcaccgtttagacgtcgcacttcagtgaaccagtagcggcttgatcagtgaccccagcgaaggccaaacggagcagaagaccaccggctgagacctgcggaaatggtctgacctccagaattgtgagaattaataaatcattgttgttttaagctacc

SEQ ID NO: 578812 - DNA, 197 bp, Homo sapiens
caccggctggccgctgaccacgttgtcctggttggtgatcatgtagacgtgttgccagtcgatcaacgtcggctggtcggggttgcggctggggttggggtattttttcaggatggtttcagtgtcaaagctgacaagtacatcagtaactctagacatgtttaagcgtccttacttggtggtaggtcagtcgacgc

SEQ ID NO: 578813 - DNA, 236 bp, Homo sapiens
atgtcccgtagcatatcaatacctggccctgtactcctaccccaagtacggcaccctattaactacatagaggagggaaaagagtagctaacgcgggggtgaaagaggacgtgtaacccactgccatgcacaaaggactggctagtagtaaacctaggttggcccctgcttgtactctactgggctagcagagtctagccccaacatgtgcccatggcctctagaaactagctcag

SEQ ID NO: 578814 - DNA, 1247 bp, Homo sapiens
agggggcctctaaaatggtaaaataggctctacaaagggaaaataaaaagtggtgttctcccgggcgcaccacacagtcttcccggcgaaggaaccaccagggaggccttattaaaaaaaattgggggggaatatccccccgtgtggttgtagaggaaaaggcctcctaaaagaaattttttcggcccaagtggagaacaggacctatcttcggcccctcctaaggggggcccctccaccccgcgcgtttgtggtgggagaaaatggggcccccgccctaaagatatcccagcgtgtgtcaagcgcggccagatggagcccccttctctttcttaatttaacccgggcttgtgaaaagtggcgcgttctcttgcccgatgttttcaaccccgggtttctaacccaccagaggccccatggggcacctcccgcctaaccaagcggtagcttcaagacgtgcgttttataactttgggccccccacaaaagagggaccaggtaccccaaggagtactctatacgccttagtagaaagaatacccaagaagaacatgttttggccccccggggcccggaagaatagaaagagcgtgcttggcgccaaaaagaggggaacagtccctcccaacctaagagagaacccccaacgtggtgctcattttggaaccagaggagattaacacacacggttcgcaccacacccttgggtggggagaacaccaagagaaaaacttctcacactctgtggtgggtggattgccacacaccgcacattgggagactcccatcggagacctgtggttggtctatttttgtgccctgccccctgtgtgttctggtaaaaatagtgggggtctcccttacttgccattatacaagaggaaagagccaagaacatggggacacttttagagtctccaccaggaagaacacctggccacccacattgtttcgccctgtccaacacacagagtgtaacatccggaagaacacaaagagcgcctttttggctaagactggtggaagactatccaggacccaattaccaatagaccagataccgatgagatccccccgtccactggggtggccaaagtcctgggtcctaagatctgtggcgtctgtatctgcccaagctctgaaaaggccaagggctaaagaacttgcccctataactgggcgtaaaaggaccctgttgaattttctgtacataaaaataattgaaataataccaattttcccttcca

SEQ ID NO: 578815 - DNA, 933 bp, Homo sapiens
  misc_feature (1)..(1): n is a, c, g, or t
  misc_feature (48)..(48): n is a, c, g, or t
  misc_feature (61)..(61): n is a, c, g, or t
  misc_feature (117)..(118): n is a, c, g, or t
  misc_feature (170)..(170): n is a, c, g, or t
  misc_feature (174)..(174): n is a, c, g, or t
  misc_feature (180)..(180): n is a, c, g, or t
  misc_feature (183)..(183): n is a, c, g, or t
  misc_feature (213)..(213): n is a, c, g, or t
  misc_feature (216)..(216): n is a, c, g, or t
  misc_feature (234)..(234): n is a, c, g, or t
  misc_feature (237)..(237): n is a, c, g, or t
  misc_feature (271)..(271): n is a, c, g, or t
  misc_feature (362)..(362): n is a, c, g, or t
  misc_feature (391)..(391): n is a, c, g, or t
  misc_feature (464)..(464): n is a, c, g, or t
  misc_feature (499)..(501): n is a, c, g, or t
  misc_feature (518)..(518): n is a, c, g, or t
  misc_feature (520)..(521): n is a, c, g, or t
  misc_feature (588)..(588): n is a, c, g, or t
  misc_feature (767)..(767): n is a, c, g, or t
  misc_feature (799)..(799): n is a, c, g, or t
  misc_feature (801)..(801): n is a, c, g, or t
  misc_feature (839)..(839): n is a, c, g, or t
  misc_feature (842)..(842): n is a, c, g, or t
  misc_feature (863)..(863): n is a, c, g, or t
  misc_feature (872)..(872): n is a, c, g, or t
  misc_feature (925)..(925): n is a, c, g, or t
natgttcattttcccccttccctccctatcttttaagaattaaaaaangaagaaacaaaanaaaaatttcatccccacaacgcaagacacgatgcttcttgaccagactctgcccanncgcccctcctgggagctccttctcaatccgcctcactgcggccaggtcattntggnggtgcntgntcccaggggctgcagcacctagttttatanttnggagaggttgggataganctngggaggcagctgaggtgttttagtgtcaaaagangactggctgacccccctagctcaatttggtctcacaggtgagaaggtacctggctataaatatgaatactgattgaggcaggcttgatctnagactttcagggcaggcagaatgactatngcccaggtcccacaggatgtggagtttccgggctcagcatcatggtatctggggcgcatgtccaagtggagtnaattctagctgggaaggtccgctcaggcacacggnnnccccggtctgtttttcntnncccaccccatggagtatccaacgctggtacctcacctcccccccaaccccaatagcacccatgtgtntcaggagcctttggatgcctcctgccatcctgtgtgcaccctgaggccctataactcgtctcgcatcttgtcacccttaggccggaccaggcgcccaatgaatagcagggagccgctttgggtgtcccgcactaggaagatgaaggggtggtcggcgtagaacagcttggggctgcgantccctcgcgcccgtagatgtcctggtcaaagnanttgccatctgtgtccactcaaaggcggtggcgtggacnctnggccaggtacaggtcttcttnctgacatgntgacagtcggcttgttttgtcatggctcagtaggccagccagcagtgttctgnggtatggg

SEQ ID NO: 578816 - DNA, 547 bp, Homo sapiens
gtgacagatatttttacacacacacacacacacacacacacacacacacacccaacagattagaaaagtttaataagtacacttggatatctaagttttaccagctatttatatcggctatttagttttcatcctgccagcagtgcttatttcattttgtctatatttaacatttggtcaggaatatgaaaacataatctgttttaagactcctagaaagctatgatattatttcgttaatactatcataggtttctaggttacaggttgctcgcttctgtaatctcagtactttgggaagctgaggcaggcagatcacttgaggtcaggagtttgagaccagcctggccaacatggtgaaaccctgtctctactaaaaatacaaaaattagccgtgtgtggtggtgtgtgtctgtagttccagctactcaggaggctgaggcacaaaaatcacttgagcccggaaggcggaggttgcagcaagccaagatcggatcacttcactttagccttggtgacagagtgagactgtgtctcagaaaaaaag

SEQ ID NO: 578817 - DNA, 141 bp, Homo sapiens
  misc_feature (113)..(113): n is a, c, g, or t
  misc_feature (125)..(125): n is a, c, g, or t
aggtctcctaaaactgggattaagaaccttgctctcctcatctccaaggcagggaccatcaagaacctacagactccatctcttctgcagcctcatgccaacccgggctattntgctgccttaanacaggtgtccttaacc

SEQ ID NO: 578818 - DNA, 278 bp, Homo sapiens
ttcatgacttctctttggcacatcaaaattgctaacatgactactcttgcattttgggtccattattaagttaaataaggattgttacttgaacataagcactgtggtacccaacagttgatctgataatcaagatggctactaagtgactaactggtaggtagtgtatgtatacagttacagcatggataagctggacaaagggatgaatcacatcctaggtgggatggagtgggacagcatgagatttcatcacactactcagactagtgagcact

SEQ ID NO: 578819 - DNA, 149 bp, Homo sapiens
aataggctggccccaggctcgaacccactactgatcagcagcgcgagtttagacctgctccgtttccgacctgagccgggtcacccctccttaggcaacctgctgggcccccgctcccgggaggacaccatattgatgccgagctaacg

SEQ ID NO: 578820 - DNA, 316 bp, Homo sapiens
cccgcgtccatcccccttcgtcagtgactcagacccacactgtgccgtgcagctgtgtgccctgcacacccgcttgacggggcactgattacttttggggggccctttcagaggcacttttaaagcaaataaaacattcattgctcaaatgtttttctgtattcttccttttaacaaaaacatgcatacatacacaggggatggtgggtcctaggaaagacacacacacacgcttcacacacacacgctcacacccacactttagtgagcacatgctcacacacattttgcttcttgaccccaggcctgtacccca

SEQ ID NO: 578821 - DNA, 812 bp, Homo sapiens
  misc_feature (600)..(600): n is a, c, g, or t
ctcgctgccgcgtcctggcgctggctgctgctgctgtgcgctgcctgcgcctgctccgctgcccccgccgtgccccgttacaccaaccactgggcggtgcaagtgctgggcggcccggccgaggcggcacctgcgtggccggccggcgcacggggtacctcaactatgggcagattggaacacctgcgaagataactaccattttgatcacagcaaaacctttaaaagatcaaccgttgagtagcagaggccctcaacgacccttcctcagaatggacccccaggttgaaatggctccaagcaacaaggaagtgaaacgaagggtgcaagcagaccaggtgctgaagtgacccgaaggccctattactatcaacgaccccattgtggtccaacatgtgcgtacctgcaattgtggcgacaagaacagtcgctgccggttctggaactgaatgtccaggcagccgtggaacgaggggctacacacggaaaaaagcgtggtggtcaccatccttgatgatgggcataccagagaaatcacccctgatctggccccaaaattatgaattcctaacgccaggctaccgactgtgaacggcaatngattattgacccatctccaggatattgactgccatgcaatgaaaaaataaacaccggcactcgttgtgcggcaaaagttgctgcttccagcaaaacaagttcctactggcatcgggggcatagcgtacaatgccacaataggggggctaccgcttgtgggacggggatttcaaaatgtgtccagggcaaggcccggcgcgttagaacccgtc

SEQ ID NO: 578822 - DNA, 1100 bp, Homo sapiens
gcgagaaagaagctgtctccatcttgtctgtatccgctgctcttgtgacgttgtggagatggggagcgtcctggcggctagtgctccatggcgagctggataccatgtttgtgtggaagtgccccgtgtttgctatgccgatgctgtcctagtggaaacaactccactgtaactagattgatctatgcacttttcttgcttgtcggagtatgtgtagcttgtgtaatgttgcataccaggaactggcaagaacaactgaataagattcctggattttgtgagaatgacaaaggtgttcgtcccttgtaacattctctggttggctactaacagctgctatatcgtttgtgcttcggcttctggctactgtctctactcttcttctctctttactaatgatcaacactgacgcagtaccacgctgactcctagacgctgcacgtgccacaactggacttccggctctctttaaatttgctgcagcaacttgcaattattattggggcacttcttcattccagcaaggaactttttacaactgctgtgcgtctaatgctaggccactggccacgtgcccttctcgttctcatcctcatacaacctagctccttaccttacttgcattcttgcaccattccactggacactggacatccgtggcgtcgcacccacactcgccaacccaacggcgcaactccgaagcatgctccgctaatgcacgcctttgctcatccagcctacagcctcctgacattatctgcctgctcctttcacttgcctatccgtcctgtcccttggtctactaacactcaatccagcccagttgtccaagaaaaaccaagggccgtccatcaggctgtcaacaatgctccctcctgcgttgggtgctttcctgtaaattgcccttactactggcccaacacaatccccaagcatctcccccaacccaagatcctcgctctcggtccacagctctccagcctacttcccgcccctacaccaacggcacttccgccatgcgccacctctgtcccacgtgacccacaacctcatttccccccaccccctactcccctacgggctacactctcccccagccg

SEQ ID NO: 578823 - DNA, 693 bp, Homo sapiens
gcaccacggcagctctccgccaatttctctcagatttccacagagaccgtttgaagatctcaagcgcagagtatgccatgaacgcgatatggccaggcgtggtgggacggcctggaggtgtggtgagggggaacgtgtaggaatgggccacagacatggccgtgagcccgtctagccatgccaggaaggctaagagcatgtaagaggccgagcacacttaacatacaccgagaaggcaccaatcccaacactgtggcacctggacagacataagacagacgaaaccagggaaaaagagaagacaaccagaaactaggcgggggctcacaaacaccaatgaactccaaagcacacaacaccagaccatcaacgggaaaagcccgagaacaagcacaagaaacacgcccgtagaacacagaatagacaccaaacaggcaatcaagagaaaacacgacaatagaaggatccgacaaaagtcactggaccaacaagtcgttcacaccactgcaacagagatggaatagacggcagatacatacgaagccgaaagcgccacacgcacaaaccaaaccgcagcgacgtagaagacataacaccaacccaaacaagagaaaaaacaaaacacaagcgcgaaagaacgaaaaaaaaacacaacaacaccacacatcacagaaacagaccaacacaagaacg

SEQ ID NO: 578824 - DNA, 158 bp, Homo sapiens
tattgtcactggcggaggagtcagttgatatttagggatttattaggtagtgagtgttgagcttgaacgctttcttaattcgtggctgcttttaggcctactatgggtgttaaattttttactctctctacaaagtttcttcctattgtccaaagagc

SEQ ID NO: 578825 - DNA, 296 bp, Homo sapiens
ggtcggtaccctgtgctggggaagatggtggttgctggccagagtcgggtgatgagtgggtctgggtatggggcgtgggcgcggtgttgagcgtagctactctgtccagtcccagaaggaagctgttccgtccagttgaggagcggcgcgctgatggttcactgctcctcctccaaggactcctgcgagatgccctcgtcttcctccttctccagttgttttggttctgccccttggtttccttccttgagttgtggtggttatccgggtcttggtagcacccttgttttttgctt

SEQ ID NO: 578826 - DNA, 291 bp, Homo sapiens
ttccttgtcgagcgggtcgtaaaccctcatcccttgatttgtattttttttttttggaaaagggaagtctggctcggtcaccagggtgaattgcaggggtgtgatcacagccgtcaacctccaaggcctcagcagctcctcccacctcagacctccgtgagtagcgtggaacatataaacatgtaccaccagtgccaccgggatgggcttgggctcttttttttttttatttttggggagaagggaagggagtcccccggcggggggcgcgccacagggcctctcgagaga

SEQ ID NO: 578827 - DNA, 302 bp, Homo sapiens
  misc_feature (3)..(3): n is a, c, g, or t
  misc_feature (27)..(27): n is a, c, g, or t
  misc_feature (108)..(108): n is a, c, g, or t
  misc_feature (110)..(110): n is a, c, g, or t
  misc_feature (112)..(112): n is a, c, g, or t
gcngagggtggcatcagctgccgcggngggcgtggacacagccgcagctccggctcggtggagctcccccagcgcacggcagagtccgggcagagacgccgcgtctcnangnggggtcacgaatgcggccgacatattacccccagcaccctcagcgtgcctttcccgacccccttggaggcggaaatcgccatgggtccctgggcaccagatgccgagccccaccaaagggtggtttggggaaggatctcacagttgagtgggcaggatcctgggtcgtccgctggaaagttgaaagattg

SEQ ID NO: 578828 - DNA, 459 bp, Homo sapiens
  misc_feature (108)..(108): n is a, c, g, or t
agtagagacggggttttgccacattagccaggctggtctcgaactcctgacctgaagggatccaccagcctcgtccccccacaatgttggggttacaggcgtgacacntgcggccagcacatgtcttcttttttgttaagaccaggtctcgctctgtcacccagactggagtgcagtggcacaatcttggctcactaaacctctgcctcctgggctcaagcgatcctcccacctcagctccccaaaatagctgggactacaggtgggtgccaccaatgccaggctaattttgtttacttttttgtagagataaaacaccatgttgctgaggctggtctcaaactcctgggctcaagtgatctacctgcctcggctccaaagttgctcacagccatgagccaacgtgcctggcctatacatctcttgggtacacatatatgagtttctctaggggacaga

SEQ ID NO: 578829 - DNA, 173 bp, Homo sapiens
ttcaatttctacacgaggacactcagctgttctgctacccatttatttttaaggataggactccattccttgaagtaacagtagtcatcataagaaaaatttcattttaagaggttagaagagctgttgtcctaaatgtactgttatacataagaaattgtgtagaaattgaa

SEQ ID NO: 578830 - DNA, 135 bp, Homo sapiens
acatgatgatgacatcaccccagcttaggggcctctctgccaagaggaacttttatctggttctgacccatcccttcagggtttgactaggagacacttccccttctctgatttcctaggcggtgatgttctctg

SEQ ID NO: 578831 - DNA, 293 bp, Homo sapiens
cgggacgggagacgacggggtggaaggccgagggcccaggaggacagcagtggctggtgggagaccctggaccccaaacccccaacagagtgggacccagctgtggtctggtgtgaagacccgtgcaccatgctgcccccagtgtgacctccactctgggggccttggttccttctgagtgctgcatctcgcacacaatccacagtgtgacatgggtgcgggctagggccacatggaatgcctcaccccagtgactgggagaactgtggtgtggatggccacccttgccttgg

SEQ ID NO: 578832 - DNA, 333 bp, Homo sapiens
  misc_feature (24)..(24): n is a, c, g, or t
  misc_feature (113)..(113): n is a, c, g, or t
  misc_feature (134)..(134): n is a, c, g, or t
  misc_feature (137)..(137): n is a, c, g, or t
  misc_feature (180)..(180): n is a, c, g, or t
  misc_feature (198)..(198): n is a, c, g, or t
  misc_feature (208)..(208): n is a, c, g, or t
  misc_feature (210)..(210): n is a, c, g, or t
  misc_feature (212)..(212): n is a, c, g, or t
  misc_feature (223)..(223): n is a, c, g, or t
  misc_feature (249)..(249): n is a, c, g, or t
aggacattactggctatgggaatnggtacttatgaaaactaagggttgggtctcctgaggaactctaactacccagttagctcttctctttggcacttaatatgaccactgcngggatgaaagggtctacagtngcnacttcaacttggccaacagtcctcccagtcctggtcgagcttngaatcgtcccttgaagtnttcttcagtntncnccttcactganagtttgattccttcaggaagactgcnttggattatttccaagaaaatttctgcaaacgtagcacttaaaccgctgaactaaaccacttgctcatgggtggtaagcactga

SEQ ID NO: 578833 - DNA, 203 bp, Homo sapiens
gctcgctgttcgctggcacctcgctgtcgctgctaaacaatacaacattagccaggcgatggtggtgcatgcctgtaatcccagctagtcgggaggttggaggcaggataatcacttgaacccagcaggaaaaggttgtggtgagctgagattgtgccattgccagcgtagatgtcggtggcctttcccacagacacctccag

SEQ ID NO: 578834 - DNA, 272 bp, Homo sapiens
cagcgaaaacgaagtacttccatactgtcctctccgggaatgagccggttctgtttcttaaagtactttgattcatcctgcgagaggtccccctggcgtcagccaactccagcacaatgttcaggctcgttgtccttcgattaacggaggtccaatacttgatgatattggggtggtaccgttgcttcaagagggcgatctccttgacacagtcctgcctcgccttggggtccatcatctcaaagatctgccccttcttcagagccagtgtc

SEQ ID NO: 578835 - DNA, 153 bp, Homo sapiens
gcaagactcagaataaaaggacagatcccagtgagaaaacttaagtttaaataagtgtggtaaaataatctacaatattaaatgtaagttactcatcagatatattaattttacagcatataaattaagaaataaaattctccatcaattgga

SEQ ID NO: 578836 - DNA, 114 bp, Homo sapiens
gggttctccaaacggatacagtagcgccaccagtacacgtgggaattctgggcttccctcatgcccatgtagaaggggatgacagtgacacgtatgttctcagttgtttcccga

SEQ ID NO: 578837 - DNA, 370 bp, Homo sapiens
tactgttgactgtaatatactaacaagtgagtactacagcttcgtgagttcccttagagacttcctataagattaccaggtctcaagtggtcttgggaacccctggagatattactgaacttaaagttttcagaatatctgtatgtggtatattccagtggcaagcactatatccatcacacgttttcatttattgacataactccaaatatttccacatagtctaaaattcaggaaagtaaccctatccttacctctgaggatagggcttgttaagcataggtaaaccatgataatttaaattcacctgttggtgactgactttttttaatgactgtttttagtcaagaaaatgtgaaggtaggtctgc

SEQ ID NO: 578838 - DNA, 98 bp, Homo sapiens
  misc_feature (84)..(84): n is a, c, g, or t
ctcaaggtagccccggagaccaaagtgaagagcagctagcaccaggcagggagccagggcccccagaccttccgccaggcgttnggcaagtacatcaa

SEQ ID NO: 578839 - DNA, 189 bp, Homo sapiens
  misc_feature (146)..(147): n is a, c, g, or t
  misc_feature (173)..(173): n is a, c, g, or t
  misc_feature (180)..(180): n is a, c, g, or t
tctgcaggatcttgtgaataaccagcgaccaggggagatgcatgtttatttacaccagcagccaggtgggtgaggctcacgctgtcctgtggtcttgagatttttatttttggcatatgtaatccattctgtacaggtagctaacnnttgtaaaacgctagtgtattcctggnggtaccnggagctcga

SEQ ID NO: 578840 - DNA, 293 bp, Homo sapiens
ggtcgatgtattagtcaatttgcacactgctgataaagactgggcaatttacaaaagaaagaggtttaatgggacttacagttccacatggccgaggagacctcacaatcatggcggaaggcaaggaggagcaagtcacatcttacatggatggtagcaggcaaaaagagagagcttgtgcaggggaactcctcttttaaaaccatcagatcttgtaagacttattcactatcatgagaacagcatgggaaagacttgctcccgtgattcaattaccttccactgaggcaagg

SEQ ID NO: 578841 - DNA, 120 bp, Homo sapiens
  misc_feature (71)..(71): n is a, c, g, or t
  misc_feature (108)..(108): n is a, c, g, or t
aattcgcggccgcgtcgacgagaagacgacagaaggggccttttgcgggtggcggcgaaaccggagaacancgcccaatgggcttcgggcaacgctaacgagaattancggtttgggtcg

SEQ ID NO: 578842 - DNA, 1584 bp, Homo sapiens
  misc_feature (1054)..(1054): n is a, c, g, or t
aaacgtccgtcgtggtgttgtcgatcccctgctgtagtgtgaagtcccctgggggggatcctattactacctctctcgtccgtgattttttctctccatattggtgctcctccgcggtgcgtgctcggtgattactacacattgtttgtcgaccccaccccgggggtacctcctggtcttgttgccccccctttttagtccctcatctttttttagggtcgtcgacgccaccctgatgaaggaggacccacaacattggttgggcacaccgcaaataaaaacgccgccaggcgcgtgtggtgtcaacgcgctggttcctccctgcgggcatatctctcccccgccggggggggaataaacttcttggctttcgggaaccacacaacagtgacgtctttctccgggggggggcaccacaaagtgaaaaaacaccctacagtttctgtccctaaatgacccccgtgttgggttttccgggtggggagaaaaaaaactcccgcctctgggcttcttcaagaggggctcttcttcttttaatgtggcagaatactgaattatgtttgttcctgcgcccgcccaccctacgagcaagtggggattgttcccccctctgcgggccgaattactagacaactgttgatgagggagtataagacgccgcgccgggtgggtggtcttctgtctttgtagaaattgctgcccaaaagacttttggggtggggccgggaaaatatgttgtgtttttcgccggggggtctccctcctgttttgggggcctccgctcttctgtctccgtgatttggtgtcctctcctctcagacaccccgctcttctcaaagtggtgtgtgaaagatctggggagacacactctgtcttttgggtctgcggtgtcgccacatattctaaatggccccgtgggtatatttttcggctctttaaaagtctcacagagacccctctcgggagtttacacccacaaccccttctcgagagcccctcttgtctccacgatgaagtgtgggtggctctgtgatattggtgacacacacagagngggtgtgtgttctctgtaaaatatattttcccttctaaaatgttatactccacgagacatatgagaagatatatatatgggttcacattataaggcttataaagggggagaaccacatattgttgagaatgagaataattttggagaactttacccacaagtctcctataagaggaactcttttgtgagaagagggagataataataatatgcacatagtgatccactatccacctctatataacaagtggagaaactctcttggagccacacgagatttggagattaaatttgtcttttgagaagttttttggtaataataaaataatgtaaaaaacacatgctttaaatttgcacaatttaaaaatgaaagggggtaaaataaagttaagaacacatttaaaaagagaaatgagttgttacccacataaaattatagtgctataatgctgaggagaactaccgttttttttttgaatttagtatttgagatgagttgttgggacacacccaatataaatgaagaatga

SEQ ID NO: 578843 - DNA, 187 bp, Homo sapiens
aaatggttttttggttacaggtttttaatggtaccaaacaaaggtatttggcacctggttccctgggtccttcctttttaaaaggtaggttcattagatcaggaaccttggttctaagtctggttccccgtaggccccaaatgttctgctgtggaggaaggttcccaataaaagtttttaaatgaaa

SEQ ID NO: 578844 - DNA, 122 bp, Homo sapiens
atcctagtatgacgagctaatctgggccgacttgtgtacttgccagctccagcagtctatcttgtacactgctttgatgacacccaacgcaactgtctgtctcatataactgaaaagcaagc

SEQ ID NO: 578845 - DNA, 133 bp, Homo sapiens
gatgacacttgtagatctcgttggccccccttagtccaggagactaataagcagcccccgccagacggtgaacccaatgggccatctcccagaaagtttaacaaaacccgaccaggtcgcccccgttcacctt

SEQ ID NO: 578846 - DNA, 200 bp, Homo sapiens
cttgagtgtgaggaagctaaaaatgtttgcacagtgcaactcccgcccttgctccctcggactctccgtggagctcccacggactgaaagatgcgtgcccccaagcccgaacgagccccgccgtgccctttgcaaagggcagcagtggccgtcgctgccctgtgcgggctcccggtggctggcagccttgtgccaggggg

SEQ ID NO: 578847 - DNA, 554 bp, Homo sapiens
tgggggggggaattttccccccgcgcgccccccccaggggggggtcagggggggaaggggaaaagggggggggggggggcaacctacaaggggtggtgctcccggtggggtttactacttctcttgtgtggttttgcttggggaccttttggtgaggagggagagggggtccacgtgcgaagagagactttttgtgggcgcgtgttggccgatagggaggtagcaggcgccttgtggtgttggctggccccctcgccgtggtgtggtatatctttccgcgggtggggcgtgtcgtgtgtttatactgacttcccaatgaatatcaagagggggggtttttttttttaacagagagggggtccaatagatggttcccacaacaccttctgtggtggctactgagaaagaatccgcgcgcccgcgggcacctccagagtaatctcctgcgcggggggtgcctccgtccgagacccccgtctgctgttgttggtggcgggggcccaggaggtttttctcccacagggggcgctctggagagagcccccccttggggg

SEQ ID NO: 578848 - DNA, 196 bp, Homo sapiens
tcggggtattgatagtagaaaaggctcccaaagcacggataggagacctgccacaaaaataaatacctggtgccttctgatctcacagttggtcagttctacttcttatccggaagcgaattcatctccgagctgaggatgccttgtttctctttgtcaacaaggtcattccacccaccagtgccacacatgggtc

SEQ ID NO: 578849 - DNA, 148 bp, Homo sapiens
gattagcagaactagtgtttttgttttcacattcagttctcctgaagcggtgtaaggctgaaatggtggaacttctcaaagaaacaggataagagtaaaagtagactgttcctgttccaaagtgtggaagcgaactctgccaagtgca

SEQ ID NO: 578850 - DNA, 732 bp, Homo sapiens
tactatgcccttgctcctttgattctcgagacaagagaacgtcagttacagaaggagaagaaagtagatagaacgtgcggagcaggggaggtgcccaagttcgaaggcgagcttccgctggcctcatttggactaccattaagctgccagagaagaaggtaaagaatgtgacccagattgaacctttgcggcttggagactgatgaggagaggtgtctctgaaggtcacagacttggatagcaccagctggaagaagaactgagacagtggacagaagcagcgttgtatcaacggctcgtccaaacagcgtgcactctctcaggagccctttgttcccaagaaagagaagaagatcatgttgctgagggcctttctggttctctagttcaggaaccttttcagctggctacgtgagaagagagccatgagatgcggcatggtagcgtggagcgaatgagaatggcgtgaggtagaagcccatgagaagcccagcatttggaggaggccgagactacaggaggaagagctagaaacaagagatggagcggggcaggctacggagagaactggtgcataagggcgagatccaatacgcaagtaccgagggtctggacgataaacgtctaagtgaccagcctctgactgtgtctgtatctcccaaattctccagtcgattccactgataaactcagctgtgagctgcggatagccgccggcatgggaccgggtcg

SEQ ID NO: 578851 - DNA, 88 bp, Homo sapiens
ttgctgtgctctgcttctgcccctgcttctgctgcttcctgcttctgcctctcatgtctcttcacctgtgccagactagagtcaagcc

SEQ ID NO: 578852 - DNA, 419 bp, Homo sapiens
  misc_feature (339)..(339): n is a, c, g, or t
  misc_feature (413)..(413): n is a, c, g, or t
aaagtctccagatgcagtagctcacactgtagtcacagtgactcaggaggctgaggtgagaggattccttgaggccagggttcgagaccaaccttgggcaacatggcaagaccccatttcttaaaaaaaaaaaaaaaaaaatttaaacttagctgggtatggtggcacatgcctgtggtctcagctacttgtgaggctgaggcaggaggattctttgggcccaggagtttgaggttacggtgagccacaatcacaccaatcactgcactccagcctgggcaataaagtaactcttggactcaaaaaaataaaaaaaattgtagtggtagccatgtgttnattgtttaaataaattctcccaaagggcttaaaagtaattactttttaatttttttattagtttgtattttttngaccct

SEQ ID NO: 578853 - DNA, 214 bp, Homo sapiens
tcgttattcattcaacgatttataacacctcccttcaggtcatacaaatgttcaaccttaggtaacctgacgtacgagctctgttttcaggtgactgggcactgcaaccccggagaccactgtgtcagcaatgggtgtggccatgagtgtgttgcagggtaaggacagatgaatagttatcttaaggatcatctttccctaagatcgtcatccc

SEQ ID NO: 578854 - DNA, 588 bp, Homo sapiens
agcctgacgctaacaaaaccggagctgatctataacgatgaagcggagcagaaacgcccggtggacgccgagcaaaaaaacgcgcaggatactgcacaggtgcattactttatggagtcatacagggataaatgtgttgaaaagccagcgcaaggccaaaactctggcactgaaagaggtgtctcccgcagtggagaccggttccgtgaaaacagttttggcatcaccagacgttctagccaaaaggaccagaaaggttggccgggagccatcccccagaagaactacagaggcaaatgacattgtttctaagcagatttaagggcaagcgggggaagggaaacaaacccgttgtcagatcacaaccacgccgctgtaaaaaaggcgagcagtacagagacggttgaaaggcgagctagaaattcccttggaagaagctcctccagaagaattaattagttaacacgaatttactacaaagctcagtctgatggtatctggggagaacatgaaattgattacatctttgtgggggaggaagaacaaaattatctgccgcgctgaacacatagggacattagcccgtcc

SEQ ID NO: 578855 - DNA, 117 bp, Homo sapiens
gagtctccagagatggggcctggagctcggaggaaggggccaggctcacattcgtggggctccctgaatggcagcctgagcacaggtaggcccttaataaacacctgttggataagc

SEQ ID NO: 578856 - DNA, 364 bp, Homo sapiens
aaagaatctatgctgatgacagagtactgcacttgattctaccatggaaactaacagatagtggtgagaagaaagcctaagatcggggggtctaagactgatggaatcgtttatggttccattggatggttggaaagagatttggagagaatcaggcattcagtgtatttctttcccactgaaatcccaagaaagcagagttggagtttcatgtatgatgacttagtgccatagcagtggtactagcttggaaactggactaactctctgggatggaatccgtgttcgtgtaaagcaaaaacctattcatttttatagaccaaatatttggatggtttatatttctacagtattaacagcgacc

SEQ ID NO: 578857 - DNA, 689 bp, Homo sapiens
agagggccatcgctggtggcggggacaagttgtgaagagttttaaaaaaatttatcatttctccttaactttgggcaagttaagaaatctccgatggtggatgtctcagcaagtacctgatggttgtcctccacagaacttaccctggtgcagatgggaggcatttcaagccacaggaccggcacttgccctctgtatggtaaacacataacggtgtgagtcctgtatcagatgttacagcaagtattagcccatttgggtgcaatcatgcgcctcatgccagtatgtgggcctaggcctcttgggaccgatcatgtttttacccagagaaaaaaaagcatcgccggttcgctgcctgtgacaccatgtcatccagcaatgggccaatggcctttgttggcaacaaggtgagcagggcttacattcttctgcgggaatatttatacagcgcagaggagtcttgattccagtctggtggcaagcttccattcgcttaagatgcctgtagggagtgtcaaaaaaccggtctcgttcttgcagtttggttcaggctggcagtccaagtaaactttctgtgggtgtgccctctttcaataaaccaagtaccattccccctcttggtatgccagtcacggaggccttgatcggtcaaaccaatgtttaaaactttggctacaatcaagagctgc

SEQ ID NO: 578858 - DNA, 338 bp, Homo sapiens
tatacttgtgttttttttttacagcccaaaacccttattttccttttggcccaatggaagatttttgcacaacctgaaccccggggctgggcccaacgtttccattattccccaaggggaaatccggggggtttaggactcgcaatttcccttttttcctgaaaatataaggaactggacctattggagaaaccctccttggctttcctaattataaggtttcagagggcttgaaatgtggttttgggaagttgccattttggaaaggggttaatttgttggggatacagggattgcctgctttaaaaacccccttacccgtgactcgcccctttggg

SEQ ID NO: 578859 - DNA, 81 bp, Homo sapiens
acatctgtgtacttctgtgccatcaacggcggctaccaagaagagcagtacttcgggccgggcaccaggctcacggtcaca

SEQ ID NO: 578860 - DNA, 766 bp, Homo sapiens
tgggcgggcggggccgggggataatgaggtcaggagtttgagaccagcctgaccaacatggtgaaaccccgtctctactaaaaataacaataattagtggggcatggtggcgcacgcctgtaatcccagctactcagcaggctgaggcaggagaatcgcttgaacccgggaggtggaggttgcagtgagccgaaatcgcgccactgcactccagcctgggcgacagagcgagactccgtctcaaaaaaacaaaaacaaaaacaaaaattaagccaggcgcagtggctcatgcctgtaatcccagcacttgtgggaagccgaggcgggcagatcatgaggtcaggagttcgagaccagcctggccaacatggtgaaaccggtctctactaaaaatacaaaaattagctaggtgtggtgatgggcgcctgtaatcccagccactcgggaggccgaggcagaagaatcgcttgaacccgggagggcggaggctgcaagtgagccgagatcgcaccactgcactactccagccttggggacagactgagactccgtctcaaaaaaacaaaaaacaaacagacaaaaaaagccaggcgtgatggtgggcgactacgaatataatccagctactcgggaggctgaggcaggagaatggcctgaacctgggaaggcgaaggtgcagcgagccggaccggacactgcactccagctgggtaacaggagatgtctcaaaaaaaaaacgcaaagaaaaaaatttggggccggcccg

SEQ ID NO: 578861 - DNA, 944 bp, Homo sapiens
tggctattaatcctgccacaaaattttaaataacttacaaaaatctgaaattgtcacccaggaacccatttcacccagctgctcttttgggccgccagtctttggtctctcttttagagcaatggtgagggggatacccttttcctcggggaagcagaattcctagggttggtcgccctgtgcgattacacaaaattgttggcaacagtcgatggcgcaaagctgtctgcccatgggccttcttctcacgtgaaccccacgtcaaaagtacccgagggttgccctctctcgtggtgggtgactcaacgcccaatttctctccttaggttgagcaccttcccaagtaaccattacacgggttcaccgagttgctcgcaccttgttgcaccatccaggtattctgtgccggtctctacaatccaatctgcatactggtcatcatcccacctgtgaatcgcagcgggactcgccgcttaccgcgcagtggcggcgcggccatcaatgcgctcccccaacatgagggatcccttttgtgtcgccccccaccaagcattctttccctcgacttctgccacacctcttgtacttgtggcctccctcgggtggtacacgattgtacagcaacggcgacctttgctgccatacgatcaagccggaatattcctctcccgtcgtgtgtccactgctgttgacatcctagtgattcccgcagggacgcttctctcacagccgcaccttgccacccgatttaatgaaccgctggttcaaattcttcttcatccagctcctgggccggcctactaacgttttgccctccggaacatgtgggcgggggactcctcactgtggggcccgtgctgggaacgccgacccccggcatttcccctcagcgtggacgccccctctatttttggcacgccgggtgtccataacgagctatatcg

SEQ ID NO: 578862 - DNA, 396 bp, Homo sapiens
tattctcaaggggatcgaaagggtcatgtcgtcacatatatagttggcatgatagcctgtcctgcacgaatagtgatcagcaggcgcggtatgtgtctcgcctcgacgtatactcatgcaccctacatagctgcataagcgcgtggactatataatctgctgcaaagtacattgtctgggctccaggatgttagcaacgtctctcctccaatagtcataggtatctaattccctatgcaaaagttatagtggtcactccgggcactatcatggtggatcatactaatagatcattcccgaacgggaacacatcaagtggctcagatagctctcactatcgcttaatcaaaatctgagtctatggcacgacagatgtagattcgtagtacactgtag

SEQ ID NO: 578863 - DNA, 496 bp, Homo sapiens
  misc_feature (24)..(24): n is a, c, g, or t
  misc_feature (75)..(75): n is a, c, g, or t
  misc_feature (132)..(132): n is a, c, g, or t
  misc_feature (135)..(135): n is a, c, g, or t
  misc_feature (142)..(142): n is a, c, g, or t
  misc_feature (150)..(150): n is a, c, g, or t
  misc_feature (177)..(177): n is a, c, g, or t
  misc_feature (181)..(181): n is a, c, g, or t
ataatgagacgtcgaagtttaaanggaggtcataggagttcctggagaaatggctctccgttcttcataccccantgagttcaccccagtttctggccacagatttgaggaaggaacctgttgccagggaantcntcctctngtccccantgttgattaactaaagtcctggacacnttcnttcctccactggcccaagacccaccttgacccaccttgaaacctcttttcagagccgagtggcatgaaaaatgtgtactgtttctgcttctgttgatggagtggctgtgggagattaaggaaatgctaatttgagcttcattcataggggaacctactatatattgcatccctgctggttggaaattatcttcatctctggactgcattgtttagaaaaatgttaatggcttacaattctgagaactttattgtgtggctctggggttaagaattctgtggtttgaaaaaaaataaatattttgtattgattccc

SEQ ID NO: 578864 - DNA, 134 bp, Homo sapiens
tttcacacaagttaaaggaagtttaatacagataaggattgaactatacatttttttactgtttatttgtttatttatttatttagagacagggtctaactctgttgctcagcacagagtccagtggcatgatc

SEQ ID NO: 578865 - DNA, 467 bp, Homo sapiens
tggggttgtgtccttcatcgtggggtcatcctctcgtgctctttgttaacttccccatcatcatccctttctgtggctcctgtaaatcagatgttgatcctcccagatgagggcgtcttttttttttttggaaacagttccattttggtcgcccaggtgggattgacgtgggtgtggctctggcgctcagtgcacacctctgtcccccaggtccaagtgattttcctgtctcagctttctgagtagcgggaatacagaggtgcacaccaccacgcccagctattgtttggtatattaaaagaagcagaggggtgtccacctatgtgggccaggttgttctagcagtcttgacctcgtaatccgcccgcctgggcctcccaagtgggctggcttaccgggcgtaagcacacggtgcgcagcccttgtgaggaatatatccctcctccataaagctagcctcggtttct

SEQ ID NO: 578866 - DNA, 153 bp, Homo sapiens
cgaaacaacagtcctgctctgtcaccaagactgcagcgtagtgacacaatcacggctcactgaagcctcaacctcccaggtcaagcaatctcctcctcagctcctgagtggtgggctaaaggcatgtgcacacaggcctggctaattgttatt

SEQ ID NO: 578867 - DNA, 1195 bp, Homo sapiens
cgacgttctgtcatttagtgcgggagggatcatgaacctgctgctggctgaaccctccggtgtccctgacccagtgctaagcttgagcatggctgagcatgtgagcccacagcctgagcagctgtgcccagattgcatgcgtgagaacgaggatggatgatgcactctgtgtcaactacaatgccccctgtgtccagaatgatgcatccatgtgagatccgaggatggctggacaatgttgactggactgaagagccttgcgaaatgtaacaatgtgatgtgcgcctgcctttgggccctgctgatgtgcctgtttcctgacaagaacccactatactgtacacgcctagaaccgtacagctagggttgaacttgtggcctgtgagccctagtgttagttgccagacctactgtggacccccctgtgggacccacaccgtgtgaaagacttagggaccctatgactgtgagactgcatccctttgcggcagaaggcatatccgagatggaaaaggccgaggactccggtttgaggtggttggccgtgcggaacacggtgcactggggcgttggtgtgcgaacggttaaccccggggaagtaacaagagagacgtccagtccctatagtcccttgggggcgtccacacgcccgtggacaggcagagcgaattacacggttggatacccctggggcgcaccttagaacaacagaattaacgaagaattccccgacggaccgagtataggcgggaatacacccaggtgggcaccaaccgacgggcgtgccggatatgctagagcggtgacagttagaggggacacccagagggggaagcgcttgggagaggcgcgtaacccacaccttgtgcgggctcgaagggcggccccagagagccggtcaacatttgggcgagggagccccagcccgcgcgggatgggacccaccgggcacacgcaggagccacgcgagcataccaccagggaacgaaggagttgaggcaccgcacagggggagaccccactcgcgcccgcccggcaataggaggaacacgcgaggaggaaggtgggcgcacaagctgagcacacaccaacaagcagggagcgagactgaagcactgtgcacccgatggaggagggaccccccacacgaggaggccgcggcaaccagaacagcgacagacggaacgccagcggg

SEQ ID NO: 578868 - DNA, 382 bp, Homo sapiens
ttttccccgcctaactgacagtcccacatcgcaagagagttcggatgcggactgaacagacgacatcagatgtgaaaattagaaaatcagtcctgctataggaagaatagtccccaacgatacccaagtcctaattactggaacctgacacctatatgcataaatgactctgcagatttaagttaagaatcctgagatgggaaaattatactccattatataagcaggtcctaatgtaatcacaggtgtctttataagagggagtcagaaggagatttgtctagggaaaagagagtaggaaattcgccaatggaagcaaaaggttggagtgtgacaagaaagcacccatgacccaaggaatgtgattggcctcccgaagcta

SEQ ID NO: 578869 - DNA, 244 bp, Homo sapiens
catccatcttcattcccatcccccaacattcattacttacacaccactcatccatcagttgttgctgtgcagcaattcacatcccatggtcaatcacggcattcatgcaacagtgcacatccacacagcagcatgggagttcattcaactcaacacagggccaaagcagcacagctcacatgcaccatgctcaatgtaggatggtcaaagtgagtggcatatcatacatgggcgccagtggcag

SEQ ID NO: 578870 - DNA, 301 bp, Homo sapiens
tgacgtctagagtgatcccgcactcaggcacttctggcaggagcgtgcgaggtatgctgtcccacaaaaccaagcgaggccacggccgctctggacacgtctcaaggtgtttgagcggtattccaccgtcctacgacaagaatacgcggatggtggttcctgctgccctcaaggtcgtgcgtctgaaacctacgagaaagtttgcctatctggggcgcctggctcacgaggttggctggaagtaccaggcagtgacagccaccctggaggagaagtgcgcctggggaagtgcgcctgggtg

SEQ ID NO: 578871 - DNA, 2165 bp, Homo sapiens
  misc_feature (386)..(386): n is a, c, g, or t
ggtcacggctgtaggggcaggccacctgctaggtaaccgaacaacatctacgaatgatcgtacgtcacagatccagtgcgagtgtagtgagatgaatcctgtctgtcggtaagatacataacccatcaactatagtcgagagggcatattgcgcgaatcattgcacgtacgctctccgccgtcaaactaagtacggtgctggctcgctcactgattgatcgcgtctgattatacaccacagccaatatacgatcgaaccaactacatgctccctgagctccttacgcgtcacctactctcactatgtccttgctgcggattctcggtataggtcggaggtcgcggtagtcagtgcgatacgagagtgttagaagagcgaggtgcanagccgcttcgcctgtgatcagggcagagctattaccgcgatctcggtgaagtgcctcacgattagtaacacttaaacacagtgcgtttcttgctgtacaaacctgatgctagcgtgtttctccttcgtaatgcgttaggagaggctcatgcaagtttccatacaacgagagtcacatctttaattcgaactcaatgaaatagtaactccccctctggcccattagaggcccagaataagctcggaaaaatgtgtccccccctacttccctgttcgttgaattcgccagtccacctgaactctcgaatcaatgtcaaggtggcctcaactttgacttcgctgaattctatctttctcgcatgttccgcttatgctatgcgtagtgcaattttcacctaatgatcgtgaactaaggccaggacgcggaaaacactgcgaatcaattgctaaccattttctgttgcgagctccccgggacggcaagaggaggggatggaacccccaatattcttataactcaaatcaatcgtcatctggtagagtggacaccgaggagcgacccctctgaaaaggtgtgaatcacttgcttatataccgaacccaagggagtatgacggggaagaaaattcgtcccaataattggtaactatgacatagtcctggtggagaaaatgaaccactgtgggatcaacaaagaggcaacggggctgaagctaggagaatcacaccggcgttcgcagagggatacacgggcgtggggcaccccaatatattaacagaaggtatatgaggtgacaacgaggaaataaacgatcgtacataataatgaatcgcgaggcagaaaatagatacgctcacctggcgaacaatcagtgagggtacccaaactatactgagggaggagtcaataacacaacacgtactctcatcctctctctctaccttctgtacttgtgatacacgcaaaaaggaagaaagacatagaaacatagaagagacaatcaagcgaacaagaacacggagccacacgaagaagagagcagcgagacggacgaacgacagagcaaaagaaacaagagagagtacggacaaaacagaagaaaggaaaggacagacagggaaaaacgaggaagaacgagagacagcaacagaagacgaacaagaagaaaggggcagaacagaggcagaccaaggggcagcgacacgaagcagaacaaaggaaagcgaaaaaaaagcaaagaaagaaaagaaagacgagaggaggagagcaggaaagaagagcagaaaaagagaacgcatagaaagagcagaaacgagaagacacagagaaacgaagaggagtagcagaagagaagacccagacgagcagaaaggacagcaagaggaacaggacaacagacaacgaaagcaaagcagacagtcaagagagagaagaagaaaagagcaaacgacaagaaagacaggagaaggaggagcaagagcacgcgcgagacgaggacgagagcaagcagagcgagaaggaagcgaagcaaaaacaaagcagaagagaaaaaaaggaagaagaaagcaggaagacgaaagcacaacaaacagacaacaacaaagccaaagaaaaagaaaaaaaaaaggaaaaagagaaggaaaaaaaacaaaagaagaagacaaagagaaaagaaaaagacagagcgagacaagacggaaaagaaaaagaaaagaggaaacaaaagagagaaaaaaaagaagaaagcgaaacggacaaaaaaaaagacgcaagaaaacg

SEQ ID NO: 578872 - DNA, 225 bp, Homo sapiens
ccccgaaccaagctttagcgccgaggcgcgtgtccaaaggccagtaatccctcctctgtgttgccatgggaattcaaggcctggcaaactaattgctgatgtggccccagtgcatccgggagaatgacatcaggagttactttggccgtaagtgggccattgatgcctctatgagcatttatcagttctgattgctgttcgaagggtggggatgtgctgcagaat

SEQ ID NO: 578873 - DNA, 347 bp, Homo sapiens
cgttcctcccccatctcccccccaggaccaccacgaatacaggcctcagggtggcgctcggccccctcatgaggcgaaacggctcgttttcagagaacacaggagagggaagatgataggtgttccttgaacatctactatgtgagaaacaccacccagggcactgcacctgcctgtgttagaaagaggatgcaaccatccccaacagggaagggcggaaaatgctgcactgcgcatgggctcacaaggaagatacataacgccacagttttttctacagactcctatttctgcaagctgcttgcgttgattaaaactccaatacagccctgccctcgttggcctca

SEQ ID NO: 578874 - DNA, 362 bp, Homo sapiens
cgcacatgtcatgcagtcgatccacgcatccatgtttgcgccatagaaagcgggaaagccaagggtctccgcgaagacctcgtggaaggaaggccaatctgaaatcaggttggtcgggatcggtactatagtggtgttcatgagcgcaccatacgcgtgaaacagccaatatctgcaacgggtcgatgtcagtcttgggctccgacgacgaaagcggtcgctatcgacgtcagctcgggatggttagcgtaaatgccccggacttcgcctacggaaccgctcttcgaacggatgagaggcaagaagtttcatcagaagggactgtcatgccttctgcctctaggcgtcgagccgcagtgcga

SEQ ID NO: 578875 - DNA, 1980 bp, Homo sapiens
  misc_feature (1453)..(1453): n is a, c, g, or t
  misc_feature (1489)..(1489): n is a, c, g, or t
  misc_feature (1491)..(1491): n is a, c, g, or t
  misc_feature (1513)..(1513): n is a, c, g, or t
cagtagcacgatctcggctcactgcaacctcttcctcccaggctcaagtgattctcctgtcttagcctcccgagtagctgggattataggcacacaccactaccacctggctaatttttgtacttttagtagagatggggtttcaccatgttggccaggctggtcttgaactcctgacctcaggtgatctgcccgcctcagcctcccaaagtgttggggttacaggcgtgagccaccgcacccggcccccttccttcgtcttagtcaatcctatcccacctcttcttccaccagtcccctcacctgatggtcccaacacttcatcatccaccacctcctggagggggtaccccgaggtgctccgctggggactctgctcattctgggggtgcggttgacggctggtcgtgatctttcccgtaatctgtcccctcttacggaacctagtctccgttctgtccatggccttcttctggacactgctaggatccagaagagtatgttatcaattctcaagcctaggagaagtcaggagtggagaacagctctgagaagatactgttgtccaactgatctccaggcaccacggagtccggtccctccaatcaggaaggtcggaatctctgatgtcatcgttcatgccaacctggcaaccagtttgaaaaaaaacacatgtaactgccaggctgatctcttgtcctggagatcctgggtgaatggtatctcctgccactgtcccaacctcagaccattgtccaaaagcatcttcagggactccacatccctctgttccctgtcccagcagaggctgtgtcctctccactcaaagcctgaagcatgttggggtctcttcgtctctgtacatgcccatttcagagtccagtctggtgggagagggatcaggatgggaaagaaaagtagggtaagcagaaacgatgaaaccttataagagtgagattatcatgtacaagagtgagattatcatgtacaagagtgagattatcatgtacaagagtgagattatcatgtacaagagatcccaggaacattgacttgatgaaaaagtcacatcagagcactcaatttggcagaggttttctgccgaatgtttactcacattcactgtccgagattctgtactgggggtacacgcgtcctctgccctaaggcatctttgagtccaagagatattttgaggactggaaatcataggaaactgcccctgagctcacacatatttccaatgtgagctcacacatatttccaatggtgtccccaatttcagggaatccatggattacctaaagccagcccctccagttcggctaagaaactctagtctatatatcaagttttgtatcatatgtattgctctgaactcagaaatttcccttccatttatggattctatgaataaaatatcacatgtacaaaaagactaagtcaaaaaatntcagctgtgcacagtggctcatgcttgtaatcccancnctttgggtggccaagggaggangattgcctgaggccagcagttcaagaccagtatgggcaacatggcaagagcccatctctaaaaaaaaaaaaaagaaaaaaaaaaactttttgggcggcctggcctggaaaaattttctaaacaccattcgtgtggggcgcgggcccagagtgttacggaacactgggccaacgaggtcccagagggaaacccgggcacgcatcaggggtggtttactccaccataaaagaaacgcccggggaaaccagagtttttcggacgatcccaacgggttccgcagggccagcacgggtccccaccacggggcccagaggtcgaaagaatacccgcatccgtgtggaaaacaacgagaacgaacaaagaggacaagcacacacgagcacgagcaagcgacattgacacacaaagcaggaacagcgaccaagacacagaaacaggacgaagacggacaaagaagacgacagaga

SEQ ID NO: 578876 - DNA, 403 bp, Homo sapiens
agactgagcaatgtatttaatctaggtaataagtaagtagcaaagcccatactaactgctgaatgatatgcccatctatacatttgaaaactaaggaaaatttaattactacttctgtggtaaagcattgtctgccttctataggccaaaggattagagatttctcagctgaattaaaactattgagccatacaggtgcagtggctcacgcctgtaatccctacacatagggaggctagaagatgggaggatcgcttgagcccaggagttctgggctgtagtagcgctatgccgatcgggtgtccgcactaagttcggcatccctatggtgacctcccgggagcgggggaccaccaggttgcctaaggaggggtgaaccggcccaggtcggaaacggagcagg

SEQ ID NO: 578877 - DNA, 919 bp, Homo sapiens
  misc_feature (181)..(181): n is a, c, g, or t
  misc_feature (185)..(186): n is a, c, g, or t
  misc_feature (189)..(189): n is a, c, g, or t
  misc_feature (269)..(269): n is a, c, g, or t
  misc_feature (276)..(276): n is a, c, g, or t
  misc_feature (280)..(280): n is a, c, g, or t
  misc_feature (283)..(283): n is a, c, g, or t
  misc_feature (892)..(893): n is a, c, g, or t
ctgggtcctatcgggggtggtctggtgatctgtcccctcatggtcctatccatgccctgttgaagggcctccgtagtactctcagtggtgcatcgtgcggactcctcgccgttcgtcgttcgcctctcattcgttgagtgccacagcatgctgtcttccgccagcccaggtctcctcaggntcannggncgagctccgttctctggtctcatcatcagatgtcatcgcgtacactccctctgtcctgtgtgcaggccaagggacctacntgggggnctgngantctaccccagggtctgatggtcccaacacttcatcatccaccacctcctggagggggtaccccgaggtgctccgctggggactctgctcattctgggggtgcggttgacggctggtcgtgatctttcccgtaatctgtcccctcttacggaacctagtctccgttctgtccatggccttcttctggacactgctaggatccagaagagtatgttatcaattctcaagcctaggagaagtcaggagtggagaacagctctgagaagatactgttgtccaactgatctccaggcaccacggagtccggtccctccaatcaggaaggtcggaatctctgatgtcatcgttcatgccaacctggcaaccagtttgaaaaaaaacacatgtaactgccaggctgatctcttgtcctggagatcctgggtgaatggtatctcctgccactgtcccaacctcagaccattgtccaaaagcatcttcagggactccacatccctctgttccctgtcccagcagaggctgtgtcctctccactcaaagcctgaagcatgttggggtctcttcgtctctgtacatgcccatttcagagtccagtctgcatttcccctcnntgcacaaagtcgtggcccagatctgg

SEQ ID NO: 578878 - DNA, 1893 bp, Homo sapiens
  misc_feature (1366)..(1366): n is a, c, g, or t
  misc_feature (1402)..(1402): n is a, c, g, or t
  misc_feature (1404)..(1404): n is a, c, g, or t
  misc_feature (1426)..(1426): n is a, c, g, or t
cagtagcacgatctcggctcactgcaacctcttcctcccaggctcaagtgattctcctgtcttagcctcccgagtagctgggattataggcacacaccactaccacctggctaatttttgtacttttagtagagatggggtttcaccatgttggccaggctggtcttgaactcctgacctcaggtgatctgcccgcctcagcctcccaaagtgttggggttacaggcgtgagccaccgcacccggcccccttccttcgtcttagtcaatcctatcccacctcttcttccaccagtcccctcacctgatggtcccaacacttcatcatccaccacctcctggagggggtaccccgaggtgctccgctggggactctgctcattctgggggtgcggttgacggctggtcgtgatctttcccgtaatctgtcccctcttacggaacctagtctccgttctgtccatggccttcttctggacactgctaggatccagaagagtatgttatcaattctcaagcctaggagaagtcaggagtggagaacagctctgagaagatactgttgtccaactgatctccaggcaccacggagtccggtccctccaatcaggaaggtcggaatctctgatgtcatcgttcatgccaacctggcaaccagtttgaaaaaaaacacatgtaactgccaggctgatctcttgtcctggagatcctgggtgaatggtatctcctgccactgtcccaacctcagaccattgtccaaaagcatcttcagggactccacatccctctgttccctgtcccagcagaggctgtgtcctctccactcaaagcctgaagcatgttggggtctcttcgtctctgtacatgcccatttcagagtccagtctggtgggagagggatcaggatgggaaagaaaagtagggtaagcagaaacgatgaaaccttacaagagtgagattatcatgtacaagagatcccaggaacattgacttgatgaaaaagtcacatcagagcactcaatttggcagaggttttctgccgaatgtttactcacattcactgtccgagattctgtactgggggtacacgcgtcctctgccctaaggcatctttgagtccaagagatattttgaggactggaaatcataggaaactgccctgagctcacacatatttccaatggtgtccccaatttcagggaatccatggattacctaaagccagcccctccagttcggctaagaaactctagtctatatatcaagttttgtatcatatgtattgctctgaactcagaaatttcccttccatttatggattctatgaataaaatatcacatgtacaaaaagactaagtcaaaaaatntcagctgtgcacagtggctcatgcttgtaatcccancnctttgggtggccaagggaggangattgcctgaggccagcagttcaagaccagtatgggcaacatggcaagagcccatctctaaaaaaaaaaaaaagaaaaaaaaaaactttttgggcggcctggcctggaaaaattttctaaacaccattcgtgtggggcgcgggcccagagtgttacggaacactgggccaacgaggtcccagagggaaacccgggcacgcatcaggggtggtttactccaccataaaagaaacgcccggggaaaccagagtttttcggacgatcccaacgggttccgcagggccagcacgggtccccaccacggggcccagaggtcgaaagaatacccgcatccgtgtggaaaacaacgagaacgaacaaagaggacaagcacacacgagcacgagcaagcgacattgacacacaaagcaggaacagcgaccaagacacagaaacaggacgaagacggacaaagaagacgacagaga

SEQ ID NO: 578879 - DNA, 248 bp, Homo sapiens
tgtattaagcatcttatgcctttgctgtggtatgaattatgtccgagcaccctgaaggacagatgctggtagatggtcttcggcacttatgctagggaaactgcacgcttctttcccttgaggtactttctgtaattgtacacagtagaagacagtcactgtcatagcgatggtcctggcactacgcgcggccgacgcatcagtcaatgagtgtcaaagtaagccctctaagagtagaaagtcgccag

SEQ ID NO: 578880 - DNA, 183 bp, Homo sapiens
aacactcagtatggcccccacacagagaactggatcaacagatccaaaaggtaattctggctcaggagactatatgggagccacttgtcatgcctgcataggtggaacaaatgtacgaaatgaaatgcaaacactgcaggctgaagcaccacatatagtagtaggtacacgcgggtgaagggg

SEQ ID NO: 578881 - DNA, 1949 bp, Homo sapiens
  misc_feature (1422)..(1422): n is a, c, g, or t
  misc_feature (1458)..(1458): n is a, c, g, or t
  misc_feature (1460)..(1460): n is a, c, g, or t
  misc_feature (1482)..(1482): n is a, c, g, or t
cagtagcacgatctcggctcactgcaacctcttcctcccaggctcaagtgattctcctgtcttagcctcccgagtagctgggattataggcacacaccactaccacctggctaatttttgtacttttagtagagatggggtttcaccatgttggccaggctggtcttgaactcctgacctcaggtgatctgcccgcctcagcctcccaaagtgttggggttacaggcgtgagccaccgcacccggcccccttccttcgtcttagtcaatcctatcccacctcttcttccaccagtcccctcacctgatggtcccaacacttcatcatccaccacctcctggagggggtaccccgaggtgctccgctggggactctgctcattctgggggtgcggttgacggctggtcgtgatctttcccgtaatctgtcccctcttacggaacctagtctccgttctgtccatggccttcttctggacactgctaggatccagaagagtatgttatcaattctcaagcctaggagaagtcaggagtggagaacagctctgagaagatactgttgtccaactgatctccaggcaccacggagtccggtccctccaatcaggaaggtcggaatctctgatgtcatcgttcatgccaacctggcaaccagtttgaaaaaaaacacatgtaactgccaggctgatctcttgtcctggagatcctgggtgaatggtatctcctgccactgtcccaacctcagaccattgtccaaaagcatcttcagggactccacatccctctgttccctgtcccagcagaggctgtgtcctctccactcaaagcctgaagcatgttggggtctcttcgtctctgtacatgcccatttcagagtccagtctggtgggagagggatcaggatgggaaagaaaagtagggtaagcagaaacgatgaaaccttacaagagtgagattatcatgtacaagagatcccaggaacattgacttgatgaaaaagtcacatcagagcactcaatttggcagaggttttctgccgaatgtttactcacattcactgtccgagattctgtactgggggtacacgcgtcctctgccctaaggcatctttgagtccaagagatattttgaggactggaaatcataggaaactgccctgagctcacacatatttccaatggtgtccccaatttcagggaatccatggattacctaaagccagcccctccagttcggctaagaaactctagtctatatatcaagttttgtatcatatgtattgctctgaactcagaaaattccaccatttatagcagtggtttatttatttataccattgaaggaaatggtttatttatgaatctatattatggatattctataagatactgggtgtacaaaaagactaagtcaaaaaatntcagctgtgcacagtggctcatgcttgtaatcccancnctttgggtggccaagggaggangattgcctgaggccagcagttcaagaccagtatgggcaacatggcaagagcccatctctaaaaaaaaaaaaaagaaaaaaaaaaactttttgggcggcctggcctggaaaaattttctaaacaccattcgtgtggggcgcgggcccagagtgttacggaacactgggccaacgaggtcccagagggaaacccgggcacgcatcaggggtggtttactccaccataaaagaaacgcccggggaaaccagagtttttcggacgatcccaacgggttccgcagggccagcacgggtccccaccacggggcccagaggtcgaaagaatacccgcatccgtgtggaaaacaacgagaacgaacaaagaggacaagcacacacgagcacgagcaagcgacattgacacacaaagcaggaacagcgaccaagacacagaaacaggacgaagacggacaaagaagacgacagaga

SEQ ID NO: 578882 - DNA, 1886 bp, Homo sapiens
  misc_feature (181)..(181): n is a, c, g, or t
  misc_feature (185)..(186): n is a, c, g, or t
  misc_feature (189)..(189): n is a, c, g, or t
  misc_feature (269)..(269): n is a, c, g, or t
  misc_feature (276)..(276): n is a, c, g, or t
  misc_feature (280)..(280): n is a, c, g, or t
  misc_feature (283)..(283): n is a, c, g, or t
  misc_feature (1359)..(1359): n is a, c, g, or t
  misc_feature (1395)..(1395): n is a, c, g, or t
  misc_feature (1397)..(1397): n is a, c, g, or t
  misc_feature (1419)..(1419): n is a, c, g, or t
ctgggtcctatcgggggtggtctggtgatctgtcccctcatggtcctatccatgccctgttgaagggcctccgtagtactctcagtggtgcatcgtgcggactcctcgccgttcgtcgttcgcctctcattcgttgagtgccacagcatgctgtcttccgccagcccaggtctcctcaggntcannggncgagctccgttctctggtctcatcatcagatgtcatcgcgtacactccctctgtcctgtgtgcaggccaagggacctacntgggggnctgngantctaccccagggtctgatggtcccaacacttcatcatccaccacctcctggagggggtaccccgaggtgctccgctggggactctgctcattctgggggtgcggttgacggctggtcgtgatctttcccgtaatctgtcccctcttacggaacctagtctccgttctgtccatggccttcttctggacactgctaggatccagaagagtatgttatcaattctcaagcctaggagaagtcaggagtggagaacagctctgagaagatactgttgtccaactgatctccaggcaccacggagtccggtccctccaatcaggaaggtcggaatctctgatgtcatcgttcatgccaacctggcaaccagtttgaaaaaaaacacatgtaactgccaggctgatctcttgtcctggagatcctgggtgaatggtatctcctgccactgtcccaacctcagaccattgtccaaaagcatcttcagggactccacatccctctgttccctgtcccagcagaggctgtgtcctctccactcaaagcctgaagcatgttggggtctcttcgtctctgtacatgcccatttcagagtccagtctggtgggagagggatcaggatgggaaagaaaagtagggtaagcagaaacgatgaaaccttacaagagtgagattatcatgtacaagagatcccaggaacattgacttgatgaaaaagtcacatcagagcactcaatttggcagaggttttctgccgaatgtttactcacattcactgtccgagattctgtactgggggtacacgcgtcctctgccctaaggcatctttgagtccaagagatattttgaggactggaaatcataggaaactgccctgagctcacacatatttccaatggtgtccccaatttcagggaatccatggattacctaaagccagcccctccagttcggctaagaaactctagtctatatatcaagttttgtatcatatgtattgctctgaactcagaaatttcccttccatttatggattctatgaataaaatatcacatgtacaaaaagactaagtcaaaaaatntcagctgtgcacagtggctcatgcttgtaatcccancnctttgggtggccaagggaggangattgcctgaggccagcagttcaagaccagtatgggcaacatggcaagagcccatctctaaaaaaaaaaaaaagaaaaaaaaaaactttttgggcggcctggcctggaaaaattttctaaacaccattcgtgtggggcgcgggcccagagtgttacggaacactgggccaacgaggtcccagagggaaacccgggcacgcatcaggggtggtttactccaccataaaagaaacgcccggggaaaccagagtttttcggacgatcccaacgggttccgcagggccagcacgggtccccaccacggggcccagaggtcgaaagaatacccgcatccgtgtggaaaacaacgagaacgaacaaagaggacaagcacacacgagcacgagcaagcgacattgacacacaaagcaggaacagcgaccaagacacagaaacaggacgaagacggacaaagaagacgacagaga

SEQ ID NO: 578883 - DNA, 290 bp, Homo sapiens
ttactagcatgaaggatactaccctatggttagattccacccaccaggtcccttccatgacatgtgaggattatggtaactgcaattcaagatgagatttgggtggggacacaaccaaattatatcacctcccaagggctccatctccaaataccatcactttgggagttaggttacaatatattagttttggggacatatatattcagtgtacagcaaagttttatagtgtctaatagtattacagtatgagtggaacttttctttgcagttgacaagagaatctgatc

SEQ ID NO: 578884 - DNA, 439 bp, Homo sapiens
tagttgagaaggtctgagtattaaggattcatcctgggaccagtgaataatcgtatgcgggattgagacatcaggtttgagttctagaaagatctctctggctatacattggacaacagattggagttgaaagaccagaagccaggagagctgtgggaggctattgtgtcagtattcgggagagattgcatgggcctgtactctgtaggccattcctgccgaagtaatcttggagtcgggtcttgggcaagaagaggagggcgctcatgcagtccgaacacgtcgtctgtcatggtgggtaagcatgtggaccaactacctttaccactctggaaaacccccatgtagagcaatttactaattcattggtctacgaatttcgtttaccctggcgtgtgtgcttgcgaatgttctacgtgacacctgaatttgctcgttt

SEQ ID NO: 578885 - DNA, 1572 bp, Homo sapiens
  misc_feature (1045)..(1045): n is a, c, g, or t
  misc_feature (1081)..(1081): n is a, c, g, or t
  misc_feature (1083)..(1083): n is a, c, g, or t
  misc_feature (1105)..(1105): n is a, c, g, or t
tttctccacagtccctactgctatcacacctcctggagggtgtacccgagttcgtggatcatcgggggtgcggttgacggctggtcgtgatctttcccgtaatctgtcccctcttacggaacctagtctccgttctgtccatggccttcttctggacactgctaggatccagaagagtatgttatcaattctcaagcctaggagaagtcaggagtggagaacagctctgagaagatactgttgtccaactgatctccaggcaccacggagtccggtccctccaatcaggaaggtcggaatctctgatgtcatcgttcatgccaacctggcaaccagtttgaaaaaaaacacatgtaactgccaggctgatctcttgtcctggagatcctgggtgaatggtatctcctgccactgtcccaacctcagaccattgtccaaaagcatcttcagggactccacatccctctgttccctgtcccagcagaggctgtgtcctctccactcaaagcctgaagcatgttggggtctcttcgtctctgtacatgcccatttcagagtccagtctggtgggagagggatcaggatgggaaagaaaagtagggtaagcagaaacgatgaaaccttacaagagtgagattatcatgtacaagagatcccaggaacattgacttgatgaaaaagtcacatcagagcactcaatttggcagaggttttctgccgaatgtttactcacattcactgtccgagattctgtactgggggtacacgcgtcctctgccctaaggcatctttgagtccaagagatattttgaggactggaaatcataggaaactgccctgagctcacacatatttccaatggtgtccccaatttcagggaatccatggattacctaaagccagcccctccagttcggctaagaaactctagtctatatatcaagttttgtatcatatgtattgctctgaactcagaaatttcccttccatttatggattctatgaataaaatatcacatgtacaaaaagactaagtcaaaaaatntcagctgtgcacagtggctcatgcttgtaatcccancnctttgggtggccaagggaggangattgcctgaggccagcagttcaagaccagtatgggcaacatggcaagagcccatctctaaaaaaaaaaaaaagaaaaaaaaaaactttttgggcggcctggcctggaaaaattttctaaacaccattcgtgtggggcgcgggcccagagtgttacggaacactgggccaacgaggtcccagagggaaacccgggcacgcatcaggggtggtttactccaccataaaagaaacgcccggggaaaccagagtttttcggacgatcccaacgggttccgcagggccagcacgggtccccaccacggggcccagaggtcgaaagaatacccgcatccgtgtggaaaacaacgagaacgaacaaagaggacaagcacacacgagcacgagcaagcgacattgacacacaaagcaggaacagcgaccaagacacagaaacaggacgaagacggacaaagaagacgacagaga

SEQ ID NO: 578886 - DNA, 113 bp, Homo sapiens
cagaagagacgagatgagagcacgagatgggaaatgttgctgagacaagaaagcctagggaaactttagtgctagatacaaaattcacactagggcaaatggcacggtactct

SEQ ID NO: 578887 - DNA, 971 bp, Homo sapiens
cagtagcacgatctcggctcactgcaacctcttcctcccaggctcaagtgattctcctgtcttagcctcccgagtagctgggattataggcacacaccactaccacctggctaatttttgtacttttagtagagatggggtttcaccatgttggccaggctggtcttgaactcctgacctcaggtgatctgcccgcctcagcctcccaaagtgttggggttacaggcgtgagccaccgcacccggcccccttccttcgtcttagtcaatcctatcccacctcttcttccaccagtcccctcacctgatggtcccaacacttcatcatccaccacctcctggagggggtaccccgaggtgctccgctggggactctgctcattctgggggtgcggttgacggctggtcgtgatctttcccgtaatctgtcccctcttacggaacctagtctccgttctgtccatggccttcttctggacactgctaggatccagaagagtatgttatcaattctcaagcctaggagaagtcaggagtggagaacagctctgagaagatactgttgtccaactgatctccaggcaccacggagtccggtccctccaatcaggaaggtcggaatctctgatgtcatcgttcatgccaacctggcaaccagtttgaaaaaaaacacatgtaactgcctgctctgataatcagagagagagcttcctgttaaaattggtgagacatagctcaaagctagggggacggaactacatatacaatccacttgatgaattgatctgccaagagaggatgtgattcgcttagattaaatcccatgttacctagtgctcactcaggaaaggagtgtctactgattgtctactagcaggtgaagattagacatctccagctttgtagtaagggagtcattgaagattatacaacgtaagccagatgcatacatacattatatgtacaccgctg

SEQ ID NO: 578888 - DNA, 592 bp, Homo sapiens
cgtagaggacccttattgatggttcgaccatcttgatctagtttcctctatctggttcagtgcacacgcttgtggataacagtgttaaatatgtgtgcataaagtcttaaatgaaaagatgtggaaaataactaaaatagtgttgtcattgtgggaatttggttaatattttgtctcaaattccttaaataatctttggggtttgggtaataaattttatgtatgtattttccattacaaatataatacatactcatacaaaactttggaaattcagtaaagaaaattcacacatattcccaacacccaacaacaattaactgttaacatcttgatctgtgcactggtctgtgattattagggtgttagtgataagtatgcataaatgtcaaagatgggaagaaagatgaaaaacaagaaatagttgtgtggttgtagtgggataatggtaatttggtttcggtttccttgaaaggtcatcattctagtgtatgggtagtccacctttactacatatatttccattatatatgaaatgtgtacatcatagaaactttgaagttacagaaatgtagaagagaaactcacccat

SEQ ID NO: 578889 - DNA, 718 bp, Homo sapiens
attcggccattatggccgttagcagtgtctcacacctctaatcccagcactttgggaggccgaggtggacagataacctgaggtcaggagttcaagaccagcatggccaacatgttgaaaccccgtctctactaaaactataaaaattagctacgcattgaccgcttgcggtggatcatgcctgtaatcccagcactttgggaggctgaggcgggcagatcatgaggtcaggagatcgagaccatcctggttaacatggtgaaaccccatctctactaacagtatagaaaattagccagtcatggtggaggtcgcctgtagtcccagctactcggaaggctgaggtaggagaatggcatgaacccgtgaggtagagcttgcagagagctgtgatagcaccactgcactccagcctgcgtgacagagcgaaactccgtctcaaagaagaattaacttgtcgagccgatggtcgcctgtaatcccagctactcaggaggctgaggcaggagaatcactagaagctgttaggcagaggttgcagtgagcctgagattgtgccagtgccctcctgcgcaacacgagtgaaactctgtctcaagaataattacaaggacaagtcattttcccactaaacaaggtattacgaccatccgaggacatattatcatacgccgtctttatatgctcgttgaagaatttgtcagtcacctatttttcg

SEQ ID NO: 578890 - DNA, 353 bp, Homo sapiens
gctgatagaggatccccagcgctgcgcagtactaaggtagggaaatcccacatcatgggaaccatcacacagatgcctttctgggaaccccaaccttctatggatccccaaaaaggtgcttggtgggctttagcctataatgaataaagggggaaggagggaaaatactggaaaagggccattatttaatgggtgaaagaatgaagctgtagaggtcccaaccagcctagggccaaaaaagaaaattaaaattctgcacagagcaggcaagcctctgacggcggagagtagggcattcaggcgccaaccgggtgagagtcctcagcgagcacggtcaggtatggctcagcgcg

SEQ ID NO: 578891 - DNA, 212 bp, Homo sapiens
gatgaatatgaggaagaggagaaggaggacggaagaggaggaggaagaggaggagggaggaggaagaggagaaggagcgcacggcaagagcgaggagcgaagagcaggaggcggacgcgcgcaaggatgagcgaggacgaggtgatttcgcttaagaggccttccttcgccgctgttcaccaacatattcatataactcagtccatataagc

SEQ ID NO: 578892 - DNA, 340 bp, Homo sapiens
tcaggccactggttgatgcaggccaatcgcagcataggtgattggccctgatatatctggctctgcacttcacaagggagtaaatgcaaacagatgttcatgggttccccattatatggtgttaatttgcagctcagcagttggagtactcactgaagaaatcatgaagtttttggtacagattgccttacctatcgctgtaggacagcaaagatgacttttgaaccgcatcatatatcattcccactttgagaattccatgtttgaattggaataggaccattaccagttcaatgcatttgtgctaaatattgtgaaaggcatctttaaccttgttatt

SEQ ID NO: 578893 - DNA, 602 bp, Homo sapiens
  misc_feature (405)..(405): n is a, c, g, or t
gaatactatcctctattacataacataatatactgttgggttagtgtcaatttctcaaactctcccaggctgccataatgcatgtctgacctaatttctatttctcttggaggaaaatacacacacacacacaccacagaagtgttgcattaagaatgctacatttcgaatagactttgcccttgcaattttaagctatgccatattcagattaattttgtgagtgatatctgcatatgtttctgtacagtgtgaaatgactgaccctgtagtatagtacgtgatagagttctacttgttaaagtaggttagatatagacactaatgtgtgtgatgatagtgtcctgtgtttcttagtgcaaatctgtagagtaaaaatgtccatagaacttttacttaaaaacnatcccatgctagagttgccattaagcagtgcaaaattaatcggctgtatggtagattcttgaccttaaatttaacaacaacaaccaaaatcagattttttttgtgagtcttactgacctaagaaacattgtttaaattgtttaaatggatctgctgcagttactttgtgtacctagtttatcgtggtgcgtaatggg

SEQ ID NO: 578894 - DNA, 142 bp, Homo sapiens
  misc_feature (24)..(25): n is a, c, g, or t
  misc_feature (34)..(34): n is a, c, g, or t
  misc_feature (121)..(121): n is a, c, g, or t
  misc_feature (132)..(132): n is a, c, g, or t
gcgagtagtatgacttatacacanngtatgggcnaactgtggataaaaaagcccttttgcccgacctgcgaaactatccacaggttcccccccagcctgaggggcctctatacagggggtntcagctgcatnaatctcttaa

SEQ ID NO: 578895 - DNA, 1375 bp, Homo sapiens
  misc_feature (579)..(579): n is a, c, g, or t
aggtagaagagccgtatgaagctccagatggccagctgcagcttggacccagacatcagcattccagttcaggagcatcccaggaggaacagaatgatcttggtcttggtgaccttccctctgatgaggaggaaatcatcaacagttctgatgaagatgatgtcagctctgagtcaagtaaaggagagcctgacccactggaagataaacaggatgaagataatggaatgaaaagtaaagttcatcatattgccaaggagatcatgagctcagagaaagtgtttgtggatgtgttaaaacttttgcatattgatttccgggatgcagtagctcatgcttccaggcaacttgggaaaccagtgattgaggaccggattctaaatcagatcctatactacttgcctcagctgtatgagctcaaccgggatctcttgaaggaactggaggaaagaatgttgcactggactgaacaacaaagaattgctgatatctttgtaaagaagggaccatatctaaaaatgtattccacatacatcaaagaatttgataagaatatagccttgctggatgaacagtgcnagaaaaatccaggtttgctactgttgttagagaatttgagatgagccctcgctgtgctaatctggccctcaagcactacctgctcaagccggttcagaggatcccccagtacaggctgttgctgacagattatttgaagaatctcatagaagatgctggagattacagagacactcaagatgccctggctgttgttgtagaggtagccaaccacgccaatgacaccatgaagcaaggagacaacctttcagaaacttatgcaaattcagtacagcttaaatggacaccatgaaattgtgcacgcctggtcgggtttttctcaaagaaggaatcctgatgaagctgtctcggaaagtgatgcaacctcgaatgttttcctgtttaatgatgcctgctgtatacaacaccagtgcagtctgggatgtataaactgaaccaatgctctcactggctggacatgcacggtcagaaaactacccaagaagcctatcagaatgactcacagattgaacagtgtcccacgtccttcattctctcagccagttctgccaacagaaagggtgaatggtagaagcgatttccaggccatagaagaagtatgcagaaaagataaccttctgtctaacaggagttctgatgaggcgatcagaacataagagaaatagctctggtcggagcccatggttcggacgagccatgtgttatccgcaggatcctccccgggggaaccgcgcgggaatgttcacaggcgaaatggtacggaacacgatgcgtcccaggtccccctggcccaccg

SEQ ID NO: 578896 - DNA, 444 bp, Homo sapiens
gacatgaggcttgaaggtggatggttcagaggaactctgctctggcgtttaccagcttcacacgctttggtgaggtgtctgctccctcctggcttcgctgcgtggcagagattttaatgcacagagaagggaggtgacttactcagttactcagcaggaggcagtgtagcctggggctccagggctctgggatgtggggcctgtttcaccatttcttactacgtagcctcaggcaagttacttcactttgggcctcagtttcccctctctaatctcatgctgccctcaggagtaatgttttggttgttgttgttgagacagggtttcacttccatcacccaggctggagtgcaatggcgcaatctcggctcactgcaaccttggcctcccaggttcaagggattctcctgcctcagcctcctgagtagctgaggaccatcgttg

SEQ ID NO: 578897 - DNA, 341 bp, Homo sapiens
agatagactaccccttccttgtactatccctatgaggcataattataacaagctccatctgcctacgacaaagagacctaaaatcgctgcatgcatactcttcaatacagccacatcagccctgcgtagtaacagaccattctacatccagaacgcccctgacagcttcaccgcgcgccagtcattctacataatgcgcccacgggacttactatccactattactattctcgcctacgcaacactcaacactacgaaacacggcatcttcactcggcgaacaacggcatcgttcatcgcgcaaacggcatcttcatcggcgaaaacggcatcttcatcgg

SEQ ID NO: 578898 - DNA, 1506 bp, Homo sapiens
  misc_feature (738)..(738): n is a, c, g, or t
  misc_feature (757)..(757): n is a, c, g, or t
  misc_feature (884)..(884): n is a, c, g, or t
  misc_feature (1056)..(1056): n is a, c, g, or t
ccctcgtgtgtttggcgtcactttttgttgtccggagtagtctttgtcagtcgttgcatggcttctctttggttcttctgtgggcctttggctcccaaccgcggttacttctactaaggggggtatgtgttctcttccgcacccccgtattctttctttcttcctcccggttttgtgtgtctatataaattagtatgctggttggggtctatgtggtgttatccgggtctgctccaagggtgtccgttgcgaccactcggcaccgccgggggtgattttctcccccgcccggctccccttatgttggggtgctttaatttgaatccgtgtcacaactttgaagaggcccccttttttcgtccttgctttaaaaagaagtattttccaatctgtggaagggcgacccaagtcgtgaaatgtaattaacccctcttggttttagtgaaaaggggacttcactgtatggcgtccgccccttgccgccctggtgtaaaaggaaggaggtggaaccacgaacccatttttagcccaacttccttggccttcataaccgcccctttatatagagaaatagtttagttgtgtcaagggtaaggacaatattacgaagaaggtggccccctccccccccgcttcctccttttaaggagggaaccccctcgccccttggaatgtcccaacgggagattttttctcgtggccacaactattttggtaggcagaaatatttttataatngaggagcccaccgcagatnttttatagttcggaggacacccccgtttataccttctctgcttataaggcgacaacacgtcggagagaccgcttcctcttatcccacacgccctctctatgagagactgggcacactcttgtaacgngacacactctttaaactctgtccacagattgtattttttttgtgacacgcgtggagccacgagattctcggctcgtcccacgccccgcgcctttgtttatagtatagatatattggcccacgcacataagaaggctttcacgagagttctcttctctccacgagaggagaanataagacatggagattatatgaaaaatctttctgtataacaaagttataaggaccacactcctcccacaaaaaaagcgcacacggataaaacatatatagagacccgctggaataaaggggggaggaaagcagaaagaaataagagagacttcttcacttataagagttctccgcaaagtaaggcgctttccacaaattctttctgcagaacaccacaagttcacacgcccacgcgtaaccacgtgagattcttcgctttctagggccagaaagagatcactctaagtcccagtctcactcgcttctcagacaccgttcaccggtcaacgttccagaacccacgcgaggagaagcacgccgatcccagatccaagttctagaggaagaagatctgtatccaaagagaagccccaaagatttcccaagccccagatcccagttctagggga

SEQ ID NO: 578899 - DNA, 342 bp, Homo sapiens
accgtcttgcttacttgtccgatgaaatgaatgaaatagaaagtgggaaaataatattttcagagcatcttcccttaagcaagctccaacaaggcataaaatctggttcctatcttcaaggaacattcagagctagcagggaaaattatttggaggctacagtatggattcatggagacaaagaagaggaaaaagagatacttatacagggaattaagcatctaaacagagctgtgcaatgaagacattgtggccgtggagctactgcccaggagccagtgggtggcaccgtcttccgtggttttagacgatgaaggtcaaaatgaagacgatgtggagaaa

SEQ ID NO: 578900 - DNA, 931 bp, Homo sapiens
  misc_feature (7)..(7): n is a, c, g, or t
  misc_feature (70)..(70): n is a, c, g, or t
  misc_feature (89)..(89): n is a, c, g, or t
  misc_feature (98)..(99): n is a, c, g, or t
  misc_feature (111)..(112): n is a, c, g, or t
  misc_feature (117)..(117): n is a, c, g, or t
  misc_feature (122)..(122): n is a, c, g, or t
  misc_feature (146)..(147): n is a, c, g, or t
  misc_feature (151)..(151): n is a, c, g, or t
  misc_feature (154)..(154): n is a, c, g, or t
  misc_feature (160)..(160): n is a, c, g, or t
  misc_feature (169)..(169): n is a, c, g, or t
  misc_feature (171)..(172): n is a, c, g, or t
  misc_feature (174)..(174): n is a, c, g, or t
  misc_feature (184)..(184): n is a, c, g, or t
  misc_feature (195)..(199): n is a, c, g, or t
  misc_feature (202)..(202): n is a, c, g, or t
  misc_feature (205)..(205): n is a, c, g, or t
  misc_feature (212)..(212): n is a, c, g, or t
  misc_feature (215)..(215): n is a, c, g, or t
  misc_feature (220)..(220): n is a, c, g, or t
  misc_feature (224)..(225): n is a, c, g, or t
  misc_feature (232)..(232): n is a, c, g, or t
  misc_feature (240)..(240): n is a, c, g, or t
  misc_feature (244)..(244): n is a, c, g, or t
  misc_feature (259)..(259): n is a, c, g, or t
  misc_feature (340)..(340): n is a, c, g, or t
  misc_feature (399)..(399): n is a, c, g, or t
  misc_feature (429)..(429): n is a, c, g, or t
  misc_feature (478)..(478): n is a, c, g, or t
  misc_feature (487)..(487): n is a, c, g, or t
  misc_feature (495)..(495): n is a, c, g, or t
  misc_feature (507)..(507): n is a, c, g, or t
  misc_feature (579)..(579): n is a, c, g, or t
  misc_feature (592)..(592): n is a, c, g, or t
  misc_feature (651)..(651): n is a, c, g, or t
  misc_feature (927)..(927): n is a, c, g, or t
ccctgtnatatgttccatattcaagtattgagaatgctcagtaacttactatagcagcttaactttttanaactgccacacaatttccnacgaatttnngtccttcaaatnncttanatgtntggaacaatgctacatctacactnngctnccntaatcnacctcttcncnngngggccctgangaagcaccagnnnnnggnggnggttcancancaggnaatnncccaggnattttttntggnatgttttttgtactntggtatagcttggtgatgatggggttgcaaatttttttcagctttttttgttgatgtttaaattttttttttttggtagtntgatttttattaagcaagttgataattttattatatttgtttagaattttttgtttgtntttatcgttaattttgctttgaagtttttnatttttaacagttgtttttatgttgaagggataggatttaagtgaattnttggatganaccttgtnaatttgtttttnatttttagctttgtactttttagcttcttggatcatacgtttaatgtgttctttgttcaaacggcgcttgtnattagtgatagtnatcttgttctcttttcccgtactcttgtccacagcagagacattgagtataccattggnatcaatgtcaaaagtgacttcaatctgaggaacacctcggggtgcaggaggtatgcctgtgagttcaaacttgccaagcaggttgttatcctttgtcatggcacgctcgccttcataaacctgaataagcacaccaggctggttgtcagaataggtagtgaaggtctgtgtctgcttggtaggaatggtggtattacgcttgatgaggacagtcatgactccaccagcagtttcaataccaagggaaagaggagtgacatccaagagcagcaaatnttga

SEQ ID NO: 578901 - DNA, 304 bp, Homo sapiens
tgggcttgacccaggatttaaaaccgggaccggtgaaggtgacagcagtcggttggagcgagcatcccccaaagttcacaatgtggccgaggactttgatggcacattgtgggtttttaaatagtcatcccaaatatgagatgagttgtcacaggaagtcccttgccatcctaaaagccaccccatttctctctaaggagatgggcccaagtcctctcccaagtccacacagggacggtgatagcctggattacgtgtacatactgtaatgcaaaatttatcaaatctacgatttagacgcgta

SEQ ID NO: 578902 - DNA, 852 bp, Homo sapiens
gatttctcaaactacctaacacagaactaccacttgacccagcaatcccattactgggtttatatccaaaaggaaataaattgctctaccaaaaagacacatacactctcctgttcattgtagcactatttacaatagtgaagacatggaatcagcctaggtgcccaccaacggtggactgggtaaacaaaatgtggcacatatacaccatggactatcacatagccataaaaagaatgaaatcatgtcctttgcagcaacatggatgcagctggaggccattatccaaagcaaattaacacaggaacagacaagctaataccacatgttctctcttataagtgggagataagcattgggtactcatggcaaaaagatggcaacaatagacactggggaatactagaaaggcagggggcaagggttaaaaaactaactattgggtgctatgttcactacctgagtgacaggatcaatcataccccaaacctcaacatcacacaatgcgcccacataacaaacttgcacatatattccctgaatctaaaataacagttgaaaatgataacaaaacgtgggcggagggggaggaattattctaccaaaacacaataaaaacggcaaactcggggggtatacccacaattaatcgaaactacctacttggggcagtcaacacggcgcattcaccctcgggctatacctcccaagcgtggacccaaacgaattccgtagacccaaacgactagcccactcacgtggactgattccccttgttttacgaaacctcataagcggtcaaaccacgtctatactcgatagaagagtgtctgcaacgtgtgcctcgaacat

SEQ ID NO: 578903 - DNA, 318 bp, Homo sapiens
  misc_feature (79)..(79): n is a, c, g, or t
tctacaggacccaattgtgtggtgttatgatgcggcatggctttcaatgagtgtctggaagttacttgtgatccaattnagcattttttcttctttagtgttttaagatggacgacactttgtttaattatccatctctagatcattttatggtcgacatacactaacttcaatagtgtcactcctgtaattggttttgtatttgtgttaggctccttggtgttatgtatgctgggatagtgtttctataattggatttgggcatatattgtcttaagaaatattatggctctttggtttccataacaccacacaatt

SEQ ID NO: 578904 - DNA, 167 bp, Homo sapiens
gatggtctgcattgactatctatctcctggttatggattatgtcgacatctgagaaattttttatctgtgaaagagagaaacagcaaagaaaaaaaaatatagccagttagttttcataatctgatgtaatgcatcttccctggatagaaaaaaacgccaacagaat

SEQ ID NO: 578905 - DNA, 1872 bp, Homo sapiens
cttggattctagccagcacgactgaaggagccccatcagtagcacctttaaatgtcactgtgtttctgaatgaagccaattacaaagcaacaaggtgagctggttggctcaaggatctcccatgtgtggcaaagcgctggcatttctaaagaattattagaagaagttgggcaaaatgggtctcgtgcgcgtatttctgttcaagtccataacgccacctgcaccgtgaggattgccgctgttaccaaggggggagtcggccctttctctgaccccgtgtgtaaatattatacaggagggaataccgggtatttctgcgctaacgtatcccgcatgtccacacatagaagctttaaactaaataacaccttacacatcccctgtcgagggcgaccacaaccaaacgtgacctgccgagacctaaagcggtgcaatgtgtccgacgaagttcaaaggggcatgccagggaacgtcacaccctgcacacgactaggccggctctgtccgctatttaactcaggcgcctggcaacgcagatcctgtgctcatcatctttggctgcttttgtggattattttgattgggttggttttatacatctccttggccatcagaaaaagagtccaggagacaaagtttgggaatgcattcacagaggaggattctgaattagtggtgaattatatagcaaagaaatccttctgtcggcgagccattgaacttacccatagcttgggagtcagtgaggaactacaaaataaactagaagatgttgtgattgacaggaatcttctaattcttggaaaaattctgggtgaaggagagaaagggaccgtgtatgaaggactgtggaatatccccgaaggaaaggaagtaaaaattccagtagcaatcaagaccctaaaactggacactatggctaataaagaaatacttgatgaagcaagtgtcatgaaaggctttgggaacccccacgtagtgcgactccttgggatatgtatgacatctacaatatatgtaattactgaatactgtctactggtttatagaaggaataaagataaagctgaacaacaccggtcaaattgtgccgagctaaacccaccgctgcagacactattgaagttcatggtggatattgccctgggaatggagtatctgagcaacaggaattttcttcatcgagatttagctgctcgaaactgcatgttgcgagatgacatgactgtctgtgttgcggacttcggcctctctaagaagatttacagtggcgattattaccgccaaggccgcattgctaagatgcctgttaaatggatcgccatagaaagtcttgcagaccgagtctacacaaaaagtgatgtgtgggcatttggcgtgaccatgtgggaaatagctacgacgctgcggggaatgactccctatcccggagttcagaaccatgagatgtacgactaccttctccacggccacaggctgaagcagcctcgaaccgcttggaactgtacagaaatccgaatccgactcctaaaactaccaatcctggggagtcgaacaatgcgtccaatgacaatattttcaatggccacgcgactatcatcacccaaaacagcttggatgaactgtatgaaaaaatgtacactagcaggggaacccataccaaagactggaccgacattctcggtactaagactacagctggaaaaattgctagagagcttaccggacgttagaaatcaagcagatgtaatttatgttaacactcaattgctagagagcgaaggccttgccagggttcatccctgtagtaccgggctcgaacaccatccatgcagcgaacatcgaccgcgtccgcacctctataattgctaa

SEQ ID NO: 578906 - DNA, 378 bp, Homo sapiens
ggataaaatgataaattattaccaagcataatattacatggactatcccctataccttctgctttatgaattaactacaaataactttgcaaggagaaccaaagctaagacccccgtataccatacgagctaccttacgaacagcttaaagagcacacccgtctatatcgcataatcgtgggaagatttataggttgaggcgaggaatctaccgagcctgagtatcgctggttgtcctagatcgaatcttagttcaagctttaaatttgcccaatgaagcctcttaatccccttgtcaatttcactgtttgtccccagaggaacggctctttggacgctatgaaaaaaccttgttgagagagtagacaattttgcatc

SEQ ID NO: 578907 - DNA, 368 bp, Homo sapiens
gtcgtaacctcctccttacatatccagaactacaaacgaggataatgagctcagccacctccagtgcctgttaaaaccactagaagtataatccaagggctgggcgaggtggctcatgcctgtaatcccagcactttgggaggccgaggcgggcagatcacctgaggtcaggagttcgagaccagcccgaccaatatggtgaaaccctgtctctactacaaatacaaaagttagccgggctgtggtggcgcacgcctgtaatcccagctactcaggaggctgaggcaggagaatcgcttgaacccgggaggcgcccgttgcagtgaggacgagatggtgccactgcagtccagcctgggcgacagagc

SEQ ID NO: 578908 - DNA, 700 bp, Homo sapiens
  misc_feature (68)..(68): n is a, c, g, or t
ggggaagggggggccttagagattaagagttgcacaggaggagagaacaatgtggttgagccaaaaangaaggggcagccccaatttggaggttgggttttttttggttgttggggcccgggaagcagaggtttgatggcccaaaatggaaaccatgttaagttggggtgggttgtgggttctctggttggggcaagcattggatcagtccattggtggggggtttaattaaagaaagtaatcataagcttgcaggcctgacatcacttacaagaagcctcagggaagtgagccagcaaaggagcaagaacccttgccaatatgagatcaagaggtttctggagtgtgcccaaaaccagggtgacatcaagctatgtgagggtttcaatgaggtgctcaaacagtaccgacttgcaaacggattggcctaatgaagaagttcaacgtggagagatggaaaatcagctctcataactaagttaatttagtataaaaatagaattgatagtgagggtataaagtgtaaccatcagttaaacgtctcctgtcattactagagtccaagagtcagaattacaatgaaagtgggggtgtggtgaataggtagaatctggttttgagcaaatgtatgtgtgccctccttaaactagctgttatgatatgatgaaatgaattgtgagttaattagaataaagtcatt

SEQ ID NO: 578909 - DNA, 1065 bp, Homo sapiens
ggcaggccgggaggagcggcgcgcgctcggagctctcccgccctgctcgttcgcttctccagcttgggatggcgcggttagctgctgggtcgttgcgctctgcgtcgtgcatgagcctccatgctcgcggtcggccgtgggctgccgtgctgtgccctgcacagaccccgcgatgcatcgacaacgagcagaccgcggcgcctacttatgccgtagaaataagaggatcaatggtgagcgatagactccgttggatggagatggatggtgtatgtagatgagccagttattagtctggacatgttcatcaatggcagtaagctcatctctgctcccaacagttggtagcactcgcatgcttagaaccgtgatctgtttgatcgcctccgtgcgtcaattcgcactagaaacacgctgaatcgcaggaccctgtagtgaacacaacggtcaacgcgatgtggaacttcgtggtgatcttggtcccaacctcgaggaaagtaccaagttgctggcgttgtccaaatgttgtaggccaaacaattgcaacccctttgacattgaagtggcccaccggtgactggcacaacgtacggttcaaaaggacttgcatagcgacagcgaggtgattcggaagacacaaggttcccccttatgttgaggagaaccaataatctcgggtaaagcaattcgcacttggtgccagaggggaaccttgtttcgtttccctgccggaggccaccaatacacgtcttggggggagcacacagttccccgagcgaactttatgtcctcttagaggtttggaaagctcaatgtcggtaaatagaaccccaattttgcgtggacggcgccaaccgtcccccattgtgagagaactacaaatgctaacagaaacgggccaaacaacggaacgatctctggtttgggaacgaactcacgggaggacgccgtggccaccattttttacaacattatgggagtaattttggaacaccccgagaaataggaattgtggcattgtgcagatgtacaaagcggaagttggggaaaagttgagtacagaaa

SEQ ID NO: 578910 - DNA, 185 bp, Homo sapiens
cccgggggggggtttaaggggggggggggggccccccccccggggggggggcccctgggggtttcccccttaaggggttttcccaggaaaaaaaaccccccccgttttggaaccccctgggggggggggttttagcccccccccctttttttttttttttttttaacccgggggggtttccccca

SEQ ID NO: 578911 - DNA, 954 bp, Homo sapiens
agtgccggttgcggtcgctggccaccgctcaccatggatcggggtcctcggttgtatgatatctcttcgtggttcgcgtggggctcggtgcactggtgtaagcttcggggtgtcgagggtgtccgaaaggggtaggtccttgtcgcaggatggaacaaaggttctgctgtatgtagtgtgaggattgcagacagaagattgctcggctcagatgtgaatggcctctttgtgactcgttgtgcccaagacacgttgggaataattattgtagcatcttagcagaacagggagagtagctggatctgtgctgatcaagagaagccatgtgttcactcgtgtcaagcaaggcaattcatgaattcagggtaggtgacctcaaggcagctggaggagtggacaactggggtgggggtttgagcgattcctagtgggttagacagttttcccacgagtgagaaatctttcataaggctttgaaggcagcgtaatgtgccaatctgtgcgtggcggtcaactcattgggcaaacgtttgggggcctgtaaacccaatgggtctcagtttcttttagtcaacctatgatacatgcccagactggtttggatggaagccagtgtgggtttgtgacaggtcgttgactggcctgactgtggtgctactccatagagctcggcaattgagtgtgtagtgaccgtcagttcacagtggtcattatcaacaggggctgtgacgtgaaaggctttgtggtgagatgctggtggtgaaaactggtggaaagacggttgcttgggggagtcattttgtgggggcacgatttggagctccaaatgggttagaaaagtttgggtttcaccaaggaattagagaacgggctttatggggtagactggggagaaatactaggggggaaaaaagggttggattttatatacggagtaagaattaaaaggtattt

SEQ ID NO: 578912 - DNA, 195 bp, Homo sapiens
tgcgtgcctgaacaccgaaggcggcagccttgccacccggcccccaaaacgcacaccgaaagagcatgacggaccctgtaacgctcagccacccaaggtcgatagagctgctaacgtagtcatcaatcactttggtcgcatcgcttagctggtgcgggaggggaatacacaatgtctttcaccactcggatgatg

SEQ ID NO: 578913 - DNA, 295 bp, Homo sapiens
ccaataaccctcccaatcatagcttcctatagcctcaaactcctgggctcaagcagttcccctgcctcagcctctcaggtagctgggactacaggtgtacaccaccatgcctggctaattaaattttttttttctaaggttgggatcttgctttgttgcccatgcgtggcttgaattcttggcctcaagcaatcctcctgcctcagagtcccaaagcactgtgattacagatgtgagcctctgtgcccagcctggaaatatattttaactggtgttcactgaagatggcctttag

SEQ ID NO: 578914 - DNA, 131 bp, Homo sapiens
ggagtgcaggagggcggtcggcggcgctgaggagcctaagacacccacccaacccttaggagaccgggagggccggacaggggctggcgctggtgtctagcagacaaaaagcagacgggtgtgtgccctat

SEQ ID NO: 578915 - DNA, 817 bp, Homo sapiens
gatacgtgtttctgttgagaagttgagtacaaggttgagtgtaagtagggaaagttcaactgcagtcagttctagtcttggtaagtacactgtgaggcgctccaccccaagcatagcaaattaatggttccccagtgtttgcagaatcaaaattaagttctttggctaggttctccctgatgtgcccctgcttcttccctaattcaacacatccccagctccatccatgcattcccaacacatcacagctctttacatgcccaggctgtgtcttctgcacctttgtaccttctgcacctttgtttccttggccccaactgccctttcttttcctccacattaccctttatcccaaatttagcacctgtctcaaggagtcaccttcccaaggaagtttctccaaatttgttaacagatattccattgttcctccaatgcttgaccatcttcctttatagatccctgcctagaaaaatgtgggctcactgaggccagggctgcagctagtttattttataacccagcattttaaaagtgcctatttatgattggtgggaatagttaataaatggagtccttgcagatcataaccaagaccacagttcgtaatggtttcattaacttgtgttactattggatgtgattctctgcttatggtcttcctttacttgtttttcccttactgtcagcacctctagacatcaggtaccttggctctgattgctaattaaaattgttgactgggaatgacacttccaatttgctaaggcagagcagtttgtcccttgtggtttactttctaaccaggaccttagaa

SEQ ID NO: 578916 - DNA, 246 bp, Homo sapiens
  misc_feature (13)..(13): n is a, c, g, or t
  misc_feature (34)..(34): n is a, c, g, or t
  misc_feature (41)..(41): n is a, c, g, or t
  misc_feature (87)..(87): n is a, c, g, or t
  misc_feature (101)..(101): n is a, c, g, or t
  misc_feature (115)..(115): n is a, c, g, or t
tgttttcctcttnccttccaacaatgaaggtttngtattcngaaacgaataatttggttcaaaatctttatatggaagaattctttnattgctgtttcttnatttccttgtaagnatatcctgttctcccatagttcctcttcacataaaattatatctatatgggcatatgataaaggacattcttgtaaagtgttaatcttttctgtgactaaatagcaataataaacagaaaataagaaatta

SEQ ID NO: 578917 - DNA, 742 bp, Homo sapiens
ccatttcgtagagtgacgttttctgttgtgagtcagcctcaggacccacatcaggggtcactgcagagttgctatgacagcgggctggaggagtcagaaacaccaagcagtaagagttcatcagggccaagactgggtgcgcttccactcccagaggacaactatgaaaggaccacgccggatggcagtgttggtgaggcagagcatatggaaaatggtgttgctgccatcactacctttcccttcctcccctttcctcatggcaagacgcatggaagaagagtgctgttaaggcctctccattaatcaacaggtggctgaggcaggaggaacgcttgaatccagaagttctagtccagcctggggaacatagtgagaacttatctccaaaaaaaatcagttttcttttttctaggggcctatatagaattaagataaattgtgaatacgtttatttggtgaggtattcttgggcaatattttgagacataataggtccatatggattattttatttgtgcagtatttgtcggaattttaagtaacggacttaccgtagatgttgcctgcaaccgtgggggagctgcatattttgttacttgttttagggggaatatggaggctttgaagagacatggtgctctgtttttgctagtccagattgtcgtcggcggagaatacatataatgatcacgtccgaaaattgaaggtaacgtccggtgcagcatagtcgaaggtttgc

SEQ ID NO: 578918 - DNA, 277 bp, Homo sapiens
atatactcatacgatccacgcataagacttccctgtgcagctggacgaacaggatagacgcgccgatccataagctacttcctaaagggtatttactggtgctatttttagatcgattagtgttgccgtacggttgtatacgtcactcacgatcaaaaaggcgacgccatcatggccaaacgcacatcctcccgtcaatttgttacagtttttgtatcgctattactttcttttggtgtcaatgccgccgacctgacggtggggccgcgcagagttt

SEQ ID NO: 578919 - DNA, 316 bp, Homo sapiens
  misc_feature (12)..(12): n is a, c, g, or t
  misc_feature (162)..(162): n is a, c, g, or t
  misc_feature (270)..(270): n is a, c, g, or t
ggagtctcgctntgtcatccaggctggagtgcaggagtgctatcttggctcgctgcaacctctgcctcctgggttcaagtgattctcttgcctcagcctcccaagtagctgggattataggcacatgccaccacgttcggctaatttttgtacttttagtanagatggagtttcaccatgttggccaggctggtattgaactcctgacctcaggtaatccacccgccttggcctcccaaagtgctgggattataggcgtgagtcaccgtnctggcagccaatgttttatatcgctttcccattgttctgtattttt

SEQ ID NO: 578920 - DNA, 357 bp, Homo sapiens
cactcagaccacccatgatctgtgggtattctgggcctttcgtacaagtcctgcaacaacaggacaggtgacaatgatatctggggtacaaggaccatcttacaattgcaacacggacagaaggcagccgaaggatctgaggctgtcagtgtggacaaaaaggctccagccagtgagtgaccataagtgatccgaccccaaactgctgacttactctgcgaatataatcagaaagtcctggcgttgatccccatgtccagagggaacgcgcgggcttggacacggccaggacggccgcgtggcacgctcatgggctcctgccaatgatgtgctgggggccaaagcctggaccagcac

SEQ ID NO: 578921 - DNA, 901 bp, Homo sapiens
  misc_feature (693)..(693): n is a, c, g, or t
  misc_feature (755)..(755): n is a, c, g, or t
  misc_feature (808)..(808): n is a, c, g, or t
  misc_feature (838)..(838): n is a, c, g, or t
  misc_feature (898)..(898): n is a, c, g, or t
cacaggggcggccaagaggcgccagggcaccggcgccgggcgccggcgcgggggaagccggggggccagccaggcccagcagcaggagggcagcgcgccggacacgaccgagagaaacaacaacggcccagagaagaccgacggccccagccacggggacggcgggcgggacaccgcggagagcggcaccaggcaggcccccacggacagccggcgcggccacaggaagcagggcgggccgcagggcagcagccagcggcagaacgagggcgaccgggaccagggggcgcggagcgggcgcgacggcggccggcacggcgcggaccagggggaggggggcagcccaccgggcagcgaccgggccgccggcagcaagaaccggcagggcagcagcgccggccgccgcggcaccggcaccgacggcgcgcgggccaacaggacggagcagagccggcaggaccgcagcaagggcaccggccacggcgccgggggcagcaccgacggccacggcaccggcagccccggcgggggcagcaagcggcaggccgagcgggcccgcgaggagggcagccggcgcggcgccggggcccccaaccagaaccggaaggagcagggcctgcgggacatcgccagcacgccgcacgagctctaccgcaacgactacgccaccatgctgcccgactccaccgagancgaccaggacaccatcaaccgcatcatcaaggtcatgaaacacgaagcctacggagagtgcnacaaggtgagctgcctggaaatccctgggccctctggccccaagggctaccgnggacagaagggtgccaagggcaacatgggngagccgggagagcctggccagaagggaagacagggagacccgggcatcgaaggccccatngga

SEQ ID NO: 578922 - DNA, 482 bp, Homo sapiens
ctcacagactgcgcccggctaccaaaatttttttaaaaaattagccaggcatggtggtgcgtccctgcagtcccggctacttgggaggctgaggcgggagaatcgcttggacccgggaggtggaggttgcagtgagtcgagatcgtgacactgcgctccagcctggaagacagagcgagactctctctcaaaaaaaaaaaaaaaaaaattgtagagacggggttttggccatgttgggccaggtgggtcttgatctctgtgacctcaagtgatcctcccgcctctgcctccggaagtgcggggattacaggcgtgagccactgacgattctctggagctgaaaagcaaacattttcatttcacttctgcatatggagtgcatggaggaagaagtgatgtccatggttaggggcggggaacggtttccctaaggggctaggccttaaaagtgggatgggatctgcgggcgcagtctgtgaggg

SEQ ID NO: 578923 - DNA, 212 bp, Homo sapiens
tcccccaagtcacgagggcagataagcttcacctatggtcttcacctgggatgtctgaaagtgccaatgggaagacattggctggttctcacctactacatacaagttcgccatcgatgatgccagctacaagctgacctgtccagtgtgcctccaagcgctgccgtcggttcctttactcagggtgtgacttggcaaaaccttgcggcaca

SEQ ID NO: 578924 - DNA, 1035 bp, Homo sapiens
cgttcctggcggccattgcggaaaacttccccacggctactgcgtccacgtggcggtggctgtggtggactccctgaaagcatgagctggcatgggctgccctgcgagagtctgttgatgtctgagtcttccctgggctaatccatgcctgggtttggatggcttgctgactgcaggtctggcgcccagtgtgcttggtgtctgactctgtgggacgtgcctgggtgcttgccctggtgcccggggaacagaacacacatcttggctttttgttagagtgtcttcatgtgaaagagttggtacattggttggtgatgacgcatctttcttgaagaaaatgtcccattcattaagcagttggtctctgatgaagataaagcccaattagcaagtaaactgtgtcctctgaaagatgaaccatggcctatacatccttgggaaccaggttcctttagagttggtcttattgccttgaagctgggcatgatgcctttatggaccaaggatggtcaaaagcatgtggtcacattacttcagtgtacaagactgtcatgtcttaaaatatacgtcaaaggaaaactgtaattggacaaatgtgaacctgtctgtaggaggaacaatgtatcacgttacgtaagctacatcatattggaatttaccgggaactgggattgcgtcgaaaagacagttaaatcttaatataaagatatgctgaatttaacagtgatctattatgctgtcaatttcgtcaggaagatgtggatgtacagcagaagtaatgattctaagtggctggattaagagtctgggaaagtttacattccctaatattctggaggagagtaaagggaagttccaagaatttggtgtataaaaggtgtaaaccggtgggcataatacaagtgaaaaataatgagtgaagcacaactatgtgaaatagaaacaggttataagacgaaaaataacattataaacaaaacgagatttggagagaacaatacccatagtgtaataaaaataataaaaggaggtatc

SEQ ID NO: 578925 - DNA, 147 bp, Homo sapiens
gcaaacaccgcaatcacaagctgctgtggagaggcaggcgctggttacaggaagagagactggcacggcccagtcataggaatcaaggtcaggacaaagtccagagaaacaagcgaggctcaacggagaggtccagcctcggaaatg

SEQ ID NO: 578926 - DNA, 116 bp, Homo sapiens
tggttagtccagagtgtatgaactattgatggaagccagctgctccaggttttcctttctgaaattcatgtgaactttaccatgactttacttgcaaagccaagccctgttcagca

SEQ ID NO: 578927 - DNA, 430 bp, Homo sapiens
cttccagcagtaagtgggcctccgtctggatcaggatctcaatgccatgtgtctccatcccatagttccgaaggctggtcagggcagtccaccggatgtccctccaggtaggtccattattaaaaatgattcccctgtccctgtgcgcatggaacgtggcgaggtagcctcagcccgagaactcgtcccagtagtccagcagcgcttccttcactgcctagtatccgtgcatcatcaccatgcgctgcgagcccacgtacagcgtgaactccggccggaagcgctgggccatccgggtgtaggacttgggaatattcttcaattccaactggaagaggttcccgatgatgggaagcgggcaagggcctggggtcagattccagttgctgtgcacctgcctccacatggacaccagcaggaggaaggtcgc

SEQ ID NO: 578928 - DNA, 454 bp, Homo sapiens
aatgtaagaagcatgggagcagggactttgttttgctccctgccatatccacagccctagaaaaacgtcgggccattgatagctctcagtaaatgcttgacaagtaagtgaatgaacgaatgcacaattaatgaaatgagggctgcgtcaatgaataactgggaatctgactcctgcagggagccttcagcccacaggtgtatgtaagacccgccccgcctctcatccttcgggctcccacccccgccgttaggctgcggttcgcgccgcggtcgccagagggcgcggagcggcggggcttcccgcacggagggctttgcgtgaggcaccgcgtggggcggggctgcgggcgggctcccagctgctgggccctcatctgctgggccctcatcggctgggcctcgtcgaccggcaagcggaacgcggcagcggggctgggcctgtgcggcggccg

SEQ ID NO: 578929 - DNA, 266 bp, Homo sapiens
aagcgttccagaggatccccggatcggcgaccatttcaaatcatggcgtgatctgcatcagagagaaaaataagctcttgcatttgacaatgaaatgtctacccatgtagatgacttgtgcttacttccactcagcaagtgattgcccaggagctacttgaccgtggctccaagtctaaccacatgggtggtgctacttgacaatcataccatgtaacctagaaagactgagacgaaacaaagttattaagtgatgaccacacccc

SEQ ID NO: 578930 - DNA, 210 bp, Homo sapiens
gtccgagctcttagttgtcggggacggtaaccgggaaccaaaaaactgctcctgtcgacttcgactcctaatccctagccactatgcagtaagtagcatctccatccacagttagccagcttggttgtccacaatttgcaaatctgctggactctaccttcctgaacacggcatcagccaattccacaattcaattacaaaaccatttgg

SEQ ID NO: 578931 - DNA, 529 bp, Homo sapiens
gcaagcccgggttgttgtcaggggctcaccccctccccctccgtgtcctttcttgttgggaaaagacccattggtgcccaccccccagaagcccatgtctttggaggtccctcttgtatgtattgaccccacccgcttgcccgaagcccccgctttatgctccccccgaagacgccctttcgaggttttagttggatgggcgcaaagaccctcaagaaggcttgaagccagcccttgcatttccttccccccccccctttgggcctgcttgtggtttttttcccttcctttgtggcgccaggccctttgtggggttttttcccttgttttggggcccagggggggttggtcccctttcccgggccccaacaccttttaaaattggttaaaggagtttgccctccttgggcccccccctttgttgttttccccccccccccccacccttttccttcccccccctctttttggggattttttatttcttttccttttgcccccattccatttatttttttcccccccccca

SEQ ID NO: 578932 - DNA, 107 bp, Homo sapiens
gcggcctttatttcttctttatgtatattacgtggttgggcacgacgacgtgtcttgttggggacacgtactctaccgaagtatttagggataaagaggaaaataag

SEQ ID NO: 578933 - DNA, 455 bp, Homo sapiens
  misc_feature (99)..(99): n is a, c, g, or t
  misc_feature (178)..(178): n is a, c, g, or t
cctcttggacggcgagtcccggcggcaggcgctgcaggagggcgctacaattgtcaggaagttgtgcaggcaggatgcttctttaggccttggcttggngtctccgcaccacctggtgggcgctgctgttgttgaaggggtctccgggcaggatctgccagtggtcaaacacacactnggggaacgcctggccgcccgtgttggacctcaggtcagcggtgaagccaaaggactcgttgacgggcagataggccttgacacaaacatgggggtgcggccacctggaactcctcgaacacgtggccccgcttcctgttcaaaaccccgtagatgccaccgaccacctgctctggacactggatctccacaaggtagaatgggctccatgaggcgtgactgggaagtcagcacactggcatagaggcagcgccgtgctgtggggatgaatctggccc

SEQ ID NO: 578934 - DNA, 251 bp, Homo sapiens
tcaaacataagggctatatgaagtgtaggtgtgctgctgaagaacagtactctccaaaagaagataaatataggaagaagtcaagtatacttactgagtaactcaagagaggcaaagaccctgtgctgagttagctgcaaaatcggtagccaagctggaaaagacaattgatgacctggaagataaactgaaatgcaccaaagaggagcacctctgtacacaaaggatgctggaccagaccccgcttaaac

SEQ ID NO: 578935 - DNA, 184 bp, Homo sapiens
  misc_feature (98)..(98): n is a, c, g, or t
  misc_feature (136)..(136): n is a, c, g, or t
  misc_feature (183)..(183): n is a, c, g, or t
ttggcactgacatccaggacaacaaatgcagctggctggtggtttcagtgtctgcaacgggccactccagaacagtaccaatcctgaaggaaaatacntggcagaaggaggctgagaaagtggctccgtgaaggcnctatagagggctgatctgccagcatgtcttcaatatgaggaaggcant

SEQ ID NO: 578936 - DNA, 206 bp, Homo sapiens
atattactgtacacataatgcagaaatccagtgcattattatctataagcatgtatctataaccttcatatatgagttcatactaaaatataataagctatatacatagctcaaataatattacagcagtttaaactagtaaacagctatgtataatatagttaagacgaacattagcagataatagtacctactagtataagtga

SEQ ID NO: 578937 - DNA, 158 bp, Homo sapiens
ctacccggttagcgacgcccttcctgtctatccctggtgctgctcatcctcacagaaagcctagcacagtggatgaaaccagccctgtgtagcccctgtggcaacttgcttgacagcactagttggtttggttgtcttgatgattgcttaccttgcct

SEQ ID NO: 578938 - DNA, 327 bp, Homo sapiens
  misc_feature (170)..(170): n is a, c, g, or t
  misc_feature (218)..(218): n is a, c, g, or t
  misc_feature (285)..(285): n is a, c, g, or t
ttttaaatgtttttggagatggagttttgctttgttgcccggctggccttggactccttgcctcaagcatcctccagtttcagcttcccgagtatctgggattacaggcaagagccactgtccctgaccattttagccatttttaagtgtgtagttcagtggcattaagnacattcacattgtagtaccggctaggcatggtgcctcacgaccataancctggtactttgggaggccgtggtgggaggattgcttgagctcaggagttcaaaaccagcttgggcnacttagtgagaccttgtctctattaaaaataaataaataagt

SEQ ID NO: 578939 - DNA, 330 bp, Homo sapiens
tgatcaaagatccaagaatattggttctaccaggctggaatgaatttggtttggaagttcagcgtacatttaaaagctgcaacaaaatataggacgccaacaatctcagaatttgggatcagcccagatggagatcgcaattggaaatgtcttcgatcccttacttaaatgacgaaaggtctatcagcccagatagagcaattggacaggttttcgatcccttacttaaatgatgacatgtatatcatactatctgtaaatgggatattccattacagtgattacgtacagaattcccatgcgttataacactttcctgagagtaaagca

SEQ ID NO: 578940 - DNA, 591 bp, Homo sapiens
ttggcggttaatgtagacagatgataaggcaaacagcgtgcaggacatcatcaacgatctgagcgaggcgattgaaagccatagtggccgccatgagctagctgatgccccccgtggagctggccaagcccgagaaccattacagagtggactacatcctgagtgtgatgaacgtgcctgactttgacttcctctcccgaattctatgagcatgccaaggctctgtgggaggatgaaggagtgcgtgcctgctacgaacgctccaacgagtaccagctgattgactgtgcccagtacttcctggacaagatcgacgtgatcaagcaggctgactatgtgccgagcgatcaggacctgcttcgctgccgtgtcctgacttctggaatctttgagaccaagttccaggtggacaaagtcaacttccacatgtttgacgtgggtggccagcgcgatgaacgccgcaagtggatccagtgcttcaacgatgtgactgccatcatcttcgtggtggccagcagcagctacaacatggtcatccgggaggacaaccagaccaaccgcctgcaggaggctctgaacctcttcaagagc

SEQ ID NO: 578941 - DNA, 275 bp, Homo sapiens
gaagtttctaaaacatcatttgcgaggaaagacctgtgactcctcctggtggtatcagaagaggtagaggctcatcagagttggaggaccgatgtgtaacaagttctgcccaacctcctctcgctcagcccttcagtctctgtgacgtgctgtggcctctacagtggtctgccttgccactccccaacaactcatcaagtttcccctcagacttacagtcataggcaacaggttggctgtataagctcatcagattgtcctggcaagaggtaggg

SEQ ID NO: 578942 - DNA, 141 bp, Homo sapiens
aggtagtcactgcctgacaatggaagacatacttgaatggggagcaggtatgtgctttcatatgaaaaaagagctgatgtataaaactacatatatggtgaagtcaacgtaagtcacataaccttacacactaagaggata

SEQ ID NO: 578943 - DNA, 580 bp, Homo sapiens
ttgatggccccctctttccaagcacgcccccgtggatctctggctaccaccgatcccctgcctgtactaaaagtacataaaattagccgggcattgtggcaggcgcctgtggtcccagctactctggaggctgaggcgggagaatggcgtgagcccgggaggtggagcttgcggtgagccaagatggcaccactgcactccagcctgggcaacacagcgagattccgtctcaaaaaaaaaaaaaacttgattgatttcacagtgataaccatgtttttgatcataagtagagaaaagtacaggcgggatgaccacggggtctgtcgggagatttgaaacggaaatcagagctgtacttataatggtgacccaattgtggtctatatctggaaacgttatactcttagactagcagtttctttcccgggtacgctaccagtctcttcaattctgtcaccatcctttccaggagtctgtatataaccttccctctttttgcaagaaatctttctaatgccaacaagctgggtcccctggactctctatcttaattgttggtccgccatccaccactcggaaa

SEQ ID NO: 578944 - DNA, 886 bp, Homo sapiens
ggagagaactagtctcgagttttctattttagtttggcactaacaaaacatgcttaattggataaaaatgtgagtgtaaaagggggtgacacgaggggggcagggcaaaagggtgccggtggaggtgggggcgggggtcaacatacctgggacctggccctggggggtggacgtctaatcaggacggaggaaacagaggtcagaagtcccggaggtgggcagcccttggtaaacagatcattgcgttttcccaggggtgaagagaggagctccagaaaacctgagtaggatggggggcagtgtccagtagactctagggaagcccagcccccagcaagcagcagaaactctaggggacagtctgtcctatgtaaagcaagagcacagaacaagcaaagcgagcctcccgctttatgttcccatagcttgattgggccttctaaagatggggcattgtacaacgatccagaatctacaaagaatcccctctttgggcttccatacatccaagggtgaacaaacagcaagagcctaatgagagacgtctgagtccaaaaacccttggtacaggttccacaaatgacttctaacaataccctcagtcaaagagaaacaaatcagcaggaggcaagaaacaaaaaggtacggaacccaatcccaaaggctgtggagcgcacctgccacgtcgtgaaaggccctagagccaaaggaagccccatatccctacacgctcaaacgaaaaaccaggaaagagacccagaaggccgcgaaagatggcagcgcagatttagaaatccgcggccaataagggggccagaagcccccaaagaaaatggcagacgaacaccacaataacaaaggcatggaacaaccaaagagacgccac

SEQ ID NO: 578945 - DNA, 435 bp, Homo sapiens
cagagaacacattaatccattaagctaactattattcaactatttatgataatctatgtacatatatgtctgtccatatgtatttgtaaataggtagtatataatgtcaggttagggtactgggttcaagtgtatatattcctgtaagtttcttaactgcattttgatgaattcacattatgtaactataagaattgtcccaaaagtacctgtacagaacattgaatattgaaaaattgacaaattgtgtacaaacactaaaaaaaacttgtttaaattgtatttgcaataaacaacatcaaattttttcatgaaatcttggtacaaattcagatctcttatttaaaatttaaataaggaatacattttcaaaatgcagtaatcaaaatgtgatctagtgtaatgaaataaaatgtgatctacgcgtaggatgac

SEQ ID NO: 578946 - DNA, 619 bp, Homo sapiens
  misc_feature (189)..(189): n is a, c, g, or t
gccctccgccatccctccccgacccctcggccggtccgatccctggggtgattcggcactgatgagtcccgggaggaaggactcggaggtgctggcagctctggctggtccaggcctcgggccttcgcctgaggcaaattcgtctcgcattcaccatcgtcccaagattcgtctcgtatcattcacatntcatgcctattgccaataacaatcatgtcaggccgttgcgcggtagcaaccccatgcacggggcttcatcgtggtgaaggatgagtggtgggatgaggacgcgcagtcgggagtacgatccaggggaatctttccatgtccacgaagctgaaggcagagacggcgagagacgtccgatatatcgtacggtgcctctagattgctcccgtgaagaggcgatggtaggagtgcaggtatttgaggatctgtaactaaggtattaaggttcctcatggagtcacataccagtattaacgacggcgattgtgcctatcagtgcgaaggtgcagactgtacaatggagcagtcaaggcgagacagattgctatcctatacttaaaatatcgagagaagagctagatattggtgaatatcgaagcaaagtgagaat

SEQ ID NO: 578947 - DNA, 233 bp, Homo sapiens
ttgaacgtgcggtcgtctcgagacgagcaggactacatggcacaacacatcatcagtagggtaaaactaacctgtctcacggacggggctaaacccagctcacgttcccatattgagtgggtgaacaatccaacgctagagtgaattctagcttcacaatagactaggaagagccagacatcgacaggatcaaaagagcgacactcgcatatgcaacgctatggcacgctgca

SEQ ID NO: 578948 - DNA, 529 bp, Homo sapiens
atcttatggatctgcatgtcgtaggcggtcaagagtgatgtcgtgctcgctgcatattgcaggctgcaaactcccgggatcccccattgtggattcttctcatatacactcgtttcattgtgttgagtgcatcttttaggtctgattctttgctgtagttctctgtgaagttcatcaatgcgctgcatgtaggttttttacgtctccgatgctggtggcagatgactgaaagtcttctagatgctgggccctatgatttctttccaaagagccacagatggcccttggcctttcgcgtactgtggttttggtatccatcttcccagtctcctgtggggatgcactgatagtcccatcagaagtggttctatatatatgttgactgtaatcttcaaatggaaagtctcctggaggttcagaaccagatttgaaggagtctagcaccatttgaagttctcttctttcgtcaactgattttgctgcaagaatcattccttccaaacattttgaaatgatgggaatagctttg

SEQ ID NO: 578949 - DNA, 369 bp, Homo sapiens
  misc_feature (22)..(22): n is a, c, g, or t
  misc_feature (91)..(91): n is a, c, g, or t
  misc_feature (230)..(230): n is a, c, g, or t
  misc_feature (320)..(320): n is a, c, g, or t
  misc_feature (360)..(360): n is a, c, g, or t
ttgagacagagtcttggctctnttgcccaggctggagtgcagtggcctattctcagctcactgcaacctctgcctctcggcactacaggtntgtaccaccacgctgggctaatttttgtatttttagtacagatggggtttcaccatattggccagggctggtcttgaactcctgacctcataatctacccgccttggcctcccaaagtgctggggattacaagcgtgancaactgcgcccggccagaccactattaaagggataaaattatgagttaatatatggaatttaaaaacagaacaagtcccacattgatctngaaagtaagttttgggagggcaaggagggaggggaaacanttttctttt

SEQ ID NO: 578950 - DNA, 240 bp, Homo sapiens
ttcttcaattcttcatgttggccatctcacatgctcactcatgcaccagtttttcagcaggtggggcccttcaggcaggtgcattagggccatgagggttctggcgcttcatacagtgggcattcagtgcccccactacaccagcgggttggggcagctttttgccctatttgctcatgtgcagaacacagacaagaaggcaccatcatggaaagcaaaacattcaagaccgatcaggga

SEQ ID NO: 578951 - DNA, 145 bp, Homo sapiens
taggaattttagaattttaaaattatacaattccaaaaactggggttgggttactttaattcctttactggcaaaacgggggggagggactggttaaatttctttgccttctttttgttaagaataaccaaggggtaaagggttt

SEQ ID NO: 578952 - DNA, 492 bp, Homo sapiens
tcctttcccaatagatttgagctcagtaggttaataaggccctcttgatctctgaatttgagaacaacatgttcctgggaccctgatgactttttatactttgtaaagccaattgttggagagcccctcacacagcccctggcctttgctcaactagcagatacagggatgaggcagacctgacttttttaaggagggtgagagccccaactgctgttccaaacatgcccttccttgcttaaggtatgggcacaacaatgcctgccccttggaaagaaaaaactttagtagataaggaaataagaacccctcataatttttccccttaggaataatctcctgttaatatgggggccattcttcccgattattttttacccaaacatgtaaaaaatgtctttcttttttaaataggggtggactatgctgttatgagtggctttaatgaataaacatttgtagcatcctctttaatgggtaaacagcctccca

SEQ ID NO: 578953 - DNA, 845 bp, Homo sapiens
ccgcgaactgcgtcatggaggtgtctgtggaccaggcggaaagcagttgagaagcccaacgctgaggacatgacatccagagattactacttagactcctacggcacacttgggcatccacgaggagatgctgcaaggacgaggtgcagcacccgtcacgttaccggcaactccattgtttcagtaaccgagcaccatcttcgaatggacaaggttggtgcttggatcgttcgggctcgggcaccggcatcctctgcgtgtctgctgccaaggccggggcccagtaaggtcttcgggatcgagtgattccagctagtctcatgattctaatggcggctgtaacgagtacgatctaaatgtccgaaacacatgttgtatgacccagcgttggttgtaccattcactcaaggggagaggtggagggagcgtggagctcccacttggagaatggttggacatccatcaatcaggcgagatgcgatggggcataactgacctccttcgtacgttactccagtgctcaacactcgttgtctctaatgtcccgggaacataggtggcttggcgcccggatgcgctctcattctgtcccaggaccgggctcatcgctgtatgtggacggctcgatcgagggacctggctagtacataagactacgagatccactggtgggatgaacgtgtatggcttcgaccatgtcttgcatcgagagatgtggccatctaaggagccccataatggatgtcgtggaccccaaacaggtggtacaccaactgcctgctctcagtagaaggaggtggacgatctataccgtcaaggtggatgacctgaacttgagctccccg

SEQ ID NO: 578954 - DNA, 411 bp, Homo sapiens
agaacaagtagtctgctgtgctagcatgattctaaccgtctgaccctcaggcggaaaactaggtgttaccacgaaatgtgtttagtggagtggactatgtagatgctcactagtcctagctgatgcctggtatagaaaaaatgtggttttcttagctgaaaacactaaaattccacccccacaaggggtatttatgagtgacaggggtggggcctggacataagcaattttcccctggatctagccacaggattactgatgggtgatgatctgctaggccgcgtagctaagcagctaaggagacaggaggccagggctttaaaagttagagcatgctcaacagcaagtgctaagcattagcattctttgatttgaaagtcaagtgttgaatcccccccttaagcggatcag

SEQ ID NO: 578955 - DNA, 154 bp, Homo sapiens
  misc_feature (137)..(137): n is a, c, g, or t
agaaagtaagattctcagggcaacagtgtacagcagagtggttgctccacagacagaggagggcagagtggcccagagtatcagcgtacagcaaagtgggtgttcccatccacaggggcagcgctatctcatagganagaacaacccctaggaa

SEQ ID NO: 578956 - DNA, 798 bp, Homo sapiens
  misc_feature (31)..(31): n is a, c, g, or t
  misc_feature (37)..(37): n is a, c, g, or t
  misc_feature (40)..(40): n is a, c, g, or t
  misc_feature (60)..(61): n is a, c, g, or t
  misc_feature (66)..(66): n is a, c, g, or t
gacacaacgggaggggccactccatacgagncccctnagnacgctgaatacctatagtannaacgngagcaattggggaaagacccccgaaggaggcaaaaagggcgggaagactaaaagaagaacaggttcaagaaccaagagaagggggaaaaaagaaggggaaaatttaaggaaaaaaggggggacccaaaagaaaaaaagaaaagaaaaaccacaagaaaaacgcaagacaaagaaaacagaacagacaagaaaaaaagaaaaaaagaacaaaaaagaagaacaaaagaccaaaagaaaacggaaaacaggagaaaagaaaacaaaaagcgaaaaggacaagaagaggacaaaacagaagaaaacaaaggaagcagacaaaagcagaaagaaccaagacaaaacggccaaaaaagagcggaaccacaactaaaaggaaaaagaaagaaaacaacacaaaaggaaaaacccagccggaacccaactaaagcgccaagaagaagaatccacaaaaggccaacaggcagaaaagagaaaaggacccaaacgaaggacaggaccaaccaggagaaaaggcgagaacgagaaaggaaaaatggcacgcaacaaaaaagaaggaaaaaaggcgacaaaaaaggaaaaggaaagccaagaaacgtgagaacccaaaaggaacagaaacggagcaaaacgcagactggggcaaaaaggccaagaccgaaaacgcggtaaagcacagaacaaacaaagaaacaaaaagaaccacaaagaaagaaacggggcaaacgggacacg

SEQ ID NO: 578957 - DNA, 259 bp, Homo sapiens
gcacgagcagaatagctttcatctggggaatgaagttctgaaatatctaaagcagttgactcatcgtctgaaaagtcctccaaaaagagaactattgggaaaccatggcgtggtggtgtaaaagaaaagctccctcagttttttggagggaatagcttaaaaaaatacttaaatggctcagttcacttggtgcagttaagatattaaacttgtcaattttaacactggtgtcacttctggaataaccttatgtgatgtt

SEQ ID NO: 578958 - DNA, 152 bp, Homo sapiens
tgtgttagaacaagcatttgctgtgttttgtgtagcacctggttccaggacagactcagcttcccaagaggatactgctgccaagaagaagttgctctgaagtcagttcatcgctgtgatcagcacgcctcacggtcacagtcccagaaaaa

SEQ ID NO: 578959 - DNA, 602 bp, Homo sapiens
gcactcacagctcagcaaggcctactgcctttataaactccacccctgcggcaggtcatagctgaataaaaggcagcagaaacttcttcagacttaaacctcccatctgacagctctgaagagagcagtggttctcctggcatggtgtttgtgctctgagaatggacatactgcctcctcaaatgggtccctgaaccccgtgtagcctaactgggagacatctcatagtaagggccaacagacacctcatacagatgggagaccctcttcaacaaagcttccagggaaggatcaagcagcaatatttgctgttctgcagccttctctgttgatactcaggcaaacagggtctggagtggacctccagcaaactccaacagacctgcagctgagggacctgactgttagaaggaaaactaacaaacagaaaggaatagcatcaacataaacaaaaaggacatccacaccaaaaccccatctgtaggttacaacatcaaatacccagatagataaaacacaaagatgggaagaaccagaacagaaagctgaaaatcgtaaaacagagcactcttttcttccagagagtgcagctcctcacagca

SEQ ID NO: 578960 - DNA, 100 bp, Homo sapiens
taaatgtcctatagattaaatatcaagaaatattcataattgatatttaatgtataggacatttatttatactcaataaatatttttcaaaaggaaaaaa

SEQ ID NO: 578961 - DNA, 131 bp, Homo sapiens
tatttaatcgaggaaaggtctcattaacagatgttattaatctccttaacagatgttatggagaactgcaaaccactgttcaatgaaataaaagagaatacaaacaaatggaacaacattccatgctcatg

SEQ ID NO: 578962 - DNA, 508 bp, Homo sapiens
  misc_feature (33)..(33): n is a, c, g, or t
  misc_feature (80)..(80): n is a, c, g, or t
  misc_feature (91)..(91): n is a, c, g, or t
  misc_feature (109)..(109): n is a, c, g, or t
  misc_feature (121)..(121): n is a, c, g, or t
  misc_feature (127)..(130): n is a, c, g, or t
  misc_feature (135)..(136): n is a, c, g, or t
  misc_feature (144)..(144): n is a, c, g, or t
  misc_feature (146)..(146): n is a, c, g, or t
  misc_feature (149)..(149): n is a, c, g, or t
  misc_feature (159)..(159): n is a, c, g, or t
  misc_feature (172)..(172): n is a, c, g, or t
  misc_feature (183)..(183): n is a, c, g, or t
  misc_feature (211)..(211): n is a, c, g, or t
  misc_feature (279)..(279): n is a, c, g, or t
  misc_feature (291)..(291): n is a, c, g, or t
  misc_feature (332)..(332): n is a, c, g, or t
  misc_feature (357)..(357): n is a, c, g, or t
  misc_feature (429)..(429): n is a, c, g, or t
  misc_feature (450)..(450): n is a, c, g, or t
  misc_feature (491)..(491): n is a, c, g, or t
atatagtacatgtaaacaactggcataaaattnataaaaatacaatactcctatgcaataacactatattcctgaaaaanactttcatttnctcattaatatcactggnctattttaacantatatnnnnggggnnaagcattngnggnggcttatgtntttaaagaaatanagccccaactntgtcttcgaaaatctcgtagcaatagcnattttgatcacttctttgcccatccttactttcctcaaactaaagcaaaaatatttgtaaatcctaanaatatgcaaaanactaagctttaatactgttttgtacgcctatggaacctgcnaccaatttgcattgccatcaaaggngtggatgccccaaagtccttgggctgcgagcggtggccacggctgcatagcagggaccttaaggcctttgcnccaaactggctcccctaaaanatagccatattttgctgggggttacattgataaacactgcnacaaaaggatccttctg

SEQ ID NO: 578963 - DNA, 102 bp, Homo sapiens
actctgtggtagagtaacctgtggaacatgtaccctgtggaacagtaggaaaatgtaccctgtggaacagtatcctgtggaaaagtaacctgtgaaaaagta

SEQ ID NO: 578964 - DNA, 235 bp, Homo sapiens
  misc_feature (13)..(13): n is a, c, g, or t
  misc_feature (15)..(16): n is a, c, g, or t
  misc_feature (19)..(19): n is a, c, g, or t
  misc_feature (40)..(40): n is a, c, g, or t
gagagcccgccgnannctnggcgtaaggcatcgcaggtgncctcctgcaaacctcgagctgcacacgcgcccaggggaaagacgtgacgttgctgcacctgtggctagtcctgcgcctgtgtgtgagacctgagtggggctgtggagaccgagaagctgtggctcttgagtgtctatgtacctcattgttccaggacacggaacaagaacttgggacccaccgagggaccccgcc

SEQ ID NO: 578965 - DNA, 113 bp, Homo sapiens
  misc_feature (49)..(49): n is a, c, g, or t
  misc_feature (58)..(58): n is a, c, g, or t
  misc_feature (83)..(83): n is a, c, g, or t
ccggcaggtactctgttactgtactgtactctctgactcttacctacangaatttgtnacataatcttctacatgtatgattntgtgccactgatcttaaacctatgattcac

SEQ ID NO: 578966 - DNA, 530 bp, Homo sapiens
  misc_feature (240)..(240): n is a, c, g, or t
gtcctttgtgagatgccactatcgggggaaaccggatggctccacagaaaaagttcgtttaaaggaaaatggtttaaggccaaggaaatacctagaaaacggaaagtcttgaaaccagagccggaaaaagaatgcctgtgtttcgaagttccttcttaggacgaaaccagctgaagctggcgaaatccaagatggcgcctctgaagagcctctggctttatcatcatcctgttctcatgntaaacaacactcccaccagcgccgtgacaactgacggtcgccatgacaacgactggaagagaccaagaagggacagaaaaaaaggggtttcttgattccgggaaaaatctccgttctttcccaaggaaagcacgaatattcccccccgtgctcttaatgcccagccccttcattaaagacaccctacctctgaaacttcccagctctcacaagctaagttgatttcagatcttccaattccatagccattgaatacagcctgcactgcttgacacaaaaataaaaaaaaa

SEQ ID NO: 578967 - DNA, 204 bp, Homo sapiens
  misc_feature (25)..(25): n is a, c, g, or t
ttgggatcaagtttaaatgactgtnctgcccctttcacatcaaagaactactgacaacgaaggccgcgtcctgcctttcccatctggtctatctatctcgctggcagggaaggaaagaatctttcatgttggtgaaggaagaagtgggtgaagaaggtggggtgggacgacagtcaaatctagagtaaaaccaagctgcccaag

SEQ ID NO: 578968 - DNA, 396 bp, Homo sapiens
aagggaaaaaagcttatggctgggtttggttttttcccttcccaaagggttttactgttccagggtggccccagggcaggcaggggcccccctatgcctgcgccctggtaaaggtgacccctgccattttccagcagccctggtatgttcctgccccccaggaataaaatggagggagctccaaaaactttccttcccaaaggcagtctccgtggttgaaacagactggatttttgttttgcccctgcccccttgtccctctttgagggaggggagttatgttaggactccaccctcagggattcgggtggcctgcgctagctttttttaaaactaaaaacttttaaggtgggagggtggcaagggatgtgtttaataaatcaattccaaccctca

SEQ ID NO: 578969 - DNA, 386 bp, Homo sapiens
ctaaattcgcggccgcgtcgacctctgatgcttctggacaaaataaattgaaatgtgaaaagaattcacaattttagaaccattaagagcatttttgattcatggaaagaggtcaaaatatcaacattaacacaagtttggaagaagttgattccaaccctcacggatgacatcctccaagacttcaggagaggaagtcactgcagatgtggtagaaatggcaagagaattagaattagaagtggaggtgaagatgtgactgaaatgctgcaatctcatgataaaacttgaagagatgaggagttgctttctgtcaatgagcaaagaaagtgatttcttgagatggaatctgctcctggtgaaaatgtcgacgcggccgcgaattt

SEQ ID NO: 578970 - DNA, 764 bp, Homo sapiens
gtcggttgggggtgtgccttgtttcatggaagccgccgcgggggttacaggcccgcacccccgcggtgctgtcatgtggtttctccacgatggtgcactgcagcagccgtggggtgaacccccttcccggctgttgcgatgttcatctgggcagccggggtgatatattagagccctgccccgcgcgcgacgcgtgtgttccacagccaccacagggcggggcgctgtagcgtcttccggcggtgcctgtcgtgtttggcagggcagagaatgacgacaccacgcgacggagatcagatgtcacgccgcgcgcgctcgctgccgctggggggcgacgacagcacccccggcgtcgaaagggaagccactcgcgcgcgtgcgggtcgctcagcgcgagggtgcgcagtggggggcacgcagagaggagaccaccagcccggggtccccgcgcgagtggggcacacaaagtgggtgacggcctgcgccgagcgagggcgcgtggcgtgccgagccgccagggtcggccctcgtgcaacggcaacggctctcctcccatccactcgaggcgaccgcacatcagaggggtcacacaagggccgcagcatgctcacaacgacggagatactacatagagaggcgggggatgacccacacccgggcgctcacagtgaggaagactgtctcaccgccggccagtggctgttgagggactccgaagagacaataaaacgggtggtgcggcggaccacatacattagacgcaa

SEQ ID NO: 578971 - DNA, 353 bp, Homo sapiens
ttaccaaaaaccagcagatggcagccacttttttccaacttgtagggggacgtctccccccttaaattagtggccaaccagtgccatttcactcccctcaggttttttaggggcaaagcccctgccccctttttggggtggttaaatgggagtttaagtggggtgctcacaacctcctttaaagggccccccaattttttgggcccttttcagtgtgtggaaggtcatttgggccccctaagggtcattccttggaaatgttttggtggggggtccccggagggctggcccaaaaaacccttaaaaaacgggggtccttaactgggcttaataaaaaggggtttcccccttga

SEQ ID NO: 578972 - DNA, 329 bp, Homo sapiens
gctggagtctgaagttgtatgaaccagaggcccgtttcttcttgccgatcatcttccttctggaagggaatatctgcactatgcctgtcccatcactgtactttggaagcagacaacttgcttgatttcacagcccatgactggagcagactctgattcaggatgaaccataccttgagttttacccacagctgacttagatgagactgtgcactgcgcacttttaatgtgatgctgaaacaaataagaattggggattataggtaagatgcaaatgtattctacatgtgacaaggacatccattttgtggactggggcagaatgctat

SEQ ID NO: 578973 - DNA, 144 bp, Homo sapiens
tgaggtcaaatataatgctgagtaatagccacaccaattaaaaaattgttttttaagacggagtctcactctgttatccaggctggaatgcaggggcgtaatctcagctcactcactgcaacctccgcctcccgggttcaagtg

SEQ ID NO: 578974 - DNA, 349 bp, Homo sapiens
cacgagggcctgtgttgtagtttccacagcgcgaagtgtctatttagaacacttcactctctgatgagagagagagagagatatctctctgtgagcaatatgcacatgtgccgggtcttttggttaaaccgtcgggaaatcggtggcatattttacctcttacaaatgcgctgtgttgccattggccctcaaggaaagctacacccggagaaccgtggaaggtgataagggagacggaggttaatctgtgcccaaggtcacatgaagaatgtgcaatttggccggattcttttacaagttccgtgataacacattttgcgcacgtgttttgtgaccccgtgttttgccg

SEQ ID NO: 578975 - DNA, 1153 bp, Homo sapiens
gcagggatgctgcgggcgggagcaccaaccggggacttacacgcgcggtgatggaagaagtccacatccgggaccaccagtcatggcagatggaagtttggacagggggcgtcgtagatgggttctgattcccagagtgtctgcaggcgaggcaggtggtgaaccgagtgtgggacaagctgtccccggtgcacgagcgcatctactgtgcactctctggttcagctgctgatgcccaagccgtggccgacatggccgcctaccagctggagctccatgggatagacctggcggaagctccacttgtctcaggctgctgcaaactgtggccgagaaagtactcagcctataacatatcgagaggacttgtctgcacatcctcatggtacgctgggctgggaccaacgtgaagcgacgcgtcaggtatactggaaccctgggcagggaatgctgactcgacagcctttggccattggctggctcggcaagcacctttatctatggctcactgtggatgcagcatataagccagggcatgtctcccgaggagtgcacgcgctctcaccaacagacgctataggctctggccatgagccgggatggctcaagctgggggtgtcatctaactggctcactattaccagctgccggctgtggcaccatcgagtcatcttgcgccaatgaacctgccacaatctactgatgcagtgaaccgaaccccaggaattcctcgcgcctactgggagatcaagctctcccagcgcccatacaaacagagcgcgacaacagcagccacgaaccgcccacgccaccggtcgcgtgcacgccccaaacggggcccgcgccacacagcacacccgcgcgcgggcacgaacacgagccaacaccctctcgcaagaccgcggcccccagacggcccctcacagagacaacaccgcgcccagcacacaccacaagcaggcgcgcaaacagccgagccgaccgcgcgcgaccacccacccgtcggcggggcatcgacagcgcccagcgacagacccgccgcgccacacacgcagccgctgacccgcaccgcccgggccgaaccgcaaacgaccaccacaccacgaaccaccagcccgggcgccgccacgcgcccacggccacccacccgaca

SEQ ID NO: 578976 - DNA, 137 bp, Homo sapiens
tatgcagagaaccccccttgttgtgaatggcttgggagtgagaggtcaggatgggtccagatgcgcacatacacatcccctttttccataggagatgaactgccctgtgacggcaggtggtggtgagatcattgtgg

SEQ ID NO: 578977 - DNA, 1234 bp, Homo sapiens
gctgatttaggaaccttgccgtgtatactagtcaaatgaccatcctgattcttggacaatgatgtgagatctgacttttttgccaatgtactatgactgacacctaccccatgtgtcaatggagcaaaatggcctttgagaatgaacattttcaacaagacccatctggactgacagtgacaatttgccctcttgttacagtgccttgaccagttgtgtcatcacaaaaagccagtcataagcatcatctcatttcctatgtcgcattgtgtgccatgctcctcatgcaacaattgcagcttgcattgcgttattgtgcttgtatcattggaacttgtcatccttctgcacgtccatgtgcaggcccagcatgcctgcacgcacaacaatggtcagcacaacagccgcagccacttgcttggcagcaaccatggcaggggcatgttccttgtgctggtggcatcgcaaacataatggtcagcattgtgcaagtgggagtagatcactcagcacgcagttgcatcccccaagccacgtgtgggttacacactgtgtgttggcaatttcacaagggggtcgcaagcattgttccccccattcacgtggagccacagacccggtgttcatacacaggttggcctgcgaggattaacagacagccaaaatgaaacaagggagtccacactgtgggtacacataccatatacgactaggaaggcacccttccacatggtatccctgggacttcctttcaattccgttcctatcacacacaaacatatgtggcattgtcatggcgtggtgacactctttcaaatcagtaggagtattccccacaaatacagaattggaatacgtccaggcgagtcacatcattcgagcgagcaaatcaccaagggtggaaatcccattatacaaatccttccacaagtacatggagtaagggttaggggagtaggtagtcaccgacagattctccaaacaaccaataccaccccgtatagcaacacgccgatgtaaccctaagaattagaccgttctaatatatccaagatatcctcatttcatatcgagcacatagagtagcatcggcagagaacgactacaacggggtacacccaaaagcaaattagtattcgtaggatatacgtatactggtgcacctgctggcgctatgcacaacccactagtatattcatcgttacttagaaaagtgtgggcagatactggctct

SEQ ID NO: 578978 - DNA, 211 bp, Homo sapiens
tgacttccttccaaagagtacagtatggaaagcggggcaggagtggtgggagactgactttacagtggagaaacttgcagacactacctcagccagatgatcaaggtcaacatcaacagtgataagtcatactaatagtatatattctggatatgatgtgatgaaaatacggtcttccccaaacccctagccccagtctaatatggagagg

SEQ ID NO: 578979 - DNA, 741 bp, Homo sapiens
  misc_feature (188)..(188): n is a, c, g, or t
  misc_feature (198)..(198): n is a, c, g, or t
  misc_feature (210)..(210): n is a, c, g, or t
  misc_feature (227)..(227): n is a, c, g, or t
  misc_feature (250)..(250): n is a, c, g, or t
  misc_feature (271)..(271): n is a, c, g, or t
  misc_feature (306)..(306): n is a, c, g, or t
  misc_feature (321)..(321): n is a, c, g, or t
  misc_feature (355)..(356): n is a, c, g, or t
  misc_feature (361)..(361): n is a, c, g, or t
  misc_feature (372)..(372): n is a, c, g, or t
ggaccgcaacccttgccgtctgccgctgacatcgctaccatggtctccggcagcagcggcctcgccgccgcccgtctcctgtcgcgcagcttcctcctgccgcagaatggaattcggcattgttcctacacagcttctcggcaacatctctatgttgataaaaatacaaagattatttgccagggttncactggcaancagggcaccttncacagccagcaggcatnggacatatggcaccaaactcgtnggaggaaccactccagggaanggaggccagacacatctgggcttacctgtctttantactgtgaaggaggncaaagaacagacaggagcaacggcttctgtcatnnatgtncctccgccttntgctgctgctgccattaagtgaagctattgaggcagaaattcccttggcttgtgtgctatcactgaagggaattccccagcaggacatggtacgagtcaagcacaaactgctgcgccaggaacaagacaacggctacttgggcccaacgtgacctgggagttcatcaatcctggagaactgtcaacaattggcatcatgccttggccatattcaccaccacaaggaacggattggcattgtgtacagatctggcaccctgacttatgaagcagttcaccaaacaacgcacgtcgccttggggcagacttagtgcgttgccattggcaggtgatccttataatggaacagattcactcgactgcctcgac

SEQ ID NO: 578980 - DNA, 320 bp, Homo sapiens
  misc_feature (70)..(70): n is a, c, g, or t
gtcagaaaatttccgggaccagccatcaaacagtatattccaattttcttcgtgctatactcaccaagtnggcaaaggttcgtaatggcatctctgcaccaatctcctcccccatagcaataagggcaatccccagaacagccactccctgcaatttgaagagagagcagaacccattaagcttccaagggaataaaaaaacagtcaccctttgactcaaggtcccaatctggaaaaattaaaaaggccattccctgtgcggggaacacctttttaaccccttaacattaccaggaacccgcgttctcccacaggggtta

SEQ ID NO: 578981 - DNA, 113 bp, Homo sapiens
atatcagctcggtaccggtctgacagcttctgagcagaaagctggaggggggatgtcgcgggggttattcttgttgtggtttattttattacaatctttttcctctttttcta

SEQ ID NO: 578982 - DNA, 310 bp, Homo sapiens
ttgtttggaaacctctgcgccatgagagccaagtggtaggaagaagcgattgcgcaggctgaagcgcaaacatgaccgaacatgatgaggcagaggtccaatgtagaccgttagagtgtgtttgccaccgttggaggccgccacaggtagcagaacactagggaatgccagaagctggggatgcgggttaagaatgttgtgggaactgactatgtctagctgtctagagtctcggttctcgctggtatctagagaccttcatcgtcctgcatgatcgccgagtcacctgctgaggagcccaaccttgatg

SEQ ID NO: 578983 - DNA, 324 bp, Homo sapiens
cacgaggacaactgctttgttcggatgtcaagttcaccaccctcatccatgtccttcacccgttacaagttaaggaagatatagaatctctttctagattgattgattgaaaccacatagatgaagaccctcccagcaccttttaaattttccgtgtcaccagaataccccagggccatcccatgtcgatcacagtggacgtgatggaatcctcaccgtttatcccggtcctgggggcatcacacaagcaccctactcatgcacacataatgtataatggatcatttcccacgctccctcaaatgctaggaagacattttgtta

SEQ ID NO: 578984 - DNA, 595 bp, Homo sapiens
tcccaatttgtaaagcgctgatcctgttttattgggcaggaaaacaaaacaacccagcagcccaggagggacaggtggatccttaatcctcctcctcgtcgtctccatgccccagccccacccgtggccctttctgtggctttctctcctcttcacgcggcccgggcggccacccccgtagggagagcgcagagagaagctcgatgtgctctcgtgggaactccaggcggacaatgaaggacgggatgttcaccacctgtgctgtgcggacccgtggaagcagcgacaagggtgagggtggacgtggaggaaaaacggacgcataaccccgagctaccgcaccactcttgcctcttccacccaccccgtgaaggccgccacggttgcagaccccaaggcgctgcaggacaggtgtgcccctgactcctcacgtgcgccccccggggattccaagggtactcgaccttaatccccaaaaaggctccagatgactttctcaaccccattttataggagaaactctgaaagtatcccacctaagaaccacaaagcaaatgaagatggccgtgtgagagcccccaagttccgagtcgaa

SEQ ID NO: 578985 - DNA, 451 bp, Homo sapiens
atccaccaggcaccactgcaatgtgtgtctaaggcagagcctttcagatccgtgtccacccatgtgccaataggacaatgggcaaagctacaaatggcaagagaaaaatgggactattaatgcgtgtggaaaaggccttaatagttaagttacagctaagaatgtcatgtcttgggttagaattttcatttttagcaccgttaatgtattcacttaaatctatgttagcacctcgtctccaggcagaacaacaaaccatccaaacatcttaaacattgggggaaacacgaaggggagggttaaagagagaatccggtactgtggaaggagtggatttagatcacaagatccttgtcgatatccttctgcttgatgccgaagcagccggcccactcatccagggcgatgtacttgtcattggccaggtcacaggtctcgaaaaagcgggtgg

SEQ ID NO: 578986 - DNA, 141 bp, Homo sapiens
gcatccccacgtacgtcgcatatctaatagaaaacaaacgccaaccaatataattcaagtactgcattattacaattattactaggagtctctattttaccctacctacaagcctacagaagtaatatcgagatctaccac

SEQ ID NO: 578987 - DNA, 785 bp, Homo sapiens
  misc_feature (13)..(13): n is a, c, g, or t
  misc_feature (41)..(41): n is a, c, g, or t
  misc_feature (57)..(57): n is a, c, g, or t
  misc_feature (134)..(134): n is a, c, g, or t
  misc_feature (155)..(155): n is a, c, g, or t
  misc_feature (158)..(158): n is a, c, g, or t
  misc_feature (180)..(180): n is a, c, g, or t
  misc_feature (215)..(215): n is a, c, g, or t
  misc_feature (220)..(220): n is a, c, g, or t
  misc_feature (250)..(250): n is a, c, g, or t
  misc_feature (252)..(252): n is a, c, g, or t
  misc_feature (307)..(308): n is a, c, g, or t
  misc_feature (330)..(330): n is a, c, g, or t
  misc_feature (333)..(333): n is a, c, g, or t
  misc_feature (337)..(337): n is a, c, g, or t
  misc_feature (345)..(345): n is a, c, g, or t
  misc_feature (406)..(406): n is a, c, g, or t
  misc_feature (419)..(419): n is a, c, g, or t
  misc_feature (423)..(423): n is a, c, g, or t
  misc_feature (425)..(425): n is a, c, g, or t
  misc_feature (457)..(457): n is a, c, g, or t
  misc_feature (463)..(463): n is a, c, g, or t
  misc_feature (493)..(493): n is a, c, g, or t
tctgccggttgtntttgtaagaggcgaattcagtttcccangtggcgctgcggcagnagtccaaagtcggactttcaaaacaaacccgaagttttgaacccggcggtggcagttgtcactggcaaaggtttggngtggtggcgccagtgtactanttntggggaggtctcaaccaggttntggcaccttcaatccccacctgatatctgcgtatnatcanggtatcccgcttttcccccagttccccaanancgtccttcctttccctagttaaaggatcgcagttttggtctgatagtgcatccanntattccagtgttgtattcccanttncctnttcccatntaaagtggtggcctttcctggggataacttgggtatcccccgctgggagagcaagaacaanaaacaagggagcnagananctgccgctcccctgccaaaggatatgaatacnagcctnagctggtttgagaagctggatgtgcttctnaacgctaatgatggaaatgtggtccggaataagaagtggctgtataatcttggggtctcaaaagagataattggcatgtgcatctgtttcttctgtagcagtggctgtatcttcttggggtctccaccgcagaatagcactgctgtcactcctgcagtgctgtgggaggagtcagagattatgcagaaggaattgaagttgctgcagtaccagttgagccagcaccaggagctgctgctgaaacagctggctgagggacgacaggctcaggttggcagttggaaggatctcc

SEQ ID NO: 578988 - DNA, 435 bp, Homo sapiens
gactccctccatgtggccccaggtgccaccaataaaaatcctacagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatgttgggcaaatataataaaaattttaaaaaatttaaaaaattaaactaaaatatgaagatattatgaataaaagacaaataaaggtaatagataaaaattaatatacattaagtattaaaaattaaaaaaattgaaaaaactttaaactcctccaaattaacaaccttatcaccaaaaacacaaatctcccatttttgaaattatacca

SEQ ID NO: 578989 - DNA, 157 bp, Homo sapiens
agagcaagtacagcagtaggacaataaatcaattcaagaagatattaccatcatgtcccagggagtgcgaggtttctagaggagcaagcggctctcctcactcagggctgccgggggggtcttgaactaggtgctattgaaacttctagaaactagg

SEQ ID NO: 578990 - DNA, 172 bp, Homo sapiens
ttcatcaaccacaatactctgcgtattaacaagtataatattaagtatggcatgacctctagagctaatgtgatcgtggggttgtaattacagaccccgacgatcacataatcctaaactggatcagccatagtatcgtggtgtgtcgactccactaacgggggatcctcta

SEQ ID NO: 578991 - DNA, 388 bp, Homo sapiens
catgtctcccctaagtgctgagtgtgagcccctgtgccctctttcagttctttaggaaaaagtatagtgggcagggtgcagtggctcatgtctgtaatctctgcactttgggaggccaatttgggcagattaccagagatcaggagttcaagatcagcttgaccaacatggtgaaaccccgtctattcttaaaattccaaaaaaaaaaaaaaaaaaaaagaagaagaaaaaaaaattagccaggcatggtggcaggcacctgtaatcccagctacacgggaggctgaggcaggacaatcgcttgaacccaggagggggaggttgcagtgagccgagatcgcacccctgcactccatcctgggtgacagagcaagactctgtctcaata

SEQ ID NO: 578992 - DNA, 1371 bp, Homo sapiens
gtgtccctgtggtgtggacgtggttggtgattggcagtgatcctgtgatatccggcttaactcagcgtcaaaaatgcgatgatcttctcgtgcaaagacaccgttgaccggcgaagaccgatcaactcgctggaggttggagccacagtgacgactcaatcggacaacatcgtgtaagcggccaaggaatcgcagggactaacggagatggcgattccgcgcccgatccatgcagacggctcactctgtttgcacgggcaagtcagcgtggaacggatggcgcgtaactccttctcgtgaccttagcatacagttcctagaacggacgctctgagcgacgtgacagcgctgggctccatggcggctcgtgacgtaggggtggctatgttgcaagattcgtatcggtgtcacggaggcccatgacgccaggggcgaacgagcgccaagtcatgcacgcatgggacacggtctgggaggccgcacaatgggggacacatcccagctccgcacagacctgggagagacagggcccaaaaggatttcgccaagaggactaaccacggaaacgcgccaagtccccaaatcacgccggggataccaacgaccacaggacggtgccatccaacatccagtgaagacggccaagggggccacagcgaacacgggcaataggtgcacaagagcaactcggccgaccccaaggacacacatacgatatgaatacaataggaagccgatcacccagcacgccacagttccaccagaaggcaaacaaccgggcgaaccgccttccagcgaaagcaacccagcagatggacacaaaaccccgaatagaagggaacaaacccaattgcgaccgcgacctctacttacggacaagccaacacggacgctaggagcgacacacaacacgttgtcccctacaagcagcacacatcaccgctgtggtaccgagcgggaccctcgcccaccccagttcagccgcgccacccagtcgtagacacagcaccatagagaggcacccagaaaacatcggccaacacagcgagcaactggctgatcccaatatgaacgtaccccaatgcgtcagcaacacgggagcccctaggcgggcacacggcgcccgcaccaaacatcgagtgcgctagtacaccaccacatgccgctccacacaacgacggcgcaaccagcgtcactcaccatcggctgcgctaacacgacgacacacaactgcgttgtgtggactcgacacacaccagacgagaaacactatcttaccacaccaacgacaaacaggcaacaatcatccagccgcagcacacgcgggccatccaacaacaacagccacccaacgagtctagccacccgacc

SEQ ID NO: 578993 - DNA, 815 bp, Homo sapiens
cggacccccctggttggggagcaggtggtggtccgctcctaacccggtggctagcgctagagacaaggagaagcgcatacagcgtaccagacccctgtggaccagctacctagcaggacgggctaccagctagcgctacctagcacatagccagctagctagaaaataggcctatatgacgaggaggtaggggtactagacagcgccgagctacttccgtaagcagctagcataaagctagcggtacccgccggacatacagggccacctattagcgtatacacctatgggctactgcccacacacctaggaccggccaccgacagagtacaccaaggacaagggtaccttaccctacagaaccctagtacccgagaacctaggtacaagaacgccaagaagaccatacgggcggcagcgatgtacaactacgcaagaagtacaaaccccccagctagggagcaccggggccagccgccccctagaggaccaggaggacgcagatcctacgagtagtacgagagggaactaggagcccagcacgctagaccccgtacctacagacctagaagccctaccgcagcagcatacaccatagagcaagacctggtggaaagggctatgctagtcgcgactaaccaggcgccttcgggactaggggcaccctgaagcagaagactagagccggggccaagtctagagaccctatccggatatctccggtacaccggatgtaatacatctagcggagtaacccaggctgctgatagtgccccaatgtgcaggaaagccttagagggttccagtgtacgaga

SEQ ID NO: 578994 - DNA, 291 bp, Homo sapiens
tacagtcctcaagccatccgtgctgggtctgtttttttttaatataaaaaaaaaacccccctttctacccaaaatagaatacaattacaagatcttcgttaaattaaaactccaccttccggttaaaaagaaattctcttcctaccccctccaaaatagtggaattaacggcccccccccaccagccccgtttatttttttttaaccttaaaaaaaagcaagcccaaagcctggccaaaattttaaacctttggaacccccccccctaaccccccaaaagggctgatataa

SEQ ID NO: 578995 - DNA, 180 bp, Homo sapiens
gcgagatctcagctcactgcaacctctgcctcccaggttttaagtgacttcccctgccctcagcctcccgagtagcttggattacaggtgcccgccaccatgcctggctaattttgtattttaagttggccatcgttggccaggcttggtcctccaacttctcgaccttcaaggtgatcc

SEQ ID NO: 578996 - DNA, 660 bp, Homo sapiens
caggctgggcacagtggctcacaccggcaatcccagtttttttggtggcccaagcacttggatcatgaggtccggaggttttttataccctggctaacatggggaaaccttggctctactaaaaataacccggttgtctggcaaccgatgacagactccttagcgagagccaaaccaagcccttcagtgagttacacaaactgtggagtttgaactgaacatctacaaggagcgtggaggctgagcttctcaagagtcctggttgcagaagcaaggctccttcttggaaaaaaatcaaggacccagggtggcgctttttttttggcttcacaagctactgggtctaaagccccatcttcgtaacagggcaacccaaaaggctggttgggagcccaaaagtcatgaacgtgaagtgggaaccttaataccacattctttttggcacgacactgaaggtccttaggtggtcaaaaggagaaaccagcggctccattttcgttatcaccatcgtatttccttctttaaaaagggtttctttggccattctaaaactttctaggcgggcggtttggccacaaaagggagagttggttcgatcacaaaagagcgctatacttatcacataacaaagccttctccccaagggcggtttggagcagg

SEQ ID NO: 578997 - DNA, 168 bp, Homo sapiens
atagttgaccgagccacccagtgtccagcgcctggtcaagaacgttggcgccgcgcagtacctcgacgcggctttgccacagcgggtccttgagttcataggtgcgtgccgccggggccggtgagcggcaaaccgtcgagcattgcatacaagcccgaggcgtgggag

SEQ ID NO: 578998 - DNA, 169 bp, Homo sapiens
gagatcacacgcattgcactccagcctggacaacaagagagaaactccatctcaaaaaaaaaaaaaattcttggccaggcacgggggttctaggcccagggcagaaatttatcaaaatcaagaagctaaagaagttcggtctctaataattttgctcggtgaaaaaatt

SEQ ID NO: 578999 - DNA, 151 bp, Homo sapiens
ccggttagagcggctctgtgagcgctccatccccgctatgtttctctaaagtaaccatctttaaagtgatcctctaaatatttaaaatagtactcatctcagtcataacaagagacaaaactttgcaatagcctaggggccctacctgatc

SEQ ID NO: 579000 - DNA, 250 bp, Homo sapiens
actagtgacagtacctgtctgatagtggatgctctgacatatgtaaagagttatactatatatataaaccagtgatatatctgacaaactgtatttgtgagtcataagagagtgtaatacataacattatacataaattgtatgtatatataactctttacatactcagagcatccctatcagacaggtactgtcattatccctttattatcgttgagaaatgggcagaaatgggctatcggggtcccga

SEQ ID NO: 579001 - DNA, 176 bp, Homo sapiens
tgctgtgattacaggcgtgagccaccatgcctggccttgttcagggtttcaaagctcgttgcgcaattaaccctccacattctgtggatatccttttgcccaggaaacaaacgctctccacgtgacctactgcactcaccactcccgacttggggcccctcggccggtaccgagct

SEQ ID NO: 579002 - DNA, 106 bp, Homo sapiens
tgggacctgagaccaaggtcagagaagccttccaacctcaggagcctgacttcccgacggctccaccagaccttgaacagctccgactaacagatgagcttgctcc

SEQ ID NO: 579003 - DNA, 1214 bp, Homo sapiens
tatagcgagggggtctcattaggtggcccaggggggttcctcaaactcctataaacgcaaggtgactccctccggcctcacccgtctctcaaaggtggtggggattgtgcgggcatgtgagccacggagcgtgggcacaatgtttgttatatttctttaacaagtagaagggcgtcacatacgtgaaacgtggaagggtgcatacaatgtggccgaaagagttgggtcgtgacgcataagttattggagggaagttacaccacccgtggacctatagagcgtggtgggaagaatcccactctcctttggcggactctcaagaggggctcgtgtgttccccactctcatctctgtggtgaaaactcgtgccgtgagctcccctaagtggcgtataaggcatattgtggaggttttgggagacactccctttataagagcctgtgggatcctcccgacttacaattggcgcaggaaacatttgtgggaagccacagcggggaaacacccctattttaagagggaatatggggagggggatctcataaatattcacaattgtacacctaaaccaatgttgaagagggtctcggaaccagcgcggagggtatatgaccccccttgtgtagtgtcgatcctatatgctgtaccaaagagtggggagcaacaagaagggaggcgtaataccgaaaccaacgagagggggcgccccaagcgtagaacggggacacgagagacgcaggaacgagagcacaacgagacccacctcagagagagaaaaaccaccgcaacgacacaaccaaccactacaacagctgacacgcagacaccggtcaccacaaaaaggaaaaaaccacacaaagagggagaggggaccccaccacaagcacaacaaaaagcagaaacgaccgagaaacaaacagcagggtggtaccaacaaaaggagggcggcgccccccagagagaaatcaagactgaactccgccacgcgcaagcaaaaataaacaaggcgaacaggacgacacggggcgtgaccgcccggggcagcgcaaaaacaaaacaagcacagcagagacgtgagcgagaggaaaccacacagcgtggatcaccagaccggggcggcacacacctagtaggatgaaagcgccagccaccaccaccataccgcgggatgtatagtgcaaacacaaagaaggggcgcagaagcacacacccaa

SEQ ID NO: 579004 - DNA, 428 bp, Homo sapiens
gggggctcctttcccccccccccccccgggggcattgtgtgggggtctcggggtttttttcccaccggggggtttcccgggccccccccccgccccatttgaaaggggaaatttttttcccccggggggtttcccccttaccttcccccaaggccggggtttttccccccccccccccatttgggggggggaggggggtcccccccgggtttggttccccctccaaaggggcccgctttggaaaccccggaacccccgcaggaaccccgccaatttttttgccccctccaaaaggaattttggcgggcccctttttcggtttagggaaccgcggtttcttaaggggttccccttttgcccaaattggggctttagggaattttatttcccggggtggttttttttaaaaaaaggggttttaaatttga

SEQ ID NO: 579005 - DNA, 124 bp, Homo sapiens
ggatcactgcacagagtgagactctgtctcaaagtcaaaaacacaaggtagacagcccatttcttttgtttttgttttgttttgtttttgagacaaagtctcgctatgttgcagtgtgcttccg

SEQ ID NO: 579006 - DNA, 113 bp, Homo sapiens
gcgcgatactcgttagtgtgccctagaaaagacaaaaagacaaaaaataaaaaaaataaagtcaattaaaataaagagcagtgtaagataatggcagaatagttggtatttca

SEQ ID NO: 579007 - DNA, 333 bp, Homo sapiens
gcatgcatgtggagcgaaacacgtggatctggactcaggctgaggtactggcctcattaccttctcacgtgttgaaaaatgaccatgtcaggaggtttctcagcacttcctctcccccacagcagcttcagagtccaagtcctggcaatccctccctttctaaagtaggtaccgtgatgggcgtgtctggaaggcctgtgtgtggagtggctggtatcccgtcctcgcagagcggagcccagcaccacgggcagcacccggccggctccgccgcccccttgcctcactgctcccatgcgggcagcgcgggctcagccctggcctaccggaccc

SEQ ID NO: 579008 - DNA, 318 bp, Homo sapiens
  misc_feature (229)..(229): n is a, c, g, or t
  misc_feature (316)..(317): n is a, c, g, or t
catttttccttagttggtttccagtaataaagtcatgttgtctgaggccgggtgcagtggctcacgcctgtaatcccagcactctgggaggctgaggtggcggatcgagaccaccctggctaacacagtgaaaccctgtctctaccaaaaatacaaatatttagccgggtctggtggcgggcgcctgtagtcccagctacccgggaggctgaggcaggagaatggcgtnaagctgggaagcagagcttgcagtgagccgagattgcgccactgcactccagcctggggtgacagagcgagactccgtcaaaaaaanna

SEQ ID NO: 579009 - DNA, 421 bp, Homo sapiens
  misc_feature (11)..(11): n is a, c, g, or t
  misc_feature (70)..(70): n is a, c, g, or t
  misc_feature (74)..(74): n is a, c, g, or t
  misc_feature (114)..(114): n is a, c, g, or t
  misc_feature (216)..(216): n is a, c, g, or t
  misc_feature (403)..(403): n is a, c, g, or t
caacctttttnaaaaggccccccacgccttattttccaaatagaattaaaaccccgattcccgaagaggncccngaaagttgggcctaatttcccccggccgggttatgggggnagggcagggtaaagggatcccttaaaaaagtttaacacctcctatgtatcctcacaatcctattgtgaggatgtgacttgttccagtgttcctgaacttttncgaaggaatcgtgctctcaatgcaaagtgtcattctctggaattgcacctggctcaggaaaggactgtctttgtacttgaatttaaatccaatggagaactttaacacgggcatttgcatgactgagaattgctgctgtcttttttccgtatgtcactttcttgaatgtgttctaataaaatgattnctaaaggcagaaaaaaaa

SEQ ID NO: 579010 - DNA, 264 bp, Homo sapiens
gcatgattcatctggataagggaatgataaatagaggatggagtgcatacagtatgagtcagcagaatgagggatgccttcgtgcccacaaagatcttactcaatttgcacaacttgtacttggcctcctcaggtgtaatacgatgtacagcaaagcgacccttggtgtcatagatcagacggaaattctctcccgtcttgtcaatgctgatgacagtccattaatccagcagggtaggttatatcagttcggaccttgccatc

SEQ ID NO: 579011 - DNA, 176 bp, Homo sapiens
tcgaagagcccaactccggctagagctgtacaatcctcaggccgtcttgtagaaaagaaagcagcgaggcactgcctggatccgagaggaacgctactctttttgtgtctcaagtcgcctgcatcctgtcatttcgctccggcttcctctctgcgtttgacacgcagagacgatcc

SEQ ID NO: 579012 - DNA, 742 bp, Homo sapiens
  misc_feature (3)..(3): n is a, c, g, or t
  misc_feature (144)..(144): n is a, c, g, or t
  misc_feature (214)..(214): n is a, c, g, or t
  misc_feature (225)..(226): n is a, c, g, or t
  misc_feature (263)..(263): n is a, c, g, or t
  misc_feature (269)..(269): n is a, c, g, or t
  misc_feature (271)..(272): n is a, c, g, or t
  misc_feature (274)..(276): n is a, c, g, or t
  misc_feature (280)..(280): n is a, c, g, or t
  misc_feature (283)..(285): n is a, c, g, or t
  misc_feature (287)..(287): n is a, c, g, or t
  misc_feature (296)..(296): n is a, c, g, or t
  misc_feature (327)..(327): n is a, c, g, or t
  misc_feature (332)..(333): n is a, c, g, or t
  misc_feature (354)..(354): n is a, c, g, or t
  misc_feature (418)..(418): n is a, c, g, or t
  misc_feature (513)..(513): n is a, c, g, or t
  misc_feature (547)..(547): n is a, c, g, or t
  misc_feature (552)..(552): n is a, c, g, or t
  misc_feature (711)..(711): n is a, c, g, or t
ggntggggtttttgggagtgaggcagggaggatgcctggggcctgtgggaatcagagagaagctggggtcagaggtaggagctgacgctgtggggggtggggggtgaaaggtgaggcaaggtcaaaggtgaactgcagctcggngggaggggtccaatataaaccaggacttgcaggtgtagaagtaaaatgggactcatagagggtgaaaganaagttggagtnngaggggattcagagatcaaagagaagttggggttttntgtagntnntnnngttnttnnngngggttaatngtgaggcaaggtcagcggtgaagtgcagctnttttnntggggtcaaacataaaccagntcttataggtctagaggtaaaatgggattcatggggggcagaggtcaaaggtgaagcagaagtnaggggtgaaggaaggtctgcaaagttaaaggtgcggtttccagagtgagaaggggtgaagcggggctcctcctgggaatgtcaaggttggaaganctcaagggggttaaagataaattagggctctttnggganccagggtcggagatgaagtagccagaggtaaagcgagctccaaaggtattgttagggtcaggggggagtcagccttcgagggaaagcggggctctagggttcagaaatggggggcctagcggatcaaaggtcagaagcctcgaggggacaggtgggaancgatgggagcagcctaggccacctcctcctc

SEQ ID NO: 579013 - DNA, 691 bp, Homo sapiens
  misc_feature (252)..(252): n is a, c, g, or t
  misc_feature (363)..(364): n is a, c, g, or t
  misc_feature (542)..(542): n is a, c, g, or t
  misc_feature (546)..(546): n is a, c, g, or t
acggggctttcagggaccatggtgataagatttaacccttggatttccccgccgccactttatgggccgttctggcaggggtaccctacccccaatctatggggggtttaaataaagcactcggcctggaggaaatgtagcgccccgtcctgtgcttctcaggccatttttttaaacccctgttaggaaggttggatttggcgcgccttgcttcaccaaaaatccgggggaaaaatttttgggtttaatttncggggatatcccaagcccacagtgaccccccttgtttagtttcgcaaggcaaagggcccctaaaagtccttttgtgaaggggttgggtttgagcgggaaagaaggtcaaanngccgggaagcccccccccccccctttgaaaaattttcctttaaggcccccgccttcatgtttgaaaaaagattaaggggggaaaaggtttttcttttttgggggtttccccggaaaaaaaggggcccggtttcccccaagttttaaactttccgcctttggggacctacccaaaaaancctnatttttttttttttaaagccgggggggggttaaaaaaaaggttttttccgggccaaaggtttttttggggttttggaaaacccccccccaggggggtggggtttgttggcccaaaccccaaaaaaatttccaaaggtttaagcca

SEQ ID NO: 579014 - DNA, 1082 bp, Homo sapiens
gtatcggacacgggaggatcaggatgtttgctgagctggctggaaccttagacggtgccagataggagtgaagcgtggctccatggctgccctcctgctgctgcccctgctgctgttgctaccgctgctgctgctgaagctacacctctggtgccgcagttgcgctggcttccggcggacttgtgcctttgctggtgcgagctctgtgcttgcaaaatgggctcttcgagctcgctgccctgtgccgcggctgtctgccgccggtcgggtccccagtcccagcctagcgcacgtaggaagtgcgcagcgcgcgctggtgctggcgccagagtttctggagtccctggagccggacctgcccgacctgagagccatggggctccaacatgtgggactgcaggcccaggaaccaaacacatgctggaataagcgataaagctggctgaagtgtacgctgaagtggaatgggccagtgaccaagatacatctaattcaccccagagcaataaacagacacagtagcctgtacatcaaacaaactctaggaacacagagactccccaaggagtgactcaggactcaagaacatatagaagatcctgaaaatgacaaggagtacatataagcatagtagaaggaagaacaaacagagaaaaatgatgatactaacctacggcaaatccccaaaaacataaagcaaacattgtaccagagaaacccatagagtagaagaaaatcaggaagaaggaaggaaattgagagaaattagtgggggacaacaaagttagggatagattaaaaaaaattacataaaggtttacataagggacgaatgtggtaaaaagatagaagtggagaaaagaaaataggaacaaaataagaaacaagagggagattgaaaggagatgaatacacaaaaagataaaaattatgatgagaaaaagaagaagacacaggaaatacatttgaaaaaaacaagagaccacaagtaaagagaagagacaaaagaacgaattggaacttaaagagtacagaagaatgcaaaaaataggaaagatagtgaatagatagacaagatataa

SEQ ID NO: 579015 - DNA, 126 bp, Homo sapiens
ggcttaacgtatatatgtgttactacccttgtcggtccggccactacgtcggccacgtggccggacacgttgtggccggaacgtacgatgaattcgagctcgaattcatcgatgggacgtgtacgt

SEQ ID NO: 579016 - DNA, 1254 bp, Homo sapiens
tttttttttttttttgctttgtacttgagtttatttcacaaaaccacggagaaagatactgaaatggagctctttccagcctccaagcaaggaggccccagcagccagtctccagccccttgagccctttttgttaggcccacacccaaaagaggagaaccagtgtgtgcgcgaaggtacatggcaaggcacttttgaaaacatcccagtttaccgtggtgaaattgaacttactctgaaacagatgaaaagggacatgcaaatttgctgagcacatggaggtgtttgttagtaggtgaaaatcatgtcctgggtataacccagcttctccaggttagggtgagccgccgtctggatcagtggtggcgggccacacaccaggatgagcgtggacttcgctggaggaggaaggtgctccttgatcatgtcggcagtaacgaagcctgagctgtacttccagccaatgggaggcctgtccagggtgtaccacaggtcgaactggtctgggtgagtcctggcaatttcttcaagctcttttctgaccaagatatcctcctctgtctggttggcaaagatgagggacatcctggtcctgtcactggggtccttggtgatgtggcgaatgagctgcaacatgggtgtgatgcctgtgcccccagcaatcattcccaggtgatcggccagtgtttttttaggctcactcgtctggtctggtctgattccaagattccctggcccatggtaaaacaagcgtccccttggccctcgaaaaaagatggtctccccgattttcatgttctccaaatactgagtcatcttcccaccttcaggatattgggggtgtacatttttgaagtagatctttataattaggtccacaaagcctctgtcatcatcactggagacaggggtgtaagccctgaccaccaattcattatcgatttttgccaagagctggacatagttacctacaggaagccctaagacatggtccggcgaaggcagtccaaagcggaacctccgggtgttgtggctgattttctctttctcaatcaagggcagcgggtacttggcttcagggtcctgtaaggtgattggctctctcctcctggagttcatgctcttcaggaccaacacgagcacagtgaccccagtgacggtgatggtcaggagcagggacgggtcccttaagctcggcaaggctggagaaggccgtctgggtgaccgggcggagggggatgctggggaaggaag

SEQ ID NO: 579017 - DNA, 287 bp, Homo sapiens
tagcctctgagtagctgggatacaggtgcgtgcaacatgcctggataattttcgtatttttagtagagctggggtttcatcgtgttaaccaggatggtctgaatctcctgacctggtgatctacccacctcagcctccctagttttttaacagataatttctatctctttatcattatcttctatatggtaagacatcgttcttctactttcttttatttctttagacatgctttcttttagtattttgaacatatttaaaatagctgatttaaagtctctgtttag

SEQ ID NO: 579018 - DNA, 1655 bp, Homo sapiens
tttttttttttttttgctttgtacttgagtttatttcacaaaaccacggagaaagatactgaaatggagctctttccagcctccaagcaaggaggccccagcagccagtctccagccccttgagccctttttgttaggcccacacccaaaagaggagaaccagtgtgtgcgcgaaggtacatggcaaggcacttttgaaaacatcccagtttaccgtggtgaaattgaacttactctgaaacagatgaaaagggacatgcaaatttgctgagcacatggaggtgtttgttagtaggtgaaaatcatgtcctgggtataacccagcttctccaggttagggtgagccgccgtctggatcagtggtggcgggccacacaccaggatgagcgtggacttcgctggaggaggaaggtgctccttgatcatgtcggcagtaacgaagcctgagctgtacttccagccaatgggaggcctgtccagggtgtaccacaggtcgaactggtctgggtgagtcctggcaatttcttcaagctcttttctgaccaagatatcctcctctgtctggttggcaaagatgagggacatcctggtcctgtcactggggtccttggtgatgtggcgaatgagctgcaacatgggtgtgatgcctgtgcccccagcaatcattcccaggtgatcggccagtgtttttttaggctcactcgtctggtctggtctgattccaagattccctggcccatggtaaaacaagcgtccccttggccctcgaaaaaagatggtctccccgattttcatgttctccaaatactgagtcatcttcccaccttcaggatattgggggtgtacatttttgaagtagatctttataattaggtccacaaagcctctgtcatcatcactggagacaggggtgtaagccctgaccaccaattcattatcgatttttgccaagagctggacatagttacctacaggaagccctaagacatggtccggcgaaggcagtccaaagcggaacctccgggtgttgtggctgattttctctttctcaatcaagggcagcgggtacttggcttcagggtcctgtaaggtgattggctctctcctcctggagttcatgctcttcaggaccaacacgagcacagtgaccccagtgacggtgatggtcaggagcagggacgggtcccccggtcggacgttcgttcccggctctggccggcctccgcgcctctggcctctttccttccggccgtcccgacggagatatttcttcaatactccataaatacaccccgccgcggaacccacccggagtgagacgcccaacacgtcgtcgaactggggttggccgggggccgctccccgccgcgggcccgcagactcgtggcgtcgccccgcagctccgcctggccgacggggaaccggccgagacccggacacgcacgcccgggaggacaaaagcgcgggcggaccccgcaggctgggaccccggcggctggcccgctccccgagaagggccgtggtcggggggctctcactcacgagccgctggctctgggtcagccctgcccccagggcagcgctccatcatgaggctggcggggcgctgagccgtggcgtcctcgctcctgcgctgcccctctgcaccctccgct

SEQ ID NO: 579019 - DNA, 80 bp, Homo sapiens
ttcataatgaaaggaaatgttatttttaatagaggttagtgaaaataaaaataaaactattttctaatcgcctaaaaaaa

SEQ ID NO: 579020 - DNA, 1301 bp, Homo sapiens
tttttttttttttttgctttgtacttgagtttatttcacaaaaccacggagaaagatactgaaatggagctctttccagcctccaagcaaggaggccccagcagccagtctccagccccttgagccctttttgttaggcccacacccaaaagaggagaaccagtgtgtgcgcgaaggtacatggcaaggcacttttgaaaacatcccagtttaccgtggtgaaattgaacttactctgaaacagatgaaaagggacatgcaaatttgctgagcacatggaggtgtttgttagtaggtgaaaatcatgtcctgggtataacccagcttctccaggttagggtgagccgccgtctggatcagtggtggcgggccacacaccaggatgagcgtggacttcgctggaggaggaaggtgctccttgatcatgtcggcagtaacgaagcctgagctgtacttccagccaatgggaggcctgtccagggtgtaccacaggtcgaactggtctgggtgagtcctggcaatttcttcaagctcttttctgaccaagatatcctcctctgtctggttggcaaagatgagggacatcctggtcctgtcactggggtccttggtgatgtggcgaatgagctgcaacatgggtgtgatgcctgtgcccccagcaatcattcccaggtgatcggccagtgtttttttaggctcactcgtctggtctggtctgattccaagattccctggcccatggtaaaacaagcgtccccttggccctcgaaaaaagatggtctccccgattttcatgttctccaaatactgagtcatcttcccaccttcaggatattgggggtgtacatttttgaagtagatctttataattaggtccacaaagcctctgtcatcatcactggagacaggggtgtaagccctgaccaccaattcattatcgatttttgccaagagctggacatagttacctacaggaagccctaagacatggtccggcgaaggcagtccaaagcggaacctccgggtgttgtggctgattttctctttctcaatcaagggcagcgggtacttggcttcagggtcctgtaaggtgattggctctctcctcctggagttcatgctcttcaggaccaacacgagcacagtgaccccagtgacggtgatggtcaggagcagggacgggtccccgagccgctggctctgggtcagccctgcccccagggcagcgctccatcatgaggctggcggggcgctgagccgtggcgtcctcgctcctgcgctgcccctctgcaccctccgct

SEQ ID NO: 579021 - DNA, 1432 bp, Homo sapiens
tttttttttttttttgctttgtacttgagtttatttcacaaaaccacggagaaagatactgaaatggagctctttccagcctccaagcaaggaggccccagcagccagtctccagccccttgagccctttttgttaggcccacacccaaaagaggagaaccagtgtgtgcgcgaaggtacatggcaaggcacttttgaaaacatcccagtttaccgtggtgaaattgaacttactctgaaacagatgaaaagggacatgcaaatttgctgagcacatggaggtgtttgttagtaggtgaaaatcatgtcctgggtataacccagcttctccaggttagggtgagccgccgtctggatcagtggtggcgggccacacaccaggatgagcgtggacttcgctggaggaggaaggtgctccttgatcatgtcggcagtaacgaagcctgagctgtacttccagcctggttggcaaagatgagggacatcctggtcctgtcactggggtccttggtgatgtggcgaatgagctgcaacatgggtgtgatgcctgtgcccccagcaatcattcccaggtgatcggccagtgtttttttaggctcactcgtctggtctggtctgattccaagattccctggcccatggtaaaacaagcgtccccttggccctcgaaaaaagatggtctccccgattttcatgttctccaaatactgagtcatcttcccaccttcaggatattgggggtgtacatttttgaagtagatctttataattaggtccacaaagcctctgtcatcatcactggagacaggggtgtaagccctgaccaccaattcattatcgatttttgccaagagctggacatagttacctacaggaagccctaagacatggtccggcgaaggcagtccaaagcggaacctccgggtgttgtggctgattttctctttctcaatcaagggcagcgggtacttggcttcagggtcctgtaaggtgattggctctctcctcctggagttcatgctcttcaggaccaacacgagcacagtgaccccagtgacggtgatggtcaggagcagggacgggtcccggagtgagacgcccaacacgtcgtcgaactggggttggccgggggccgctccccgccgcgggcccgcagactcgtggcgtcgccccgcagctccgcctggccgacggggaaccggccgagacccggacacgcacgcccgggaggacaaaagcgcgggcggaccccgcaggctgggaccccggcggctggcccgctccccgagaagggccgtggtcggggggctctcactcacgagccgctggctctgggtcagccctgcccccagggcagcgctccatcatgaggctggcggggcgctgagccgtggcgtcctcgctcctgcgctgcccctctgcaccctccgct

SEQ ID NO: 579022 - DNA, 652 bp, Homo sapiens
  misc_feature (250)..(250): n is a, c, g, or t
  misc_feature (318)..(318): n is a, c, g, or t
  misc_feature (366)..(366): n is a, c, g, or t
  misc_feature (383)..(383): n is a, c, g, or t
  misc_feature (395)..(395): n is a, c, g, or t
  misc_feature (402)..(402): n is a, c, g, or t
  misc_feature (409)..(409): n is a, c, g, or t
  misc_feature (412)..(412): n is a, c, g, or t
  misc_feature (425)..(425): n is a, c, g, or t
  misc_feature (427)..(429): n is a, c, g, or t
  misc_feature (432)..(432): n is a, c, g, or t
  misc_feature (436)..(436): n is a, c, g, or t
  misc_feature (439)..(439): n is a, c, g, or t
  misc_feature (443)..(443): n is a, c, g, or t
  misc_feature (445)..(445): n is a, c, g, or t
  misc_feature (463)..(464): n is a, c, g, or t
  misc_feature (466)..(466): n is a, c, g, or t
  misc_feature (469)..(469): n is a, c, g, or t
  misc_feature (476)..(476): n is a, c, g, or t
  misc_feature (480)..(480): n is a, c, g, or t
  misc_feature (489)..(489): n is a, c, g, or t
  misc_feature (501)..(502): n is a, c, g, or t
  misc_feature (528)..(528): n is a, c, g, or t
  misc_feature (549)..(549): n is a, c, g, or t
  misc_feature (551)..(551): n is a, c, g, or t
  misc_feature (556)..(556): n is a, c, g, or t
  misc_feature (558)..(558): n is a, c, g, or t
  misc_feature (564)..(564): n is a, c, g, or t
  misc_feature (574)..(575): n is a, c, g, or t
  misc_feature (578)..(578): n is a, c, g, or t
  misc_feature (582)..(582): n is a, c, g, or t
  misc_feature (595)..(595): n is a, c, g, or t
  misc_feature (607)..(607): n is a, c, g, or t
  misc_feature (612)..(613): n is a, c, g, or t
  misc_feature (618)..(618): n is a, c, g, or t
  misc_feature (631)..(631): n is a, c, g, or t
  misc_feature (633)..(633): n is a, c, g, or t
tgtctcattcagaacaaaaactaactctgtctaactactgtaaggcaaactcttggtaccaaccaacagagtcaacttgccacccctggcacacagctctattcctatcacatgacttcctgcatgctgcccttcctttctccatcccaattacacctcccagccagatacacaagacacatttgctggtgaactccactcctcccagctctctatgcatttccactcaactacctctactgccttcagntatgctttacttactcagttccttcaccattgtcttctgaaaaattgtcttttatctgtgtttggtgngaaaccttaatctgtcagaatctcccagaaggtcattaccagttgccngggtgtttattcggcantctctaaggcancctttgnggaatcnaanggggaggaccccnannngcnattntgncctncntcaaaattaaggccctanntnccncctctanaatnattcaccangacgcaggcttnnattcaagttggaaggtcgggaagctntgtttaactaaaagctgcacnancagangnaattgnagaaataaanncancaanggggggtactatngcaatattaatnatgcnnagccngcaagaaggcagncnttcaacagggtgggagtgc

SEQ ID NO: 579023 - DNA, 1441 bp, Homo sapiens
  misc_feature (301)..(301): n is a, c, g, or t
gatagatttgagaccctggaacctgaagtatctcatgaagaaaccgagcatagttaccacgtggaagagacagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagaancaaatagaaaaacagatgatccagaacaaaaagcaaatttgctgagcacatggaggtgtttgttagtaggtgaaaatcatgtcctgggtataacccagcttctccaggttagggtgagccgccgtctggatcagtggtggcgggccacacaccaggatgagcgtggacttcgctggaggaggaaggtgctccttgatcatgtcggcagtaacgaagcctgagctgtacttccagccaatgggaggcctgtccagggtgtaccacaggtcgaactggtctgggtgagtcctggcaatttcttcaagctcttttctgaccaagatatcctcctctgtctggttggcaaagatgagggacatcctggtcctgtcactggggtccttggtgatgtggcgaatgagctgcaacatgggtgtgatgcctgtgcccccagcaatcattcccaggtgatcggccagtgtttttttaggctcactcgtctggtctggtctgattccaagattccctggcccatggtaaaacaagcgtccccttggccctcgaaaaaagatggtctccccgattttcatgttctccaaatactgagtcatcttcccaccttcaggatattgggggtgtacatttttgaagtagatctttataattaggtccacaaagcctctgtcatcatcactggagacaggggtgtaagccctgaccaccaattcattatcgatttttgccaagagctggacatagttacctacaggaagccctaagacatggtccggcgaaggcagtccaaagcggaacctccgggtgttgtggctgattttctctttctcaatcaagggcagcgggtacttggcttcagggtcctgtaaggtgattggctctctcctcctggagttcatgctcttcaggaccaacacgagcacagtgaccccagtgacggtgatggtcaggagcagggacgggtccctacaaggccgccctgctcctctcccaactcaagcccgacagggaaagttgcctctcctcccgccgggtcactggagtctcagccttccggaatccgagccggcccgccccgctccccgcccttcgcggtcccgcccacgacctctccccacgcctcccgctccggcccccacctccgct

SEQ ID NO: 579024 - DNA, 855 bp, Homo sapiens
ggcaaggctgaggtcagtgaatatctcccgatccttgtggataatgtgacagatggaatgcagtgatgtcaagctctttgccctccgctcatctccagctgctcgccaatatcagaagagttgctcttgttcattggccaaatgcaccgtttattagcgaccgtagctgtttcgcgttcaactgtggacagagtaattctatggtcctacgcagtagaggcacagtttggcgctccaagagacagtaagcaggtacttcctcagtgatgcgagaaataacttatcttgccaaccacactctaaatggagaaatccttcgtaacatgcatagagtggtgctatagatgtaaagtcttgtagtcttgtctgcaaaggcgagatgatctagttgttatccttaatctttgatggacacactggacactggggatcgcaagctacatatggactatcacattatacgttccagcagtacacgaacttagtttctatctcccggttcatagacgtgtgatgtcgactatgagttaaccaccatagtaagtccggatacaggaagaagtatggagtgcactaagggaaagatcaagaagaagtgtccagacgattattcttacgaaggcatcagagtagacatggacactatcaccgggtccgagtacttattccaatgcggtgactggagaaagtgattcctgtaatggaagctgctttccatctatgaaatcacacaagtgttcctgaagaccactagatataggctgatacacgtactcaggtgactgatgagtattggctgacagcctgttccttgaaatggctttcttctcaatgccttccagactcaccccttga

SEQ ID NO: 579025 - DNA, 171 bp, Homo sapiens
cttcaggggacgcagcgctggaggtaggcactgggtatggatgttgaagagagaaacccaaagagttccttctctactggaagaagacaggaaactggaaggattttgtcaacggcttgaagttctttatgaataaagttctttcagctgtaatatcctctcgctatactg

SEQ ID NO: 579026 - DNA, 730 bp, Homo sapiens
  misc_feature (54)..(54): n is a, c, g, or t
gcagaagtccaggctaggagcctcagccggtgacgccaggaaacaggtctaggntaatagcaggtaatggtgacaagtccagtgtgcgtacgtgtcatgaagaatccatggttgatgacatcccagaagagaacactaagtctaagcttacatcttacccctgaattcccttcctctgaagcactcattaaggtgaataaacaatattccttaatacctatagaggtggaataccacccagaatcctctcatatacaaaagaaaaagaacaaatgggtgatagacacagaattgtctcattcaaaatctcaaagggtcgtcattgaaaacccttcggtgaaagactattttgtgagggccgttgggggttcgggaattttagttgcaaaaaacgagaggttgtgggttccaagggaaggcccctttattaaaacaaatttttatttggccagggctaattttaagaaacaatttttgttgtacccccctttttttgtgggatacaacgggtttcaaaaaaaacactcgttgggaatttataatttttcccgcctttccttattataaagggaacttacctggtgggcgggaacaacccataaggaagacattttcttccaacccaagggctcccgggttccaaggaggggaaatattttatataccccttttttggggataactttttcgcgcggataatctttaaaccactttatttgtataacttcct

SEQ ID NO: 579027 - DNA, 98 bp, Homo sapiens
gtatcggagatcggcacaacaggagacacaacagcccaggcgccctgctgcacaggctggggccctgagcaacacatgcagtggcttcctcctccccc

SEQ ID NO: 579028 - DNA, 1168 bp, Homo sapiens
tttttttttttttttgctttgtacttgagtttatttcacaaaaccacggagaaagatactgaaatggagctctttccagcctccaagcaaggaggccccagcagccagtctccagccccttgagccctttttgttaggcccacacccaaaagaggagaaccagtgtgtgcgcgaaggtacatggcaaggcacttttgaaaacatcccagtttaccgtggtgaaattgaacttactctgaaacagatgaaaagggacatgcaaatttgctgagcacatggaggtgtttgttagtaggtgaaaatcatgtcctgggtcctggcaatttcttcaagctcttttctgaccaagatatcctcctctgtctggttggcaaagatgagggacatcctggtcctgtcactggggtccttggtgatgtggcgaatgagctgcaacatgggtgtgatgcctgtgcccccagcaatcattcccaggtgatcggccagtgtttttttaggctcactcgtctggtctggtctgattccaagattccctggcccatggtaaaacaagcgtccccttggccctcgaaaaaagatggtctccccgattttcatgttctccaaatactgagtcatcttcccaccttcaggatattgggggtgtacatttttgaagtagatctttataattaggtccacaaagcctctgtcatcatcactggagacaggggtgtaagccctgaccaccaattcattatcgatttttgccaagagctggacatagttacctacaggaagccctaagacatggtccggcgaaggcagtccaaagcggaacctccgggtgttgtggctgattttctctttctcaatcaagggcagcgggtacttggcttcagggtcctgtaaggtgattggctctctcctcctggagttcatgctcttcaggaccaacacgagcacagtgaccccagtgacggtgatggtcaggagcagggacgggtccctacaaggccgccctgctcctctcccaactcaagcccgacagggaaagttgcctctcctcccgccgggtcactggagtctcagccttccggaatccgagccggcccgccccgctccccgcccttcgcggtcccgcccacgacctctccccacgcctcccgctccggcccccacctccgct

SEQ ID NO: 579029 - DNA, 953 bp, Homo sapiens
  misc_feature (55)..(55): n is a, c, g, or t
  misc_feature (69)..(69): n is a, c, g, or t
  misc_feature (72)..(72): n is a, c, g, or t
  misc_feature (193)..(193): n is a, c, g, or t
  misc_feature (197)..(197): n is a, c, g, or t
  misc_feature (239)..(239): n is a, c, g, or t
  misc_feature (253)..(253): n is a, c, g, or t
  misc_feature (278)..(278): n is a, c, g, or t
  misc_feature (290)..(290): n is a, c, g, or t
  misc_feature (346)..(346): n is a, c, g, or t
  misc_feature (363)..(363): n is a, c, g, or t
  misc_feature (378)..(378): n is a, c, g, or t
  misc_feature (389)..(389): n is a, c, g, or t
  misc_feature (419)..(419): n is a, c, g, or t
  misc_feature (425)..(425): n is a, c, g, or t
  misc_feature (497)..(497): n is a, c, g, or t
  misc_feature (682)..(682): n is a, c, g, or t
  misc_feature (691)..(691): n is a, c, g, or t
  misc_feature (709)..(709): n is a, c, g, or t
  misc_feature (719)..(719): n is a, c, g, or t
  misc_feature (756)..(756): n is a, c, g, or t
  misc_feature (762)..(762): n is a, c, g, or t
  misc_feature (796)..(796): n is a, c, g, or t
  misc_feature (813)..(813): n is a, c, g, or t
  misc_feature (855)..(855): n is a, c, g, or t
  misc_feature (858)..(858): n is a, c, g, or t
  misc_feature (870)..(870): n is a, c, g, or t
  misc_feature (874)..(874): n is a, c, g, or t
  misc_feature (882)..(882): n is a, c, g, or t
  misc_feature (911)..(911): n is a, c, g, or t
ttgttatctcctcccctttcttgattgctattccaaattcagggtggtaggtacnttctctctctctcnccncctgaccaccttctccctgttcagtgttttctcacaaagtaaattcaccttagatcttcccgatccttctggcagttaccaaggtagtttccaaactggcaggagataacatggtcatgantttncagctggtagttttcattaaactcaaaggcacagggaaactnttccattaattgcnagatacagtttaggaactgggtgangataggggacanttctttagagttcccatcgaggtggccacactttgggaaaacttgtggcccatggntatccattccttctctnttaagatcatgagtnctttgaatgtnctataaaatggatctaggaggatgctagcnacttancagatttgtgctgtgcggtcccatccatcagaacaatggacttagatactggccttttctaccttcactgcntttgttatgaaaattccagcttccataatagcttttatgtgttttaaccaccctgagctctccaggccgctaagaaattcactcattgttggagttttcaatttacaaacttccaagagtttctgcagattgctccgcattacatggatgttcttaatgcccatgattctgaagcgaatgttggnatagttgtnttcattttcatacccctncccagccgcncggttggccatggcatttaactttggtcttgtgtgtncaacanacataaactggctccctgggtttgtttggctaanggcctccaacaagagcncatcatctacacagcgagttttaaatccagaaagagggtggntanacggcaaaaggnagcnttgttctntttgtagaggtaggagagcccagggacangttctttacttctgaactttgaacttccaaccaccgttccca

SEQ ID NO: 579030 - DNA, 839 bp, Homo sapiens
  misc_feature (26)..(26): n is a, c, g, or t
  misc_feature (537)..(537): n is a, c, g, or t
  misc_feature (591)..(591): n is a, c, g, or t
  misc_feature (799)..(799): n is a, c, g, or t
aggggtaagaagataaaccctccaanaaaaacctttaacccgtggaaaaaccccctggagatatacacccgggggagccccctgttgttgtgttaaactttggggccacaaccggcaggggatgggtgttttccacagggaatattttgcctcctcacccaactttttggaggaaaaaaaaaattaacaaccttccctggtattggggacaaacatcctttggggcctgaaccaaagcagccccggggtttgttggtaccccttcagaagtggggcacaccctctttaagcacttccggggaaagtgttcaaccacccggccacatccgaagttgtcaaagaggtgtgacgcacccccctgtcctttcaagagaaaaaaaatgaaagagtggaactcccccccggcgggtaccgagggcatttggagtctttctccccatccccactgatcttttctgtggtttacaggcttaagacaaggacgccccgcggtgacgtgttgttcactttaccaatgtgtgaccgcggagtacagcnagtgccaccaccgtgtattctcctgagaatgaggagatatagaggggtactctntccacaactacccgcagagtctgtacgattttgtaataactcaggtgtacacaacgcgccatgagtgcccactatgttttgtagtaaacacaacgctcccctgagccgctgtagaaggtttgtgttagaaccaaaagaaatgccaacggcctcttcctagaacaaaaaaacagagtatcccaaagtataataaactacagaagaagcncataaaaatacaaaatagacgagaactagatcacacacaa

SEQ ID NO: 579031 - DNA, 1115 bp, Homo sapiens
ttagacacctgctctcgattgcccttaaaagcaggccatcccaaatcctttctccctcaatttctcacatttcccatctggagccagagccccaggcttaacccccacatctggtcctacaaaactaaaacaaaacaaagagacagagaccagtcctcaaagtgtcaaggttggtctgacccatggtgagtgaggcaatgaatgtcgtaccaatgggaggcctgtccagggtgtaccacaggtcgaactggtctgggtgagtcctggcaatttcttcaagctcttttctgaccaagatatcctcctctgtctggttggcaaagatgagggacatcctggtcctgtcactggggtccttggtgatgtggcgaatgagctgcaacatgggtgtgatgcctgtgcccccagcaatcattcccaggtgatcggccagtgtttttttaggctcactcgtctggtctggtctgattccaagattccctggcccatggtaaaacaagcgtccccttggccctcgaaaaaagatggtctccccgattttcatgttctccaaatactgagtcatcttcccaccttcaggatattgggggtgtacatttttgaagtagatctttataattaggtccacaaagcctctgtcatcatcactggagacaggggtgtaagccctgaccaccaattcattatcgatttttgccaagagctggacatagttacctacaggaagccctaagacatggtccggcgaaggcagtccaaagcggaacctccgggtgttgtggctgattttctctttctcaatcaagggcagcgggtacttggcttcagggtcctgtaaggtgattggctctctcctcctggagttcatgctcttcaggaccaacacgagcacagtgaccccagtgacggtgatggtcaggagcagggacgggtccctacaaggccgccctgctcctctcccaactcaagcccgacagggaaagttgcctctcctcccgccgggtcactggagtctcagccttccggaatccgagccggcccgccccgctccccgcccttcgcggtcccgcccacgacctctccccacgcctcccgctccggcccccacctccgct

SEQ ID NO: 579032 - DNA, 359 bp, Homo sapiens
ccatgtatcccatcatctcacagtcctcccttaacattcgggggttacaattcagcatgagatttgggtggggacatggtagccgaaaccatatcaccaaagctcatgtgacttttcagtattaagctgttacaatgaattgctcaatcttgcagaatatcctattttgtctttgcatctatgcagcctccgaaatactatgcactttatacagggcatgtctagaacaagcactccagtcttgtacctcggaatcctagccacaccagaggaatgtccttcaaaggttccacgttttgtcattgcatcgattaaaaaggtttctccgtatgctctggaggtactccccatgagtgtcc

SEQ ID NO: 579033 - DNA, 853 bp, Homo sapiens
  misc_feature (301)..(301): n is a, c, g, or t
gatagatttgagaccctggaacctgaagtatctcatgaagaaaccgagcatagttaccacgtggaagagacagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagaancaaatagaaaaacagatgatccagaacaaaaagccaaaatgttacagaaagacgaacgcctaagacttttacacataacacttctgatcaagactattaacagctgaacttgatgctgcagaaaaactccgtaacacagggcgaacaaattgacggcaacgcagtgaactgcatctaaagaactagtacgcaaataccctcagagtccacgatgcaagatatgggaaggcgcaacctgctgagcgcatgactttgcgcctgacaacgcaggcagaacgtaatgaggtgctacgtggagccatcgagaactaacaagaggtggccatgcctaccttgatgtccctgcaagaactgcctgaagcctgagctttgacagcgtcgctcacgacagggcaaccaattatctaggtcataatgacgagggttcccctgacttacccctgacacgagattcaggttcaactaatttcccacatgactacgttcctttcacacaactgaacctttgggcgtggagcactaccatactatgcattaaggacgactacatga

SEQ ID NO: 579034 - DNA, 1098 bp, Homo sapiens
agactaaagccaattttccgtgcaagaaggctcaagaaccacacaagcaagcattgtgctaaggctggcaatgtgtttgcagcctcaactgcgagatccaagcaggatgctggcccattaagcagcatgcaagcaattttgcaacctgggcaggagcatcaagcaagcagaaagggccaagtgatccagttctacacactttgggatatttttcttcaattttcgaagagaacaatggtgaagccatagcacacagttacccgagggcacaaatacaatacagtgatattcttacccaaaaaaaacacccagaaaggaccacaataacaaccaacactgtgattggacggcacgcatattagtacacccctagaaagaaaagcttttttagcaaagccacaacctgtccgatatgggaaggcggaggacgaccaaaaacgagggtacaaactagcaaacagctgtctactaaccgcagatgatacacctcaatacagacacacccgcggggatcaaacaagcataacgtgcgaggaggagaacaaacgaaaagacatagaacaacacaccgcacggagggcgaaaacacagaaaacgaagtatcactgaaaaaaaacctaccccgaaagaaagaggccaaccaaagaggagaacacaaaacgggaggcgaaaacatacaaaaaccgagggcatctaccacacaccggagagcgacgacagggaaacacacaacaacgaccccccagaacgcgggaaacaaaaaacagaaaagaccaaccgcagcaccaacaacacaccaacacagcacaaaacagaagcaaaacagaaagaagcaacaacaagaaaaacagacaacaagagaaagggacaaaacggaacaaaaaaaaaaaccagaactagatggccgccagacgaacaacaagatacacaccacaacaacacaaaagcacagccaggagacaacaaaagagacgaaagcataaccagagtagagcactaatatgaaaacacaaaagccagaaagaaaagcacaaacaggtatagtaatcaacaacagcagaataatgaacaaacgagaatagacggagggacaaacag

SEQ ID NO: 579035 - DNA, 263 bp, Homo sapiens
gaatcaattcagtcatttttgccgcaccaacatggtttgactccccctgacttcttcatctgtcctgcctcctttcgttgctttcttgaggtctttttcttctcatacaggccatgttcttgcaagtctatgtttgggttcatttatctttgcataatccaggcaatcataaatcatgccaaagccagttgtctagcccaccaccaaaattagttctgaatccaaatacaaatatggcacatactgttggaaatggctgagga

SEQ ID NO: 579036 - DNA, 103 bp, Homo sapiens
tatggattgaattaataagtgttagtcatgatagcttgttcatgtgtgcgagatagtagtagtggttgtggtgctggagttaaatgttgagtagtaggaatgc

SEQ ID NO: 579037 - DNA, 410 bp, Homo sapiens
cggagagggtataaacgttgtctattatgtatcaactgaaaaattttattcaaaaaaaagtttttgaagactcatgtggctgcagatgttttcacattaggaataaagcttttacaggaccacctgtctccagctggctcccagggaccactgaaaacagctggctaccctcagaaagacaagatggtcttgttaataatttcaatggactctcgaagctcatcctccttggtcaccagcggaggcgcaaacctgataatgtcgccatgggttggcttggccagaagtccattatctcgaagtcgtagacacaccttccaagcatcccaatctttggtttctttaatgacaatagcgtttaataatcctcttcctcttacggcaggtacaacatcagaaggtagcttcat

SEQ ID NO: 579038 - DNA, 207 bp, Homo sapiens
aaaaaccccccccggggggggggcccccccccgcctttttttttcccggggggggggccccccccggcccttttttttttcccccggggggaaagggggtttttgttgggggattgggggcccggttttgggggggggggaaaaatttttttttttttcccccccgggcccccttttgctttttttttggggggggggggggtttca

SEQ ID NO: 579039 - DNA, 201 bp, Homo sapiens
gtcgactaccgccagaagctcacactgggtgtgagggggcctgaactcgcgctagggcaggtcatcgcacatatgctcagcgctataccgactggaggtaggctgagcctcacatgtcaacagggccacggaacgcaggaggcaagcgtgaaagctgcggcacaggatcagtggaagcttctggaccttgctcagagtcga

SEQ ID NO: 579040 - DNA, 203 bp, Homo sapiens
  misc_feature (40)..(40): n is a, c, g, or t
  misc_feature (159)..(159): n is a, c, g, or t
ccaaaagtagttgaacccacaaagttgggaaaaaaacagnggagaaaaagcagagcacctctcctcctcaaaaggattgcagttcctcaccagcaatggaacaaagttggacagagaatgactttgacgagttgagagaagaaggcttcaggcgatcanactacgagctacaggaggaaattcaaaccaaaggcaaagaagtt

SEQ ID NO: 579041 - DNA, 283 bp, Homo sapiens
tagtccctttgaaatcatatatggccaaacttctgtcttggggtctccacccttaccagactctgagccactcagatattacctcccctgcttaatccagacatggactcccattcgcgaagcagcaaataaggccgtgcctcgccctggtaacaccttattgtcctgtgaacgtaacggccgtacaggacacagaccgcgtttccagcacaaatccaacatgtaagcatcatggctacaagggaacatgagcctcaagtgcccagaggcctcaaagggccca

SEQ ID NO: 579042 - DNA, 369 bp, Homo sapiens
ctcgttgtatgtgggcgttgggtctgggaagcataggcatcagaggaaagcaagagcagtggatctgagaggagaggagttctgaggggccgtgagcctgagaggggctgagatgtgtgtctgagaatagatgacatggagaggatggtctgagcgggcacgggaggagatacggatgctggtacgatgcgggcctgagagtcagaatccagaaacaggaatgagactgcgcggtgtggtggcgcaggttacattccctgccccatagggttgatgggatatctgttattctgtgagagacagcttcgacttgagtatatgagagtgtagggggagtcagatctacgcacagagagcgggtcgggatac

SEQ ID NO: 579043 - DNA, 443 bp, Homo sapiens
gttacaattatcgacaacatcaggtgccccagaactgggcccaaaacacgtgccataattaccggcggcccctctccacggaatccacactacaaccaaacggtaacactcgacactccctccacacaacccactattacatactttcctacctccactccttggccgggcaggtccaaccgttcagcccttcggtgccggcctgaatgcatacctttccttcaaatccccattgggctgtggttgcctctatgaagtcttcccctaatttcctacaaatctctcccctccggtactgacactgcagctattagtccttaatctttatttctggtctctttcttcttttttttctgggatggagtttggctctcaaaggctgagtgcagtggcacgcatctggctcactgcaatctccgcctcccaggtttaagcgattctcc

SEQ ID NO: 579044 - DNA, 150 bp, Homo sapiens
caccgcggctccttaacccgaagtgcagtcgacgatctaatttcattacaaatagactttgctatttctattccgtgagatcagtctaaaagcatgagctcaggttaactgggcattttgtagggcgggttaaattctggaggcggtaac

SEQ ID NO: 579045 - DNA, 146 bp, Homo sapiens
ggccgtaagctctcactgctcgcctcacgggcggctccacttgcgctggtgatctgagccgcggtgtccgccgcggtcatgagctcaggtccgtcgctcaggcgatgtaatccttgccgtctaggctaactggttatacccgcgga

SEQ ID NO: 579046 - DNA, 160 bp, Homo sapiens
aactggggaagaacccagacgttgaccacaagcttcttgcctgatcgagaccgtgaggaggccgcagaatccggcttcgggaagcagctgccgcaccggagtgcggcaagccacagccaggagcccgcatcacgactgacgacgatcgagatcagccttc

SEQ ID NO: 579047 - DNA, 594 bp, Homo sapiens
ggggtagactctaagccatcactagttaccattgagaaagattttctggtttcttttctccaatcaaaataagatcataggattgatttattctttttcttaattgcataatcttactgaagcatgtcatattatttaaaatctcagaattagagttttattcctcagtataatagtaatattttactagaattagaatttaattttgggaatttgatcattcccaaaatattttcatgtgcattattttatttccaatgttagctttatgaggaaaatagattgtattctcttattttgtgtaatgctttcaggatatatattaatttattaatccacacaactgtttgagaagtctaacttacagatgagaaggaagcaaaaatagaaacgatgtaaagtagattaagttttaaaagggtgtgagtattgtgatgatatagcaggcaatgtcatggtacatccatttcaagaaagtacagctgaactttactcaggctgggaattgggaactagaaagttaggaactcaagtcacatattccctttaaaccctctccagaatctcctttttttgacgggttatctgcaactc

SEQ ID NO: 579048 - DNA, 138 bp, Homo sapiens
tggagtagtcatgcgtgcctcggtactgcatctcgctctggttagtgattcctgctcagctcagagagctggactacaggtatgtgccaacacacctggtaatggtcttatttttaagaagaaacgggaattccgcca

SEQ ID NO: 579049 - DNA, 376 bp, Homo sapiens
  misc_feature (279)..(279): n is a, c, g, or t
  misc_feature (323)..(323): n is a, c, g, or t
  misc_feature (342)..(342): n is a, c, g, or t
  misc_feature (371)..(371): n is a, c, g, or t
ttttgagacggattagcgtctgtcgcccaggctggagtgcagtggcgggatctcggctcactgcaagctccgcctcccgggctcacgccattctcctgcctcagcctcccaagtagctgggactacaggcgcccgcactacgcccggctaattttttgtatttttagtagagacggggtttcaccgttttagccgggatggtctcgatctcctgaccttaagttatccgcctgcctcggcctcccaaagtgctgggattacaggtctgagccacaccgngtcccatctgggaatttagatccaagcccagggagccagtgctncagcccacactgggctggngttgcgtgaaatgagtgaatggccagggncaggg

SEQ ID NO: 579050 - DNA, 265 bp, Homo sapiens
tcctgaagaatgggctgcccttacatattaattatatacttattcatgacagcacgcaacaattaaccatcaattaggcatatcatagtttacagtcgctacaaaaatcttataaataatcacaaagccattatccagatgttgccatagaaacagagactgtaaattctaggtagctgagatcctttctgaaacccatgttaagtcaatagaaatataatgcagggcattacactaagtttctggatctagtacactaaaaaga

SEQ ID NO: 579051 - DNA, 868 bp, Homo sapiens
  misc_feature (5)..(5): n is a, c, g, or t
  misc_feature (11)..(11): n is a, c, g, or t
  misc_feature (121)..(121): n is a, c, g, or t
  misc_feature (205)..(205): n is a, c, g, or t
  misc_feature (222)..(222): n is a, c, g, or t
  misc_feature (240)..(240): n is a, c, g, or t
  misc_feature (242)..(242): n is a, c, g, or t
  misc_feature (247)..(247): n is a, c, g, or t
  misc_feature (259)..(259): n is a, c, g, or t
  misc_feature (275)..(275): n is a, c, g, or t
  misc_feature (303)..(303): n is a, c, g, or t
  misc_feature (327)..(327): n is a, c, g, or t
  misc_feature (331)..(331): n is a, c, g, or t
  misc_feature (333)..(334): n is a, c, g, or t
  misc_feature (339)..(339): n is a, c, g, or t
  misc_feature (350)..(351): n is a, c, g, or t
  misc_feature (357)..(357): n is a, c, g, or t
  misc_feature (361)..(361): n is a, c, g, or t
  misc_feature (366)..(366): n is a, c, g, or t
  misc_feature (382)..(382): n is a, c, g, or t
  misc_feature (397)..(397): n is a, c, g, or t
  misc_feature (402)..(402): n is a, c, g, or t
  misc_feature (411)..(411): n is a, c, g, or t
  misc_feature (415)..(415): n is a, c, g, or t
  misc_feature (423)..(423): n is a, c, g, or t
  misc_feature (425)..(425): n is a, c, g, or t
  misc_feature (435)..(435): n is a, c, g, or t
  misc_feature (445)..(445): n is a, c, g, or t
  misc_feature (462)..(462): n is a, c, g, or t
  misc_feature (518)..(519): n is a, c, g, or t
  misc_feature (537)..(537): n is a, c, g, or t
  misc_feature (545)..(545): n is a, c, g, or t
  misc_feature (865)..(865): n is a, c, g, or t
gagtntcaggnatatggaccaaagccatgtaagtgtcaacaacctaaaaaagccttcagataccgcccctcctttagaacacaagaaagggatcacactggagagaaacccaatgcttgtnaagtatgtggaaaaacctttatttcccattcaagtgttcgaagacacatggtaatgcacagtggggatggaccttataaatgtnagttttgtgggaaagcnttccattgtctcagattntntcttntccatgataganttcacactggagaganaccatgtgaatgttaacagtgtggtaanattttctgctacccatcgaatacntaananntctcncactggagatnngccttntgantatcnggtgtgtgggatagcntttcatagtcccagntcctntcgtagacntganaggtttcncntgggagattnggcttttcantgttaggtatgtggaanagcattcacgtgtccccgttatgttcgtttacttgttagggcccactctaggaaanntctctatgattgttagcngtgtgggntagcattttcctctcttacaagttttcatacacacgttagattgctctctggagaaagaccttatgaatgtaagatatgtggaaaagacttttgttctgtgaattcatttcaaagacatgaaaaaattcacagtggagagaaaccctataaatgtaagcagtgtggtaaagccttccctcattccagttcccttcgatatcatgaaaggactcacactggagagaaaccctatgagtgtaagcaatgtgggaaagccttcagatctgcctcacaccttcgagtgcatggtaggactcacactggagagaaaccgtatgantgt

SEQ ID NO: 579052 - DNA, 914 bp, Homo sapiens
tcacagacgtgtggggcggcgggtgcgggaggcgttgctgcagtgcgtcgtgaccagcacgcgtctgcgatggtctcctgccgccgtcttgtgccccttctgcgactatattgatgtcggccacaagcggatcccctctcgtggtgcccatcggccagtggtccaaggcttcttccgcctttcgatgtctcgcgtctttgtcgcccttgcaggttcctgttgttgctccactagccctcaggcccctgtctgtccgactctcccgcgccccgttcctgttgaatcccgtttcgcagtcgtctggcggtatagccgcttggtggttaatccctgcccccccgtttctcgtgttgtgttgtgcgcggcctccctagtggtgtcgctccttttcaaatccgagcgggggcttcgggagccccccctgcctctccgaaactcaaggcgccccccgagggcctggaccctatggatcatcccggttctcgcggcggaattttttcgaatccgcccaacaagttgcctcccccgtacttctcttaggtccccccgtggcgccacttggtggacccccttgcagggtgcaccgcacccggggtgtacctccccgtcctcgcccccccactttaaaatactaccgccccgaaactcttgcaccactaggacgttccccacccatgtagccttcaacacagaatctcatttcccgagctgtctacaacaggacaccattacccccctaacacccaccccggggttaaaaacccgcccaactactttcgctattctctgcggagccaaaccaccaccgtttcactgacccccctcgctccatgaaatgattcccccctacaaaatttttaaaaggggcccctttttccccttacccccccctcaccccccttggggaaaaaaac

SEQ ID NO: 579053 - DNA, 238 bp, Homo sapiens
  misc_feature (12)..(12): n is a, c, g, or t
  misc_feature (202)..(202): n is a, c, g, or t
ctcccccacggnatctgacgaccggggtggggacggggacggacgacgactgacgtggctctactgctacctcttacgcggttcctttctctgccctttggggtaccccgacgacccgacccctacggacacggacacttctgcacgaccacgtcttgtgacacgcacccttttcacacggaccaccttgggtacccgacgnctcgacacttcgtacactccttgggtcctacgcgtg

SEQ ID NO: 579054 - DNA, 121 bp, Homo sapiens
caaaaagacccccaaaaaaaaaaaaccccccccaaaagagaaaaaaaagggaaggcccccccggggggggggccccttaaaaaaaagggaacccccggggggggggaaagggggcggggga

SEQ ID NO: 579055 - DNA, 121 bp, Homo sapiens
ctgcccacctgcatggcaagcattctgatggcacatggcccatgcagcccccatgcagtgcccccagcacactcatcttcttctggtctgttgcaactcaacaggcctgcacccacagcat

SEQ ID NO: 579056 - DNA, 134 bp, Homo sapiens
ccccattgctctaacaacctcttaattatttacagactcagaagatgctttttcaaagttgcattttctctgaagccacatgcattctttgcacaggcctcagaagtcttctaatgagactgcttctttttgtg

SEQ ID NO: 579057 - DNA, 553 bp, Homo sapiens
  misc_feature (81)..(81): n is a, c, g, or t
  misc_feature (100)..(100): n is a, c, g, or t
  misc_feature (114)..(114): n is a, c, g, or t
  misc_feature (388)..(388): n is a, c, g, or t
actctagagatccccaaagctctacttatgtgtaccagatggtctgtgctgtgaacacgggggatgagatgggcatgcttncatacaaatgtcaggtggncagtagagctctgnaaatcccagctcttaagattatatcagcgagacaagcactacactgtgccaaacactcttccaggcttgctctgtcggcgctgacctcaatggacaggccgtctatgcggcttgtcagaccatcttgaaaaggctggaaccctacaagaagaagaaatccagtggctcctgggaagactgggtcacagccgcctacatggacacagtgagcttgtctgccactgggttttatagaacacccaatctgggctacagctttgagactaactcaggnaacccccttcactacttcagctatggggtggcttgctctgaagtagaaatcgactggctaacaggagatcaaaagaacctccgcacagatattgtcatggatgttggctccagtctaaaccctgccattgatattggacaggtggaaggcgcatttgtccaggcc

SEQ ID NO: 579058 - DNA, 203 bp, Homo sapiens
agaaaagacatatagtatttacttcaagagtctaagagtggcagtgaggggatagcaccaggagatatcagctgtgagggctggagaaacagtgtaaaccggggagtgtaaacaagagcagggcatgtagttcagaatggtgaataggagtatgactagacaaaagatagtagggatgacaagtttttttggggcacagtcta

SEQ ID NO: 579059 - DNA, 297 bp, Homo sapiens
gagacaaggtttcactcccattgcccaggctgaagtgcaatgtgctatctcagctcactgcaacctccgcctctttgctcaagcgatctcctgcctgggaatacaagcatacgccaccacattcagccaattttcataaagacggggttttgccatgttgcccagactagtcttgaactcctgagctcaagtgatctgcccgcctcagtctcccaaagtgctgggattacaagggtgagccaccgcgcctggcctaaaagctgcattttctttctttctggtttttgagacagagtc

SEQ ID NO: 579060 - DNA, 157 bp, Homo sapiens
tccgcaccgtaagttctgtgtgtgggacctgcagaccagaagcactgtgactaggctatgtccgcagtatcccccacatgcacatcgaggggctgaaaaatctaacaagaataaaaacttgtcaagaagctggccaagaagtatgatgcgtttttgc

SEQ ID NO: 579061 - DNA, 262 bp, Homo sapiens
aggtgaaaggatctcgcttggctgggagggtaggctgcagtgacccgtgatggcaccactgcgctccagcctggcgaaagagcgagactctgtctcaaaaaaaaaaaaaaatttgagagacgcaaattatttgctggaagagggaaagggaactggttaggggagaatggattctaaattcttgaaggccaaacagatcgagaaagaaagagacagagaaaaaaattgaggttgagggtaggcaggaggacaaacaaaatgg

SEQ ID NO: 579062 - DNA, 285 bp, Homo sapiens
cgtgcttgaagaatactccaacacccgggaaagggaaaagcacaactacaatcgggctagtgcaagcgcttggtggcccatctctaccagaatgtctgtgcgtgtgtgcgacagccttctcagggccccacctgtggaataaaaggtactagtgagactggaccatgggtggtgacaggggacctgcttctccttcagtcctcccaggcccacgcaacctatgatacttatggggtcttcaactcatttcaacaccaggaatgtcattctcacaaacctctgtag

SEQ ID NO: 579063 - DNA, 468 bp, Homo sapiens
attatttacattcatcccacgtgcagaatacactcaccccctcctattattctgcagaattctcatttatagcatcagcttacagtccaggatattgtcatctaaattaggtccagttttggatgaggctcctcagatgtatgtagtttcttcagctccttgagtacattacttctctatgtgaagacctgtgaaactaaagaggcaaattgtttgccccacacataaccaagatgcaatgattggtcaggtgtatgataactagtgtagacattcttgttcaaacagagggaaaatgttggtacaaaggtgtcgttacgtcacaccatttttgaaattcagctgggcacaggttggtaattccttgattaaaatacaggtctggaaataattcattatggctcttagctcgtccttctgggcttttgtttccacaacaagaacaaaactccatctcaaaaaaaaaaa

SEQ ID NO: 579064 - DNA, 176 bp, Homo sapiens
tggggcgagtgttgggggtaaaagcccccccccccaaaaagtggaacagcccggagccttatgtgaaaggaccccgggtgttgtaaactgggacccggaagccaaactggaatcaaacgccgcctgtaaattgtatcttataacttattaaataaaacctttgccccgtaaaaaaa

SEQ ID NO: 579065 - DNA, 181 bp, Homo sapiens
agctgcagttgtctgtgagcctgagatctgcgccattgcactccaacttgttgcaacaagagcaaaactctgtctccaaaaacaaatggaccatgtgatcctctctccctttatggagccaaaattcaaccgatttcatttccctaaatctattcgacacttaaagcgggtgattagcatc

SEQ ID NO: 579066 - DNA, 993 bp, Homo sapiens
gattaactgggcatcatggtgggcaccgtgggatctcagctacttgggaggctgaggcgggagaatcgcttgagcacaggaggcggaagttgcagtgagcagggatcatgccattgcactccagcctggagaggagcgaaactctgtctcagaaagtatgaatattatatacagaataaaagaaaattacaagcaagagaagtacacacaaaacaaaccaaaaaacacgtaagaagccacatcataaccaaatgcctcaaaagcagtgacaagtataaaatgccaaaagcagccaatgaatcaaggcacattactttcggaaaaacagatatgaaaattactgcgtacttctaactaatcaaaaaattttcaagccaaatgcagtggaatgacatgtttgaagtgctaaatgaaaacaacaaattttgtttgcgtgttagcttttgagacgggatcttgctctatagcccaggctggagtgcagtggtgcaaccatagctcactgcagcttcatagtctcagcctcaggtgatcctcccgaattaccctcccaggtagatggaactctgcaggtgtgcaccatcatgacctggataattgaaagtagttaaggaagacaggagtctcgctattattgacagggcttatttagaactcctgggcatcatgtactctgtccatctcggctcccaaagtgcttgtataacaggcatgaaacagcataaccaagcaataagaagtactacatataggaagaaacagagagtgataaaaaaaaaataagacacagggtagataagaatcgtgaaccacaaagaggggaaaggaagcggggagcaacaagtgggatgcaaggaaacatgaggacgcgaaggagaacaaagagatacacccgaaagtaagagacacggggaaaagagaaaacaagggaatcgcaacaggcacaaacagataggaagaagggaaaaaaggaatacggaagaggcaaagaaa

SEQ ID NO: 579067 - DNA, 209 bp, Homo sapiens
gtggaaggtggaaggaagatggaaggcggaatgcggaaggcggaaggtggaaggtggaaggtcaaaggtggaagaaggtggaaggtggaaggtggaagaaggtcgaaggcggaaggtggaaggtggaaggaaagtggaaggtggaaggtggaagattggaaggaaggaaggaagattggaaggaaggaaggaaggaggaaggaaggaag

SEQ ID NO: 579068 - DNA, 416 bp, Homo sapiens
gcttctgcgggtcgcgtgtcggtgaccagcctgatcccactgatcatatgatctaactgctgacaactctgtcgaactgccatcaagacctgattgtgctacagcatgagtatgcagatgtgtgcataacgctcattgtgcaatctatcacgcgggctgagcagcatgatcctcagtgtccagcaatatggctcacacctagtggcagactctagcctggacaaggagcattataacgatgcacaacacctgcgtgactggtacaggacctacgcgaacagtatcgagcttgggtctcttgtcgcgtctggcatcattacacctatccatgaacatggtgaagaggctaatgtatgcagtcgctaccgcgagtcgctctgctaccaccatagaggtggactcactccagatgactc

SEQ ID NO: 579069 - DNA, 317 bp, Homo sapiens
  misc_feature (15)..(15): n is a, c, g, or t
  misc_feature (28)..(28): n is a, c, g, or t
  misc_feature (47)..(47): n is a, c, g, or t
  misc_feature (212)..(212): n is a, c, g, or t
  misc_feature (217)..(217): n is a, c, g, or t
  misc_feature (270)..(270): n is a, c, g, or t
aggtgagcacgattngtgaccccagggnccacgcggaaaacacccgntcagcctgaggactttcatgaacaagtcggaccagtcctacaccgtgacacccgataccgccgccaccttacgagtggacctcactgacgcagctgcagcgcgtggagatgtcgcgtgtgcgtcgcatattgggctgcgtcacgagaccaatcaggatgccgcancgctnggtatcgacgggtcaggacatcacgttgtccttgtcgtcgctgatggcgtgtnctcgactgagggagccgaggaatgcgccagggtcgcctcccacactg

SEQ ID NO: 579070 - DNA, 306 bp, Homo sapiens
cgcgatcgggttttttattattattattttgtcaatctctttggcttcagctggatggggggggcttggatcactgcaacctccgctctgggttcaagcgtcatgcctacctcaacactgggattacaggctccaccacacccactaattttttgtaaaagggtttgctgtgccaactggggggaactctgattaatgatccaccgctggctcaagtgctggaacaggtgtgagccacggcctggcaatatttaaatatctgtttgaattggataattcgaaacacaggagacgggcacccagtgc

SEQ ID NO: 579071 - DNA, 433 bp, Homo sapiens
  misc_feature (56)..(56): n is a, c, g, or t
  misc_feature (136)..(136): n is a, c, g, or t
  misc_feature (162)..(162): n is a, c, g, or t
  misc_feature (226)..(226): n is a, c, g, or t
  misc_feature (254)..(254): n is a, c, g, or t
  misc_feature (258)..(258): n is a, c, g, or t
  misc_feature (268)..(268): n is a, c, g, or t
  misc_feature (280)..(280): n is a, c, g, or t
  misc_feature (285)..(285): n is a, c, g, or t
  misc_feature (291)..(291): n is a, c, g, or t
gcgcgcgcggtgacgtgtataatggtaaccaggagattaagaaggaaaggtagggnaagggtgccgtgaaaggttctccctgagacccccaggagaggtgggggccggcttgcctgttaatttaatattaaattgnggatgggaatcgagaggaaaaagttnttcaggggatgatttctcagcctctcagcctgtacaagagaggctgagggcccggggccctcancagtcatagcggcgggactgtcgggaangggnagtcctcagntccctggatggncaggnggggangcccctccgccgcttcgtcccccacgcccctgagcgactcaaagccgccgacaactccaggggcacgctgctgccggacatcgggaggtctccacgacgacaatcgtcatcaaacgctgcggactcactctcatcacaggta

SEQ ID NO: 579072 - DNA, 715 bp, Homo sapiens
cggtggcggcgcatagctactgtataacatactattatacgaatctgatagatccaggcacagaatcgagtcgagacgccgcaagtccgtctgaggagctggctctagtagaatcgggatagctgtatttctttcactaggcattttacgtgacagcacggcaaaggggaacgagcccccttatataccagtcgatatctcgtgagaactgtgccgctctctattaacagtggactgtctcctgtccatctccttccccagtccctccctcacgtggatatgattacaatttgaaatgagatttgggtggggaacagagccaacatcatatcattcgcacccgtgggcccctcccaatatcacatgtcctttttacatttcaaaaccaaatcatgccttcgacaacagtccctccagagtcgttaactcattccagcattaacccaaaagtccaaagttcaaaagtctcatccaagacaaggccaagtcccttctgcctgtgagcctgtaacattaaaagcaagttagtgacttccaagatacaatgggagtacagacattggtaaatgttcccattccaacatgggagaaattggcaaaacacaggggctacaggccccatgcaccactgcactccactgtgcaagtctgaaacccggcagggcactccttaaatatcgtttcttacgtcggaaatggagtctcgtctgttgcc

SEQ ID NO: 579073 - DNA, 152 bp, Homo sapiens
cttagaggatcccagcggctgcctttttttggctacgtctggatgccttggcttcacacaatgaaccacctctcccgcagttcccaatggacttgtcatttcatgttcttattttatgacctgttttgtaaataaatgctgtttcccaatgg

SEQ ID NO: 579074 - DNA, 912 bp, Homo sapiens
gggcccgccttgggggccggtctacgtccctgttctcgctgagtccgcaatggtcctaaaggcagctccaaacagcagtctgaggaggacctgctcctgagaattcagccgaaattctctcggccagtgtcctcgggggctcttcttgccgaaaggcgtcaatggtgtcttgccatcccaattgtgttatacgtgggaatatgggcatattggatcttatacagtcgtggctgttttgtataggtgtgatggacccctagttaaggcaacatatttggggtaggcctttgaataacaagatttgtgaaaattgggttctcaagcacaaaacagaagagggagggatgtgtttccaaaagaaggtgattcgaaaaaatttctgaagactgataatagaaaagattgtctcgagaggggggacagggatgaaagatctttgtggaaaagaagaatgaggtgggttgattatagaagctaacgaacatttcccattctttttataacaaaactttctgttacccggtcgtggtcatgtgtggtcccttcttccatatggaagaatttcaagcccaagagtgtattccttaacgcgggtgactcatcttttgagaagtcaagaaacgcgtcgtccatttgtggttgtgactggtcggatatttagggaaggaaaaactggtcgtggagttcgctcaataagtagtgtgatttagatactttgctgggctttaaatacagtatggtaagatcttaagttagaagtagtcgtgactaggttcaaagtgtcttttaaaaagaaaaaaaatgttgggcggccgccgaagttataacttggggggcggcaattataagggtgcgtttcagacgcgcgtggggtccaaagcggcgggtaaattgggcggttaaacacaccgg

SEQ ID NO: 579075 - DNA, 1078 bp, Homo sapiens
gggacgccgtcgaagaagcatcgttaaaggtctctcttcaccctgccgtcatgtctaatgtcagagtctcctaagagagcccgaacagcgtgaggaagctcttcattgtgcagggttgagctgttgaaacaactgatgagagcctgaggagccatctcttgagcaatggggaacgctcacggactgtgtggtactgagagatccaaacaccaatgcgctccaggggctttgggttggtcacatatgccacttgtggaggaggtggatgcagctatgaattgcaatggtcatcacaaggctggatggaagagttgctggaaccgaatagacgctgtctccagagaagatttctcagaagaccaggtgcccagcttaactgtgatacatcacgatatttgtctggtggcattgatagacgaaaggacgacgtgtacatgatacatcgagactatagaggattgatttttgtagacagttatggtagagagagaattgaagtgaattgagaatctagtgactgtagccgatggcacgcttggcagagaaaaggtggcttctgggcttcttgttaagcttttgtaccagagcccactggacgttcccgtgggcactgaagagtttgtcccacttacacgacatagtagcccattacccttgttgaaaatgtgccccatcacactggtgtaaagttaaggaagaaaggcccctgttcaaaaagcgaagaagggattgggctagttgctttcaatcctagcccaaggggcaggtctgaacgtcggttcctgtaggacctttgtggtaggttgtgcccgtgggcagggtgggttcccgtggctgggaattgagcaattttcagggtctgtcgtgaggaacaacttccacgttgggtcgcggtgggtgcggcttttggggatgggcatagcccaggtggttgggtggtgtgattatttgttggcatgctagggcagttaggtacttacttggcatttagggtaatccgatataggaaaggcatgtgatcgcaaaggtggagataaacgtaataattggattgtggggaaattacacacaaaatcag

SEQ ID NO: 579076 - DNA, 790 bp, Homo sapiens
  misc_feature (56)..(56): n is a, c, g, or t
  misc_feature (114)..(114): n is a, c, g, or t
  misc_feature (116)..(116): n is a, c, g, or t
  misc_feature (133)..(133): n is a, c, g, or t
  misc_feature (144)..(144): n is a, c, g, or t
  misc_feature (171)..(171): n is a, c, g, or t
  misc_feature (186)..(186): n is a, c, g, or t
  misc_feature (188)..(188): n is a, c, g, or t
  misc_feature (212)..(212): n is a, c, g, or t
  misc_feature (223)..(223): n is a, c, g, or t
  misc_feature (233)..(233): n is a, c, g, or t
  misc_feature (235)..(235): n is a, c, g, or t
  misc_feature (238)..(238): n is a, c, g, or t
  misc_feature (245)..(245): n is a, c, g, or t
  misc_feature (251)..(251): n is a, c, g, or t
  misc_feature (253)..(253): n is a, c, g, or t
  misc_feature (258)..(258): n is a, c, g, or t
  misc_feature (263)..(263): n is a, c, g, or t
  misc_feature (268)..(268): n is a, c, g, or t
  misc_feature (272)..(272): n is a, c, g, or t
  misc_feature (274)..(275): n is a, c, g, or t
  misc_feature (277)..(277): n is a, c, g, or t
  misc_feature (280)..(280): n is a, c, g, or t
  misc_feature (283)..(283): n is a, c, g, or t
  misc_feature (291)..(291): n is a, c, g, or t
  misc_feature (298)..(298): n is a, c, g, or t
  misc_feature (309)..(309): n is a, c, g, or t
  misc_feature (313)..(314): n is a, c, g, or t
  misc_feature (316)..(316): n is a, c, g, or t
  misc_feature (323)..(323): n is a, c, g, or t
  misc_feature (333)..(333): n is a, c, g, or t
  misc_feature (342)..(342): n is a, c, g, or t
  misc_feature (355)..(355): n is a, c, g, or t
  misc_feature (360)..(362): n is a, c, g, or t
  misc_feature (368)..(368): n is a, c, g, or t
  misc_feature (371)..(372): n is a, c, g, or t
  misc_feature (385)..(385): n is a, c, g, or t
  misc_feature (389)..(389): n is a, c, g, or t
  misc_feature (393)..(393): n is a, c, g, or t
  misc_feature (437)..(437): n is a, c, g, or t
  misc_feature (466)..(466): n is a, c, g, or t
  misc_feature (470)..(470): n is a, c, g, or t
  misc_feature (485)..(485): n is a, c, g, or t
  misc_feature (494)..(494): n is a, c, g, or t
  misc_feature (497)..(497): n is a, c, g, or t
  misc_feature (500)..(500): n is a, c, g, or t
  misc_feature (507)..(507): n is a, c, g, or t
  misc_feature (525)..(525): n is a, c, g, or t
  misc_feature (563)..(563): n is a, c, g, or t
  misc_feature (567)..(567): n is a, c, g, or t
  misc_feature (771)..(771): n is a, c, g, or t
tcagagaaagaaaaaagaaactttccatcatactagaagaaacttggccgtaaggnttgggatctgtgctcaaactacacatgcaatgaggacaatattctgctaatacaattnanttgctgctgcatttgtntactgtttgtntaatattaacaattataaacagagcantgcaactagtatttngnacaatccttacagtgttattagtntcaggtacaanattttatttntnttnacaccantggttntntttgngtacntgggntttntnntnttnatnttaagttnttttttntatttaaggtnttgnnanttttctnaggagttttncccttgatnatattggcaatanttttnnntgttanatnnagcaaacctttgntgtntaantagtttgcagccagaatgagttcaaaaagtgttccttggtcaantttcaggaattcttggtcccaaacagggntatnatctgttcgcttttntttgttctnatnatnttcaggnggaggagggttatccttntggtgggtgcaccactgaatgaccttttttaatattgntgtnttcacatttggtagaggaattgggtcatcatctccttcatcatccattcccaaatcttccaacatggtcttaatagtcacagattgtttggcaatttccacatcaacttcaaatatctctccatcagaactctgcaacttaattgaaggcatggtgttcggtgttaaggagacggccggcgggaggctgacgagagccgggagngttacgaaggaagagaaaa

SEQ ID NO: 579077 - DNA, 958 bp, Homo sapiens
gggaggcggcgcggaggccgcggctggggttgagcctgccgtgaggccgcccccgtgcgggctgggccttctggcgtgcgcccctggtttctcctggggggtgatgagctgggagcgtgtctgggccgagctactgcgcacggtgagcccggagctgatcctggatcacgaggtggcttcactgccctgcttcccaggacaggagcccaggtgcaggccggagcccactgaagtcttcactgtcggacccaagaccttttcctggacaccctttcctgcggacctgtggggcccgggccgttcctaccggctgcttcacggggcaggagggcacctggaatcccccagacaggtcccttgcccagccgccccggcacctgatccctgcagtggcacccaagggtggaagcagcagccagtctgtggagggtgacggggccctgagcaagctgacccatgtgccagaaggagttcgaccccagtctttcaatgggatgtgccacgactttgaatgaccctggcacgtcacagggtgagctgtcatccacaggagagccggccacgcaagggatccaatgggcagattgacccatacacgtgcccaacgcaaagccaactgtgcagacccccaagtcaccagaagattcgagaacccagttcccaagcgcacaccgtcgagaaccggagcaattagcacaaaatccgggcattttcaaagccacacttgcatacttccttcagtttgcatgtatacacagcaagttacctgcagtagtaacagacttccccctcgtgatggagccccgcattaactcaccattttgaggtcaagaaagggcacacgtgtaaccggggccgctaggggaaacaggaagaatatcgggacatcaacatcggacacaactaggtccgtgccgagcggtatgcatatgggggtaaggaacagacacgggtcaca

SEQ ID NO: 579078 - DNA, 811 bp, Homo sapiens
  misc_feature (656)..(656): n is a, c, g, or t
  misc_feature (746)..(746): n is a, c, g, or t
  misc_feature (794)..(794): n is a, c, g, or t
  misc_feature (801)..(801): n is a, c, g, or t
gtgcaatgagatctaaatagaaacagcaaaaagtttaaaagcaggggcatgatattaaggcatagagtttttcttagttttctttttccttgtttgttggtttatgtagagttaagttgttatcaggttaaaataatgggttataagatagtattcgcaagcctcatggtaacctcaagccaaaaacaaacaaacaaacaacaacaaaaaaacacatagtggatacacaaaaaataaaaagcaagaaactaaatcatatccccagagaaaatcaccttcactagtggaggataggaaagaaagaaggaagagaagatcacaaaacaaccagaaaacaaataacaaaatggcaggagtaagtccttacttatcaataataacattgaatgtaaatggactaaactctcccgtcaaaagacagagactggctggatgaaaaaacaagacccattgattgttgcctacaagaaacacacttcacctatatagacacacacaggctgaaaataaagggatggaaaaaaatattccatgccagtggaaaccaaaaaagagcgggagtagttatatttacattacatacaatagatttcaagacaaaatctgtaagaggagccaaagaaggtcactacataatgataaaggagtcagttcancaaggtgatgtaacaatgtaaaatatatatgtacccaacactggagcacctagatatataaagggaatattattagacctaaagagagangccttgatacaataatggctggagaactttaaaccccattttcagcanttggacngatcttccca

SEQ ID NO: 579079 - DNA, 996 bp, Homo sapiens
gcaaagcgaggacggacagctcccagagggcgaggggtgcggtgtgcgtccgcttctcacctcaggtctcccttcggccccgctgccctccctcgcggctgggtgacagctgggtccggtccgtcgcgggctgcctggggtgcgaggatcgcgcaccccgtcttcgcgcgctgtgcctgccgcgccgcccctcgtcccgcccgtccgtcgtggtcttttttcctcgggtgctgcacgggtgctgatgccgagtcggtggcagcgaggacattttctgactccctggacccctgacacggcatgcaattctaccatcccgtcgcggggccggacgaatactccggcccaggatgcagaatgtgattaatactgtgaagggaaaggcacctggaagtggctgagtacctgaccccggtcctcaaggaatcaaagtttaaggaaaccaggtgtaattaccccagaacagcacgtggcagctggagatcaccctagtccaccacagtacaaacatggcaaatgggctacaaggggaacgaaatcgacaagtgaaggcatacctaccaacacggacaaacaatttaggacaccccacaaatgtacccgggcaaacagcggagcaacacacgatggcatatcagatgaatgggcacgcctaccagcgacagacgatgatgggagcgccgccggggcatcaaaatacaaccaggcatcaaggaaatcaccggaagcggtgaaaaagacacacggacaactcggacacagaggaaaaaagcacacaaaaggaagacagagacgcaaaaaacaggcgaccgcaaacaagacagaatcacgaacaacgcggcaccaagcagcaagacacaacgcagaacaagaagccggaacacagcaaacgaagaaccacaagagaacaaacgagacgcagaacgagaaccacgagaaaaaacgacaaaaaaaacaaacacagaagcaatgactgaagacacaacaccagacaag

SEQ ID NO: 579080 - DNA, 373 bp, Homo sapiens
gaagtcaccgcgtcggtactgtgccttggctgcggagcggcgccaattcaatttgcccgggtagatcgagcggttggattccggtcatctgcacggttgctgcaggaaatccagcgcgacagcgcgtgataatcctcgtcgacaacgaccgtcatcgcatcgtagcggcaggcgagcgggaagggcagggagaagcgatttttagcgatgctgccgcgcggtttgtcgacgatctcgagtttcgaacaatcaccacgtcattgatgaatttatagaagctttgcaccagcacgaagtccgcgccaattgcgggccagtgcttgagaaagggtggcactcaacaccagaggctgacggcacaggggggaagatg

SEQ ID NO: 579081 - DNA, 279 bp, Homo sapiens
tggctgctctagatgtgatcccattcaacttgcggtgacgcatcacgcctgtccaaagtcagcaaattttttaacattccttaggaatgggcttcgccctgtgccaattttaaaaagtcagacttcttcaggttacctaccatcactgtaggtagaaggatagggaagaccccacatgtaacagttagagaacttacatgataatggtaagcacctggtgtcagcccagtctctacgtccctcctcacagctccctcagcccctgggagtcctcacaca

SEQ ID NO: 579082 - DNA, 1396 bp, Homo sapiens
ggtggtgccactgtggtcgtgactgctgtttagcgtgtgccacgaggccgcccagtccccctcactgcttgagcctacgcactgccacctcttatgtgtgaacacagaaatccatggtttcactaatggatacgctgcgcccgatttgccacaataattgatattgattgtcgcgacctacgatgcactctcctctcctagtggacgtggtgcgtatgtgagtgcgttgcgctggagcgtagagaagtcaccattgggctgcacgtactgccgtactcccttcactcaatgtctcttacctgtattgtctggcgcaatctcctagagttgcctggcccgttgtggcgaagagcgacagcgttcgagggcaagagccgattgggacgtgatgcggcaaaggcatataattgatcgccaaaaagggggtaggacttcaccaatggcaccgcgagatatgagcgaagagggctaatctgtgtcctccggtttgtcccccgcggcataaactgtgcaaagcgtctcggtcctcggcgtggcttcgcgggggcatggcaccgagaacgtagccaggggacgatcatcctgggtccggtgttggacctggtgtcagttgggccagggttcggtggggctacgggcgccggggccctttatcaagcagggtccctgcgtcacttgggcaatggtccgttcgtcccgggccgagacattggggagccatcgtttcggccattgggtgaaggcctcaccaggaatgtgaagcccggtccctccttggtgtgggcattccgtttcgcgtgaaccccagctagcattgttcccccgcaagataccgccgagtgtatgagagcttccggaagcgctgcctacaaattttatcccttgggggagaagagatcgtttgttgcaccaacgacgcgagtgggctccatttaagggaacggttcaggcgactcgtcaaagtctacttcaaggcccaactggggcctagcggggatgtggagcgggttaggaagagtccgaatcctccacgacactagggggggaaaccgatagtgttgtcccaggggccgggttggccatggcccccacggcgaaagaagcacgacaagtacacatcccagtgttagaagcaggcggaaccaggcaaagtactccctttggatggcaacaaggccatgacgacctgtgaatcgcttgggggtcctgaacgggcttggccgacgtgtgacaccaccgcaaagagcgtctgtggtggcacgtgaggtccggtgaccattcccaactttagaaattgcctttgggactttggtgagtctgcagtaccttgcgggttgtcacccggggatctacaatataaacactcctggcatttggtcccccggtttttttccca

SEQ ID NO: 579083 - DNA, 775 bp, Homo sapiens
  misc_feature (59)..(60): n is a, c, g, or t
  misc_feature (73)..(73): n is a, c, g, or t
  misc_feature (86)..(86): n is a, c, g, or t
  misc_feature (90)..(90): n is a, c, g, or t
  misc_feature (112)..(112): n is a, c, g, or t
  misc_feature (118)..(118): n is a, c, g, or t
cgaggcactcaccatccccacctcacctcacctcacccccgccagcaacggatgaaggnnctgccggtggganccgtcggcccagngccnctgccccccgaggctgctagangtaggngttaggcatgtcccacccacccgccgcctcccacggcacctcggggacaccagagctgccgacttggagactcctggtctgtgaagagccggtggtgcccgtgcccgcaggaactgggctgggcctcgtgcgcccgtggggtctgcgcttggtctttctgtgcttggatttgcatatttattgcattgctggtagagacccccaggcctgtccaccctgccaagactcctcaggcagcgtgtgggtcccgcactctgcccccatttccccgatgtcccctgcgggcgcgggcagccacccaagcctgctggctgcggccccctctcggccaggcattggctcagcccgctgagtggggggtcgtgggccagtccccgaggagctgggcccctgcacaggcacacagggcccggccacacccagcggccccccgcacagccacccgtggggtgctgcccttatgcccggcgccgggcaccaactccatgtttggtgtttgtctgtgtttgtttttcaagaaatgattcaaattgctgcttggattttgaaatttactgtaactgtcagtgtacacgtctggaccccgtttcatttttacaccaatttggtaaaaatgctgctttcagcctcccacaattaaaccgcatgtgatctcca

SEQ ID NO: 579084 - DNA, 315 bp, Homo sapiens
ctcagctgcatagagtgacatgtgcctgtcgtcacactctactcaggaggctgaagctgggaggattgcttttgcccagagaggtgagggctgcagtaagctatgtttgtactccagcctgagcaacagaatgagactttgtctcaaagtagaagaagaaggagcaggagaggccgagggagagggagagggagagggcgaacagagacggagacgactcgggcacagggagaggaagaggaccccgaagaacgacactaccacacagaggaaggcagagagcaagaaggagaagagaagaccgagaacaggacg

SEQ ID NO: 579085 - DNA, 1092 bp, Homo sapiens
  misc_feature (59)..(60): n is a, c, g, or t
  misc_feature (73)..(73): n is a, c, g, or t
  misc_feature (86)..(86): n is a, c, g, or t
  misc_feature (90)..(90): n is a, c, g, or t
  misc_feature (112)..(112): n is a, c, g, or t
  misc_feature (118)..(118): n is a, c, g, or t
cgaggcactcaccatccccacctcacctcacctcacccccgccagcaacggatgaaggnnctgccggtggganccgtcggcccagngccnctgccccccgaggctgctagangtaggngttaggcatgtcccacccacccgccgcctcccacggcacctcggggacaccagagctgccgacttggagactcctggtctgtgaagagccggtggtgcccgtgcccgcaggaactgggctgggcctcgtgcgcccgtggggtctgcgcttggtctttctgtgcttggatttgcatatttattgcattgctggtagagacccccaggcctgtccaccctgccaagactcctcaggcagcgtgtgggtcccgcactctgcccccatttccccgatgtcccctgcgggcgcgggcagccacccaagcctgctggctgcggccccctctcggccaggcattggctcagcccgctgagtggggggtcgtgggccagtccccgaggagctgggcccctgcacaggcacacagggcccggccacacccagcggccccccgcacagccacccgtggggtgctgcccttatgcccggcgccgggcaccaactccatgtttggtgtttgtctgtgtttgtttttcaagaaatgattcaaattgctgcttggattttgaaatttactgtaactgtcagtgtacacgtctggaccccgtttcatttttacaccaatttggtaaaaatgctgctttcagcctcccacaattaaaccgcatgtgatctccaaagaaaaacaaaaaacaacaaccaacacaacaaaaaaaccaagaaaacccgcgcaccgccagaaaaccaggcagacccaagaaacacagggcgcaccgcgccgctgcagcaacgaacaaggaccgtagtgccgcaccgagcacgaaccaacgacgggagaacagggccaccacacaagacacaagcgacgacaaccacaaccgcaccagcggcaggggatgagacaccacgcgcaacgaacaggacaagataggcacgaaagcaacaagtcacagaaacacgaggggaggggcccagccagcgacaaacaacagccg

SEQ ID NO: 579086 - DNA, 387 bp, Homo sapiens
atttgccccccgggcccaaaattccgccccgggggccaagccgaaaaaatttttggggagggttttaaggggcgggggttttggtttaaaaaaaacaacctccccggttccgggaaattttgtttttgggtcccgggaaacatccatttggggttccaatttggccccagcctttggttcttccggccgggattttttttgggggcggggggggccgggttccacaccccagaaaaggagggccgggccgggttccttggggcccaaaaccgaatccacaaaggggggggccttcgcttgttccccccggagtttggtggggtcctccctcccgggaaaaaaattcccctttttttcccaaaggggaataaaaagttttccggggga

SEQ ID NO: 579087 - DNA, 983 bp, Homo sapiens
gatgtactgtagacataaatgaggtgaaagaaagtcctgcatatctaatataaatactcaggaaagatagatgatatagaacgcgtagttcagtacatacctcatcgctaacaaaagcgatgggagcagcagatgtttgaacctatggtctgtatatatacatgtctgttctccccaagtctataccattattattagctcttagatatttttagacctatctttaaagtcccatgattctctcattgccttttgaaatgccctgtatgatgttagaataattccatatcgttcatggggttgtctgggcacttgttcaggaaatatgagaggcagtaatcattttaggccgttttcatccctatttacatttggtcaccgggtttgagcgtaaacctttgctcaatcattaaaaacatgcttagctgtggttcgctttgaacgatcgtaccagatttagtagagggcagtaagaggcagttgaaaaaacgagagaggtcggggagaatgtggttaccatgagcatctttagatcataaggcagattgagacatgatacatccaaggtcattctccctgtactgtcctcttcatttagcatgaatagatgcttttgctgttcggaaacaattgccctttttggttgagacagggtctaggctcgtgttgcccaggctagagtggcagggattgatcttggtcacggaagcgtctgcgctgggtgtcaagggaattcagcacacaagtagtggatacacggatgagcaacagccggaaatgtgacatcggacaaaggggtccgccggggtcagcggtcaaaccgggccgtgatgtcgctagccccaaaggggggtaaagggcacaggcaattattaccagacggagaagtaaggaaggggatcataaaaccaagggagaacagagaaatacttgtagaaaaccacgcgggtacaacacctcgtatttggttcatatattatcgg

SEQ ID NO: 579088 - DNA, 590 bp, Homo sapiens
gatgtccaatgctcgcatcttacagtatcaaagtttactgttagatcagcctcgtttgactttctctcccacaaagtgtttcaatccagctacactacttcccgactcagactgcactattcctgctcatgactgtcaagaactgttagaaactatcgaaactggccgatctgatcttaaagctgtgcccctagaaaaggcagatgccgccgtgttcacagaagtagcagcttcctcaagcaggaagtaggaaaagccagtgcagttgttaccatggagacagatgtgttgtaagctcaagctttaccagcgaacacctcagcacaaaaggctgaattgatcgccctcactcaggctctccgataaagagtaaacgtattaacatttacactgacagcaagtacgcctttgctactgtgcatgtacataaagccatctaccaggaaagcaggctactcacctcagcagctagctgtgatccactgcaaaggacatcaaaaagaaaacacggccgtagcccatagtaaccagaaagctgctgaggaaagtttagaatttctcctggcagagatggtccacgagtctggctc

SEQ ID NO: 579089 - DNA, 1368 bp, Homo sapiens
tcaaaacagtgaggaaacattaaaaaaaaaagccctaaagcaaaaaaaaaaaaaaaaaaaaaaacaaaaaaaaaaaaaaaccaaacaacaaaaaaacgaaaaaaaaaaaaaaaaaaagaacaagacgaagagcgcaaaacacaagaacaataagacaaagaaacaaaaaaagagaaaacaacaagacgcaagagagacgagggcagagaaggagagggagcattcgtcgagcctatctaccatctctctgtataatgaaaactaaactaataatctcactaacaacacactaaagatacatactaaataaaaaaacataacaagtataatacagacaaacagagactagaaaaaaagacaataaacaacaaccaaaaaaaaaaacacatacacaaaacacaataaaaaaagaaacaaaagagaagaaagagagaacagaaacgagaagacaaaagacaaaaaatgagagcagagaaaagaaagaaaaaagagataacgaaaagaacaaagaaaaaagaggaagaaaaaacacgaggaagcaaaggaaaaaaagaccaatcgaaaactaagaaaaaggaaaaaaaaaagaaatagaatagaagaagcagacgagaaaaacaagacgatgacaggataacagatacaacaaacaagaggagaaaacacagaaaaaacagacatagcagcgcagacgctggagacaaaaaaaagaaacagagcagagaaaaaaagaagagcaacaaaagaagaacaaaagcgaagaaaagacaagacaagacagaaaacagaaagaagaagcaacaaaaaaagagaacaaccaaaaaacaaaaaaggaaaggaaggaacaaaaaaaccaaaaagaacacagagaaaaagacaaaaaaccagacagagaaacccaacaaggaaaaacacaacaacagcaaggacagaaaaacacaagcagagaaagaaaagcacaaaagaacagaaagaaagaaagaaaagaaagacacaaagagacaagcggaaaaatgaaaaccgacaaaggacaagagaaacaaagaacagaaaaaagagaaaagagagagaaagagcacacaaaacaacgaagaaacgacaaagaggagaacaaaaagacaaaaaagaaagacaacacgaacaaaaacacaaagaacaaacaagagaagaagaagcagaaaaaaaaaaagataaaaaaaaataaaaaaaaagaacaagaaaaataaaaaaaaaaaaagaaaaaaagaaaaaaaataaacaaacaaatataaagtaaaacgacaaataaaaataacaaaaaaaaaaactaacaatataaaaaacgacaaaaaacaaacagacaaaaaaatacaaaaaaaaaaagaaaaa

SEQ ID NO: 579090 - DNA, 328 bp, Homo sapiens
gacgaatcacttgaacacaggaggcagcggttgccgtgagcggagatcacaccattgcactccagccccgggggaacagagtgattctcctgccttagcctcccgagtagctgggattacaggcatgtgctgccatgcccagctaatttttgtatttttagtagagacggagtttcactgtgtcggccaggctggtctcgaactcccgacctcaggtgatctgcctgcctaggcctcccaaagtgctgggattacaggtgtaagacatagcgcctggcctactgctacttttttcttttgcttttgagatggagtcttgctctggtcg

SEQ ID NO: 579091 - DNA, 365 bp, Homo sapiens
aaaatgggaaaaaacccaaattttttgtgtttgggcccaggacccctttccctactccctagcacctgtggtccgtggcttagctcgggcaaggaaatgagagcccctgtgttgttaggttttttttgggaactcttagaaggccggagccccccccccccttccctgccttttttcccttttgcagcctggaatatggatgtgtggtctggatgtccaccccccccttttgggccctaaaaacaagggcgattgttttaggatgacccccccccagcccttagagtggccagaagggccggggggctgctgtgcccacccgggctgtttctttttaaagaaaaataaaattttttggggtttta

SEQ ID NO: 579092 - DNA, 257 bp, Homo sapiens
tctttgggacggcggcacggccccattatctcacctgacatcaccaaggtttgcagtacctcaacgagatcaaggacagtgtggtggccggcttccagtgggccaccaaggagggcgcactgtgtgaggagaacatgcggggtgtgcgcttcgaacgtcacgacgtcacccttgaaggccgacgccatccaccgcgggagggggccagattattccccacagcacggggctgcctcttatgccagtgtgctgaccgg

SEQ ID NO: 579093 - DNA, 471 bp, Homo sapiens
ccggtactgtaggcctatgtggaggtgcgacgccccttcacccatgtgccatgccccaggctgcttcccccacaccctccttgtcctccctagctcaggctcggtcagttctaagtttacctgagctcttttatttcagatgtaagacttacaaatttaagtttgtaaggacgaacttaaccaccatcttcccaaggggttatcaagatactcagaggaacctgaaaatgtatgtgtaaatactatttaatgaacgactgtacaaagtagaattcctaatgtattttttgtatgctttgcattgtatatggaagaacttgtgtcatcaagtatgtatcaatgggtagttaaagtttatttttaaaaccgtccaataccttttgtattatgtaacattcaaaagacaatgtactgtattgaaagtagtaagagacccaaaatgtaataaagtaataataactgacatgaaaa

SEQ ID NO: 579094 - DNA, 415 bp, Homo sapiens
  misc_feature (1)..(1): n is a, c, g, or t
  misc_feature (13)..(13): n is a, c, g, or t
nggttttctttcnggcctcctgcagagtccctggaagaaaatttaccaatctttcctgctttctatttttatgatgacaatcaaagcttgcccgaggaacacaatttgtgacttttaaaaaaatgatcaatgatgtccttaaaaaaatgtggtctgccaacctgtacaaaatggtcctatatttgtgaagagggacgtaagataaaacgatgttatacatcgatatgtatatatctgttgctatgtagacttggagaatactgccaaaatgtgtatgacaagctgtatcactgcctttgtttatattttttttaactgtgatattccccacaggcacgttaactgttgcacttttgaatgtccaaaatttatattttagaagtaataaagagaaaaatactgacatgttcccaaa

SEQ ID NO: 579095 - DNA, 892 bp, Homo sapiens
cgcgccgtgggggagtcgtgcgcaggcgcggacagcgctgcttccgcggcggttggggtggtggggccccgggcggcgttgaccatgacccagcagggcgcggcgctgcagaactacaacaacgagctggtcaagtgcatagaggagctgtgccagaagcgggaggagctgtgccggcagatccaggaggaggaggacgagaagcagcggctgcagaatgaggtgaggcagctgacagagaagctggcccgcgtcaacgagaacctggcacgcaagattgcctctcgcaacgagttcgaccggaccatcgcggagacggaggccgcctacctcaagatcctggagagctcccagactttgctcagcgttctcaagagggaagctgggaacctgaccaaggctacagccccagaccagaaaagtagcggcggcagggacagctgaccagaccacgggcagggcctgcctccgtgtgcccctcagctcagccccagcaagtgtgtgctcagagcatctttgttcttcacggcagcagctaccttccctcactgtctcaggtgccgagaggggcaggtgccagcctccactggcatcagtgacaagcccagggcacagcccacccgggggtcctcgcttcatgctcacacaggctatggggatggtgggctccaggtcagctctgcaaggggcttgtctctgtggcacccacactcctgccctgccagggaggctctggttgtctgagcaccatgggggccccctcaccttgtccctcctcagccagcagaggcccagggcaagggacaggaggacaggggttctccttcaccacagaacccaaacctcaggtctcacccctgtggcctgtgattatgaataaagattatctttg

SEQ ID NO: 579096 - DNA, 1179 bp, Homo sapiens
cgcgccgtgggggagtcgtgcgcaggcgcggacagcgctgcttccgcggcggttggggtggtggggccccgggcggcgttgaccatgacccagcagggcgcggcgctgcagaactacaacaacgagctggtcaagtgtgagcggcgcagccgggacggggaggtcgggagggccgcagggccgggttcccggctcgcagcggggtgcccctggacccgcctcgctgcgggcatcgcgcggctgagcagagccctccgtgccggaggccgggtgtccgtggcccgagccctcgctggctcgcaggccccgcgccgggcgctcgggggtggtgcctgactctggcttcctcgggtggaaggaggcccgccctccgccgccgcgctcctgccctgggcccacagcgccgcccctcccggcccccaggcatagaggagctgtgccagaagcgggaggagctgtgccggcagatccaggaggaggaggacgagaagcagcggctgcagaatgaggtgaggcagctgacagagaagctggcccgcgtcaacgagaacctggcacgcaagattgcctctcgcaacgagttcgaccggaccatcgcggagacggaggccgcctacctcaagatcctggagagctcccagactttgctcagcgttctcaagagggaagctgggaacctgaccaaggctacagccccagaccagaaaagtagcggcggcagggacagctgaccagaccacgggcagggcctgcctccgtgtgcccctcagctcagccccagcaagtgtgtgctcagagcatctttgttcttcacggcagcagctaccttccctcactgtctcaggtgccgagaggggcaggtgccagcctccactggcatcagtgacaagcccagggcacagcccacccgggggtcctcgcttcatgctcacacaggctatggggatggtgggctccaggtcagctctgcaaggggcttgtctctgtggcacccacactcctgccctgccagggaggctctggttgtctgagcaccatgggggccccctcaccttgtccctcctcagccagcagaggcccagggcaagggacaggaggacaggggttctccttcaccacagaacccaaacctcaggtctcacccctgtggcctgtgattatgaataaagattatctttg

SEQ ID NO: 579097 - DNA, 528 bp, Homo sapiens
  misc_feature (29)..(29): n is a, c, g, or t
gcgagtcctgagagcctcagcaacttgcncagggaaggctcagactctagccctggccgggcaaactccaagtcctctcacttaagaacaaccagtgcatcgtgtttactttctctttctctaccctagtgacattctcagaaagaggaaccgtcggaaggttccagggttttcttgatgtgggcatttcgaggtgttgacaaaaggacctctgtgacctttacttatggcctagtgcacacacttgtaagtggcccccatatctggtgccacacaggccagagtgcacttcccgctcctcttataatgccctcactaatgtgactgtaacttcattaactccaggccagattggatccttgtaccgactggtgagtaagcgaaccttcactacagacagctgtctttgctgatgactagctacttcatttttaaaattacggtgaatcaactatatgccaatattgaacaatgccttccttttttagcttcctgagcagcaaaataaaaactaaatcaaaaccaaaa

SEQ ID NO: 579098 - DNA, 777 bp, Homo sapiens
  misc_feature (2)..(2): n is a, c, g, or t
  misc_feature (18)..(18): n is a, c, g, or t
  misc_feature (21)..(21): n is a, c, g, or t
  misc_feature (24)..(24): n is a, c, g, or t
  misc_feature (57)..(57): n is a, c, g, or t
  misc_feature (60)..(60): n is a, c, g, or t
  misc_feature (109)..(110): n is a, c, g, or t
  misc_feature (144)..(144): n is a, c, g, or t
  misc_feature (148)..(148): n is a, c, g, or t
  misc_feature (157)..(157): n is a, c, g, or t
  misc_feature (274)..(274): n is a, c, g, or t
  misc_feature (416)..(416): n is a, c, g, or t
tnttctcaaaataccacnacnacnacaacaacaaaacttcctaggccagatgtggtngcnaatatgtataatcttagcactttgggaggccaaggcaggaggattgctnnaggcgaggagttcaagaccagcctaggcaacatngggnacccccatntctacaaaaatttaaaaattagcctagcatggtggcacgctctgtaatcccaaatacgcggtaggctgaggctgaggagggtggattgcttgagcccaggggtttgaggctgcagtnagccaaagtcacgccactgcattctatcctgggcaacagatggagaccttgtctcaaaaaaaaaaaattcctgacatcgctatgtattcccaactttatcatttgtctgcctgtttagttttgacttatgtttttttttttnccccctgtggacatgtagttgacggaaatcgtgaaggaactttaatattttatttaaatttcccaaaactaatcatgccttatgtgactaatcttcagtgataatatttcatctactgatatattttcttgaggtgtgtaattttcagtataccttaatcatttggtataaaaaagagagaggtttttgatatatgaatgctgttcttgtaaaaatcaatcttgacactttattttaaactttttattggtaatgacagtgggttttgtacatcatgattttcaatttaggatatctgtctaatttgttttttcagagtaactatattggaattcaataaaaatattcaaaatttttctta

SEQ ID NO: 579099 - DNA, 125 bp, Homo sapiens
cgattcaaagggacaagcaccaagacttgatgcctaagcaaagcttgcgatgccgtatgcaagcttgcgatgccgtatccaaagcttgcgatgcgggggtgactacctctagatgctctaccctg

SEQ ID NO: 579100 - DNA, 254 bp, Homo sapiens
gcggccgcctactactactaaattcgcggccgcgtcgacccctgtcctcctgtcccttgccctgggcctctgctggctgaggagggacaaggtgagggggcccccatggtgctcagacaaccagagcctccctggcagggcaggagtgtgggttctccttcaccacagaacccaaacctcaggtctcacccctgtggcctgtgattatgaataaagattatctttgtaaaaaaaaagtcgacgcggccgcgaat

SEQ ID NO: 579101 - DNA, 158 bp, Homo sapiens
gtaatgagctgaaagcttatatttacatgtcgctgaataagaagacaactttagtatggagctatggtatatatagtatctataagctattcagacatataaatctcttgatgaaatgcattccttcctcaatggcactagctgaaaatggagtgctt

SEQ ID NO: 579102 - DNA, 893 bp, Homo sapiens
accagcttgctagtcgggccgttttaatcgtcagaggcgctgcttcgcggacggtgtggtggtggggccccgggcggcgttgaccatgacccagcagggcgcggcgctgcagaactacaacaacgagctggtcaagtgcatagaggagctgtgccagaagcgggaggagctgtgccggcagatccaggaggaggaggacgagaagcagcggctgcagaatgaggtgaggcagctgacagagaagctggcccgcgtcaacgagaacctggcacgcaagattgcctctcgcaacgagttcgaccggaccatcgcggagacggaggccgcctacctcaagatcctggagagctcccagactttgctcagcgttctcaagagggaagctgggaacctgaccaaggctacagccccagaccagaaaagtagcggcggcagggacagctgaccagaccacgggcagggcctgcctccgtgtgcccctcagctcagccccagcaagtgtgtgctcagagcatctttgttcttcacggcagcagctaccttccctcactgtctcaggtgccgagaggggcaggtgccagcctccactggcatcagtgacaagcccagggcacagcccacccgggggtcctcgcttcatgctcacacaggctatggggatggtgggctccaggtcagctctgcaaggggcttgtctctgtggcacccacactcctgccctgccagggaggctctggttgtctgagcaccatgggggccccctcaccttgtccctcctcagccagcagaggcccagggcaagggacaggaggacaggggttctccttcaccacagaacccaaacctcaggtctcacccctgtggcctgtgattatgaataaagattatctttg

SEQ ID NO: 579103 - DNA, 1033 bp, Homo sapiens
gggcatgacccgttaagaggcagatatagtctagtacgagcgtgaatggacaggccgtcgcgggggtgcccggaccgctgcgggcatcgcgcggctgagcagagccctccgtgccggaggccgggtgtccgtggcccgagccctcgctggctcgcaggccccgcgccgggcgctcgggggtggtgcctgactctggcttcctcgggtggaaggaggcccgccctccgccgccgcgctcctgccctgggcccacagcgccgcccctcccggcccccaggcatagaggagctgtgccagaagcgggaggagctgtgccggcagatccaggaggaggaggacgagaagcagcggctgcagaatgaggtgaggcagctgacagagaagctggcccgcgtcaacgagaacctggcacgcaagattgcctctcgcaacgagttcgaccggaccatcgcggagacggaggccgcctacctcaagatcctggagagctcccagactttgctcagcgttctcaagagggaagctgggaacctgaccaaggctacagccccagaccagaaaagtagcggcggcagggacagctgaccagaccacgggcagggcctgcctccgtgtgcccctcagctcagccccagcaagtgtgtgctcagagcatctttgttcttcacggcagcagctaccttccctcactgtctcaggtgccgagaggggcaggtgccagcctccactggcatcagtgacaagcccagggcacagcccacccgggggtcctcgcttcatgctcacacaggctatggggatggtgggctccaggtcagctctgcaaggggcttgtctctgtggcacccacactcctgccctgccagggaggctctggttgtctgagcaccatgggggccccctcaccttgtccctcctcagccagcagaggcccagggcaagggacaggaggacaggggttctccttcaccacagaacccaaacctcaggtctcacccctgtggcctgtgattatgaataaagattatctttg

SEQ ID NO: 579104 - DNA, 174 bp, Homo sapiens
cccgactagcccgacagtgtgggggggggataacacgttggggattgggattttttttaaaaaaaatactggctcccccacaattgggttgcctggggggaacttggtctgcttcagcccaaaaggaatcaaaagatcaaaagcattttggaaaggccaaaaccgtcctgtggg

SEQ ID NO: 579105 - DNA, 908 bp, Homo sapiens
  misc_feature (17)..(17): n is a, c, g, or t
  misc_feature (49)..(49): n is a, c, g, or t
gaagttactgacctcantataggggcgaaccgcgccacttccactgcgngtgcgcgcttcgtactcattacattgttgccatgcgatcatctcaacgctcgcgcgtggtgtgggccggcgcgtgacatgaccacaggcgcggctgccaactacacacgactggtcagtgcataaggactgtgcaaacggagactgtggcgcagatcaggagaggagggacaaacacggtgcgaatgaggtgaggcagctgacagagaagctggcccgcgtcaacgagaacctggcacgcaagattgcctctcgcaacgagttcgaccggaccatcgcggagacggaggccgcctacctcaagatcctggagagctcccagactttgctcagcgttctcaagagggaagctgggaacctgaccaaggctacagccccagaccagaaaagtagcggcggcagggacagctgaccagaccacgggcagggcctgcctccgtgtgcccctcagctcagccccagcaagtgtgtgctcagagcatctttgttcttcacggcagcagctaccttccctcactgtctcaggtgccgagaggggcaggtgccagcctccactggcatcagtgacaagcccagggcacagcccacccgggggtcctcgcttcatgctcacacaggctatggggatggtgggctccaggtcagctctgcaaggggcttgtctctgtggcacccacactcctgccctgccagggaggctctggttgtctgagcaccatgggggccccctcaccttgtccctcctcagccagcagaggcccagggcaagggacaggaggacaggggttctccttcaccacagaacccaaacctcaggtctcacccctgtggcctgtgattatgaataaagattatctttg

SEQ ID NO: 579106 - DNA, 161 bp, Homo sapiens
gcttgcgggggcacacccaggcgtggatggcacgtgcctgcttggtacgctctgaacccagcgtccgctgtgcgttgtcctacgcacgggaaggtagtgcatccttgggcgggcgtcgtcgggggcaggctggctccagtgtgtgacaaatgtccaaagtc

SEQ ID NO: 579107 - DNA, 1065 bp, Homo sapiens
cgcgccgtgggggagtcgtgcgcaggcgcggacagcgctgcttccgcggcggttggggtggtggggccccgggcggcgttgaccatgacccagcagggcgcggcgctgcagaactacaacaacgagctggtcaagtgtgagcggcgcagccgggacggggaggtcgggagggccgcagggccgggttcccggctcgcagcggggtgcccctggacccgcctcgctgcgggcatcgcgcggctgagcagagccctccgtgccggaggccgggtgtccgtggcccgagccctcgctggctcgcaggccccgcgccgggcgctcgggggtggtgcctgactctggcttcctcgggtggaaggaggcccgccctccgccgccgcgctcctgccctgggcccacagcgccgcccctcccggcccccaggcatagaggagctgtgccagaagcgggaggagctgtgccggcagatccaggaggaggaggacgagaagcagcggctgcagaatgagatcctggagagctcccagactttgctcagcgttctcaagagggaagctgggaacctgaccaaggctacagccccagaccagaaaagtagcggcggcagggacagctgaccagaccacgggcagggcctgcctccgtgtgcccctcagctcagccccagcaagtgtgtgctcagagcatctttgttcttcacggcagcagctaccttccctcactgtctcaggtgccgagaggggcaggtgccagcctccactggcatcagtgacaagcccagggcacagcccacccgggggtcctcgcttcatgctcacacaggctatggggatggtgggctccaggtcagctctgcaaggggcttgtctctgtggcacccacactcctgccctgccagggaggctctggttgtctgagcaccatgggggccccctcaccttgtccctcctcagccagcagaggcccagggcaagggacaggaggacaggggttctccttcaccacagaacccaaacctcaggtctcacccctgtggcctgtgattatgaataaagattatctttg

SEQ ID NO: 579108 - DNA, 711 bp, Homo sapiens
  misc_feature (694)..(694): n is a, c, g, or t
atccctgtgctcttgatgtctctgcacaaagcttatggtttgatcaggatatattcacacagcgggagtcttcaccaggatatgagaatgccaagctggatcatctcttccaggacgaggtggccacggcacagcatctgcgtgaggagcagcagcggcagcagcatcagatggagcatgaacggcagcggctggtggccagcatggaggaggcgcggcggcggcagcatgaggccgacgagggcgtgcggcgcaagcaggaggagctgcagcagctggagcagcagcagcggcagcaggaggagctgctggctgaggagaaccagaggctgcgtgagcagctgcagctcctggaggagcatcaccgggccgcgctggcgcactcagaggaggtcactgcctcgcaggtggctgccacaaagaccctgcccaatggccgggatgcacttgatggccccgcagcacaggcagagccggatcacagcttcgatggcctgcggcggaaggtgtcagctcagaggctgcaggaggccggcatcctgagtgcggaggagctgcagcggttggcgcatggtcacaccacggtggacgagctcgcacggcgggaagacgtgcgccactacctgcagggccgcagcagtatcgcaaggctgttgctgaaggccaccaatgagaagctgagtgtttacgccgncctgcagaggcagctgg

SEQ ID NO: 579109 - DNA, 1292 bp, Homo sapiens
cgcgccgtgggggagtcgtgcgcaggcgcggacagcgctgcttccgcggcggttggggtggtggggccccgggcggcgttgaccatgacccagcagggcgcggcgctgcagaactacaacaacgagctggtcaagtgtgagcggcgcagccgggacggggaggtcgggagggccgcagggccgggttcccggctcgcagcggggtgcccctggacccgcctcgctgcgggcatcgcgcggctgagcagagccctccgtgccggaggccgggtgtccgtggcccgagccctcgctggctcgcaggccccgcgccgggcgctcgggggtggtgcctgactctggcttcctcgggtggaaggaggcccgccctccgccgccgcgctcctgccctgggcccacagcgccgcccctcccggcccccaggcatagaggagctgtgccagaagcgggaggagctgtgccggcagatccaggaggaggaggacgagaagcagcggctgcagaatgaggtgaggcagctgacagagaagctggcccgcgtcaacgagaacctggcacgcaagattgcctctcgcaacgagttcgaccggaccatcgcggagacggaggccgcctacctcaagatcctggagagctcccagactttgctcagcgttctcaagagggaagctgggaacctgaccaaggctacagccccagaccagaaaagtagcggcggcagggacagctgaccagaccacgggcagggcctgcctccgtgtgcccctcagctcagccccagcaagtgtgtgctcagagcatctttgttcttcacggcagcagctaccttccctcactgtctcaggtgccgagaggggcaggtgccagcctccactggcatcagtgacaagcccagggcacagcccacccgggggtcctcgcttcatgctcacacaggctatggggatggtgggctccaggtcagctctgcaaggggcttgtctctgtggcacccacactcctgccctgccagggaggctctggttgtctgagcaccatgggggccccctcaccttgtccctcctcagccagcagaggcccagggcaagggacaggaggacaggggttctccttcaccacagaacccaaacctcaggtctcacccctgtggcctgtgattatgaataaagattatctttggtaaaaaaaggaaaacagacaaaaagaaaacacaagggaacattattggaccgggggcggaaaaagagaggataaggaaggggccaagggggcgaacaggagaacccaagaac

SEQ ID NO: 579110 - DNA, 983 bp, Homo sapiens
cggcacgaggactacagtcgcttatcaccatccggaggaaagccgagctagcccgccacgctggggctctctgagaggcaggttaaaagtctggtttcatgaaccgcagagcaaaggagaggaaaatcaacgagaagaagttgcatgcagcaacaggccagcagcagccaccacatgccgcctccgccgcaacacagcctccccagcctcagccaggtcctctgagaagtgtcccagagtcccttgtagttccggtgtcttccctgcaagcctcagtgtctggctctgtccctttggggttctggtgggccaactgtgtgggggtgtgctaaaccccacctgtcacccgatgttgacccaccggggtgtctgccagcggcagagcaaatttccaggctttgatgccatgatgggagcgtggaactcttgcctagactcctcgagtgaggagaccagcgtctccgtccgagcgcaaataggcaataagacgcttacgagcactgtgatcctaatggatggataaacaatggtgaagctgaggtgactcaaccacacgcacgcgtggagcattagtggggtgtgcactgcgcagacacaaatattaagtcatcccccgacgatgttgttcaacgaacaaagtgcgcgcgcatcttgagtgtgttgtactatggccgcaatgaagggaaaccaagacacataccatccgtgtgagtggctttcatataccggacaggctgttctgaataagcagtttgtattggtactggagcctacacgaaatccacggcccttcaaatggcttcacatcaaccaatcaccatacaccttaccataggatctagaatcggtaggccacactcattgaatacagacctatgagtgatatgtcggaacttggagggggaacgcactactatgagtggccagatggactggttgcatgaacatgagccctccacagaacacatgacataatgcctaca

SEQ ID NO: 579111 - DNA, 105 bp, Homo sapiens
  misc_feature (36)..(36): n is a, c, g, or t
  misc_feature (72)..(72): n is a, c, g, or t
agtgccacccgaggccggggcagttttgttggcggnggcaggcgacggaccacggtggcatatgtgatcaangaagcgagccaagggcaactggtggtggcctga

SEQ ID NO: 579112 - DNA, 1863 bp, Homo sapiens
cgcgccgtgggggagtcgtgcgcaggcgcggacagcgctgcttccgcggcggttggggtggtggggccccgggcggcgttgaccatgacccagcagggcgcggcgctgcagaactacaacaacgagctggtcaagtgtgagcggcgcagccgggacggggaggtcgggagggccgcagggccgggttcccggctcgcagcggggtgcccctggacccgcctcgctgcgggcatcgcgcggctgagcagagccctccgtgccggaggccgggtgtccgtggcccgagccctcgctggctcgcaggccccgcgccgggcgctcgggggtggtgcctgactctggcttcctcgggtggaaggaggcccgccctccgccgccgcgctcctgccctgggcccacagcgccgcccctcccggcccccaggcatagaggagctgtgccagaagcgggaggagctgtgccggcagatccaggaggaggaggacgagaagcagcggctgcagaatgaggtgaggcagctgacagagaagctggcccgcgtcaacgagaacctggcacgcaagattgcctctcgcaacgagttcgaccggaccatcgcggagacggaggccgcctacctcaagatcctggagagctcccagactttgctcagcgttctcaagagggaagctgggaacctgaccaaggctacagccccagaccagaaaagtagcggcggcagggacagctgaccagaccacgggcagggcctgcctccgtgtgcccctcagctcagccccagcaagtgtgtgctcagagcatctttgttcttcacggcagcagctaccttccctcactgtctcaggtgccgagaggggcaggtgccagcctccactggcatcagtgacaagcccagggcacagcccacccgggggtcctcgcttcatgctcacacaggctatggggatggtgggctccaggtcagctctgcaaggggcttgtctctgtggcacccacactcctgccctgccagggaggctctggttgtctgagcaccatgggggccccctcaccttgtccctcctcagccagcagaggcccagggcaagggacaggaggacaggggttctccttcaccacagaacccaaacctcaggtctcacccctgtggcctgtgattatgaataaagattatctttgcaaaaaaaaaaaaaaaaaaaaaaacaaaaaaccagtgggcggccgcgccccgggccccccgaaaaagcttttcatagaacccactgcgcggtgtgggggccgcggggccccgagggggtaaaggggaaaccgtgggcgccatatacgcgtgtttctcctatgaggagagaatctccgcgggggctcaagagaacaatgaggcgcgcgtgggaattctctctcccccaaaatataaaacacaacgcgccgcgcgggaggcaacaccgcgagagcgcgttctctggacaaacaaacactccccaagagagtgggagcttctcgagagagggggctctatatatacgcggggactctcttatataaacacgagggggagagtctcacaaagcgagagagcgctctcgagatattctacaatatttatacgcgcccccccgaagagacgttgctgtggtgggagtaaaacagatcaacgtatagtgagatgaagaatatagaacaagtatcaaccatacacgttccatacaactgaccaataaataaaccctacgaataacatcactatatcacgatagacgtcagaaagatactaataatacaaaaatcaagtgcagaaataaacacaaaacaaacataccaaagatccagaatgaagacaacaaacaataaagaaaaacaagaaac

SEQ ID NO: 579113 - DNA, 1207 bp, Homo sapiens
cgcgccgtgggggagtcgtgcgcaggcgcggacagcgctgcttccgcggcggttggggtggtggggccccgggcggcgttgaccatgacccagcagggcgcggcgctgcagaactacaacaacgagctggtcaagtgtgagcggcgcagccgggacggggaggtcgggagggccgcagggccgggttcccggctcgcagcggggtgcccctggacccgcctcgctgcgggcatcgcgcggctgagcagagccctccgtgccggaggccgggtgtccgtggcccgagccctcgctggctcgcaggccccgcgccgggcgctcgggggtggtgcctgactctggcttcctcgggtggaaggaggcccgccctccgccgccgcgctcctgccctgggcccacagcgccgcccctcccggcccccaggcatagaggagctgtgccagaagcgggaggagctgtgccggcagatccaggaggaggaggacgagaagcagcggctgcagaatgaggtgaggcagctgacagagaagctggcccgcgtcaacgagaacctggcacgcaagattgcctctcgcaacgagttcgaccggaccatcgcggagacggaggccgcctacctcaagatcctggagagctcccagactttgctcagcgttctcaagagggaagctgggaacctgaccaaggctacagccccagaccagaaaagtagcggcggcagggacagctgaccagaccacgggcagggcctgcctccgtgtgcccctcagctcagccccagcaagtgtgtgctcagagcatctttgttcttcacggcagcagctaccttccctcactgtctcaggtgccgagaggggcaggtgccagcctccactggcatcagtgacaagcccagggcacagcccacccgggggtcctcgcttcatgctcacacaggctatggggatggtgggctccaggtcagctctgcaaggggcttgtctctgtggcacccacactcctgccctgccagggaggctctggttgtctgagcaccatgggggccccctcaccttgtccctcctcagccagcagaggcccagggcaagggacaggaggacaggggttctccttcaccacagaacccaaacctcaggtctcacccctgtggcctgtgattatgaataaagattatctttgtaaaaaaaaagtcgacgcggccgcgaat

SEQ ID NO: 579114 - DNA, 156 bp, Homo sapiens
gtatgagtgctgttttactcagtgaccagagtgagaagacatttccaaattcggtgtcttaagtccagaagattttgggcggtaccagggtttgtgtgtaattcctaaagggaataattgggatggcatggatgtgggcaaccggggccgtggaaa

SEQ ID NO: 579115 - DNA, 272 bp, Homo sapiens
tctgaaactataggcacgcaccaccatgcccgtttattttcttttgtatgagtagtagagaccaggcttcaccatgttagtcaggatggtctcgatctcctgacctcatgatctgcccatctcagcctcccaaagtgctgggattataagcgagagccaacacgcccagcccattttatgatcttataataaaatacctggagctagatactttatacagaaaagaggcttatttgtctcctaattgcagcggctgtaaagtccaagagcat

SEQ ID NO: 579116 - DNA, 704 bp, Homo sapiens
gtcgcccaggctgtagtgcaattgcgtgatcttggctcactgcaggctccgcctcctgggttcaagcaattctcctgcctcagcctcctgagtagctgggactacaggcgcatgccaccatgcacagccaaatttttttcgtattttagtggacgatggagtttcaccgtgttgcccaggctggtcttgaactcctgagctcaggcagtccgcctgccgtagcctcccaaagtgttaggattacaggccaccatgcctggcctaaactctgttatgtaacgtgatctcccagtgtaataactgcttttatttgctggtgttcgaaagtagttcagccaaacccatgacagcttcatgaattccaatcacatcttttcttcttccgcagccgtcagcttcagtcagaggaccccttcagacagccagtgtctctcctagacatgcccttttcggccatcgactgtcaaggaaccttacccattggtgcgaggtatgctcctccagcctccttctcagacatttgatccacccttggacttccatcccttagcaaggatctccagtacttcgttcaaattcattttcccatggagtgacattcccaatcgagggtaaggaaccgagatctcaattcgtacaaccattgccagctcgatcgcctcacaatgacaatgtcggctcggccatccttcacctgcacccag

SEQ ID NO: 579117 - DNA, 1333 bp, Homo sapiens
cgtgcgggtcgcgtgtcgggggggggtgcggcctggggggccctgtggcggccttccgctgcccgtcctggtgttctttgtggtcgcctccgctgcggtctcgtgggtgtcgcgctgtcggtcgctgtcgggcttctgtgtgcggcgctcttggccgggtgcctcggtggcggggctgtgtgtagcttctgggacgtgtcctttgggggcgcgggtcgtcttgcctttgcttgtgggtccgtggcgctgtctgaggccgtccgtgtgtcctcgtcccgggctcggcgcgcggttgggtgtttcctctgtcgtggcgtcttccctctgcgccgctgtccgggtctccgcgtgggtcggggggccggttgcttgtcctcccttcgctccttgccggtgctgtgccgtggcccgtcgtcggtctttgccttccccgcgttgtgtcggggcctcggcctggttgtcctttccgtcgtcgtgattgtgcgggctgtgcccgcgcttcgcttgttgcctgtggttttggttcgtgggtagctcgtcttgtgcgcttctccggcgcttcgcatcccactgcttgcggttctctcatccatcggcgtcctggggctgttatctagggcctccccagcgttgtcacctgtgcgtctcgcgttctcctgtctcgtccctggtgcttctgggcgcttgggttatgtgtgttgctttgccgctagtggtctgggtgtctcttgaggccgttgtcgtcgggccgctaggcgtagatgctctcttttgtcattccgtggttaacgtggtccgtcggggtggggctggggtatccccgtgtggtacgcgtgtcgcggttggtcctgggtctgcggtggtacttgcgtcctgtgattctgcgtgtcgtgccggttcctgtcgtgtgccggccccttcattcctgatccgtccggttagtactacggtgcctccggggttcacctgattgccagcttgtttcgggggcgctagctctgggttctttcatggggtgtgtgcagcgtgtggacgactgcacggtgactgctcgtccgagcggtggattgattctactgctgcacagtctctccgttgccatgctggaggtgtggcctggggtgtaatccccagcatgctttgggaggtgaggctatgccggatcacttgtgatcagaagtttgagaccagcctggccaacatggtgaaaccctgtctttactaaaaatacaaaaattagctgggtggggtggtgcatgcctgtaatcccagctacttgggaggctgagataagagaatcgcttgagcccagtaggtggaggttgttagtgac

SEQ ID NO: 579118 - DNA, 636 bp, Homo sapiens
gagcacgattcgcttccccgggggggcttgggttggggccccccccttattttttcacggttcggggggagcctttccgagagggttggtctttttaatgaagggggtcacccttggtttgagggtaagacacaacccgcccgtctccgggatttcaattctttccgtcttaaggattcaaaaccaggtgggggtttggcccccctcaggcaaggggggggcaggtttgccggggccttcccccagcctggtttttatacgccttaaaggcccctgggaaatggggcccccagattaaaagtttctttccttcccccccccggggccggggaaaaagaaacccttttttttttttgggggggggggggagccctttcctttgggggaagggccggggatggtttcccttccccaaatttggaaaggagaagattttttttttttcctttttttgggaccaaaacttaaaaggggggccccgggcccttttttttttgacccccttttttgttcccagggtcaaaaaggggtccttttttttgggggggttggggggggccctttaaggcccggggcgggggggggggggggggccccccccttccttttttttttttttaaaatggtcccccgcca

SEQ ID NO: 579119 - DNA, 318 bp, Homo sapiens
tcggaacgaggtaggacacacagcagcttatagacaaccgcaagctcatggagacgcaaatgggaccggttcaaagtgggggacacgagagaccaaaaccaaagcttacagcaaagagggccggggccgggcccagaaggtagatccggcccagaaggagacggaagaggtgggccaggggctcacgaataccatcgacaggctcaagatgcaggtggaccagttggagagtgaaggggagtcacggtcagtgcagacacgcaagaggaagggcgacaaggataagtaggacgggatggagggcttgaggcggcacat

SEQ ID NO: 579120 - DNA, 544 bp, Homo sapiens
  misc_feature (13)..(13): n is a, c, g, or t
  misc_feature (56)..(56): n is a, c, g, or t
  misc_feature (385)..(385): n is a, c, g, or t
  misc_feature (436)..(436): n is a, c, g, or t
actgcatgttgcnccgcgtttattagaggatcccccataagtccgatggggttacntggagtatagtagtccgcttggactgggtgaagtctaagcatgtactggctcggaggtggggtctggctccgaggtcgccccaaccgaaattttaaatggcaggttgtggtagtttaaggaccggtgggtttggtaaggtacggttggctttcattaatttaaagctccatagggtctcctcgtctggctgtgtcatgcccgcctcttcacgggcaggtcaatttcacgggttaaaagtaagagacagcggccaatcaacataggggggggtagatgagaattgcaagtgacttcctcctccggggaagataccatagccttagatggngaggtaaggagagagggagcccggtcttctgggccacactcccgggaaggnaatttcggtcatgtggagctgagaagggaaagagaggggagtgggttgcagcaaatgccacgtattctggctatcctaacggagtttaagcagatctccaatcaaggg

SEQ ID NO: 579121 - DNA, 322 bp, Homo sapiens
agacttaaatatcaagttttttaaaagttacgttattttggggctaggtgcagtggctcacgcctgtaatcccagcactttgggaggccaaggcaggcggatcatcaggtcagcagttcgagaccagcctgaccaacatggcgacaccccgtctctactaaaaatacaaaaaattagctggacgtggtggcgtgtgcctgtaatcccagctactcaggaggctgaggcaggagactagcttgaacctggaatgtagaggttgcagtgagccaagattgtgccactgtattccagcctgggcgacaaagtgagactccatctc

SEQ ID NO: 579122 - DNA, 895 bp, Homo sapiens
  misc_feature (12)..(12): n is a, c, g, or t
  misc_feature (76)..(76): n is a, c, g, or t
  misc_feature (90)..(90): n is a, c, g, or t
  misc_feature (458)..(458): n is a, c, g, or t
  misc_feature (504)..(505): n is a, c, g, or t
  misc_feature (671)..(671): n is a, c, g, or t
  misc_feature (679)..(679): n is a, c, g, or t
  misc_feature (682)..(682): n is a, c, g, or t
  misc_feature (686)..(686): n is a, c, g, or t
  misc_feature (695)..(695): n is a, c, g, or t
  misc_feature (717)..(717): n is a, c, g, or t
  misc_feature (770)..(770): n is a, c, g, or t
  misc_feature (786)..(786): n is a, c, g, or t
  misc_feature (805)..(805): n is a, c, g, or t
  misc_feature (889)..(889): n is a, c, g, or t
ttggtgaagtanagtatatgcttctctggtggcttgggggtgtgtagttggggcctaattcttgagccagtgaagngacacttgggattnagccctcaattgcagcactgaggcacgtggtgccgagaaacaatcctgagggggtccccaacccacctagtcactccttagtttgcagaggcactatctgcagagtcctgtgaaaggctgcagtgaagtcttgcatgagactccccatccagcggagttctccaagctgcagggtagagcgttgtgccaggagggtgtttgggctcatgaaacagtggagaggcgcagaggctcactgggaaaccttggcctcaccgggcctggattgggcatcggcagtgggcatgaagtgggggtgggattctttaggccagggtccaggacacttgggggatcgtaatgctgggggttttcggggaggaaccaanggtcacggagcctcctgtgctgcagtgctgggccataggtgcacanngtcaccgagccactgctggggaaggccggggctcaggtttgggtcctgggctgcgtcctgtggtggggtagtccaggctggccaggctgcagtgtctccgagggcagaccagtcgactcgatcgaacgaagggcctcgcaggaaagcgggcgccgcacgcttttcnagcgcagngtnagtnagtgggatngaagtaacatcgagcccccagnggccctgggccggggggtatataagcgggcgggcgggggccgaagctcgccangcacgcgcatactgtngatgggcatctaacaactngggggtgagggtcgggacatgggccagggcgtacggacgtcgcagggaactggcccatgccaagtgcttcgatcgtagtccttngccgta

SEQ ID NO: 579123 - DNA, 680 bp, Homo sapiens
caatggagaggaaagtcatgagataaagaaaaagttacatgcttgatttgtattgcagatagaggtctacatctgtggtgttctgtcatttcaagataaatgaactcagcataagagtcattgtaataaataaataaataagtaaataaataaagtaaagggaattcatgaagctatatctgaagctacactaacaggcccagaaaccttgcacatttggtgaaataccttttttattttgtattgaaaatgcatcttttggctgggtgcggtggctcacgcctgtaatcccagcactttgggaggccgaggcaggcagatcacaaggtcgggaattcgagaccagtctgggcagcacagtgaaacctcatctctactaaaaataaaaattaaaaaaattagccagctgtggtggcgggcgcctgtagtcccagccacttgggaggctgaggcaggagaattgcttgaatccaggaggcggaggttgccgtgagccgagatggtgccactgcattccagcctgggtgacagcgagacctcgtcttcaaaaaatatataatgaaacattttttaaatgaatggacttccctagtggtacaaaacttgtttaagactaactaaaaatctggtctgcattgggcagcggggggatctctagagtgactgaggctgaagctgga

SEQ ID NO: 579124 - DNA, 335 bp, Homo sapiens
ttggtcctggacactcgtgcgtgtgcacgtgaagatcggcgattatggtttgctcagtgtgggcattcggcgtgtgcacgtgaagatcggcgatttcggcatgctcagtgtggaccctcggcgtgtgcagtttggtcactcggcgttgcacacgccgaatgtccacacttaaggagtgcataatcgccgatcttcacgacacgccgaaggtccacactgcacacgccgagagcccatagtcgccgatcttcacgtgcacacgccgaatgtccaatgcgtagtcgccgatcttcacgccaagcgaccatacggcgtgctggagcaacccattatcg

SEQ ID NO: 579125 - DNA, 105 bp, Homo sapiens
accacgtgaaacttcttttatggttgaaaataccaggcatggttttgaaacacattctccaaaaacccttagatcctgaatgctttatttttttttaagtttata

SEQ ID NO: 579126 - DNA, 800 bp, Homo sapiens
ggggagaggctgtgtcaaagaatgaatggaacgcctactatgaggaggtggtgtacgtcctagaggagatcgagtacatgatccagaagctccctgagtgggccgcggatgagcccgtggagaagacgccccagatctcagcaggagctgagctctacatccactcggagtccacatgggcgtggtcctcgtgcatgtggcaccgtggagatcgttagccccttcaaccgtcaccgatcgcaggcgccatggatggtgcgccgagtcgcatgcgagggaaagcgcgagttgtgtccgtctaggagcccttcgtgtagctgaggtgagaacgatggcggagcacctgctgggcgtaaccatccattcccccctagttaacttgggaacaggggattcttggttccccatggttaatccaaatggggcggttgtccctgtgaagaaccgaggggagacggtgttccagaggtagcaggtttcgacctatatccgtgttacactggtgcagtcacggggtgtggggagtaagcatcatcatgaacggctgctgactagagcaaccttgaacccctgatcaacgctggagcttgggagggcaagagtccctgacgtacgtggacgagaactgtgacctgggacgtgggctgcctgacagcatcgcctgggggaaattcatgaacagtggccagacctgcgtggcccagactacatcctctgtgagccctcgaatccagaaccaaattgtgggagaagctcaagaagtcactgaaagagttctacggggaagatgctaagaaatc

SEQ ID NO: 579127 - DNA, 475 bp, Homo sapiens
cgcattcttcgatcagtcatggccgatcattcgcatgctggtcgtcgaccccgtcgacaggagcaagggactcgggcatgcgttgacgtcggaatgcttcgccagagcgcggcgcgaccgctgccggaccattgcgcttcacacgagccccatcatgacggtcgccttgccgatgtatctcaagatgggcttcagcaaggtccatgacgccccgcccattcatggcgtgccctacgccgtctacacgaaagtgctctgatcccgatgccgttcctgctggtcgactttccggtgttcgaccccgtcgcgctcgcgctcgggccgatcgtgatccgctggtatgcgctggcctatatcgtcggcatcgtgctgggctgggtctacgcccgctcgctgatcaagaaggaacggctgtggggcggcgaggtgccgatcacgctgccgcagctcgacgatttcatcctctgggtcacca

SEQ ID NO: 579128 - DNA, 1466 bp, Homo sapiens
  misc_feature (1330)..(1330): n is a, c, g, or t
  misc_feature (1337)..(1338): n is a, c, g, or t
  misc_feature (1341)..(1341): n is a, c, g, or t
  misc_feature (1344)..(1344): n is a, c, g, or t
  misc_feature (1346)..(1346): n is a, c, g, or t
  misc_feature (1350)..(1350): n is a, c, g, or t
  misc_feature (1355)..(1355): n is a, c, g, or t
  misc_feature (1358)..(1359): n is a, c, g, or t
  misc_feature (1363)..(1363): n is a, c, g, or t
  misc_feature (1380)..(1380): n is a, c, g, or t
  misc_feature (1383)..(1383): n is a, c, g, or t
  misc_feature (1388)..(1388): n is a, c, g, or t
tttgcttatcgtattttgtgctttatcttcgtcctggtcttttcctttctgctttccccctgtctcttctctcttgctgttcttgcttccttggtgccttctctgtgccttctctcttctctctcgttcttcgggcgctctatgattcctttcgtttcctgtgtcttgtggtgtctcttgtccctggttgtctttactccgtgcgctctttctctttcccatgtctccctgtttttcatttccgggtgtatagtctggtcgcgtttcttagccccctcttggttctgtacctccctttctcttttttccctccgttgcgttggctctttctttgttccccctgcttctgtgctttggtctgcttgctcttgtgcctggtctccctggtcgtcctctatctctttgtggtctcttcttgcgtgtgcttgttcttgttgctgtgctacccgttctctttgtttatttactactgtgtgtcttggctctcgtagtcgtgtcgtgctacttcgtgtcctatcctgttgctctgctagctgtcctgcgtgtttcttggtgtgtccttgtatcgtggcccttcgttgcttgtgtcgctttgcttgtatcgcgttctccccttgttggtctgtgctcgtcctgtgtcatggttcgtctctctgtcggacttcttccatgcgctggtgtctcccttttttcccccgtctccgtcctctggcccatgatcgcttcttcgtactgtgatgtgtcatccctgggatggcttctcttccttgtctctgtcactctccgttgcctcttgctcgcatgacggtgcttgcggagtgcgctgcgcccatgtcctcttggccctcatcacgctcgtccccctatgtctgcttactggctgacgccatctgatgctcctggtgcttgatcccttgcaccggttgtccttggtcttgtgtgtgtgccccctcacggtctccagtggccttctttgggatgggctggcccgccaatcgcctttcctgtgttactggcatatcattggtgatgtgggcattctcatctgcctctttgtcagctctcagccggcatcggtctcggagcttgacgctttggtctgtgcttcggtctcctgctgccatgccgtcacgatggatgcgcctacgctgctgctggtggccacacgactacttactgttggccttgatactgcgggcctgcacgacccctcagtttgtctcccttgttcctctgtggctgaggtgggagggggagggtggggtaggtcccccagcaagaaagagggacaggagcaccccaggcaggaccaaggagtcgggaggccctnccttctnnccnccntngtgngggcncanntgtntccccagagcccagcgntgncagantggattttgctcttggctttgcttttgcggcttcgttggagacagttttggaataaaatgtcccttgcaaaaaaaaaa

SEQ ID NO: 579129 - DNA, 307 bp, Homo sapiens
gggcatctagaggatccagactcggaccgttcttcctgtgtctgtgtgttgagcaactctaatcttccatgtctttgtgttgaacaactaaacttccatgtctttttgttgacaaactctaaccttccatgtctttgtgttgaacaactctccatgggtggtgcatctgaccctatcccaaaatggcttaagacgctcatctccttgactgtctgccatcccctcccaaaaataagtggaggctctgtcttttcctcctagtttgaggttctcttctcccagtgtctaaaatgatcaatatgcctag

SEQ ID NO: 579130 - DNA, 502 bp, Homo sapiens
cacgtgttccattatagtaattctccatggagtccagattcatcctggtggcgtccctttgtacatctcgcttttcttctggcatagttacttaggtctcgtaatctttgctttagcaatgtataaaccttcttcaaacagtttcttaaatatcatttcttcccgggtcctcattctcatcatttttgcacacaactgaactctataatcatcataatattttcgagcacgaacgatttgctgtcgattttcttttatctttgattgggtcaacctttgcctacgaatgcagtccttgaagtcttgcagtctcttgttatgttcatattctttcttgacaagggtagtaaggaggtcatgccttcttagggcttcttctatttcatcttggagtttcttctttgatcgattttctctacatgcttctttcttaagctgttcaacctgtgcaatttgctgtttccacatttagcttagtgttgggccagaaccacaaatatcg

SEQ ID NO: 579131 - DNA, 404 bp, Homo sapiens
tgctcgcagaggatcaccgagggtgcagcaattaatgtatatcattggaacaaagagagcaagggcatctgattaagcggcgattacagccggcaggaggacctatgggccagctgggttttactctagatgcagctgtcgtcccaccccagttctaccaccccacttcttccttcaccaacatgcaagttctttccttccctgccagccagatagatagacagatagggaaatggcaggcgcgcctatacgttgtacagtagttctatgatgtgaaaggggcagcacagtcattcaaacttgatccaacctcttggcatctacacaaagttaacacagctcccagaagtaaaataagaaggcaaggctggtgggaaggtacagggcatatgggctggccccgg

SEQ ID NO: 579132 - DNA, 109 bp, Homo sapiens
atctcctagacggacggggaatgtcttctttgtgagacactgagccacactaagaagccgcaggcttctcagagacggggcagacacatgcaatgagggatggtcagag

SEQ ID NO: 579133 - DNA, 1249 bp, Homo sapiens
tccgccatctcaggtctcttggctttgccaggacccatcgtagaaaactgatcgaccccgtttctgtaatccttatgggagaccaaccttgtgcctccgtggagatccatctcttcccagcctggaatacgcactggggaaggccaaggcctccaaaaagacgcgctgcctcctcgctccgcgattagggacttaatccggcaaggaacgtccacaacggcaggtagtaccagatctagcctctccgacaacctcgcttccttgcattcagcgcgggccttgaaaagatccggaacccattcactctctccgagagaaaaaatcgtgacgacagaatactaatagttcttactgcacgcaactcgccatagaccaacccacgttccctatctcgaagcttgactatcggccaggtactgcacctcccagttttacacctgagtcgcatttcataatacactagttacaccctggttgtacacaacacactgcacatgatttatggtgacaaatgctagcccctgtcttttctctaggtgtcctgtaaccttggaccaagtttgtgcttcatctaacgggcagccaacgcagaccatgacaaccccttggtagaagagccaaagaaagtgggcaaacaggacttgcgcttagcccttagaatcccaagctaatttccgcttggcccacgggttcctcccaacgcccttaagctgggttccattggggtccatttcgcgagacccactaagctttagctagactgttcaattcccgggcagagcgcgaattattcaccttatcccttggatctcttccgcaatgccatttcctacagcacaacttgagcctcaaaaggaatccagagcgataactttaaaatactcatacctggacgaattcttacacgggcccattgcaccccgcgtcattcattggattgtaactttataccaaaaagccacaaaaacaacctgcccctggtcggaacgacatgtcttcccctttcacatgcgatggccatcaatccaggttggcaaccgcctttattaggggatcgaccactaccgatgagtcaacaggatgaggacattcacgcattgtagagcactgccctgctcttagtagtgcgcattttcaagcgcccccccacaattaacaggtcttgacactcttaactacagccggcgtcgatacaactcctacatcatgcaacgtagacatccatacatcgtacaatgtggccgcaacc

SEQ ID NO: 579134 - DNA, 783 bp, Homo sapiens
tggaaatgagagggtcaggtcctttttaaacaaccagtggctcatgcctgttatcctagcagttcgggaagccgaggtgggtggatcacgaggtcaggagacggagaccatcctggcccaacatggtgaaacaccgtctctactacaatacaaaaattagcctggtgtggtggcacgcgcctataggtcccagctacttggtgaggctgaggccggagaatggctggaacccgggaggctgcgggcttgcagttgagccgagatggcaccaatggaactcccatgcctggaggcaggcagtgaggactccgagtcaaaaaacgacaaacaaagaaaaaaaacaacaggggggggacccgactcaaaaaaacaccacaacacaagagaggcacaaacacaaaagcatcagaaaaacaccaaccgggatttatcgtgaaacaaaaggcggcgcccacaagaagagggagaagaaataaacaaaagaaaggacacgggcccacgaaacactacacacaaaacctcgcgcgacctgggaacacaaacatcgggacagcacggcgcggaaaatcgaggggaacggacaaccaaaaaccaacaggcgcaggcaaacaactagagcgaagaacaccacaaacacgggtaacaacagccacaacgtgcacacacacacgcgaagacggaggccaagccgggtaacaccagacagcaaacaagcgcgagagcgaccattcgcgccacgagaaacaaggaccgagaagaatacacgaaggaccactgtataac

SEQ ID NO: 579135 - DNA, 295 bp, Homo sapiens
aagcactttgactggcaccaccaatcagagtgttgtgaccagtggtcttggatcatcttggtccttccagcacagcaggttcctaacctttaggggccagagacaaagcctgggccagaaaccagtcccccagagttagagcatgcagttcaggagtcctgagatgagcctgagcctcctaaaatattccagaaatgaaaccagtcagttgaacccaccttgtaccaaaaccaaaccctcaaggccatcaaatagaataaaataaaataaagctcagccacaggacatcaactta

SEQ ID NO: 579136 - DNA, 433 bp, Homo sapiens
tgcccagtaacttctgaccatttattttccagccaaagtcattaaccaaaccaattcagaaatggcagtgcttcccgaaagaataactataccttaattattaatgccacagtcagaaatgaagctggactcttctttgggtaaaggttggtgggagacagtagaaatgaggggtgtaatagaagctgagaagatatggtcaaagtctgagttaaagtttagagaggaaaagacagtttatcctggccctatttgtcaataaattatttgaatagttaaagtaaattttgtgagggatagagttataggttttctctcttgtattttcaaataaaataattcattctgatgttgcctgaccttgttgatttagtcttcatttgtcttatttcttttatagctctctagcctttcttttcccttttcttttgac

SEQ ID NO: 579137 - DNA, 1415 bp, Homo sapiens
agcggatggttgtgatgatcgccgatgtgaggggatttgaaccatcgtacaatcaatccatatgtgaccaatggaggagaagcagatcccgaaaagtacgagaggatacccgtcaagatagaaagactgaggcgcttcaatgacaaggagtagtgtcatatcctcaattaggtcctataggcagacggtaagttcatagagtcaagagggctaatgacgtccagtgttctgatttgagagacagacagtgtgacgtattgccatatgacggaaatcagaagaactccgctgagtacctatgtaagataagcctgcttcttgagactaacggaattaccgagtcaagccagccacagtaatctagaagggacttgaggaagtacggggggtgacccctctgattgacgtcggtgcgcatgcatggtttagtgcagcagtggcccttcaggtgaccgtgtcattcggtttcagtatgtctgggtgggaaggcctagataactggtcgcaatggaattcctgatcgaaagaaggggcggctagggcaagacgccttagaaggcacgttactcgcccgtgaaaaggacgctgggggcagggcacgttcaacaccttgcgattgatccccaatgggccccggtcatgcgtagggagacagttccccgtcaaagcacagggcgtatttggcccacgtgctggcatcatactgccattgtttcggccaagttcactcccgaaggactttatctggggaacggttggcccggtcccgttgtgtggccttggccgccgagggggggtcccatccaaaagagggccctggttgaccaggacggtttcgacctagacccaatcccaaagcatggtcattcgtcactagtctgggaggaaatccttttggcatggggacatcacatagggccctttgggattggctgaaccaggaagttggtaattcccccttttctttccacattatccgggaaattggaacggtgggggtctttttgtccccaacaataataaaacatatagcaataaagttgctttccacacgcaggttagaataccccggggcacaataaaagaggagccagagaaaccctactaccaaagacggaggggagagcctcctggtacaccacctgctgctagtgtgtttcgccccacttatacctagtagaacaggggagaataacattctccacacactcgttgtggtgggtaacccactactggtgtgacacactacgacgttcgctaacgccgtgggtagtgaaacaatgggtatatacgcggagccacgacattctaacccagcagatagacagacaaaccgagaagtagcacacaacaacacatcagatgtaatgacacgtaagagatgacacaaagacagatggacgaaagtagaggca

SEQ ID NO: 579138 - DNA, 216 bp, Homo sapiens
catgtggcgtttcgtggtactagatgcattagcgaaaaggttaaggtaagtttggttcgcgagtgaagtaatagttaagagctcagaaaaaatgtgcatgtgctgtagttttgtattaaatcagtcattgcatatgcagctagtatcaagtacaaacaggtagtttacctgtttatagtagtgtactaacaaagtctcccttgcgacttcagggtt

SEQ ID NO: 579139 - DNA, 178 bp, Homo sapiens
  misc_feature (128)..(128): n is a, c, g, or t
attatggatatgtctttggttacactagcttagtagactatacagtagttgaatttgtaaaagtatatgaacacctagtgagatttcaaacttgtaattgtggttaatagtcattgtattttcttgtngaaactgtgttttatgaattttaccctcccaaatcagacaaacaaaatga

SEQ ID NO: 579140 - DNA, 446 bp, Homo sapiens
  misc_feature (16)..(16): n is a, c, g, or t
cctggctctgaacttnaggatatttttaagctaagtgctaacacggtgtcactatcctaagttcagagccaggtctggctctgaagcttaggctcgtatctgttttcacattcagtcctgttgctgttatattgttttgattaaagtaaatgaagaaaatccagcattacagatagacggtggggtttatgtttatggtatatggtcttgatttgtgtgctgtatggtccgagatggattctcactctgtatgcgcaggttggagtacagtggagtgatctcggctcactgcaacctctgagtccctggttcaagctatcctcctggctcagcttcctgagtagctgggattacaggcacacaccagcatgcccagctaatatgtgtattatcagtagagacggagattcgccatgttgggcaggtcgtgtctcgaactcctgacc

SEQ ID NO: 579141 - DNA, 885 bp, Homo sapiens
  misc_feature (36)..(36): n is a, c, g, or t
  misc_feature (101)..(101): n is a, c, g, or t
  misc_feature (107)..(107): n is a, c, g, or t
  misc_feature (162)..(162): n is a, c, g, or t
  misc_feature (164)..(164): n is a, c, g, or t
  misc_feature (205)..(205): n is a, c, g, or t
  misc_feature (214)..(214): n is a, c, g, or t
  misc_feature (219)..(219): n is a, c, g, or t
  misc_feature (226)..(226): n is a, c, g, or t
  misc_feature (256)..(256): n is a, c, g, or t
  misc_feature (263)..(263): n is a, c, g, or t
  misc_feature (288)..(288): n is a, c, g, or t
  misc_feature (292)..(293): n is a, c, g, or t
  misc_feature (301)..(301): n is a, c, g, or t
  misc_feature (328)..(328): n is a, c, g, or t
  misc_feature (338)..(339): n is a, c, g, or t
  misc_feature (360)..(360): n is a, c, g, or t
  misc_feature (375)..(375): n is a, c, g, or t
  misc_feature (417)..(417): n is a, c, g, or t
  misc_feature (568)..(568): n is a, c, g, or t
  misc_feature (589)..(589): n is a, c, g, or t
  misc_feature (611)..(611): n is a, c, g, or t
  misc_feature (631)..(632): n is a, c, g, or t
  misc_feature (652)..(652): n is a, c, g, or t
  misc_feature (655)..(655): n is a, c, g, or t
  misc_feature (666)..(667): n is a, c, g, or t
  misc_feature (671)..(671): n is a, c, g, or t
  misc_feature (673)..(673): n is a, c, g, or t
  misc_feature (688)..(688): n is a, c, g, or t
  misc_feature (697)..(697): n is a, c, g, or t
  misc_feature (700)..(700): n is a, c, g, or t
  misc_feature (724)..(724): n is a, c, g, or t
  misc_feature (732)..(732): n is a, c, g, or t
  misc_feature (745)..(745): n is a, c, g, or t
  misc_feature (749)..(749): n is a, c, g, or t
  misc_feature (752)..(752): n is a, c, g, or t
  misc_feature (767)..(767): n is a, c, g, or t
  misc_feature (782)..(782): n is a, c, g, or t
  misc_feature (785)..(785): n is a, c, g, or t
  misc_feature (788)..(788): n is a, c, g, or t
  misc_feature (869)..(869): n is a, c, g, or t
gtgggggggagggggtgggaagggtggaacgggggngagaaattgtaggagtgcgaagaagaaggataaaagagtttaaggtggaagagtgattgagtgcnggtatntggagtatgaaaagaagagaagggaaaagggtggtggaggagatgggtcaaagancngagggaagatgtgtgaaggtggaaggaaatggagggtggtncagaaaagnaaagnagatagnagtggggtgaaaaagggtgaggtggagtgnaggttgntggaaggggatgggacagctccacntganntggatgtntgtggtattaatgagaaaaggatggtnataaagaggnnacagttagcaaaaacaatatnaaagaaacttgagtnaagatgattttgtgggggtgggaaaaagaggggggatttatntgaaggaatggaaatgatggagtttgagagactagtggtgagggtagtatgggtaaagatggagaaaaatcttgctgagtttggaagaaggggagaaaagaatttattaataatgtgtaaggagaaggagaaggtagagaaaaagggggangaggtgaaggggagggttgtngtgtgtgagaggaagggggagnggcgagatgtcgtggatgcnnagatggagatggtgagcccnttngagggagtggnnacangnttcaaggagcaatanaggacattngcnacggccctggacactaccagggangagctgcncgtgaggcccatntccntcnaggtggatggggagnagctcttagacgccntgnagnatgaactggtgaccactcagcgcgtcctgggagaacttgatgttggtgattgggaagaaaatgtggaggtgctggacttantgagcgaactcaagga

SEQ ID NO: 579142 - DNA, 252 bp, Homo sapiens
  misc_feature (1)..(1): n is a, c, g, or t
nctcttctccctgacaacaaaccttctccttcctgcaccttgaccttgggctttcagtgcccagaactgtgagaaataaatttctgtggtttataagccacccagtctatgatattttcttatatcagcccgaacagactaagagtacatatacaccatggaatacaccatatacaccatgcaaactaatgcaggaacaggaaactaaacaccacatgttctcacttataagaaagagctgaatgatgagaa

SEQ ID NO: 579143 - DNA, 124 bp, Homo sapiens
tctttcctgccagtgccgacagcaacggtcatcgattacaacgggaacgcacgctggatggttttaagaaatacctggagagcggtgcccatggataggggcaggggatagatagacgatctcg

SEQ ID NO: 579144 - DNA, 128 bp, Homo sapiens
gtccgcgggggacgaaaggcacccactgaaccgcgctggctgcgcgttccacaagcgttgcccgtatgcgacggcgcgttgcagcagtgaagagccgctgttgcgtcctttggataaccggcaggtgg

SEQ ID NO: 579145 - DNA, 491 bp, Homo sapiens
cacgcagtatctacgtgtgacatactcgagtataaagacatgtatgctaataacacatgagtgaggaggatggtaccctcagaggaaaacctgtcggagatcaaaggaagtgatccaaggcacatgtccccgacaagaataggagctttcttgcagcgtagaatagaccataacaagttgtaaaatggctgtctctgtctaagagcctgctaatatcctagagaggatttcgcatatcttatctctgatccttaaaagcactcttcaaggtaggcacaagccccactttacagatgaagcacatgaggtgaggacaggattcgcccgaagacacaaaaggcagtagatggcggaatcagaagtcagacccacatttgtcctggttccaagagcatgagacaaactttacagaagtacagacgcttccacacaaaacaaaccaggatggacccagaattgccacatgcctgtctgtacaacatggcgaacac

SEQ ID NO: 579146 - DNA, 989 bp, Homo sapiens
agcggtggttcttcgaaagagaagacaaagaataaaaatagaagcaaacttgggatctcttctacttataggtttggctcaagaccatgccaggtcaaaccttatctgggattctcacaaaccacgagaagaactgaccacgatactcttgaactctgaaatgagagcactttaatattgacagagaaccttggacagtgcaacatgctgactctccctgcgaacccacccactgacgcttctgacggcttaacactactgaggctgccctgcgcacgcacggacacacttcccacactacggcagacctatctacccctgacgcactttactaatcgggcaaggaaacgcactgagcacactgcacacgcaacagctgggattcaaactctacacgcagcaatcgcgtactgaccatcttttcttccaagtgcagccctcttactccactcggcccttgctctgccctccaccccgctcaaaaaacacggttcaccacccacttgcaaaagcttgcctcacacctgctcctctacccaaacgccccccctgtgcccctcaactctgcttctacctgcgccacggaattgcttcacccgcaaccaaaccctagccgcacccccttcttctaccacgcaactaacccccaaggcaactacttacttccaacttccgcgcaccacttgcttccaacgcaagcgaatagcgctgcccaaccgacgtctaacttacacacgaccccttctggaaaaccccccaaccgacacttaagcaggctcctccgcacacctcccccctccccctctaccccactcttcaaacccacacaaacgcgttttcggcaaacttccccccttattaccacaccttacccacgccaaccaccacaccactggccttttagcaccgctgggaccttctcttccaagcttcgggcaaccttgtcccagagtgaactgtgccaaacccttaccacagccaaaaagttc

SEQ ID NO: 579147 - DNA, 370 bp, Homo sapiens
  misc_feature (4)..(4): n is a, c, g, or t
cccnggtgcgaggaatgctgagtggatgataattgtgtgcgatgggttcgctgctttgtctatcactgtccgagccgaggttgtgggtagctcgatgggtgcttgtggtcgctgctggttgctgcctttgaagagctttcgcggcgggcgaaagacttaaaagcatttgcggtgaacgattccggggccggactcgtcgtactcctgcttcgagatccacatctgctggaaggtggacagcgaggccaggatggagccaccgatccagacggagtacttcctctcgggtggcgcaatgatcttgatcttgatggtcgatggggccagggcagtgatctccctcagcattcctcgcaacaggggtaccgag

SEQ ID NO: 579148 - DNA, 330 bp, Homo sapiens
ttctcagtgatgcccgtgccagttttacctggagtgtgctcttgggatctccagtagcatcagttgtcggcatgtcgtcatgctgtagggtttagggcaattacctctctgtcatcagagatcgctgtctggattactagtaggggccctcgggagtggagatttcctgctggtctgtggagctgtatctcttatggaaggatctgtgcccactctgtacacttgtgctttcgcctctaactgcagtgctgcttctggggcctggaccaccatgtgaggtatgattccctctcattatatataaagaatgttggtgttagtctgggaaaa

SEQ ID NO: 579149 - DNA, 150 bp, Homo sapiens
gcccaacttggtgcctcccaagatccccgatggagagagagagaactttgcatgacatccaccggaagcgcatggagaaggacctgaatgagttgcaggcgctgatgcaggcgcacttgcagaacaggtagaacagaggaggaggatctc

SEQ ID NO: 579150 - DNA, 313 bp, Homo sapiens
tacacaacctagggtcagtttctgcaggttgtaagccatttaccaagatagttgtaggtaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 579151 - DNA, 264 bp, Homo sapiens
  misc_feature (95)..(95): n is a, c, g, or t
gatcatgtaagaaatcgcaaaattgagttgcatgaatccaccttcgatcccgcacttttgaactctgtcgtgactaggaacacctagctgatggncttgaaaccagcctggggtaacaaaacaagcccttgtatctaaaaaacaaaagggcaggtagataccagataaataatgttgcaggaagggggtgataaaatacagaaatgtgatacacaggaaaacctcaaatggtggttcaatgggttcccagtgtcttaatctgtg

SEQ ID NO: 579152 - DNA, 114 bp, Homo sapiens
  misc_feature (7)..(7): n is a, c, g, or t
  misc_feature (15)..(16): n is a, c, g, or t
  misc_feature (42)..(42): n is a, c, g, or t
  misc_feature (51)..(51): n is a, c, g, or t
  misc_feature (64)..(64): n is a, c, g, or t
gtatgangcattacnncttaaagaggaaccagagcttctgcncaactgtcnaccttgacaaatngtggactttggtcagtgaacagacacgggtgaatgcgtccgtcgaagttg

SEQ ID NO: 579153 - DNA, 284 bp, Homo sapiens
gtaatgtatcgcccaacactagatatgaatccattaacactgacatacaattgaccagctgttatagagccattcttgtatccctcgcaaggctgaaatagggggagacagagagaaacagacatggctagaatacacagctcctctagatggcattcctcgttaaaacacacctcataggtcagaagatgccactgactcactcctagcatttcagataaatatataaataacattaatacattaactgtctgcacacttgggtgttgggagataacactacg

SEQ ID NO: 579154 - DNA, 266 bp, Homo sapiens
  misc_feature (37)..(37): n is a, c, g, or t
ggacgagaaggcgtaaagtattcgatggagcatcccncttcggcgagtctcctcccgcctcaccacagaacaaattctgtacaacataaaacaagagtataaacgaatgcagaagagaagacatttagaaacgagtttccaacatgacagatccgtgttgcacttctgatgcacagccacatgcatttctcctcacgtggaccagcttcaccagggacttcatactgcagcatcctcaccattaaaaaaagaacagcccttattta

SEQ ID NO: 579155 - DNA, 1528 bp, Homo sapiens
gcccactccaccttattaccagacaaccttagccaagccattttacccaattaacgcatatggcgataaaaagattgaaacctggcgcaatagagtatatgtaccgtcgccgggaacagatgaaagacattgataaccaagcatgtatactagcacatggactgatcctcgctatgaccttgctgcactacatgaagttacacgtaggaatataatcgtttggcaaggatgagccatgagctaagaccctccgtaggatccagatcgacgctatcctggtgaacagctatcagcaggcactcccgtctatgtaggcacaacataagtagtggaaaggactgtactacgcgttaagacgcgcgaacgcacagctcaacgcaggagcctcgtggatggactcatgcgtgggctttggtaccgttcgagtaagcgaccgtcgtatgacgtaacccatgcttatgagactcttgccccaacaggaaaaccctgcatagagaatcactccttcgtttcgagacatcgtgaaagcgtgcttggatggtccccagacagtgaggtgaacaccaagacttcgtaatgcggcaccgaccttgaacgtgaagagaacatagcgcgttgcataacgcaccacgaggttaacccaagcatttttagaacgagcccgactagtatgagggtccgcttgagaacaggctgagtttccaacgcaaattctaaccaggacatacgcaagtttcgagcaggcttccgaatctaactcctctaaacgtcaacttctttgacaatacaaagtcctctccacacaagccactttatttataccttcgatcttcttcaccttccaacaagcgcccaaaattttggagcaaccccaaatttcataattccaaaccccccttaattcacgaaacacaggaaaatcttcaacaatttggctttcacggctacattacaagtttaaacgcaaattcgcacacacaaaccaatattcctaccccattccccagtccatttacaccgccccttcggccagttctaatgcacttctacacaacacccaatccttgaacatctcttggacccacacactttaaattacaatgaccaccacaaataattccatacatcaacaatcacgaaacaccaaagaccacatcgtccacaattctacatttttaacccctcttgcaaactttaggttaaaaatccctcatatacctaacacggaggcaccttggcattcccacttcaacggatcacctcgggggttagagacagacacaaaaggttacaatacacgggaaaaccttccgccgcacaagattccttttagccccccctaggacctgtgatattagccccaacaagcagtccgattgtacagcccattccttcaggccatttcaagcccaagctaatctcaagagaacgagcgacacccggggcattggaccccaaggcggacaaccaattggtcttacaacatgggagccgggtggggaagcccctaaatccctggttgcaaaag

SEQ ID NO: 579156 - DNA, 176 bp, Homo sapiens
  misc_feature (79)..(80): n is a, c, g, or t
ggatgcattcaagccgccaaggtagggaagccacatgcaccatcaggcccttgtttggggaggctttccgaggagctcnntggcatcactttagacgggcctttgcttcccaagccccgcaagccaagccaagccttgcatttccggggcacttcccgttgaacttactgtacaat

SEQ ID NO: 579157 - DNA, 142 bp, Homo sapiens
gcagctgctgctgcggcgactctgaggatcccagccaaggaaatggaataaacagaacgactcagatgatagcagacaggacattagaacagttgttatatctgtagtccatatttttaaaatgtagctgcagacaggacat

SEQ ID NO: 579158 - DNA, 208 bp, Homo sapiens
ctgcattggccgggaattgaacccgggcctcccgcgtggcaggcgataattctaccactgaacaaccaatgccttggaatacatagataaggctggaaatcgtatcataaagcttcatctccaagcatatttttcgctttgtgggctcagctacatttttcaccctaaaaaaagcagtgctttctccccgtcggggaattgtcgacgc

SEQ ID NO: 579159 - DNA, 246 bp, Homo sapiens
cagtagtgtttcttttgttgttgtttcttttttgttatttttccagaaaagggcttttggcgtggtcaccccagggtgtgtgggttgcgcggggggccacaaaaaagagggccacacagaggaaaccaaacacaatgagattaacaacagaaaaagcatgagacacaaaccacaacaacaaaacagaacacaacaaaagagaggaagaaatatcaagaggcgaatgagtaacacggagcaagaggc

SEQ ID NO: 579160 - DNA, 335 bp, Homo sapiens
agcagcatcatgagtgttatgaatctgatatcaaacctctgtattcactcactcattgttagatgtactagaagtgctagcgagtagtcagaggaatgtgtccctctcctcatatatctttcacagagctgattgtaatggtatgaagcaatgctactggaggtgtgtcacagcaactagatggtttccacatctgtcatcatgactcaagtgaatgctagcacaccattttcagtgagccctgtttacacagaagaacacatagttctattgtattctttctaatatgtacttagaaaaaatacacactggttaaccgcggacgctagcatgga

SEQ ID NO: 579161 - DNA, 276 bp, Homo sapiens
ggagttggaagtcgcagtaagctatgattatgccacggcactccagccggagtaagaaagagagcaagatcttctcttaaaaaaaaacaaacaaaaaaaactacaagaaaaaaacagtactctcaaagggaggtacgagatcagaacctggaaagtcagtgacggactaggggaataggaagtagtattggggctgacctgaagttgaggggaagggcatctacagtggagggaaagggtatgggcagagtcggggtcacgggttagggatgcggt

SEQ ID NO: 579162 - DNA, 153 bp, Homo sapiens
atggaggaggtgaaagattgcaactgaaaactataaaacatggctgaatgaaattaaagaagagctaaataaatagaaagacaccctgagtacatggataggatgatgtaacacggattaacaggctcagcttctacccagaagcaagtctac

SEQ ID NO: 579163 - DNA, 1328 bp, Homo sapiens
gaaggcaaaaccaaagaagttatcttcagtgtggagtgatgggtccgtgcaaaatgttcctgagtgggccgccctgatgcccatgatgatcccagacagagctaggcacccacctacagcctggacacacgctcggagcttgccttcttgccggctcaagctggagtgggtctatggctacctgtggcctgagactgccgggccaacctttattttgctgaccacctggggacgatagtgtacttctgtggcctccgtagccgtgctatacagcgtgcgaggagcagacgtgcagcgacactacctgggacacaacgatgcacatcaaatgcttggccatccacccagatatggtcaccatcgccacgggcacaggtggtcgggaaccacctaaggcaagcggaagccgctgccgccccacgatgcggcatctgggactcagatcacccctcatccacttacacgctgctgggcttggacggtgtccgacagagccgtgtgctagtgtgggctatctccaaatctaatggactgcaacctgcctgtgctgcacctgcatgacattccaactgatacacactgctctccgctagtcagactggggcaaatgacgacccacgtgctggctgtcaagtgctccaatgaaggctcgacatgctggcacactcaacccaagaaaccccaactgtgacttaatcaccctgcgcgcacagtctcaacactcaactccggacccatgggcatgcgaggcaaattgtagaagtggacaggcccccctggacaaacactaacaagccgacacgatagtgcgtggggacaacatctggcacggctgtccacatgtaccgggcaactatggtaaacacctctccaaggggctacacatcgtcaacgcttaaaaccgcgttagctgagccacccacagacgctagactaataacatcgagccgacgatgtataaggcaacacacacgcgaacacacgtacaaaaaaacaaaaagcgaagaacaaagaacagcactcccgaaccaactcgcgccgaacccaaaataccttccagtccacgttcaccacaatcaccatcaaccaccctcctatattctttaaatcaccactaaccttgaatttaaacaactagacacactaaatcaaacccatcacaccaatccaccaccctaactacaaaactacacaaacaccccaccatcctgacacctacaacctacaacctccctacaacacacatacactaaccatctaaccaaaacaccaacaccccctaacacccaacaaacacccaacaaacctcacaaccataataatccata

SEQ ID NO: 579164 - DNA, 159 bp, Homo sapiens
attttcgctggactgagcaattgtcccccaccactttactgccctttgctgaaggtgctgaacacctgtgccttctatcaggggcagacgggcgtgaggcttctgactcctggtggcctgtccgtctccactacccagaccatactagtgccgcacctg

SEQ ID NO: 579165 - DNA, 653 bp, Homo sapiens
cgattgctctacaacggctatcttccaatcaagttccccttctaaagcagcttaccctgtaaaaatgttaccattaccctggaaaaatattaatacagcatagccttaatttaatccgctcctttttagtcagcctgtcgccattttcagacgccagtataattaacatgcatgcaccacattctgcctatgctcaaactggcgattcacgcttcactgctacccctggctcctggccgcacctgtatctccacgcagcgctgcttcgctagcgctctctgagacgcttaccatgcctcacgccatcgcgataataacacccctaccctcgctgcaccgacctttccctatcatcttgtatttccggcctggccctcctcaacgctctcgtcacccgtcctgcttcccctcatccaccacctcgccgccgtctcgagcctcgctcataacccatgctccgcaacgctcctcttgctcccgccccccccgcacccctccttgtccccaccgcatgaccttcgctctccctcctcccctcctcctcattcccctcgccttccccctccctccttctttcaccccccttacctccttcctcgtcacccccctcccttcctttcttctcccccctcttcccccctgcctcctctccg

SEQ ID NO: 579166 - DNA, 330 bp, Homo sapiens
cgaacctccttcagaagattgttctacacctgtgctatggacatcctggaactgcccaaattggagagggagtagaacactcctggggtgatcttgaagactctgagacggacgatgatgaaggcagtggtgatcaagctatcattctagatggtataaaaatggacactggagtagaagtctctgatataggaaaccaaggtaggtgacactttatggcacacttattactatatatcacatacatctagtattaccgtatagttatatatatcatgcataatatgtcacctaccttggcttccaatatcagagacgggtaccgagctc

SEQ ID NO: 579167 - DNA, 243 bp, Homo sapiens
  misc_feature (41)..(41): n is a, c, g, or t
aaattttttttaaaaaaatttttttttccccgttccggggnaaaaggaggagggccagtccctttttttacctttttttccctaattttaatggggaagaattttgggaaaaagggcttttggtttcttttttttttcaaattaaaggaaaatggggtttagttgaggaagaaaacaacgttgtttattaaagttttttctttttttggccaattttatttaaaaacaggaattttttttcca

SEQ ID NO: 579168 - DNA, 169 bp, Homo sapiens
taaaaaagaaaccaaaccggagttaacaaggatatcggagctaatggtaaaccatcaaccagagggacccagggcagtataaagcatggaagcaagggagtataatctcacaattataaacccactataagacaaccattggataatcattggacaaatccctaggtat

SEQ ID NO: 579169 - DNA, 647 bp, Homo sapiens
  misc_feature (464)..(464): n is a, c, g, or t
ccagggtcttgctctgatgcccagagtacaggggcgcaatcatggatcactgctgccttgacctccctgggctcaagcgatactctcctgaaccaccctcctgccccccactgatgggactacaggcatgcgccaccatgcctggctaagatgtatatttagtgtagagacgaagtctcaccatattgcctacactggtctaggactcctgggctcaagtaatcctcctgcctcagcctaccaaagtgctgggattacagtgtgccactgcacctggcctggatggatccttaatgacttcaaatacagatttcaagtactccatagcatataaatccatgctcattcaagaccattaaaaaaaatcagaacagcttataacaattgttatatagcttctgcaaaaatgcaactcattacctgcacatgtccaccactggcatctctcatagtgcctacccacntgcatatctaatgtgacgtatacactgccatctctaatctggctagccactgccatatctgatataactcagccactgttgtgtgagaaggtttaaggccaatgtaactaatgaagaaaaatgtctttatatgcacctgcatttatttattcagaagatgtcacgaattcttgagtatgtgaa

SEQ ID NO: 579170 - DNA, 238 bp, Homo sapiens
tctgagacaaagtctcgttagcctgggctacagagcgagactccatctcaaaaaaaaaagaaatgaaggcagtcgggagtgcacctgaggatactgatgcttggagcctggagggccagaaaagcctcggagtgggtggcgttggcacggggcctggtggatccagggatttaaggctgaagggcgtggctgctggaggaacagcaagagagagagagacatggagaatggtgcaaag

SEQ ID NO: 579171 - DNA, 998 bp, Homo sapiens
tcgccgggaggctgccctgccgagttctgctgccagctgcctgaggcagcctcgctgtgccccatccctgtcccgccgggcactctggagtggcagctgcgccgtgatgtgccaatgtgttgcccctgctactgtgccctgtgctgtgtgctgatgctgatgctcgtgtgcttgcatgcatgcccctgcctggctggtgctgcactgtgcaacttttggagagtgctgatgcagcatgccccgtgcagcgtgtggctgtagcggcaatgaccccttggctcggggctcatcgtgctcctgggcagctggagcctgggggactggggcgccgaggcgtgcacatgctcgcccagccacccccaggacgcctttctgcaactccgacatctgtgatcctggtgccaatggtggtgcgggaagaagctggtaaacggaggtggcccttcggcacgctggtctacaccatcaagcagatgacgatgtaccgaggcttcaccaagatgccccatgtgcagtacatccatacggaagcttccgagagtctctgtggccttaagctggaggtcaacaagtaccagtaccttgctgacaggtcgcgtctatgatggcaagatgtacacggggctgtgcaacttcgtggagaggtgggaccagctcaccctctcccagcgcaggtggctgaactatcggaatcacctgggttgtaactgcaggatcacgtactgctatacctgacttgctttgtgacttccaagaacgagtgtatctggaccgacatgctctacaaattccggttacctgtgatagcagtccaaacacttacgccttgaatacgggcagacaggagcaggtaactggcagcttataacccgagggattggggaccccagggattaaaccactaatcaatagcgcacaaagaacccttatagcagaaacattgcccaacgaataataccacacataccagtagattatcactgtagagtactcttcaa

SEQ ID NO: 579172 - DNA, 126 bp, Homo sapiens
ccttaccactctataccaccctataccacctataccactctataccaccctataccacacgtgattgctgcttggctgttgtggtttactggtgctggtggtgtagcgctggtgtatcctgtagat

SEQ ID NO: 579173 - DNA, 233 bp, Homo sapiens
gcccagaggcgggtgcatcacaaggtaggagttcgacgaccagcctggtcacatggcgacaatccacgatctctactaaaaacaccaaaattagccggagtgtacgtgcctgtagtctcagactactatgagagagagctgaggcagagagaactcacttgaaacctgtggcaggcagaggttacagtagagccgagactggcgccatcttcactaccagccctggagcgaca

SEQ ID NO: 579174 - DNA, 600 bp, Homo sapiens
gagacgtgcaggtgctggtgagagaactcgcgtgcacgaaaagggtaatcggaaaatgatcgtcgtacttcgactagtaggactgctctcgggaggttgctcgacgcggaggatcgtcagctgataaattcacttcgaacttagaatgacaggacggacatgaaatggcctcatttgtaatgtactctttggggttagtttgattgttttttacatttataagcctgtttgggtactctgattacttgttagaagactcgtaagggttaaacaatccacattattacagattgtctgatttttacgaccagacaagaagattgaagctctaagtgcctgaaaacccttttctacagagtagttgtttacacttcccttctgagaaccatatgaaaacaaggaccttattggtctgttcaccattgttacccctagtctagtactctgtgtgtgtgtgtgtgtataacatatctaagtgagggacctttcattcacatgactagaatctaaacaaaaataaccggctttaatctaacaggtgcataaaaactagaggatacctaatatacttcgggcccatctgacttctgggtaaccttc

SEQ ID NO: 579175 - DNA, 380 bp, Homo sapiens
cccaaaaggggtttattgggatggttccccacttatcttgactcaaagggcttttagggctgcttaattacaggggcctgttgctggctgctgaaatagggggagctgttgggggaactggccacggacccggcagggggttgggtcccaacactggaagcctgggcttgcacagggcccctggaagggttttgctcctggccagggggaaccagggagcggaaaggcatatttcctggcttgggcttcaacagaaaccgggagttctgctcgggacttaaaggggacatttgttggggaaaataacccaaggggggtggttttgtttggccacacccggggctgcctcccccacagtctgttttttaaatgagaaaggg

SEQ ID NO: 579176 - DNA, 378 bp, Homo sapiens
ctctaaacccatttctcttcaatccaggtgacaaagggcaccagtgaatctccagacaactgaggtcctagagtctgttctcctggaccaagctcctctccaaactccttgcccatcacaccacattgactttactatgtccttcttctgtgaaggaaggctgtatggtgctatgcgtgggtgtggagactcaccaatccatcatgaggatttgttttgcaatgacagaggaaatctaccattgtgtattggcaagggtggggccctgaaaattcatccagtggtcttggatatcacttgtttttaaatctttttgttgaagcataatatacaagcaaaaaaatgcactaatcatatgtgtagaacctgatgaatttt

SEQ ID NO: 579177 - DNA, 950 bp, Homo sapiens
  misc_feature (612)..(612): n is a, c, g, or t
caaccggggctcctgggcaccacccacaaacagctcccccgcagccaaattgcgggggattatcacaacccccgcgacagtggcgcccctgttccaaacagggggagccaaccctctcccagggcgaccactacatacaccgtggcaccacgccccccacggagaacctaaggggtccgccccctgtggcaccaatcccccctaccgcaggggggccctccccccacgccggggattcaggatctccggtaccccacccgccgcctgtcattaccgcgagccagcgcctcctccccccgcgaagggccgaacaggccaggggccgcaactctccgcccccccccccgcacttgggagcagcggccccctctccttcaccacgtgccgggaattacttcacaacaccccaccggcttctcttagccctcttcggtgcaccacccgcgtcgtacacaccacaaccacgtttcagagagattcttcccccccccctcctgacttacatcagtagaaacaaaaagcccttctcttctcacccttacatagatagataaatagattcaaccacctccacgccacccccattgtttatcttcttgtctggccccccgntcccccacgcccctcaagaatacatactagtcttgcgactgtttaaccccccccctttttttccaatgctccaccaaccacccaacggcactttgttattcacaccacagtgcgatgtttcccaacgcaacaaacacaagccttctttcgcctcattggtcccccccattgcgagctcactcccaaaaaaacacaacaatcaacaatacagatagacttgtacatacattcctcactccctcgaccccgagcagaatttacacgcatttattagcaccccacccccccaccccctcaccccccccccccctccaacccaagtggcgcccaacaaaaca

SEQ ID NO: 579178 - DNA, 387 bp, Homo sapiens
agagtccgatggaggattcacaccaggatggggtatctcgcctatcaactgaggcgactccgagtcttggtttacataaacacaattcttccactgtacacaacaaaggacaaacacagtgtcatctaaaatgctacaaaggtttaaaactcaaaagagaaattttatagtactggctgcacaatgaaagcataaaagaaaaaaaataaaagcaatgtacatgttgccaagataacctgaaagaccaccttgaacggcaggcacaaccatggctgcgttaagactccacagatccgctattcggggacggatagcggatctgcaaggggaaaaaaattcggatcgcctcacttgatagtggacccagctcaaattccgaattatact

SEQ ID NO: 579179 - DNA, 560 bp, Homo sapiens
cgcatttcgagtgcttcgagattatcatgaggttgtctatctggagctctttccattagtttataacgtataggcattgatagctataaactttcctcttagtagtgcttttgctgtatcccataggttctgatatgttgtgtttctatttgttattggtatccaaaagtctttaaattttcttcttaatttcgttcatagagcgccagtggttgtacagtaaagctggtggctttatttctcaggtattggttcagatatccacaagtagcgtttgggttatttagtttcgtgtttttactatgatgagtggtgagaacaatatactgggatatgatttagatatttttacaagtttttggtctgggtatggtggcctaacatatggtctaggcagtggaaagtgctgagaagaaaaatgtatattctgcagcagtcagatgaaaggttctgtaaatgtcggtgagggccatgtggcctagagtatagtctaactcccatgtaacttcattgatttcctgcctagatgatcggtacgtaaatccaaagttccgatgaag

SEQ ID NO: 579180 - DNA, 777 bp, Homo sapiens
  misc_feature (345)..(345): n is a, c, g, or t
  misc_feature (417)..(417): n is a, c, g, or t
  misc_feature (527)..(527): n is a, c, g, or t
cacgtgtgtccaaccagtaagcagcattggaatgggtcattcggtttaaaaatgggccacggttccagtgggtgagaactcaagaacctaagaaaggtcaggttctaggaaattaaggcggaatttaggatttaaagccagtgggttggcccttgattggggcctattagtatcaagctcaaggtgttatcattgtccttgagtgagtattaggctcactgaaaataagctcacctcgcctgtccgcgatcacatcagactggcaataagctatcaagccaatcagctgtgatcatggcttggttggaagagatcatagccatggtgtcagtgtagcagcagtcntgtcatagaagcagcttgcaaggcagtcttctctagccgcattgcttgttatcctctcgtgaatacgtgtcncagtagtcatatgtgcacaatctctcttagtgacaatggtgcgtgctacagaggacgtcagcgcacatctgtacataacatgtggcatcaggatagtctaagtgtagcangctcggaataatgcagttttggtgcatgtgattttgtctgcattccatatattaggtttggctaatgtatgattagtaagagtaaggtcagctggggcagctcgtatttggaagcaccagagcatagattagatgtgttttcagagggtaaatttttattcggtattgattattttgaacgtgtaatagtaagtagtcattgtcagttcaggtatttatagttaaggctctttaactcgtagtaaggttg

SEQ ID NO: 579181 - DNA, 712 bp, Homo sapiens
  misc_feature (7)..(7): n is a, c, g, or t
  misc_feature (70)..(70): n is a, c, g, or t
  misc_feature (79)..(80): n is a, c, g, or t
  misc_feature (166)..(166): n is a, c, g, or t
  misc_feature (169)..(169): n is a, c, g, or t
  misc_feature (180)..(181): n is a, c, g, or t
  misc_feature (186)..(186): n is a, c, g, or t
  misc_feature (189)..(189): n is a, c, g, or t
  misc_feature (198)..(198): n is a, c, g, or t
  misc_feature (211)..(211): n is a, c, g, or t
  misc_feature (219)..(219): n is a, c, g, or t
  misc_feature (235)..(235): n is a, c, g, or t
  misc_feature (245)..(245): n is a, c, g, or t
  misc_feature (248)..(248): n is a, c, g, or t
  misc_feature (256)..(256): n is a, c, g, or t
  misc_feature (277)..(278): n is a, c, g, or t
  misc_feature (301)..(301): n is a, c, g, or t
  misc_feature (340)..(340): n is a, c, g, or t
  misc_feature (353)..(353): n is a, c, g, or t
  misc_feature (363)..(363): n is a, c, g, or t
  misc_feature (375)..(375): n is a, c, g, or t
  misc_feature (381)..(381): n is a, c, g, or t
  misc_feature (394)..(394): n is a, c, g, or t
  misc_feature (399)..(399): n is a, c, g, or t
  misc_feature (406)..(406): n is a, c, g, or t
  misc_feature (413)..(413): n is a, c, g, or t
  misc_feature (415)..(415): n is a, c, g, or t
  misc_feature (452)..(452): n is a, c, g, or t
  misc_feature (480)..(480): n is a, c, g, or t
  misc_feature (488)..(488): n is a, c, g, or t
  misc_feature (533)..(533): n is a, c, g, or t
  misc_feature (539)..(539): n is a, c, g, or t
  misc_feature (706)..(706): n is a, c, g, or t
gttccgngtccggttttcccgggttgttgtttgccggcctccatctgtcctggtccgttttgttgtcttntaggggctnntggctaccagcctgctgcctcggctgcgctacgtgctggaggtgacatacccagggcctgcggtggtccttgtcttcctggctgtnctnttccgcctggnncggcnttncctggtttntgccacaagggtnctggtgtnccctcggctgtttgtntcttttgttnganagttcttnccccccagttggtctcctgtnngggctgggcctacccactatgtnttttctttgttccctgtgcttctgccttgtttcttcttngtgtcctggcctntgctgggagntattttgctgcncggctnttgtgctgctttnttctncggtgcngcctgtncngcttccttgatgtgagatcacccgatatggccttgtnccctgagagaagctgagatgtctgtgcnccgaggcnctccgtctgtgggctgtggctgcctcctatggccagggcggttanctttanagggagctctacccagtgctgatgcgggccttgcaggtggtgccgcgggagctcagcacccacccacctcaacccctgtccatgcagcggatagcctcactgctcactctcctcacccagctaaccctggcagccggcagtacccctgctgaaaccatcagtgattnaaaaaa

SEQ ID NO: 579182 - DNA, 494 bp, Homo sapiens
  misc_feature (50)..(50): n is a, c, g, or t
  misc_feature (188)..(188): n is a, c, g, or t
  misc_feature (389)..(389): n is a, c, g, or t
  misc_feature (394)..(394): n is a, c, g, or t
  misc_feature (441)..(441): n is a, c, g, or t
  misc_feature (490)..(491): n is a, c, g, or t
acggatctgaacaaccggaaaacaaggtgctgcaggcacaactgaaacantcgctggagtctgaacgttccgtcgcaaccttgctggatgatgcctatgccagcgggcgagctaatgcggcgattggtttgctggcatctgctgataccgggcgtacttccgaaaatctgcaacacttggtagcggcnaccgctccggttgcagcaccggaaaaattcctgctgctccagtttctctgcctcagagcgatgaagctattgatgctgaattgctcgacatcttcctgactgaggccgacgaagtgctggcgtttgtccagcataccttgcctttgtcacgtgaagatgcggataatcaggaacatctgaccagcctgcgtcgttccttcnatacnctcaaaggcagcagccgtattggtggggctgaccgtatttggcgaanctggatggaatatagaacaggtcatgaatcttgtggttgttcagatccnntta

SEQ ID NO: 579183 - DNA, 192 bp, Homo sapiens
catgtgagagaaaaaaataaaaggcatcccaattggaaaagaggaaatcaaattgtccttgtttgcatatgacatgttttatatatagaaaaactaaagacttccctaaaaacctttagatttggtaaacaaatttaataatcagcatacaaaatcattagcatttttagacccccataatggacttcctga

SEQ ID NO: 579184 - DNA, 384 bp, Homo sapiens
tacaatcagctcggtaccctctactaaggcaataccacatacattcccctatgttttcttccaagaattttataagtcttccagttttacatgctaagcttataatacattattgatttgatttttgtatatcgtagaagatgtaaccactctaatctcaattttctgcatgtgtatctccaattttcccagcaccatttattaaaaagactgtcttttcctcaatgtgtgttcttggcatctctatcaaaaatcagttgcatattagtgagtgaatttatttctgggctctctgttctgtttcattgtccactatttccttatgtccttttttatgccattaccatactgttctggttactatagcttttggcccttatcgag

SEQ ID NO: 579185 - DNA, 263 bp, Homo sapiens
cggtccaaaagccatttctaccaaaaatacaagaatgagccagctcataacctggtctcataaataaataaataaagagacataaatgattgccagccattattccggaggcacaagatatataacttccccaattactcctgcatataacatcacaactgtagaacctgagattggccttttgagatatcttttcaggattttttcatgtctgacaccaggggctccacctggacctgccaactgcccctgtggccccaccc

SEQ ID NO: 579186 - DNA, 912 bp, Homo sapiens
gtccccccttcccttccctggggtctgggggtgacattgcacctggccctcgtggggtcgctgttgccaccccacgcggactccccagctggcgcgcacctcccatttgcctgtcctggtcagtgccctcacccaccttcccacctgaccatgccatggcgggctgcgtgtgtcttactggctgcgactttcgtctgcgttctgtgccctggtccttctgcgccttttctacgcatacactatgtggcctggtgtgcaccctgtcttctgctgttcatccatccttgtgtccgccatggtggcattctttctcggcttggtctccctgctcctggcctctgtggtctggttcatcttgtgtccatgtgacctgacctgtgtcagatgccctgtgcgtctcatgatactgttctcttctcttgacatttctttgtgtcgctcgcatatgtctactagtcccattcgtacacggcagtgtagtatcctgcctatttgcgctaactaaccaacgcatgccttcacagcacacggccagcatgcagcgggttcagccatcgccttgagtgagtgcacgcgcaagcatcaccccatctccatcctgccacgactggcctatgtgtcttggtctctccttcgcgtaatcatcatgtggtgtcttctctgttatcagtcttctggctgctgcaccttggcccagtgtgtggttgtggatccatggagcactcagcctattacttcctgaacttccgtcttttctgacctgcagtcccattatccctgcctcctttacctttatcggctcacttgtgtttccttcgattgccctgctgagcagcgcacacctgtcacttctgcctctgtgcgctcctcgcgccctcgtggcgtttcccctacgtcgacccttcgtctata

SEQ ID NO: 579187 - DNA, 362 bp, Homo sapiens
  misc_feature (8)..(8): n is a, c, g, or t
  misc_feature (40)..(41): n is a, c, g, or t
  misc_feature (192)..(192): n is a, c, g, or t
  misc_feature (203)..(203): n is a, c, g, or t
taaaaganttaaaagtggggccctctggataaaggaaatnngggagagggctgctatttgccttaaaaaacttgtggttcagctgggcgcggtggctcacacctgtaatcccagcactttgggaggccgaggcgggtggttcacgaggttaggagatcgagaccatcctggctgacatggtgaaaccctgtntctactaaaantacaaaaaattagctgggcatggtggcggcacctgtagtcccagctactcgggaggctaaggcaggagaatggcgtgaacccgggacatggaggttgcagtgagccgagatggtgccactgcacttcaagcctgggtgacaaagtgagactccgttttc

SEQ ID NO: 579188 - DNA, 231 bp, Homo sapiens
cttgtagccaaggccgaccatgtacacccacgggtcgacatcgacgtcgaccttggtcttgctgtagcccaaagcggtcgggccgttgacgctggccttggtgtcgatgtcgacgtaccagaccgaggcgttgaccagcaggttgtcggtgatcatgtagtccatgcccagctggccggcgatcccgatcgagtcctgcagtttcaggttgctgaagccttgctgcttgcg

SEQ ID NO: 579189 - DNA, 1020 bp, Homo sapiens
  misc_feature (279)..(279): n is a, c, g, or t
  misc_feature (283)..(283): n is a, c, g, or t
  misc_feature (292)..(292): n is a, c, g, or t
  misc_feature (317)..(317): n is a, c, g, or t
  misc_feature (365)..(365): n is a, c, g, or t
  misc_feature (378)..(378): n is a, c, g, or t
  misc_feature (399)..(399): n is a, c, g, or t
  misc_feature (595)..(595): n is a, c, g, or t
  misc_feature (624)..(624): n is a, c, g, or t
acctacatactcttcatctgtcagcccgattctctagcagtgaatggagttccgtgaagtgctgtgacctgacagcgtagacaagagtacgtatggctattagtacaatgtactgcagaagcgcaccacagcggtgagtatggaccacccataagcgagagtctcacctgacgaaatgcaccttttctggcagtagtactgccacagtaacatcagatcgttcattgctatctccatacgatggatgtcaacccataacagagacacggcgacgcaaanctcntctaagccnactacgtacgctctgtcatcacaantccgatccgtgctccacggcggcaacaccgtctacagtcttcactctncacactattaccnagcctctataatcgtcacgtnatagcaactcacgcactcgctcacgcacatatgaccacaacacacgcacttagtagggacgacatcgtacaaagatcatatgtcgccattcccataagtaggtagttgcttaacgacaactatcagccttgacgatggggacatcgcggaacataatcgaccaaaattggcgcgtacttggcattctagggtcganagagtttcaacccttatggcacgggaccncccatccacggacgctgcacctctggttgcaaagaggacgttaaagcgcccttacgaagccaggcactcactttgacacagggacacctcgttctgtggcggcacgaacagctgttataaccaaatagtttatcgtatcaggtcacccaactaagtaaataagtttgtctaaataaccttttgtgagtttcccttttacaagtgagcacaacgacaagaaatgaccagcaacgtcgaactattcaattaaattgggacattacgataattaataattaaatcaagttattgtacgtcgagaccttgttgacacaaatagattattaggttaaggagtaagacacgtccatgtggatgtagaacaaagtgagaagcattaatgtacttcatacctgc

SEQ ID NO: 579190 - DNA, 946 bp, Homo sapiens
ctgtggagcatgacaggcttaggggaagcttggggactgtgtccaagagcccgctcctaagaaccatcaccacgcactcagccaatctggttctgggccctgattttgcgcacacctccatcgctgttaagcgccattctctgaccccatagggagtggcaatgaagatccctctcactcatgagaagcgaaggctggtatttagcttgtttgatatgtcatacgagacgacgaatagtgagagaacagaacaacacgagcctgagatacacgcagcaagcaggacatgctgaacaaatacgtggagtggatgacaagggggagcctaaggcatttatgacgtctgaaagaaaatgttcagtagctgaatccgcccagtgatagcctgtgggcacgagcagcaagggctgccatgggatactggtacccatctacaaagatctctattacataaacgactgcttctgactaggagaataaacctcgttctgggatctcctgtaagtgaataagcagtttgatgtgcgtaccagtccctgagtctatctcccagtggggtgtgtccagaagcaggcagattgacaggtgttttgccccctccactcgagaagccctgcacgtgcccttcaggataagatggggggcatactctgagttgctaggcagagatcaatccaaccaactagctgggagtcagaaccatgtggataaggaatgtgctctcgggacacacccacaaaaacaaactgttcgggctcggccgccaaatttaaacaaatggtgccgggcccaaggaaggaacggcagggtccaagaacggacagaggggggtcccaaaacccgggccggctgggcacaaaggcggcagtacgagcgggcaacacccgcggaaggggggggaccaacacacaagcgggcaacaggccaccactgggtcgcgccatca

SEQ ID NO: 579191 - DNA, 1689 bp, Homo sapiens
  misc_feature (334)..(334): n is a, c, g, or t
  misc_feature (483)..(483): n is a, c, g, or t
  misc_feature (700)..(700): n is a, c, g, or t
  misc_feature (1057)..(1057): n is a, c, g, or t
  misc_feature (1098)..(1098): n is a, c, g, or t
  misc_feature (1378)..(1378): n is a, c, g, or t
gggcttcagctggtggtttattggacatacaggtaggctctatagcaacaggccgggaggtgtgctgtgcagaagtgtggggagaaaatgtggaaggggtggaggggtggagtgtgttgtgcgtgcaggaacagctgtgagtgtggacggggtggggacagggtgcaaactgtggaagaggccttaagagagcttaaaagaagcaagttagagggccgagggggccagaagtctcggcttctcagagtggaacacaacgatgcccgagtgtgccctatagagggccctataacttcttgtggcgtggcgtggttctcgtgtgacaccccaaagnccgagggttgtgggaagtctccctctgtgggccactcccaaattttttctctataagaggaacactgtggcaacgagagagtttcaccaccacgagggaacagagggaaagcctgtgtgtcaacccctctcttgggcccactctggtgnctctcccagagggggggcccctccagagttccaagacaaatttcctctccctttcttctcccctatgtgagattgtgggggtggggccccacaaagtgaagtggggccaagaccagaaggcgcctctgggggcggtgtgtcccccactatagacagacagagggcgtgtggccacaaacacacgagccccgagtgtgttccccagtgtgagagcgcngttgtgaactcttttcttatcccctgggggggttcccacaacaccatacccagtgtgcccagcgttataacaggcccacaagagtgtggaggctctcctaaacaaagcgcgtgtggggccggggcccaaaaaagtgggaagtgggggcgcctgggggggcacaaaaggggggggggggtgcgcgcacaccagggggcgcccctggcgcagggcaagggggggccccgtgggggcggctccccacttcacacggcggccacaggggggatcacacacaaccacgggcccaatgtgggggtggtcgcgggggcgtctccataaaagaaatcccgggcgaaaaggcggagcagaccggcntaccataaagaaggtatcatcaccgcctcggagaggggggnccccccaacagcattattaaggcgccggataacccccaaagcgcgttttctcttggggtccaccacacgcgtgtgggtcccccaaatatagaggagaacgccgccggagactatataacgagcacagcaacagggaggtccgcgacgccgtcttacaacaccacgcgccgcccgcgaactcttgcgcgacaaaccccggtgctgtacccttgtggggaacccctcgggtcgggaagaggaagcccctacattcgcggctgcgggtgtgggccaccatacngtggggcgacaccatccccccccagacgaggattaatacaggtctccaggggacgatatacacacactcaccggcgctactaccggtgtgggacccaccccactatctcgacgcggcacacaatgtctcggatgatagtaactacaccactacatgtacgcatgcaactgcacaggcagcgagcacgccgagagggacagacgcgagcgcgcgagctccacagccagctgcaccgcaaccatcgcgtcagacacgcaaacagatatgcaacgatccaccaccatacgaatgcatacctccagcgctcgcag

SEQ ID NO: 579192 - DNA, 554 bp, Homo sapiens
acactggacccaagaaggtcatccggaacctggcacctggtagtaggcagcagatcaggtctaagcagcacaacatccaacatggccagccgaaccaggacgtgagatgagatgggtagaacatgaacatcgcctgcatacccgaaaagctcttccctgcaatatggatgtcatgcctgaagatcagcgatgggcgagcccaaccactcgtctgctagatgacatgtgatggctcgcaagacagcccatatctttatgtatgccccgtgagttcaagtccatgccaccaccgactgatactgaggtggatccctgcatccatcaacaagaatgtgcagggagcatgtggaacaaaagaagcagctttacctactagttgcttatggtctctctgcctggacactcacttttgcagagactcgacagtctctggaatggagtgtgggtccaccttaggctctgacttcctaatgtaggaggtggtcagcaggcactctcctgggccttaaaggatgcggcctcatcctcagcccgcgctcatgttgtgatcctgg

SEQ ID NO: 579193 - DNA, 415 bp, Homo sapiens
  misc_feature (58)..(58): n is a, c, g, or t
  misc_feature (218)..(218): n is a, c, g, or t
cttttccccccccgttgggaggagttggctcttaaaaatgtgtgtgatttaagtggtngggcagggggtttccgccacagaagggttgtggttttttggttgcgggggttcaaagatttcccccggaaaaggctccttttttgggttttcgggggggggccccggggggggccccccccttttgttttgaccagcatttgggggggggcacccaaggnttgaaaaaggggggccccttttttttggttggggggcccaggggccccgcggtgggcttttccaaaaaaaccctttgccgggtggggggggaacccccccctttttattttttttttttttttgggggggggggggggcccctttttttggcccgccggcttttcccccccccttttttattttctgtttcccccca

SEQ ID NO: 579194 - DNA, 149 bp, Homo sapiens
atgaatttcaatgtatccgttagcttaactaactaagatcttgctgatatcagagaagggcttctgggcaggctgagcacttgtggtgtgcaacatggtaactctgattaagagaaaccctgagtataacttgggcaatgaaagaacaa

SEQ ID NO: 579195 - DNA, 172 bp, Homo sapiens
acaacgctgacctcttctacaacgctgaccttcttccacaacgctgacctcttctacaacgctgacctcttccacaacgctgatctcttcctatttcttttgcataactcataaaataactaagcattcaggaaagacatatgggcaggaaataggcagagatcagcgttgt

SEQ ID NO: 579196 - DNA, 276 bp, Homo sapiens
aaaatcatggttgactcaggacccatctatgataaaacctatggtggtggagcactcaggttgtttggcttttctcaagaaatggcgtccttctctgacctgaactaccaatgtacagatccctaatcatcaaattgtccattgaaagactgatcataaaccaatgctggtattgcaccttctggaactctgtgcttgagaaaacccccagaatcactgatactcggcttccttcttttatgagcttgaattattggggactcctataacgtgcga

SEQ ID NO: 579197 - DNA, 505 bp, Homo sapiens
gctgttctagaggagtctcaacgtcagcacctcctgtggtcaagcgatactcccacctcaggtttcctgagtagctgggactacaggcgcatgtcaccatgcctgtctaattttttggttgttgttgttgttgcgataaggtctcgctgtattgtccaggctggtctcaaactcctgagctcaagctatcctcctgccttgggctcccaaagtgctaggattacaggcatgagccactgtgcctggcctagtatgggtcattagtattagtaatcattcctaaatgtatatgtaaacatttatttcagtgttaaatattgaagtgtttggtctttatttagaagtttgatgttgtgttttatgaccagaaatatgctgtgaacttacttctttcttatagcagttagcctatgggaaaatgggtttggttctacattattttatttaaagtcataatttccaagatcctatcaactccattaagtgaggacttactgtactgtag

SEQ ID NO: 579198 - DNA, 414 bp, Homo sapiens
  misc_feature (57)..(57): n is a, c, g, or t
  misc_feature (112)..(112): n is a, c, g, or t
ggttaacctggggtttataccccataaagacaattccccaggggataggaaaaattncccccttttccttccagcctagaagaccccccggcacccaacacacccctcaccncccttccttgaaaatataaagtgatgggacagggtgcggtggcctcaagtctgtaatccctagtgctttgggaggctgaggcagatggatcacttgagacccaggagtttgagaccagtgtggtgaacatggtgaaacccttctgtactaaaaatacaaaaactagccaggtgtggtggcacatgcctataatctgtaatcccagcgacttgagtggctgaggcatgagaattgcttgaacccgggaggcagatgttatagtgagctgagatcatgccacagcactccagcctgggatacag

SEQ ID NO: 579199 - DNA, 328 bp, Homo sapiens
ataaacataacaacaagatgttatttaattgcctattacgatctctttctctctcagacacacacacatgtgatgtatgcacaagacacaggcaagcattaacaaagcagtggcctgggcatggcggctcacagctataatcctggcatcttgggacggctaggcaggcggatcacctgaagtcaggagttcgagaccagcctggtcaacatggtgaacccgtgtctccactaaaaatacaaaaaattagctgggtgtggtggcacacgcctgtaatcccagccactccggaggctgaggcaggagaactgcttgaacccaggaggcg

SEQ ID NO: 579200 - DNA, 361 bp, Homo sapiens
gatccacacccggcactatgaagctgtatcgccgctgtaagctggaggagatgggcttcaaggacaccgaccctgatagtcaaacccttcagtttacatggagacatatgaggccacataaggaggacgagttcctaggggaactccagaagaaaagaagaggagatgagacagaatgttcgtccagcgagtcaaagagaatagaagtcggaggctcagaagaggccgagaaagagctgcgcgagaagttggtagccgtcttgaagcaaactgtcgccaggacggagaggaataaactggaggatatggaagaaatccctggatgatgagagtgaatgctttcacatgcaaatggaaagac

SEQ ID NO: 579201 - DNA, 459 bp, Homo sapiens
  misc_feature (247)..(247): n is a, c, g, or t
  misc_feature (254)..(254): n is a, c, g, or t
aggcccacggccagggcgggatccggggatttggggggccgtgggggccgcgggctgggagcatctctaggctccttggctaccagaaaagaagctatgcttcaaagaaaatgcaggacaaagggggggtggacatgagagccccccgaatgcccacgcagaacccagctgttcagcggtctctttttagagaaatagaagtttgtcggcaaaaacagccagggcgttggcagcagggttagaacanctgcctnaggctcctccctgaaggacacctgcctgagagcagagatggaggccttctgttcccggcggattctttgttttaatcctgcgatgtgctttgcttgttgcggggcggatgatgtttcccaacgatgaattttacatccaaagggggataggcccttggacccccattctccaaggcccggggggggggtttcccatgggatgtga

SEQ ID NO: 579202 - DNA, 457 bp, Homo sapiens
gttttggtgggcgatgccgttcgtgtgtgcgcgcgtcattctggctcattctagtgcccttcgggcctcgtacttccttgcccgtggtgtagacgcgggctctagctgcttgtcttgacctgaccttggcgcgtacaactcggtgagtgcgtgcttcttggcgtccatcagactggagtcacgggtctgtcccaccacgaccttgacgggtcccttgttgttcttgggcactggctgggatttgatgactggcttcagttttccttttttgaaagcagtgacaaactcgcggagggtgtcagagtcaaactcctctggctccatggcgaacttcttcccactctcgtccaggatggcggcattgacatcctccccactcccgctgagccccaggtccttcacctccccagcatagtcctcttcgtccgcaatggcaaaggtgtactcagggaagtcc

SEQ ID NO: 579203 - DNA, 806 bp, Homo sapiens
ggcatgcgctgggtcagacctgccagtctaggttgctggattcccgtagatcgctgggcatttgtcgtgcaagcccttcaatcacgggcgcatgcttgtggctggctcactgctccagtaggtctacacgctctggctagcattgctagttgcaacgtgctagcgcttgctggcaaccatcagaatgccctgtgctggtgtgtgtgtgatactgcaacgcggaactactaggcccgattccagcgacgaactatagccgcgcgctggggcacttgatgcggagcgtccttctcgatgaccacagggggacacccagctacagaccatcggatggtccgccatgcacagcacatggaaactgtcatcctaaatgtgggatagattatcttgatcataccgaatccctgaatcaagctatcacattactttataacccatagatgcccgggtcacaataggggcgtcgacaccaaggattagcgtggaagcaattggccttgcctaggtcgagcaggcgtggagagagcctcgaaccagtcgctatagacccctggagaggacacactcagacctttgggcatttcctactagggatcagggcaaataccttcaaggggtagcccatgcgtgacacattcgagttacaagggaccccaagaaactcttcctctccaattgactccactggaacacacagagacaatcaatgcgacgcattggaagcgtaatggcgaaacactaatcctgtacctgattgaactaacaacgaaggcgccccttaagcccattccatggaggagcgtggc

SEQ ID NO: 579204 - DNA, 770 bp, Homo sapiens
  misc_feature (124)..(126): n is a, c, g, or t
  misc_feature (128)..(128): n is a, c, g, or t
  misc_feature (130)..(132): n is a, c, g, or t
  misc_feature (239)..(239): n is a, c, g, or t
  misc_feature (328)..(328): n is a, c, g, or t
  misc_feature (330)..(331): n is a, c, g, or t
  misc_feature (334)..(337): n is a, c, g, or t
  misc_feature (341)..(341): n is a, c, g, or t
  misc_feature (343)..(343): n is a, c, g, or t
  misc_feature (348)..(348): n is a, c, g, or t
  misc_feature (354)..(354): n is a, c, g, or t
  misc_feature (356)..(356): n is a, c, g, or t
  misc_feature (360)..(363): n is a, c, g, or t
  misc_feature (366)..(366): n is a, c, g, or t
aaagcacactgcaacacattcaaggaggaatgataggcaacttcatgaacatttaccagcaagaggggacaagaggactgtggaagggtgtgtcccttactgcgcagagtggctgctattgttnnntntnnncttttctccagcggcctcaggttcttgttacaactgagtccgggttggaggaggtgtggggccgctgccgccaggaaaaacagcactggaggcaatgtttctataantcaaagaagagacagtgtgagaatgtcagccctcaactggaagccgtttgtgtacggggggctggcctccatcactgctgagtgcggantnnccnnnngatntnacagncacggnancctnnnncancatcaagataggcacttaccagagcttgaagcgactattcattgaacgcccagaagatgaaactctaccgataaatgtgatatgtggaattctgtctggagtcatatcttcaaccattgctaatccaactgatgttgtgaggacacgtatgatgaatcagagagtgcttcgagatggcagatgttctggctacacaggaaccctggattgcttgttacaggtgttgccttaatgaagcaaagacacttatcgtattcatccacctgacatcttgggaaatagtggtactctgaatgatatctctaccactattgcttctttatttgtgacctgttcaggagcccacatggcacggaagcaacagaccgtaattggaattaaatctaattttttcctcactcaaa

SEQ ID NO: 579205 - DNA, 290 bp, Homo sapiens
gctctcatggttacaattctcatctgagcaggaggaagcacgacacggagtgagagaactaaagaaggtgttggcagacaagccttgtgagcgcacacattggatccagtcctgcaagcagaggtggcgatttgttaaagggccaacagtatccaacgttagggttggagcacgggtgctgggacctggggcactgtgggactgggacacttttatgttaatgctctggacttggctccagagactgctccagagttggtgacacagctgtcccaatgacccctctgagt

SEQ ID NO: 579206 - DNA, 167 bp, Homo sapiens
  misc_feature (77)..(77): n is a, c, g, or t
aagatggaatctcactgtcaacccagcctggagtacagtggtacgattttagctcgttgcaacctccgccttccagnctcaggtgatcctcctgccttagcctcctgagtaactgggaccacaggtgctcactacacccggctaattattttttgtatttttggtaa

SEQ ID NO: 579207 - DNA, 1052 bp, Homo sapiens
  misc_feature (124)..(126): n is a, c, g, or t
  misc_feature (128)..(128): n is a, c, g, or t
  misc_feature (130)..(132): n is a, c, g, or t
  misc_feature (239)..(239): n is a, c, g, or t
  misc_feature (328)..(328): n is a, c, g, or t
  misc_feature (330)..(331): n is a, c, g, or t
  misc_feature (334)..(337): n is a, c, g, or t
  misc_feature (341)..(341): n is a, c, g, or t
  misc_feature (343)..(343): n is a, c, g, or t
  misc_feature (348)..(348): n is a, c, g, or t
  misc_feature (354)..(354): n is a, c, g, or t
  misc_feature (356)..(356): n is a, c, g, or t
  misc_feature (360)..(363): n is a, c, g, or t
  misc_feature (366)..(366): n is a, c, g, or t
aaagcacactgcaacacattcaaggaggaatgataggcaacttcatgaacatttaccagcaagaggggacaagaggactgtggaagggtgtgtcccttactgcgcagagtggctgctattgttnnntntnnncttttctccagcggcctcaggttcttgttacaactgagtccgggttggaggaggtgtggggccgctgccgccaggaaaaacagcactggaggcaatgtttctataantcaaagaagagacagtgtgagaatgtcagccctcaactggaagccgtttgtgtacggggggctggcctccatcactgctgagtgcggantnnccnnnngatntnacagncacggnancctnnnncancatcaagataggcacttaccagagcttgaagcgactattcattgaacgcccagaagatgaaactctaccgataaatgtgatatgtggaattctgtctggagtcatatcttcaaccattgctaatccaactgatgttttgaaaattcggatgcaagcgcaaagcaacaccattcaaggaggaatgataggcaacttcatgaacatttaccagcaagaggggacaagaggactgtggaagggtgtgtcccttactgcgcagagggctgctattgttgttggtgtggagctgccggtctatgacatcaccaagaagcatcttattctctcaggcctgatgggagacactgtgtatacccacttcctctcaagcttcacctgtggtctggcaggggccctggcctcaaaccctgttgatgttgtgaggacacgtatgatgaatcagagagtgcttcgagatggcagatgttctggctacacaggaaccctggattgcttgttacaggtgttgccttaatgaagcaaagacacttatcgtattcatccacctgacatcttgggaaatagtggtactctgaatgatatctctaccactattgcttctttatttgtgacctgttcaggagcccacatggcacggaagcaacagaccgtaattggaattaaatctaattttttcctcactcaaa

SEQ ID NO: 579208 - DNA, 967 bp, Homo sapiens
  misc_feature (124)..(126): n is a, c, g, or t
  misc_feature (128)..(128): n is a, c, g, or t
  misc_feature (130)..(132): n is a, c, g, or t
  misc_feature (239)..(239): n is a, c, g, or t
  misc_feature (328)..(328): n is a, c, g, or t
  misc_feature (330)..(331): n is a, c, g, or t
  misc_feature (334)..(337): n is a, c, g, or t
  misc_feature (341)..(341): n is a, c, g, or t
  misc_feature (343)..(343): n is a, c, g, or t
  misc_feature (348)..(348): n is a, c, g, or t
  misc_feature (354)..(354): n is a, c, g, or t
  misc_feature (356)..(356): n is a, c, g, or t
  misc_feature (360)..(363): n is a, c, g, or t
  misc_feature (366)..(366): n is a, c, g, or t
aaagcacactgcaacacattcaaggaggaatgataggcaacttcatgaacatttaccagcaagaggggacaagaggactgtggaagggtgtgtcccttactgcgcagagtggctgctattgttnnntntnnncttttctccagcggcctcaggttcttgttacaactgagtccgggttggaggaggtgtggggccgctgccgccaggaaaaacagcactggaggcaatgtttctataantcaaagaagagacagtgtgagaatgtcagccctcaactggaagccgtttgtgtacggggggctggcctccatcactgctgagtgcggantnnccnnnngatntnacagncacggnancctnnnncancatcaagataggcacttaccagagcttgaagcgactattcattgaacgcccagaagatgaaactctaccgataaatgtgatatgtggaattctgtctggagtcatatcttcaaccattgctaatccaactgatgttttgaaaattcggatgcaagcgcaaagcaacaccattcaaggaggaatgataggcaacttcatgaacatttaccagcaagaggggacaagaggactgtggaagggtgtgtcccttactgcgcagagggctgctattgttgttggtgtggagctgccggtctatgacatcaccaagaagcatcttattctctcaggcctgatgggagacactgtgtatacccacttcctctcaagcttcacctgtggtctggcaggggccctggcctcaaaccctgttgatgttgtgaggacacgtatgatgaatcagagagtgcttcgagatggcagatgttctggctacacaggaaccctggattgcttgttacagacatggaagaatgaagggttttttgctctctataaaggcttttggccaaattggttgagacttggtccttggaatatcattttctttgcgacatacgag

SEQ ID NO: 579209 - DNA, 833 bp, Homo sapiens
cccacgcgtctgaaagagtgaagaggctcatgctgaagattcgagtcattgtatcactacatgtccgtgcaagcaacgtcaaatgatataacgtctcatctggagatcaatttgggagaccttggccgcccaggacgtggcggcaggggaggacgaggtggacgtgggcgtggtgggcgcccaaagcgtggcatgaggaccgacaagtcaagtgcttctgctccatgatgtggatgatccatgaggcattcccagctctggcttaacgtggagtgccataagacaaccctggttcctttgtgaacccttcgtgttcaaagcgttgggcatgcttaaggattccaaacgactaagaaattagaacaaagaaaagagctgtcatgtcataccattcacacctaaagacggaatttaatctggcttctaaaagatgaacttctcccgctacacagaacggtaacacacatatggtagctcagtgtggtatttagaaatgtatggtagcagggatgttttcataattttcagagattatgcattcttcatgaatactttgtatagctgctggcgaaatatgcattgccaacacttgaaatatacggttgtgaacacgttgtgtaaccagtttttaacagctatccagcttcatgggaggttcggacattacagggatttaacgacagttccccccaataacaaactgttcttaacatattggacatacctggtttaaataccgtgtttgcatattcacacagtggcaactgggaccttgttcaccttctggttgtcaattttatgctgggtggactctacccttttggttttaccgc

SEQ ID NO: 579210 - DNA, 418 bp, Homo sapiens
  misc_feature (62)..(62): n is a, c, g, or t
  misc_feature (65)..(65): n is a, c, g, or t
  misc_feature (81)..(81): n is a, c, g, or t
  misc_feature (132)..(132): n is a, c, g, or t
  misc_feature (146)..(146): n is a, c, g, or t
  misc_feature (163)..(163): n is a, c, g, or t
  misc_feature (165)..(165): n is a, c, g, or t
tgattcacctcgttcccgaactaaaacttctgcgctttaggaaaaaagcaagcgttccaatntgngaggccctcccccacnccgtcccttcccaggagaagaaagaaagggctttgtgtgtgcggtgagggntccgttcatcgagntcaaaaatgcacagcgncngggggcccggaggcgtggggcgccgggccctgcccaccccttttccccgggccggcggcgagtcgggaagctggtgcgggaaccggggccacggggcgccgcggcccggcagccaggaggaagaggatgctgcgccgccggggaccagagggcggggccgggccgcgcggacctcggcgggacccagcgggcccgggcgggcgcaccagccgccctttgtcctccgcctccgggtcgcgggggccgcggccgc

SEQ ID NO: 579211 - DNA, 138 bp, Homo sapiens
gctggatgcgtcgtgggccagtatcggagccttgcagcgacaaaggccagaggcgtggtggtgcagttcgacggggaaacagtgagcagaacatcgagtgtgggggcggctatgtgaaggtggttcctaatagtttgg

SEQ ID NO: 579212 - DNA, 471 bp, Homo sapiens
  misc_feature (41)..(41): n is a, c, g, or t
  misc_feature (83)..(83): n is a, c, g, or t
atccccaaggccccacccccggtctgtggaaaaattggctncccacgaaactggtcccgtggtgccccaaaaatattggggtnatggttgttcctagggtgtagacctatgaaaaagatatgccattgtcctcccatgaacctaaaaggcaaggtgattttaaacaatttagatgcccaaacaaagaaacccaaaagcttcccaaagtaataaatgatagagaaaggaaattgttacatcatgtgcccaaattagaagcaaatctaaacttcttatcatgtactccaccatctgatttgtataagtaattggggaaagaaaaactcacaatataaaacaagattgactagttctagcagatgacacctgtaaatagaatttttactagttgaaattctgatgtgaaatgaagccattattattatcacaataaagtgttctttttagttctttttttaataaaaaaaaaaa

SEQ ID NO: 579213 - DNA, 435 bp, Homo sapiens
attcagagtagccctagttctcacaacactatctgaattttctacatatcacatcacagactaatattgtttataccagtcttgtttcctcctaataaaatataagtgccatgaaagaacagaccttgtcttttcctaaacaggtcctgacacctcttagatcctcagtaaatctttgttacatgaatgcatttgagctttcactctcttggtctgaccttcccacaatgatttcccaagggcttcacatcaggatctacaggtaagaagaggattaaggaaggccaacttgacccttcggaatgggatccacaagggatgggcaccggggatttaacacgaatttggggtagaaataagggcctcttgggcgttaagagagccatcaaacaagggcgccttttttttcttaatccgggccctgtgtccggtcct

SEQ ID NO: 579214 - DNA, 650 bp, Homo sapiens
  misc_feature (322)..(322): n is a, c, g, or t
  misc_feature (325)..(325): n is a, c, g, or t
  misc_feature (408)..(408): n is a, c, g, or t
  misc_feature (427)..(427): n is a, c, g, or t
  misc_feature (435)..(435): n is a, c, g, or t
  misc_feature (444)..(444): n is a, c, g, or t
  misc_feature (475)..(475): n is a, c, g, or t
  misc_feature (478)..(478): n is a, c, g, or t
  misc_feature (563)..(563): n is a, c, g, or t
  misc_feature (578)..(578): n is a, c, g, or t
aagagatgcagagggaggaaatacagaagctgatgggccagatacatcagctcagatccgaattacaggatatggaggcacagcaagttaatgaagcataatcagcaagagaacagttacaggatctgcatgaccaaatagctgggcataaagcatccaaacaagaactatagacagaactggagcgactgaagcatgagttccactatatagaataagatctttatcaaacaaagaacacattgcaaagcataattaaagatcgagactaataaattcaaaaactcaagaatcagcttaccaataaaactttaagcaatancantcagtctgaattataaaatctactgcatcaactaacatagactctcatccataaacagaccatgctggagagtctcaacacanaaaagaactccctagtctntcaactgnagcacctcnaacaacagatgaactccacctctagaaatantantaatgggtcttcaattaatatatcttgaattgacaatggttaatgcacttctctacgaaatagtcctattctttgtaatacacanaaactaatctagcangaatgtactgaaaaattttcaaaactactagttcaatgtatcaatttataattcccctggaatttttctccg

SEQ ID NO: 579215 - DNA, 127 bp, Homo sapiens
aagtccgggaaggcgaagaacagaatagagaagatagggaaattagaagatattcacacacttttagaagaaaaaagattaatttaaacctgtaaagtaggcagctcaagaaaaaagacaagctagg

SEQ ID NO: 579216 - DNA, 135 bp, Homo sapiens
gtccgtctcccgcctcccggagaggatccggagactggaggaagagctccgcagctgaagtccgattccaacgggccggaggaggaacggaagcttcaagaaacttggaaggcctttgaaggaactcaagcaaaa

SEQ ID NO: 579217 - DNA, 187 bp, Homo sapiens
  misc_feature (18)..(18): n is a, c, g, or t
  misc_feature (20)..(20): n is a, c, g, or t
  misc_feature (46)..(46): n is a, c, g, or t
  misc_feature (160)..(160): n is a, c, g, or t
  misc_feature (171)..(171): n is a, c, g, or t
caaagactccctgatttntnattggttaaggaagcaaagctttgtntaaaaacttggggtccgcagaaaggaacattaaggtctggccaggcccctcaggaagaaactgagagcaaagaatggaggtcagagtttagtccctggtgttcccccttatctnacgtctgtttnaatccatttggtgggg

SEQ ID NO: 579218 - DNA, 258 bp, Homo sapiens
agatgactaatattggttacatcccacatgatatagcaaaatcttctaaacatcctcttcaaaaattggtgctgaatatcttccatttccccttcagatcctatctctctctacccttctccaccctgtctgtgccttaggaggttgacctgcattgaccacattcattagggcttcctgtctgtggtcaatggcaacattgatagcagagagcaacgagcagggcttgcagatccccgtggctcatatatacctgac

SEQ ID NO: 579219 - DNA, 171 bp, Homo sapiens
tgagtcatcaactgacaatgcagtgtacatgccagggcagctggacatgtgcggtccttctcctgccggggctatgtatcatatggtcgctccttcagctattattcccctgacatatcagcccccaagtatagatctgatgcaatttgacgggcaaaagaaaaaaaaaaa

SEQ ID NO: 579220 - DNA, 685 bp, Homo sapiens
cttgatctgcacccgcatgtagctttatctgtaccgatcacaagcccacggcatcgccctgaggacgcggctccacgatctacagggtctaacgggcggtcctccgcgacgattctgactacgacgctctctggccaggctgtaagatctgaatggacatctactgggactttactcgactacatcatgaacatgacctctgactggcttgagagttctgggagagttttctttgtcgaaagtgaacatgagtgcttttctcactttcggagaagatgtttaaatagtgctgttgtaacttttaatagtcctgtgtatcattcaactatttttcttgcagtaccgaggcacattcgaaaagatggaattgaagtcgctttgcttaacgctgagtgaatataaagagtagtttgcagctgtgtggtagtggattaattagcagccttagctctgaggtgtctgggtctagagttacttatttttaccaagcattttcagcctccattctggatgctgtctacacttaacaggtcttagctgtttactttttagagaataatattgttcattgcattgctgaggattatgaacctatttttgcagaaggacctgcacataagtgcatctgtgaatccggcttaaaaaaatggattcttttttgagtaaaccttattatctgcttagt

SEQ ID NO: 579221 - DNA, 901 bp, Homo sapiens
gggggcgggacgcagcgcccactaagtaagggaggcgggtgcatcggagtttatttatattagttgttaatcaaagaaaaacatatacatagttaaaaagaaatcaaataatgctcgcgggattggtagtgaaaaccatcaaacctctgccttttctctacccaccccgatttcatttttccagagacaatcacttttaacccttagcagtttcttattgtagtttttgttttgttttggtttggtttggtctgaaaagacatgtgtatactgcttgttggggacttttctacaacagaccttgatggggttgccggcattacacaatctctcttatgtgccatccttcgaatggtgtggaggtatttgttttaaagtcggggtgtgaaaattacataaggatgacgaactttgtatgggtgatttggttaactgttaaatatacggtcgggcttgtgagatggaataggtctgcggggagtaagacgtgaagggggggagtagaaaaagaagaagtgtcagatcggtaatgtgtgtccctgctcttctgaaagaaagagcgtgcgtaggttatagtggaaacccgtagtgtctctcgacgcgtcttcatggaaatgtgttggctggagtgctgacggagagagatgttcgtgtaaccgtgttgtgggtgggcggtacgtgtgttatggcgcccgttcaacttagttgtatggtcgtgggggggcgttgtggttgacgatgcgggttttatgacaaccgtagcttgtgctaccgcggcacggtgctgtttgttcgcgcacttagagatgcaagtgtttgaatttttgtcattcgtggcggacctgcgccatcgagggactcgcggatgacttgtgatagcgctaatctgtgttctttcgcg

SEQ ID NO: 579222 - DNA, 275 bp, Homo sapiens
ctaaggacttaggcaatcttctgctgcttgtgctgtaaccctcaccagcctgggcagcagcaagaaactatttattaaaaacttaagatgggccaggtgcggtggctcacacctgtaatcccagcattttgggaggccaaggtgggtggatcacttgaggccaggagttcaagaccagcctggccaacatgatgagacctccgtctctactaaaatacataaattagccgggtgtggtggcaggcgctctgaaatcccagctactcaagaggctg

SEQ ID NO: 579223 - DNA, 858 bp, Homo sapiens
aaacactggttgaaagccttaacaatagactaaaccaaccagaagaaagatttcagaacttgacgactaatctttcaaattaacccaatcagaaaatgggcgaataggaacagctccggtctacagctccccaacggtgacgacagccacaagaagggtgattctggatttcccatctgaaggtccggggttcatctcactaaggaatggccacaaaatgggcacaggtcagtgggtgcgcgccacatgcgtgtaccgaagcagggggagggattggctccctcggggaagcgccagggggtcagggagattccctttcctaatctcaagaaagggggtgacaggagggtacctggcaaaatcggggtcactccccaccggaatattgcgccttttctgacggggcttaacaaaacgggcacaccacggagaattatattcccggaacctgggctcagaaggggccctacagccccacgggagtctccgcctgaattggtaaacacaagcagtcctgagaaatcaaactggcaagggaaggcagcggaagggtgtgggggaaaggggcgccccggccatttggcccaaggcttcccttaaaggataaacaaaagcgaagccaagaaaacctgggacctggtggtgaaaacccaacaacaaggtcacaagggaggcctggccgtggcccctggtagagggcacccccttggggggggcaggggacccaaacgcaaacgaacagtgaacccttgtgtcgaactataagggtcccggtcagacagacttgaagacagcgagggttttccaatacgacactggtgatttgtgacgggtgaagggcccccagtgggtccggcc

SEQ ID NO: 579224 - DNA, 262 bp, Homo sapiens
  misc_feature (2)..(2): n is a, c, g, or t
  misc_feature (5)..(5): n is a, c, g, or t
  misc_feature (22)..(22): n is a, c, g, or t
  misc_feature (24)..(24): n is a, c, g, or t
  misc_feature (47)..(47): n is a, c, g, or t
  misc_feature (50)..(50): n is a, c, g, or t
  misc_feature (58)..(58): n is a, c, g, or t
  misc_feature (96)..(96): n is a, c, g, or t
  misc_feature (116)..(116): n is a, c, g, or t
  misc_feature (134)..(134): n is a, c, g, or t
  misc_feature (142)..(142): n is a, c, g, or t
  misc_feature (182)..(182): n is a, c, g, or t
  misc_feature (189)..(189): n is a, c, g, or t
  misc_feature (200)..(200): n is a, c, g, or t
  misc_feature (203)..(203): n is a, c, g, or t
  misc_feature (208)..(208): n is a, c, g, or t
  misc_feature (219)..(220): n is a, c, g, or t
  misc_feature (224)..(224): n is a, c, g, or t
  misc_feature (251)..(251): n is a, c, g, or t
  misc_feature (253)..(253): n is a, c, g, or t
antgnagcccagggaggcggancnggccccagaaggacacccgcctngantttcccgnagcccggcccgggcccttgggagcagaacagcctttgnaggttgacaggaggggaccntgcgagcagacgcgcgcnccacacancagccccgccccggccttttgggagccggggggcagaggnctcggancccaggagggnctntctanccacagctctnnaatnttcaagagcaacaggaatgtacacatntnaggggccag

SEQ ID NO: 579225 - DNA, 113 bp, Homo sapiens
tgaagatggcatgaatgatcaggatttaccaaactggagtaatgagaatgttgatgacaggctcaacaatatggattggggtgcccaacagaagaaagcaaatagatcatcta

SEQ ID NO: 579226 - DNA, 200 bp, Homo sapiens
gcatggaaggtacctggttgtgctgtgggaatcactggcccctccttggtttaaaaagcacaacacatcatacatatttaccatgaccagaagcgctggccccaatgtctccccacatctggtcgaggggaacctcgctggccatgcccacaaatgagagagaggagagagcctgccccagaacagagaaccacacgggt

SEQ ID NO: 579227 - DNA, 280 bp, Homo sapiens
gacgttggcttgatcattactaatatggaacgttacctggcgttagatcgtcgtgatacatgttagttttacccttgtgaaaatgtgttgccgcaatgataatcctgtctcagtacgagaggaaccgcaggttcagacatttggtgtatgtgcttggctgagtgagccaatggggcgaagctaccatctgtgggattctgactgaacgcctctaagtcagaatcccggccaggcggaacgatacggcagcgccgcggagcctcggttggacttatccgag

SEQ ID NO: 579228 - DNA, 534 bp, Homo sapiens
  misc_feature (46)..(46): n is a, c, g, or t
  misc_feature (108)..(108): n is a, c, g, or t
  misc_feature (320)..(320): n is a, c, g, or t
  misc_feature (368)..(368): n is a, c, g, or t
  misc_feature (379)..(379): n is a, c, g, or t
  misc_feature (447)..(447): n is a, c, g, or t
  misc_feature (450)..(450): n is a, c, g, or t
aggacggtaatgagggcatgtgagatgacatgacatacatcatgtntccccattactgcagctcatatacaccaatatgtgttgtaaacgagtgaagtgtgcttgtancccctcattgcatgaggtattgatcaagtagaagatcgtgcttacgtaggttgcgattggtgtgatatggattttagccatatgttgttattagatacacaggtttcaattagcatattttttgcattgtgtagttagatttagtgggttgtggagattcatgattagatgatgtgtgtcgatttccccatcgacgccaacatctcttgttngaggtttgcatctagcacatgtggtgcttaaggagtattagagggttnggcttagcatngctcacatgtttgattaaccctttgtgcattcatagagagggaacccatcaacttagggtttccctangtntcattagttaattgttgctcttagatatcgtggatgaattatgtggtatattattcatggttcctaatgtttcacctaggtatt

SEQ ID NO: 579229 - DNA, 212 bp, Homo sapiens
gcggagcgagccgagaggacccgagtggggccgaggccagtagccccggggcctgagcagaggccgtagcttgcgccggacccgggccaggcggagccaaagatgccggctctgctgcgcggccccgcaccgggtccgcgggctagcctgtacagctctcgtcccgttcccgcatacgtgcgtgctggtcggtgcgtgaggcggcccggtat

SEQ ID NO: 579230 - DNA, 305 bp, Homo sapiens
cggtcctactttccacaggctcattcaagaacaaaaattttggttgatagaagtccaatgtattgcctttttactctatggatcatttcctttatgtcatgtctccacttaagactaggtcatgaacgttttctcctaaaattttcttccgaaagttttagttttacatgttacatttgagcctataatccattttgagttaactttttataaaaaggatgatacttaggcagggtttttttttccttttgcctatgaatatccaactattccaacaccatttgctgaaaagactatcgttcctc

SEQ ID NO: 579231 - DNA, 510 bp, Homo sapiens
aggatattaggcgcgtactgagtggtcaccaaccgattcgaccagttatttgacgacagaatcggaccccttcgaggtgctgaagtgcagcagagaacacgaaaaaagaagccggcggggacggtgttgggggccctggggccaagagcgcagctcaggccgtggaccagatcaaatccaacgcggaaggcaaacagctgcgcacggagtcccagaaagaccgcaagaacccgctgacccccagctgttggcgtggttgacaagacagaggagacgcagccgcccgtggtgctaaagaaagaaggactaagaccgagttggaagaagacctgatcaacaacttccaggggtgaaggggccaatacttgatagaagaccagaaaggcgaccacctcgtgaacgaagatacgaaaagccactttgaagacaggggtgaaggaggcgcatttaaggtggatagacgataattgaccgacctatcgaggtcgtggtgacctggcagaggcgagg

SEQ ID NO: 579232 - DNA, 129 bp, Homo sapiens
tctcactccagtctgtggtgccggtctcccaagttcagtcaggctgtgccatgcctgagagcccccacaaagacggagcatgcggaatagggtggcagctcaagccctaacatacagggatcctgcggc

SEQ ID NO: 579233 - DNA, 113 bp, Homo sapiens
tacgggtagaggataagtagagacagatagggaccagagactcctcctgaaggactcctacctagacccctggtgatagtggtaaccaagatgatggtcctcagcagcaccac

SEQ ID NO: 579234 - DNA, 436 bp, Homo sapiens
acatgtagtcaaacagttatcttttccttgagggatccaattataaatggtttatatttatagctcaaatttacaggcagtgaaaagaaaaagaggaaggaagaaaccccatctcagtgcaatccatgtacagccaccacgaaacaatgagaatgtaatacattcataagcacaagtgaagtgaagagcatggcagacacacagatgcaactgtgaaagttccttttcttaagaaatgcaaggcagcaggacttcttaattacttacttgaagaaatattagacaaagttcattcaatgccagaaacactcatggatgagactacttcagaatcagactatgaagaaatcgggagtgcacttttagactgtagattgttcgacgacacatttgtaaattttcacagcagccatcgagcaaaaaaatacatgcatct

SEQ ID NO: 579235 - DNA, 80 bp, Homo sapiens
accgaggacacggccgtgtattattgtgcaagagatggcagccgagggaccagccggattttgatgtttggggccaaggg

SEQ ID NO: 579236 - DNA, 433 bp, Homo sapiens
  misc_feature (378)..(378): n is a, c, g, or t
  misc_feature (388)..(388): n is a, c, g, or t
  misc_feature (427)..(427): n is a, c, g, or t
gttggaaagggctgggattttcagaatagactttcttatatatctagggtagaaataagtaaaaattcctgaagatttgtcattgcccttctccacatatgttaagcattatcttctctttcagtctgattttaccagtttagaatgccaaaagggacatagcttaactggtgggcttttttgacctgcctgtgtttggagggcacggtctttcaacctgccatactgaaactcctgtgtaggacatcttgacacctttatgggttcaggattaataggaaccttattttagccttccatcccccatagtttcacggtctctagtttatttgactccggaaaatggacttccattttttgaggggtgaggacttaccnttcaggcccntccccttgttataaggagttttaggtgttgggccggggnctgggt

SEQ ID NO: 579237 - DNA, 186 bp, Homo sapiens
tccactccgcagaccagcacaacctcttcccctacaactagcacaacctcagctcctacaaccagcacaacttctgcccctacaaccatcacaacctccactccacagaccagcatatcctctgcccctacaagcagcacaacctctgctcctacagccagcacaatctctgcccctacaaccagc

SEQ ID NO: 579238 - DNA, 385 bp, Homo sapiens
taatttcagtgcgcgggaacgggcgtgaagtggttatgattgcatggccactcggtctgacaactcaccaacggtggagcagatcctggaggatgtgcggggtgcgccggcgaggatccagtgtatcaccatcctggccccggaagacccccagttcccttcaggataggatggaggatgcggaggccccgggagagcagtctaccagcaaagccgggcctacgtaggctagccaaccagacggcttgcaagcaggcgggccacgtgctgaggcagaggtgtagagcctccatgcagcagagccggacgaggacctggagacgggaggttaggcccagatagaagcaggcagcattaaccggcagccgaggctgactcctacaag

SEQ ID NO: 579239 - DNA, 252 bp, Homo sapiens
gggggttttttttttttgggagggggggttccccaaaaaaaagctttttttaaaagtggggccccctttaaaccccctttgggtatagggggccttgcttttccaaagccctaagggcccggtttcccttttgggggggggattttttttcccggggggggtttgttttgttttccgggccccccggggaattgttttttttttttttttttttttggggggttaccccccaaaaaaatttgttaaaaccca

SEQ ID NO: 579240 - DNA, 1048 bp, Homo sapiens
cagtaacacataggggcaggtgggcaggcctccgccctcctcccctactccaggcccactgagtctcagcccaggagccaccgagatctcccaagcaccatggtccgataccgcgtgaggagccgtgagctgaacgctcgcacgaggtgtactacggcacgtcgatgttgcatggtggcaacgagcaatggatcaccacggccacgaggagcaagggctgagcccggagcacgtctaggtctacgagaggatccatggaccagtctcactaatagggcgcagagcacggctctcgaacggaaggctgcaccgtgaatccacacggcggcatggatcgttcctgcagaaggctgcatcaagacgcatccgtgcaggcaccggaggaggccctcgcacgagggcctgcatgacccccaggaagagcaacattggcgagcaaaggcaagcatacacgctatcccgtgggagcccccctcgggcgcccacaggcatgagagagattaagagaaaaaaatcgtttgccgcgaccaatcaaccacacgtggaggtcccataggcaaactttcacccttacgagtcacatattgcttccacagtcccacccaagcgtgcgacagctttacgggaagacagaggatccagcgcttggctcccagacgaataagcaacccggcacgactgtgaggggcacaaataaggcaaaaggtttccgcgcccgttcaactaattcccaaggcgtttggcctgtccgaaataggcgccccttggggaggttttggggcgccgtgacccctggactagggcaaaacagtggccccccctgaagcacaaacggaaaattccagtggcacgcctgtggtacacacttggcaagacccaacaggaaaaggggttcccaagcccagttgtgcctcccgatggcataacagtagtgcgctgttgtggaactcggaaacgggcgaacccaaccaccacaacatgataaacaacaaaccagaccaacaaccaccactgggctcacgatcaaatccggcaccaaaagactcgg

SEQ ID NO: 579241 - DNA, 1361 bp, Homo sapiens
  misc_feature (387)..(387): n is a, c, g, or t
  misc_feature (400)..(400): n is a, c, g, or t
  misc_feature (425)..(425): n is a, c, g, or t
  misc_feature (488)..(488): n is a, c, g, or t
  misc_feature (533)..(533): n is a, c, g, or t
  misc_feature (541)..(541): n is a, c, g, or t
  misc_feature (562)..(562): n is a, c, g, or t
  misc_feature (571)..(571): n is a, c, g, or t
  misc_feature (573)..(573): n is a, c, g, or t
  misc_feature (586)..(586): n is a, c, g, or t
  misc_feature (601)..(601): n is a, c, g, or t
  misc_feature (650)..(650): n is a, c, g, or t
  misc_feature (669)..(669): n is a, c, g, or t
  misc_feature (691)..(691): n is a, c, g, or t
  misc_feature (696)..(696): n is a, c, g, or t
  misc_feature (709)..(709): n is a, c, g, or t
  misc_feature (731)..(731): n is a, c, g, or t
  misc_feature (747)..(747): n is a, c, g, or t
  misc_feature (757)..(757): n is a, c, g, or t
  misc_feature (759)..(759): n is a, c, g, or t
  misc_feature (780)..(780): n is a, c, g, or t
  misc_feature (845)..(845): n is a, c, g, or t
  misc_feature (901)..(901): n is a, c, g, or t
  misc_feature (936)..(936): n is a, c, g, or t
  misc_feature (1014)..(1014): n is a, c, g, or t
  misc_feature (1019)..(1019): n is a, c, g, or t
  misc_feature (1036)..(1036): n is a, c, g, or t
  misc_feature (1044)..(1044): n is a, c, g, or t
ggcaggtggagagagctctgtatgtagcacctgctgctaatggccattggtatacaacgttagatccggtgtgcttgggacgtgctcgtcttggctcatgtgtgcatgcgtgctgcatcgggctcgcatagtatcttatccgcgctacatgatgtgtcctgcactgcatcatcctgcacaagacccgtactgatgcccgacactcagtctgctctggcattccttggcgtattatcgcctcctggggtatcagcttggagactctctgagcttagtcttgcgcaccataaccatagctcgaggagcgcgatctctcacccgaacgtcccagaccggtagccgagataccaccatcgacaagagagccaggagcaatagagtaaattngcccggccgctgntcaccactgctcgtatcataccatnttgcactttctaaactcctatcaagcccatggcgctgagtagccaaaaagcgcatacggtgcnattgcgacctctttcgcaacagcaagggtattgcttaggtagctnttggagangaacctcagagacttccagcngcccactcntntgctcttccttcngcccatggaggaaantaaacttatttgtgtgatcccggcgcggcacggatccttaagtgaatcnctaccaccctacggctgantgtaagcttcctctataaatcncttcncccgtcctctccntgatgacggtttggtgtgattngccaacttccgtactntgtcgtgtgncnggtcggtaatggcctcggtcncgttcactcggtgtgcaataggcgttgactgtgcgaacacgtcataccgccgaagaaccatggtnctttggcgcccggaggagcaaaggcgctttcttcaatgagcaatcggccccgatgnctcgccacgaagagagactttcgaacacacgaatngctgcccaggagggcatgaactcgaatgacctaaccaggtggcaaggctggtgtgcctccgaacacccaaggaacttntattnccaaccccaatggaatngcctccancctacatccctaaccatctactccccctgtctccgatgaacatagtgtattgcaacttcgaactagaaagcacgtgcctttggtccttgaacccttcttgtgttttccccttgttgccatgtttctgacgggttggagaacatacagcacatgcggaaaatgggcacgatacaaaagcgaaatgaaagggacgagcaccgttccggggttaaacaagggcccagggccaggaggtaatatttagggaaaatcctttaaccaactaacgtggctgcttgggacaaactcgggcaaaggtattccttgggcgtggttga

SEQ ID NO: 579242 - DNA, 278 bp, Homo sapiens
tatgatatcgtgaggaagtatttcgagagagactattaataaattttattaagtataaggtgatcattgctctattattagttatggtcatctctatactgtgttaattataaattaaaatttagcataggtatatacatatagggaaaacacatgtcatcatcagggttccatcatggtctgcaatttcaggccaaccactggcgggctccagagctcatctcctctgctttcccacagcgggggccctatcgtcatcctcatactcccacctcagg

SEQ ID NO: 579243 - DNA, 1495 bp, Homo sapiens
  misc_feature (529)..(529): n is a, c, g, or t
  misc_feature (604)..(604): n is a, c, g, or t
ttttgatgatggcggatagctgtcaggagacgtctcgtgcgcgtcgccatggtccgacgaaaagtcccaaggaacggagtcacagactgacgaacaaccgactcactattaacttcgcaacggtggccgcgggcagcgactgggtctctgtcgcgtgcagctttaacgacttaaccgaggcatacaccaccgttaggctacaacctacattgataaggcctacttgtgcaatcgaaccagcggcacttgttccacactgacgagctagaactccacaacttccggatgcttgagcgcggccaacccaaatccacactggagaaccaagacagcgaccctgtgccacaggttgtgcaacatggcacgagactgcacaccgactatcgaaccttgacatgttgtcccgcaaccgacgcaacgcaccgggcgcacgcgtcgctcgtaccctggaccatgcaggggacacccttcgccctctcagtctgtacactctcacgcacaacgtcctggattaccgtgtactacacgncgaagcctacacggaagttctagctactttccgttgcacaacttccacggcacacaaacccttggccaacacagngctcggcggctctagccccagctccgaaccaacgttcccttggggacccgtaacataaacccccggcgtacatacggcttctgtacgccattcgataattcatcctttattgcacgttcgtgtgccccgcgcccgccgtgttgcgccgcgccaaagtcgtcccccgtgtcttgtaacttgcgcgccttaaggccacgtttacgcacggcggcgctcacgaccccggtaggggcgctcaattcagcttggttgggcccgacacaacagcggcccgtgtgttacgcttctggccacgacgtgcgccccactgcgctccgtcgcactctgtgctgctccgccaccgggcgggcacacgctccgtggtgtccccccctgccgctgcgcgccgctcagtagcccttcagcatgagaggacacagttcaggacggaccactctacccaccatcagccgcgcggggcaccaacacccgcgcgtcacatcacggggtgcgcgtccaccaacactaacatatctcacccgccggcaacaacttccccgaacggagcagcccaacaccaatctgttccacacgcccccgccccaattcttcacgcaccacccaatcaatcaagcgacctgggcaccacatgctgcacgccccctatactctccagcacccgcctcgctgtcacacgctcagcgcacaactcgactactccgcgcacgcttggaacaacatgctacaacacactcttacgaagcaccaaccaatctaaccgcttgcgcttctcccacagagcgtaacaccacctcaacacagcacgccacaccgccctcagcaccctaaacgcgaccaccatcgtggcggaaccatcacccgctggcttatacaacgcgggggccgccaccc

SEQ ID NO: 579244 - DNA, 148 bp, Homo sapiens
cggtcctacgcatatcgaattatcatatattcgattttccgtatgcgggagaagtgaacatgagcgagctcatcacccccaccgtcctgtttaaaagcttggcagatgccactcgaaccaaaataacgctactcatcgcccgcgaggg

SEQ ID NO: 579245 - DNA, 444 bp, Homo sapiens
  misc_feature (2)..(2): n is a, c, g, or t
  misc_feature (9)..(9): n is a, c, g, or t
  misc_feature (41)..(41): n is a, c, g, or t
  misc_feature (80)..(80): n is a, c, g, or t
  misc_feature (95)..(95): n is a, c, g, or t
  misc_feature (116)..(116): n is a, c, g, or t
  misc_feature (130)..(130): n is a, c, g, or t
  misc_feature (148)..(148): n is a, c, g, or t
  misc_feature (230)..(230): n is a, c, g, or t
  misc_feature (254)..(255): n is a, c, g, or t
  misc_feature (300)..(300): n is a, c, g, or t
  misc_feature (360)..(360): n is a, c, g, or t
  misc_feature (368)..(368): n is a, c, g, or t
anggcaggngacaactgaacggcccccggaagggaagctgngggcggtcaaaacccccggggtccagtccctggaaatancctacagaaacatcnggagccctgttgaacaaaaanggcaatcaccttanacctgtgttaaattaaanagttgactgacagttaccccttcctctctgtttactcctaccccaataaatatgaagggctgtagaagctcagggctcttgntctctagaagcaaagagcccccgnncccttcttgcaaacagatacttttgtctttgactccatactccantcccgtgttcgtcctcctccattcagtcccatattggccaggctggtctcaaactcctgntcttgtgntctgccaaccttggcctcccaaagtgctgggattacaggcgtgagccaccacacccacccaagaacagggtttgtt

SEQ ID NO: 579246 - DNA, 899 bp, Homo sapiens
gacggaagaaccaggagttggcgtgaccatggggaagcaaaagaaagcagaggaaggtatgcgaccatgaatgcgaatgcttagtctcagagatcagatggtcttcccagcaagaggatagattaaaacctacaaagaacgaaaatgaaggatcccagcgtcattaaatggaccaagaggaagttccccaacagccttcctgcttattgttccaactataatagcacgagtctgggtgccaccattagcacatcgcatcgttgatagccagactttatcaacgttttccatagaaagccaaactggagcttagtgcgagtcaatgatggactgtctgtgatgccaagtgtatcccatgtataaccgatagtgtaaggggctgaagttgagaaattggggcggaagtatcgagtggctctaaggattgccagaggatccaaagattcgtaacgattacgcagtgtacacactaaggaacctatgcagatgaatgcttagtgacagagagtaactcagcgtaagtgttacatcgtggccacgggttgaccgggacctgggaaaggaagaatccgtaagatgtcctggagtccctatcatgtacatttctaaccatagatacgaacatggatcggatgccagatgattgtgggagccctcgattctaaattcttacaatgacacagattccgtctggcttaatttcgagcaagtgactactgggttgcaaggttatgtacacaaaatgttagcggggagttttacggaatcagaagagatgatgagtcacagggcagatattaattataccggtggacaagaccagaagaataaaattaaaggatggagcctgaacagagttaagtacacttaagcaatatgtgaagccggggatgagggaa

SEQ ID NO: 579247 - DNA, 145 bp, Homo sapiens
gctgaggtaggctggggtcctgaaggctttgatcttggtccttctcccatggtaacggatcagttcatctctctgtccctcaggtcctggatttctctctggggcagtcaggctggcccctagcaggaagagagtcatcctggag

SEQ ID NO: 579248 - DNA, 1035 bp, Homo sapiens
gctatactaagcccaatgatgggtgctaatcgtggagcgtagcactggaaggtgtactaccaggacaagctctctgagccagcggagagctccgcttcgagattggcgagggggatgaacctgtgatctgccgttatggtctgtgagagcggccacttcgagcgcatgtgcacgaccaggacgaacagttccatcgtgatacctcaagcccgaggctatgtctctgggcagtgtcgggcacgcgaaaagttcgcaaagattcgcgcaccaaagattgcttgacggctggaacagtatgaccttacatcgcatcaaggagttttgtgaccaagcggcgccgaacgggaaggtcctatgggcgcagaactcgacacgttcgacgtacatctagggaaggcgtgagaaagcatgtagacaccgcaatgatgcttgcaacacaggatgacagaggctgcgacctgggtgttacctatcgacaagtgcacagggtacaagtacaaaagtcacaggcctgtatacatcacgagagtaataaagtgactgactcggatgagtcgtctgagacatgggaagttactggagatcctaagtcttttccttcagcacaagtgggatgtgaccaaggcgactcaagtaaatacgccgtccacggtgtcccccgtatgcggtaagcttggaggcctttccttcaacatcgtcgacacggacatgggggcctaagttggttggtccacttcgcttggcaagaacgccttaactaagggggcgctttccattccgtggcctggggcaactcttggaaagacagccgttgcgtagcacacggacatttgttgccctaataagtataaccctgggaaaaccaatggcgggtgcaacatacctgtaatgcaagagcggggggcgcccattcaatatccctggcgacagggctgtgaacgaaggaggcaccgcgcatgtccttgaagaaccgcgtgccaaatgtggagccgtttttagaaaatcccttggccacacggggtacccgttgtagtt

SEQ ID NO: 579249 - DNA, 236 bp, Homo sapiens
taggactcgaagcactggggagaaaggattaatgttactgaattttatcttcctgtttttttctgtctttacctactggcgttatgattacgtaagccccatgtctaccatttcgtactattgtttcagagactccactggtggagaggttacacgcattatagaaacatttggaataatagcaagggtggaactgggtacgcctggaaactcacccagttgcggagtaccgcagc

SEQ ID NO: 579250 - DNA, 267 bp, Homo sapiens
ccttcaaaatgtacttccttaattaaaaatacttaaattgctacaaaatgcaattatcagagccataaatgagtcatatatatatatagttttgcgctggtggagggtcttgccttgatgtgaatggctcctgactggtcagggtagtggtggctgaagattgaggtgattgtgacaatttcttaaaataagacaacaatgaagtttgctgcattgatggactcttccttttatgaaagatttccctgtagtatgtgacgctgtgta

SEQ ID NO: 579251 - DNA, 151 bp, Homo sapiens
ccggtaccgtatgtatagctttcattagtctgctagaatatttaataagttatcttaaagatttaaataaccattaaaatgcaacaagtttaagtaaaataattgactggtctagctattttctttttcttttccaggtaataagctaccc

SEQ ID NO: 579252 - DNA, 299 bp, Homo sapiens
gtcactctgccagtacagggtcagtccaagggccatccccgtcacctcgttcacacacactcacatggaagtgattccgatatacagtaaattggaatacatccacagtcgcgctttcgcataccacccctggactttccgatctgaggggcaataggctggtgggccagtggtccaatcactcgtcccttttatccgcgccactctgcagcaatgcctgaatgcagtcccacagagccttggcgctagtgtgtgagtggtcacggtgtgtgctctcggacagccccatagccacagcc

SEQ ID NO: 579253 - DNA, 622 bp, Homo sapiens
gccagtcgccacccgcgtccgcatccggcaccatgcgcgaagatcgtgcacagtccaggctgggccaatgcggcaaccagatcggctgccaagttttgggaggtcatcagcgagtgagcatgggatcgaaccccacaggcagttaccatggatgacagttgactctgcgagcttggagacgaatcaacagtgtactacaattgaggctgctggtaacaaatatgtaccatcggtgccatccgtggtgtgatcttggagccctggcacctagtggactctgtcaggtcatggaccccttcggaccaagatacttctagatccagatcaacgtatctgtgcttcggccgatggagtggcagccgggaataactgggccaagggccactacacagtagggagccgagctggttcgactcgtgtcctggatgtggatgaggaaggagtaccgagagctgtgactgtctccagggcttaccagctgagccactctctgtgcggggcggcgacggggtccgggatgggcaccctgctcatcagttgagatccgggaagagtacccatgaccgcatcatgaacaccttcagctgtcatgccctcacccaaggtgtcagacacggtggtg

SEQ ID NO: 579254 - DNA, 299 bp, Homo sapiens
  misc_feature (132)..(132): n is a, c, g, or t
  misc_feature (135)..(135): n is a, c, g, or t
  misc_feature (138)..(138): n is a, c, g, or t
  misc_feature (174)..(174): n is a, c, g, or t
  misc_feature (176)..(176): n is a, c, g, or t
gaaaaaaaaaaaaaccccgccccccggggggtgggggggggtcttctcttttttaacacccctccgggggagaagggggggggccgggggggtttttttttcctccctgtgggggggggtgttggccccccncanccnaagagggcctttcctttcccccgggtttatttttgngnggcgccgggccccccccccccccgggtttttgggggtgggggggggggtttgggggccccccccttttttttttttccggggcccccgggggggtttttggccccccccccccccctttttga

SEQ ID NO: 579255 - DNA, 1336 bp, Homo sapiens
tgtgtgtttggggggaggtctttttttttttccgcctcacacaaaaaacatatttctctctctcttgctgtgttgtgtgtgtgccaaaaaacacacactggtggagaggggtaagagagggtggggggagagaacaatattattaaaaagaagagggaattttctctctttttctccagagagaggtgatattataaaaaagagagagatataagagagggaataatattattaagagagagtagagtgagggaggagccacagcgtgtgtgagaacacgcgtgtgaggaagaaaaatatttccttttttgagagcttagtggaggagagagaaataatatattatatatataaagatcttctgcgagagaacataaacgagtgggagaaacctgcgaggagggaagatggatataatttctccccccacaacaaagagccccgcgcagagaagagtctcccaacaataatactccggggggggtaacacaccaaggcagggaggggtgtggaacagaggggagaaaaacaagaagaaaaaattcttcgtgagagagaaaaaacggcggggcagagagacccaaccaaacagggtgcgagaattccacgaaagaggggggagacacaccaaaaacccgcgagaacaaggggcccataaatgaggagggagaaacaaaaaaacaccctacagagaggcggtgcagaaagaaaacaatgcatctgaggcaacaaaaaagcgggagagcagacgcgggtggaggcggcgcatcgcaccagaaaaaagcgcggggaagaggacctacacaaccagaaggggaccaccctaacaaaaacacccgggggcgacagaaaaaactagtggccaacacacaagagaacacgacaagaagaacacacggggagtaaaccccaacgagagaacccttccgagagagagagagaagagaaaaccaacacggggggaaacgagggcgacagaaaacaagacgacaaagaaggcggcccccaaagacaacccccagcggcgaaaaaaagagcgcggagaatgaaaagcggcgagagttcatatacaccaaaagacgaggacaagagagacccccacagaaaagagaaaacggggtacaaaccaccaggagttcgaggggaagatgtggaagaaacaatattcgagacctaaagaaagaagcgagatatcaatagagatagtgacgcacacaaaaaagaatcaacaaagagacgactgaagaggacaacaaaggggaggagcgatacaccgacaagtgggcggtacgagatgagagaacgtatcgcaagggtggcaatgaagtgggaatca

SEQ ID NO: 579256 - DNA, 158 bp, Homo sapiens
ctcggtgtgtgaggagttaggccacatgtcctcagttaccggcttcagttataccttttcatcttcctgtttatcattttcatcatatggatcgcccagggagtcgtatctgtatgtattaaggcccgtgtggttgccggggtcgatctggcggccgc

SEQ ID NO: 579257 - DNA, 398 bp, Homo sapiens
ggctatacacatgatgatagctcagtaactgattttttaaaaacatgagtttaaaacaaaatggatatcaaaaattaaaaaacacttggttaaaaatttctatgctgctttttgatatatcaggaaagattaatatttataatttctaatttataaattaagacattctattcacttgaccttttaagcaaagtttttataagtaagccacagtaggccatgaactacattagttatctgatagtagagtgttctcagagaatttatttttctacaaaattatttaggatgtaggtaaaggaaaattgctttactcagtgcaggttgggggtgtagtggggctgttggactttggaatactttattaaggctctacttttttttttttggggggggta

SEQ ID NO: 579258 - DNA, 180 bp, Homo sapiens
aagcagagacggggtttcgccatataggccaggctggttttggactcctgacctcaagtgttcctcctgccttggcttcccaaagtgctgggattataggtgtgagccaccgtgcgcggccttgttcctctcttatagtgctgcacctctaatttttttcttcccttctgtcgtcttctc

SEQ ID NO: 579259 - DNA, 225 bp, Homo sapiens
  misc_feature (22)..(22): n is a, c, g, or t
  misc_feature (26)..(26): n is a, c, g, or t
cagggaaatttttttttaaaanggantttcccggagggccccccgggtttttttttcccccctttttttacccaaaggcctttttttccctttaaaaaaaaaaaaaaaaaaaaagggctttcttttcagttttttttatgggaaaatccccccggggtccaaaaaaaaaattttgaagtttttatgtcagggaagttttttttaaaaaaaaaattgtaaacccca

SEQ ID NO: 579260 - DNA, 406 bp, Homo sapiens
ttgagtgagtcttatcctgagtcctacttgattgcactgtggtctggaagatgtaatgatttctacttatcttcgcatttgctgtggaatgttttacttccaattatgtggtccattacagaataagtgcaatgtggtgctgagatgaatgtatattctgtagatttggggtggagagttctgtaggtgtctattaggtctgctaggtccagagctgggtacaagtcttgaatatccttgttaatttgtctgtctcgtcgatctgtctaatattgacagtggggtgttgaagtctcccagtattattgtgtgggattctaagtctctttgtatgtgtctaagaacttgctattaccaatctaggtactcctgtattgggtgcatatttcttgcggatgagttcact

SEQ ID NO: 579261 - DNA, 132 bp, Homo sapiens
catgagagctggagaggctagcctcaacagtgcgctgtcgggctagtcggggctgtcgggctagtcggggctgtcgggctaagtcggggctagtacgggctacgtcggggctagtacgggctagtacgaggc

SEQ ID NO: 579262 - DNA, 1340 bp, Homo sapiens
  misc_feature (1078)..(1078): n is a, c, g, or t
  misc_feature (1245)..(1245): n is a, c, g, or t
  misc_feature (1299)..(1299): n is a, c, g, or t
  misc_feature (1330)..(1330): n is a, c, g, or t
tcacagtcttttttgcccacgggtttttccctaaatgaaaccgtcatactaacaggggctatttaccatcccaacgactaggacaaacaggaaatgattaagagcactgtcacattaaaaacgctcatcttagtcgcaaagcaagtctcgcaattaagcactaaactttgtaaacagtgattctaagcagctttcacatgaagttatccacacgacattacgcactcaagcacggtttatcgccatcccgccttgactgttaccttccgatcaagtggacttaaacacgattcagcaagactgtcagttcatcataaggcttgtggatgcgtatcatcatcgccgcgtaccggtcgaccatcacaggtccccactattattgatgaattctctaaaatcccacattgactaccacctcggcggaatctgcattcggttctatcggccgatgagggatctctacaagagcgcgttgcttgtgggaattacgtctatttgcaaactgccgcatccggcggacataataattgcgccatcaaccagaatcatttagctaaaaggcatctcgcaacggcggttcattcccgtcaaatcagcgccttaacccctacacatgttcactaacctctctttaccaggctcgctaataaagcacaggcgtttcccccaaccaatatatcacagcctcggagagatctcccctctcacacgtgcgcctccttctttccaaagctgctgcagaacccactctactgatactcaggagaacaaccgtgtaacacctgacaacatcggcccttatagctccacatacatcgggaccttctacctagtcttatctaccgcacgcattctactactggggcctcgcgactccctcacccgcgttacggtcaaagcctttcaactgcagctgcgtcctctcaccctcttcgtgctcaaccgcgtatcccacagtacacacggactagtccgtccctcagtcatatgacacctactacacgttatcacggcccacctcagcgcctaagcgcatacccatcccaatatccgcgctttcgcacccacttccgcccantactctactacaccgcatcagccccttattcctgaatcgcgcatgtctcacttgcatataacactcaactctatcaccatgagagcatgccgctatctctacaacactcactacgtcataatcgtgacttctctgacatcataccatgcgctcactcgcgctctgtngtgtgaacactcctatcttctctctcctacgctcctgcaccgtctgctctatgnacctatcacacagtgtcctcacttaccatcngtgactctct

SEQ ID NO: 579263 - DNA, 143 bp, Homo sapiens
cgggggcgaggggctgcggaggcagctgacccggaaacagcgtatcactgagaccgagtcgccttatcaggagctcaggggtcacgaggtcgcgatgtctacatgcgacctcaacacacagcaggcccgtattacaaactgag

SEQ ID NO: 579264 - DNA, 119 bp, Homo sapiens
agtaacggacgcagaaatagctggaatacggtaaagatagggtcagataggaccaaaagcagcaggataggtagggagataggctaccatatctagaagctagcataaagctaccatac

SEQ ID NO: 579265 - DNA, 1431 bp, Homo sapiens
  misc_feature (1233)..(1233): n is a, c, g, or t
tagccctgccgcccgcctgtgtgtccccagagccatggagagagccatgtctgatccagaatggccaatgctggcagagcatggcctgaactgctatgatgtgaccatggcatgccttcatgaaatgtgctgcctgtggagaagtgtgctgatggagctctcctgctgaagagctgaaaccttgctctcagtagcctataagaactgtggttgggctgtgccagatggtgctgcctgtgagtgtgttgcttgtccaggtcatttgatgcagcaaaatgcaactgatgtgatgtgtgctctgggcatgtgacgcaagtggtgccctgatgtgttgctggttgacagtacctgtgtgaagaatgtggtgggacgaccttgaaggctccaagtgggctgttgttgcaagaacaacctgatcgcattgtgtggcccattgccttgtggaccaagggaccaacactatacagttcaacagtgtggaatgtggcccctggtgggaacttgcactgaatgcatgccctgtgatgtcctatcaatagcccattagacatggacattgacatggtggggaagaccataatctaaacctggcagttaaacagcgatttggtgaccaccctggaacggtgaggttagtggccacagacacccctaggtgtgtttggacacgtggaaccgatatggaagatgtgcctggcgactttccgcagtaattggcagccttaccaactggccccctggtggcttctaatgggcccctttaagcgctatagtgaatggtggcccaggttggagaaccggagttccaaatgggccaaatggacatgcgtggatgtgaactttgcgccatggcctacgataccacctaaatagagcgtcgccgtagataccacttgctcactttggctgaggccccttttgtggcacccccgttagaagaagcctatatatattccccaggagtacatttttcaccaaccgttcaacctgaataggaaattcctgtggctcccaaacaacaatgggcacccccccctcggaatagtgaaatgtgtgccacaagatgctctcccatttcctatatggggcccatacgatgaaccgccaagccgttattataccaggaactagagatgaggaccccaatttggtgcgccttatgagatctccctttaggcagagcgcactccctccttttcaagtgcctgcatagaggcaccttaccccctttcnaaccaagatatgtggaacagataggagaacgacccctttcctgattcactgtgtgcgcaggcactttagcgctttaggcgggactagaaaagcagaacccctttgggacaagcatttgtttagggaacctagttgtgcccgggagcaaaaacctgatccctggtggagcggagaaacgacaacagtgcggagggcgcg

SEQ ID NO: 579266 - DNA, 142 bp, Homo sapiens
  misc_feature (58)..(58): n is a, c, g, or t
  misc_feature (62)..(62): n is a, c, g, or t
  misc_feature (97)..(97): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (125)..(126): n is a, c, g, or t
  misc_feature (133)..(133): n is a, c, g, or t
tgactccacctccaagttatgccatggccgcttccagaccatggaggagaagaaagcnttcntgggaccactgaagaaagaccgaattgcaaaggangaaggagcttaatnccnggnacagattnngcagttngtgggtctc

SEQ ID NO: 579267 - DNA, 480 bp, Homo sapiens
  misc_feature (22)..(22): n is a, c, g, or t
  misc_feature (41)..(41): n is a, c, g, or t
  misc_feature (213)..(213): n is a, c, g, or t
  misc_feature (437)..(437): n is a, c, g, or t
  misc_feature (445)..(445): n is a, c, g, or t
gcaggagaacctcttgaatctnggaggaggaggttgctgtnagctgagatcgtgccactgcactccagcctgggtaacaagatagaaactccgtctcaaaaaatatagatatacatgtatagactggctgaatggattaaagtacaggacccaactctatgttgcctacaagaaactcacttcacttgtgaagacacatatagactgaaagtnaagagatgaacaaagatattctatgcaaatgaaacccaaaagtgagcaggaatagctatacttagataaatcagactttaagtcaaaaactataaagagagacaaagaaggtcattatataatgataaagtgatcaatttaagcaagatggtaaagcaattcttaatatatatgcatccaacactggggcacccagatatataaagtaaatgttattagttctnaagggggnggtagattccgatacgataatagttagggaattta

SEQ ID NO: 579268 - DNA, 116 bp, Homo sapiens
tgtcctgcgggtcttacgtgttggcgcagtagagtgttggaagccgagagatgtttcccagttcccagacggtctaatgttgaggacgagtgctcgtcccatcgaacgctccgtcc

SEQ ID NO: 579269 - DNA, 150 bp, Homo sapiens
acgttctatagcactagatagagcgatagctccatgtgcagtgatatcaaccatctcgttaccaacgttcggaggccaagttccgcggcgtcacaatttgtgaccataatgcggaggaacgatctggcaagtgaagtctacatgacacgt

SEQ ID NO: 579270 - DNA, 1387 bp, Homo sapiens
  misc_feature (225)..(225): n is a, c, g, or t
  misc_feature (255)..(255): n is a, c, g, or t
  misc_feature (311)..(311): n is a, c, g, or t
  misc_feature (318)..(318): n is a, c, g, or t
  misc_feature (375)..(376): n is a, c, g, or t
  misc_feature (382)..(382): n is a, c, g, or t
  misc_feature (396)..(397): n is a, c, g, or t
  misc_feature (402)..(402): n is a, c, g, or t
  misc_feature (405)..(405): n is a, c, g, or t
  misc_feature (411)..(411): n is a, c, g, or t
  misc_feature (428)..(428): n is a, c, g, or t
  misc_feature (437)..(437): n is a, c, g, or t
  misc_feature (458)..(458): n is a, c, g, or t
  misc_feature (485)..(486): n is a, c, g, or t
ttcaccggcaccttgcgtcggtcgcgccgcgggcctgctcctgccgcgcgcacccccggggcttcggctccggccgggtcgcgcccagtttcctgccctgaggccgcgggcagccgccgccatggtgtgcctaccgtctcccagcccaacacgggtgaagtgctccggggacgggtcggcgccccgatgcatgcccgtgccctacggttctccgccatgcagggntggcgcgtctccatggaggatgctcacaantgtattcctgagctgacagtgagacagccatgttttctgtctacgatggacatggngggaggnagttgccttgtactgtgccaaatatcttcctgatatcatcaaagatcagaaggcctnncaaggnaaggcaagctacannaaggnttnagaagnatgccttcttggtatgnacgccaaanttgaccactgaagaagtcatnaaagagctggcacagattgcagggcgnnccactgaggcatgcaagcatgcacacacacagcacaagacagtagcgtgcatgcacagcatgcatggtggccccacaagccaggcggcctgccacctgctgcccggacagcaggcgtaccaagtgcaactaaagcgccacgcaacgtgcgcgacacgacaacggagaccaaacaacagacagcgcaggggcaacgaccaccgaacaagcacagcacgtgactggcaagatgagagaaacaagccgaaggacaaccagcggcacccaaaggggaactcgaagagcggcacagcaaccaggcgcccgaagaggacgcacacggaacggccacaactccattcacgagggcacacactgggcaccaccagggccacaggggcgacaacaccagaccaaagagccacaccaagagccggaacaggacgggcacgagacggaaccaaggcacagagaaccggatcgagccggggacagcccccacaagcgcagacagggagcagcgcacacggaggacagcaacagacaaggcaggaggaaagggagcgcgacacagcaggccgagggagcgcgcggggcagcgtcgggacctcccatcgtggcgggaggacgaagcaagaggacgacgggagacgggaccgagtggaccgacagaaacggagacacgggaagacggaggggcgaggagaggacgacgaggcccggacggaagcagaggcgaccaggggagcaaaaacgagacgcacaaaggcggcagcgagacggaggaaaggaggggggagaacaggcggggagcgagaccacagaggagggacacgcagacgacgcaggagagaaggcaggggagggccgagccggagcaaaagcaaggagaggaaagagcggcgggaacgagcgcgagaact

SEQ ID NO: 579271 - DNA, 826 bp, Homo sapiens
  misc_feature (225)..(225): n is a, c, g, or t
  misc_feature (255)..(255): n is a, c, g, or t
  misc_feature (311)..(311): n is a, c, g, or t
  misc_feature (318)..(318): n is a, c, g, or t
  misc_feature (375)..(376): n is a, c, g, or t
  misc_feature (382)..(382): n is a, c, g, or t
  misc_feature (396)..(397): n is a, c, g, or t
  misc_feature (402)..(402): n is a, c, g, or t
  misc_feature (405)..(405): n is a, c, g, or t
  misc_feature (411)..(411): n is a, c, g, or t
  misc_feature (428)..(428): n is a, c, g, or t
  misc_feature (437)..(437): n is a, c, g, or t
  misc_feature (458)..(458): n is a, c, g, or t
  misc_feature (485)..(486): n is a, c, g, or t
ttcaccggcaccttgcgtcggtcgcgccgcgggcctgctcctgccgcgcgcacccccggggcttcggctccggccgggtcgcgcccagtttcctgccctgaggccgcgggcagccgccgccatggtgtgcctaccgtctcccagcccaacacgggtgaagtgctccggggacgggtcggcgccccgatgcatgcccgtgccctacggttctccgccatgcagggntggcgcgtctccatggaggatgctcacaantgtattcctgagctgacagtgagacagccatgttttctgtctacgatggacatggngggaggnagttgccttgtactgtgccaaatatcttcctgatatcatcaaagatcagaaggcctnncaaggnaaggcaagctacannaaggnttnagaagnatgccttcttggtatgnacgccaaanttgaccactgaagaagtcatnaaagagctggcacagattgcagggcgnnccactgaggatgacgatgacaagaaaaaggtgtgatgaagatgatgtggcacactgaggaggctgcactgcttgcgtgaagaaggctaccatggactattgaagagctgtgacacgctacgggagactgtcacaggccctcccacaagcaatccgggcgtggccgcagacaaggtcaggcccatggaggcagactggataataggaatcttcaaaaaatggccagcaagccacaggctcccaaccacggacggcgcactgagccgacccggagggctgtcactgaagcattaacctgaacagaaaggaagagaaaaagcaggagaaaccaaacaacagcg

SEQ ID NO: 579272 - DNA, 501 bp, Homo sapiens
atcccagcactttgggaggctgaggcgggcggatcacgaggtcaggagtttgagaccagctcacatgtggtgaaacctgtttggtaaatacaaaatagctgggctggggtgctgcctgtatccagtatcggaagtgagcagaaatcattgaatcaggaggcgaggtgcagtgagccgaatgtgccaagatccagctggcaatagagtgagactccatctcaaagaaaacaaccaaacgatgggcaatgcaggccgggcttgggggtcagccggtaatcccagatttgaggagtccggtgggttgcacccaaggtacggagtcaaagacacgcctgcgcaacattgatgaacccctgttctacaaaaattcacaaaaattagcggggcgtgttgaggcgccggagtcccagcaaacaagggagcatgaaggcaggaactttgcttgaccccaggaggcaaccgttggagtggcgtgagacacaccgcactggatccagcctg

SEQ ID NO: 579273 - DNA, 354 bp, Homo sapiens
  misc_feature (265)..(265): n is a, c, g, or t
  misc_feature (312)..(312): n is a, c, g, or t
  misc_feature (329)..(329): n is a, c, g, or t
ctattcaagtgcaaggatatcagaaggtttttttttatttaaaaaatttttttttcgagatggagtttcactctgttgcccaggctggagtgcaatggcagcttactgcaacctccacctcctggttcaagcgattctcctgcctcagcctcccaagtagctgggattacaggcacgcgccaccacacctggctaattctatttagtagaaatggagtctcaccatgttggtcaggctggtctcgaactcctgacctcaggtganccacccaccttggcctcccagcgtgctgggattataggcatgagccnccaggccggccccaggnttttatattaagccttcttgctctc

SEQ ID NO: 579274 - DNA, 120 bp, Homo sapiens
tattgcgcacgatacgggctgaaggtgggctgtctcgggaagggtgagttgaccagcgcaccatactgagctcatcagtgtacctgcatgaggcgaccaggactcctgatgctgtgtaag

SEQ ID NO: 579275 - DNA, 196 bp, Homo sapiens
gagaatatgagtgccatgcatccaatccccaagggacagggcttcagcatcagcaaaaattacagtggttgatgcgttacatgagataccagtgaaaaaggtgaaggtgccgagctatatacctacgagaatgatgttaggctcgatggggtaaaaggaggcatgggtactgacagtacctagtgtgtgcctgatt

SEQ ID NO: 579276 - DNA, 903 bp, Homo sapiens
  misc_feature (25)..(25): n is a, c, g, or t
  misc_feature (123)..(127): n is a, c, g, or t
  misc_feature (175)..(175): n is a, c, g, or t
  misc_feature (182)..(183): n is a, c, g, or t
  misc_feature (211)..(211): n is a, c, g, or t
  misc_feature (242)..(242): n is a, c, g, or t
  misc_feature (245)..(245): n is a, c, g, or t
  misc_feature (264)..(266): n is a, c, g, or t
  misc_feature (278)..(278): n is a, c, g, or t
  misc_feature (281)..(281): n is a, c, g, or t
  misc_feature (303)..(303): n is a, c, g, or t
  misc_feature (305)..(306): n is a, c, g, or t
  misc_feature (309)..(309): n is a, c, g, or t
  misc_feature (311)..(311): n is a, c, g, or t
  misc_feature (323)..(323): n is a, c, g, or t
  misc_feature (329)..(329): n is a, c, g, or t
  misc_feature (332)..(332): n is a, c, g, or t
  misc_feature (336)..(336): n is a, c, g, or t
  misc_feature (341)..(341): n is a, c, g, or t
  misc_feature (348)..(349): n is a, c, g, or t
  misc_feature (354)..(354): n is a, c, g, or t
  misc_feature (356)..(357): n is a, c, g, or t
  misc_feature (362)..(363): n is a, c, g, or t
  misc_feature (372)..(372): n is a, c, g, or t
  misc_feature (377)..(377): n is a, c, g, or t
  misc_feature (388)..(388): n is a, c, g, or t
  misc_feature (390)..(390): n is a, c, g, or t
  misc_feature (396)..(396): n is a, c, g, or t
  misc_feature (400)..(401): n is a, c, g, or t
  misc_feature (409)..(409): n is a, c, g, or t
  misc_feature (414)..(414): n is a, c, g, or t
  misc_feature (433)..(433): n is a, c, g, or t
  misc_feature (452)..(452): n is a, c, g, or t
  misc_feature (494)..(495): n is a, c, g, or t
  misc_feature (513)..(513): n is a, c, g, or t
  misc_feature (570)..(570): n is a, c, g, or t
  misc_feature (644)..(644): n is a, c, g, or t
  misc_feature (716)..(716): n is a, c, g, or t
  misc_feature (818)..(818): n is a, c, g, or t
  misc_feature (829)..(829): n is a, c, g, or t
  misc_feature (886)..(886): n is a, c, g, or t
cagtgagggtctctctcttcctctngtgctcttgctggaggctggtggtccagagaggtcttactcctataggaggcacatgtgggaccatgagagtccaccaccctgtagctgtagccaaannnnntgtaataccaggaaatgagcttaaaaaagtagtcgttaaaggcaatancaacaannagcagtcaaagagtggagagagtgaggngtacagctgattagaagtaagaaagaagaanaantaggatgcaaagtagtagnnnaaaaaagccctnaanggggccctccgaaacctgcatnannacntncttaaaaaaatnaaaaanggnaggnttttntaaaaannaggtnanntccannaataaaacnttggnaatagggaaangnaagganatannaataaaantaaantaaaaaaaaaagataaaantaaaaaaaaaattaaaaanaccaataaaaaaaaagaataaagtaatggagaaaaccgcgannataacaccacaatatccnggaggaaatccaaagtcttctgggtggcagttatggcatggactgtggtcatgagtncttccacgataccaaagttgtcatggatgaccttggccaggggtgctaagcagttggtggtgcaggaggcattnctgatgatcttgaggctgtagtcatacttctcatggttcacacccatgacgaacatgggggcatcagcaganggggcagagatgatgacccttttggctccccctgcaaatgagccccagccttctccatggtggtgaagacgccagttgactccacgacgtactcagcgccanatctgccccanttgattttggagggatctcgctcctggagatggtgatgggattccattgatgaaaancttccgttctcagcctt

SEQ ID NO: 579277 - DNA, 430 bp, Homo sapiens
tgaaaaaaaaggtcttgggggtgggcgggatttgatctgtcctcattctctgcgcctttcgcagagcttccagcaccggtatgttgggccagagcatccgtaggttcacaacctctgaggtccgtatgagccactatgaggagggccctgggaagaatttgccattttcagtgggaggggagtgggcgttactagctaacatgggtctgaaccttggatctgcatttgctacaccctttcttgcactaagacaccaactgcttaaaacataaggaggtttcagttccttcattgaacagatatgaagagcattttaagaggtgcagcctctggaagtggatcaaactagaactcatatgccatactagatatgtttgtcactaaactgatgacgcgggccaaaataggggggtctatcctgaaaccatgt

SEQ ID NO: 579278 - DNA, 1066 bp, Homo sapiens
  misc_feature (428)..(428): n is a, c, g, or t
  misc_feature (580)..(580): n is a, c, g, or t
  misc_feature (670)..(670): n is a, c, g, or t
gggcaggtgccatgggcccgcttgaggcacactgtaggggacgcgagtggctgggccatggtgcggcgctcgggccgccgccgccgtgtgccttcggcggggtcctcggcctcttcaggcagacgcacgccgcctcaggacgctggggcttggggagctgctggaggagttctcgccgtgactcagtaccgggccaatggatggcagcgggaccggcggttctaatgcgttgacgccgcattgaggaatgcatgatcgtcttggtacgccttgttttgagtcagaggacttacatgatttccaagctggtagatttcctacacatcgagcgaatcgtgcgtgcatatctggatgggaccggacttatgcacccaggtcatcgacttcaggtggtctaccatgggcaggtacttgcaggaagctctctngcaaggaacgcgacgcaaaaggtaccaacaggtgtcctgtaagaggtttagcctgatttaccgaagggtgccatacccaaagttgtggccaaccgatctccgtcgtatctctcgagcgctgtgctatagaccaggatgacatcgcgaccccnggaggtggcctagcgcaccgaagaactagcgccaattccgctcggttgcgccgcgaccgatatcataatctcccttgtgttgtccaccanaggggggcttcacaattcgccaacctaccggtttgtgccccacggggtgttccgggccacgccaagcagtccttgaggcccttgtttcgaagcgtgaagcgcggcacggcagtttccgtgcgctaaattggcgcacccgccacctacacagttgggtctcaaccaatatgcttccaattgcggcgttggtcaaccttagcggagcgccgcggtcgtggttgccggcggaacgcttattcgttgcacttgaccctcgtggggttgggaaccggagccccatttgcctaggttgcccgccgtggaacccgtatcccccccacggcgggatggcggccaaagccgtgggagcttcggtttgccgcctttcccttctccccgggacacagcccctgtggc

SEQ ID NO: 579279 - DNA, 256 bp, Homo sapiens
ctgatgcccatgtccaatgtgaggatggccttggtacagggtcggccattctcacctcgtctcagccctggtgagcccgtacactccacttggagtctggatggacacatgggccagggggtctgaagcagcctcactcttaacttcgtgttcaacactccatggaaaccccggactgggacacaggcggaagcctatggagagccgaatcagtgtttgtgaagaggcaggactggccggagtgatcaaacatagg

SEQ ID NO: 579280 - DNA, 266 bp, Homo sapiens
gatgtagatcgagctgcatgtcttcatccttgtcactggccggtcatctcagtgcctcctggcttggaaaaacccttgcgggatggttgctttggactcactgttcaccaggtgaatgaggacagaacttcttgaagtactccatttgttctcattctcatcaattttcctctggtcataaatccttacaaactgatctcgtccacccactgcaaactggtgggtataggcaggattcacatagatagttacaggggtaccgagct

SEQ ID NO: 579281 - DNA, 8232 bp, Homo sapiens
gcctccacacggctccgtcgggcgccgcgctcttccggcagcggtacgtttggagacgccgggaacccgcgttggcgtggttgactagtgcctcgcagcctcagcatgggggaacatggcctggagctggcttccatgatccccgccctgcgggagctgggcagtgccacaccagaggaatataatacagttgtacagaagccaagacaaattctgtgtcaattcattgaccggatacttacagatgtaaatgttgttgctgtagaacttgtaaagaaaactgactctcagccaacctccgtgatgttgcttgatttcatccagcatatcatgaaatcctccccacttatgtttgtaaatgtgagtggaagccatgagcgcaaaggcagttgtattgaattcagtaattggatcataacgagacttctgcggattgcagcaactccctcctgtcatttgttacacaagaaaatctgtgaagtcatctgttcattattatttctttttaaaagcaagagtcctgctatttttggggtactcacaaaagaattattacaactttttgaagacttggtttacctccatagaagaaatgtgatgggtcatgctgtggaatggccagtggtcatgagccgatttttaagtcaattagatgaacacatgggatatttacaatcagctcctttgcagttgatgagtatgcaaaatttagaatttattgaagtcactttattaatggttcttactcgtattattgcaattgtgttttttagaaggcaagaactcttactttggcagataggttgtgttctgctagagtatggtagtccaaaaattaaatccctagcaattagctttttaacagaactttttcagcttggaggactaccagcacaaccagctagcacttttttcagctcatttttggaattattaaaacaccttgtagaaatggatactgaccaattgaaactctatgaagagccattatcaaagctgataaagacactatttccctttgaagcagaagcttatagaaatattgaacctgtctatttaaatatgctgctggaaaaactctgtgtcatgtttgaagacggtgtgctcatgcggcttaagtctgatttgctaaaagcagctttgtgccatttactgcagtatttccttaaatttgtgccagctgggtatgaatctgctttacaagtcaggaaggtctatgtgagaaatatttgtaaagctcttttggatgtgcttggaattgaggtagatgcagagtacttgttgggcccactttatgcagctttgaaaatggaaagtatggaaatcattgaggagattcaatgccaaactcaacaggaaaacctcagcagtaatagtgatggaatatcacccaaaaggcgtcgtctcagctcgtctctaaacccttctaaaagagcaccaaaacagactgaggaaattaaacatgtggacatgaaccaaaagagcatattatggagtgcactgaaacagaaagctgaatcccttcagatttcccttgaatacagtggcctaaagaatcctgttattgagatgttagaaggaattgctgttgtcttacaactgactgctctgtgtactgttcattgttctcatcaaaacatgaactgccgtactttcaaggactgtcaacataaatccaagaagaaaccttctgtagtgataacttggatgtcattggatttttacacaaaagtgcttaagagctgtagaagtttgttagaatctgttcagaaactggacctggaggcaaccattgataaggtggtgaaaatttatgatgctttgatttatatgcaagtaaacagttcatttgaagatcatatcctggaagatttatgtggtatgctctcacttccatggatttattcccattctgatgatggctgtttaaagttgaccacatttgccgctaatcttctaacattaagctgtaggatttcagatagctattcaccacaggcacaatcacgatgtgtgtttcttctgactctgtttccaagaagaatattccttgagtggagaacagcagtttacaactgggccctgcagagctcccatgaagtaatccgggctagttgtgttagtggattttttatcttattgcagcagcagaattcttgtaacagagttcccaagattcttatagataaagtcaaagatgattctgacattgtcaagaaagaatttgcttctatacttggtcaacttgtctgtactcttcacggcatgttttatctgacaagttctttaacagaacctttctctgaacacggacatgtggacctcttctgtaggaacttgaaagccacttctcaacatgaatgttcatcttctcaactaaaagcttctgtctgcaagccattccttttcctactgaaaaaaaaaatacctagtccagtaaaacttgctttcatagataatctacatcatctttgtaagcatcttgattttagagaagatgaaacagatgtaaaagcagttcttggaactttattaaatttaatggaagatccagacaaagatgttagagtggcttttagtggaaatatcaagcacatattggaatccttggactctgaagatggatttataaaggagctttttgtcttaagaatgaaggaagcatatacacatgcccaaatatcaagaaataatgagctgaaggataccttgattcttacaacaggggatattggaagggccgcaaaaggagatttggtaccatttgcactcttacacttattgcattgtttgttatccaagtcagcatctgtctctggagcagcatacacagaaattagagctctggttgcagctaaaagtgttaaactgcaaagttttttcagccagtataagaaacccatctgtcagtttttggtagaatcccttcactctagtcagatgacagcacttccgaatactccatgccagaatgctgacgtgcgaaaacaagatgtggctcaccagagagaaatggctttaaatacgttgtctgaaattgccaacgttttcgactttcctgatcttaatcgttttcttactaggacattacaagttctactacctgatcttgctgccaaagcaagccctgcagcttctgctctcattcgaactttaggaaaacaattaaatgtcaatcgtagagagattttaataaacaacttcaaatatattttttctcatttggtctgttcttgttccaaagatgaattagaacgtgcccttcattatctgaagaatgaaacagaaattgaactggggagcctgttgagacaagatttccaaggattgcataatgaattattgctgcgtattggagaacactatcaacaggtttttaatggtttgtcaatacttgcctcatttgcatccagtgatgatccatatcagggcccgagagatatcatatcacctgaactgatggctgattatttacaacccaaattgttgggcattttggctttttttaacatgcagttactgagctctagtgttggcattgaagataagaaaatggccttgaacagtttgatgtctttgatgaagttaatgggacccaaacatgtcagttctgtgagggtgaagatgatgaccacactgagaactggccttcgattcaaggatgattttcctgaattgtgttgcagagcttgggactgctttgttcgctgcctggatcatgcttgtctgggctcccttctcagtcatgtaatagtagctttgttacctcttatacacatccagcctaaagaaactgcagctatcttccactacctcataattgaaaacagggatgctgtgcaagattttcttcatgaaatatattttttacctgatcatccagaattaaaaaagataaaagccgttctccaggaatacagaaaggagacctctgagagcactgatcttcagacaactcttcagctctctatgaaggccattcaacatgaaaatgtcgatgttcgtattcatgctcttacaagcttgaaggaaaccttgtataaaaatcaggaaaaactgataaagtatgcaacagacagtgaaacagtagaacctattatctcacagttggtgacagtgcttttgaaaggttgccaagatgcaaactctcaagctcggttgctctgtggggaatgtttaggggaattgggggcgatagatccaggtcgattagatttctcaacaactgaaactcaaggaaaagattttacatttgtgactggagtagaagattcaagctttgcctatggattattgatggagctaacaagagcttaccttgcgtatgctgataatagccgagctcaagattcagctgcctatgccattcaggagttgctttctatttatgactgtagagagatggagaccaacggcccaggtcaccaattgtggaggagatttcctgagcatgttcgggaaatactagaacctcatctaaataccagatacaagagttctcagaagtcaaccgattggtctggagtaaagaagccaatttacttaagtaaattgggtagtaactttgcagaatggtcagcatcttgggcaggttatcttattacaaaggttcgacatgatcttgccagtaaaattttcacctgctgtagcattatgatgaagcatgatttcaaagtgaccatctatcttcttccacatattctggtgtatgtcttactgggttgtaatcaagaagatcagcaggaggtttatgcagaaattatggcagttctaaagcatgacgatcagcataccataaatacccaagacattgcatctgatctgtgtcaactcagtacacagactgtgttctccatgcttgaccatctcacacagtgggcaaggcacaaatttcaggcactgaaagctgagaaatgtccacacagcaaatcaaacagaaataaggtagactcaatggtatctactgtggattatgaagactatcagagtgtaacccgttttctagacctcataccccaggatactctggcagtagcttcctttcgctccaaagcatacacacgagctgtaatgcactttgaatcatttattacagaaaagaagcaaaatattcaggaacatcttggatttttacagaaattgtatgctgctatgcatgaacctgatggagtggccggagtcagtgcaattagaaaggcagaaccatctctaaaagaacagatccttgaacatgaaagccttggcttgctgagggatgccactgcttgttatgacagggctattcagctagaaccagaccagatcattcattaccatggtgtagtaaagtccatgttaggtcttggtcagctgtctactgttatcactcaggtgaatggagtgcatgctaacaggtccgagtggacagatgaattaaacacgtacagagtggaagcagcttggaaattgtcacagtgggatttggtggaaaactatttggcagcagatggaaaatctacaacatggagtgtcagactgggacagctattattatcagccaaaaaaagagatatcacagctttttatgactcactgaaactagtgagagcagaacaaattgtacctctttcagctgcaagctttgaaagaggctcctaccaacgaggatatgaatatattgtgagattgcacatgttatgtgagttggagcatagcatcaaaccacttttccagcattctccaggtgacagttctcaagaagattctctaaactgggtagctcgactagaaatgacccagaattcctacagagccaaggagcctatcctggctctccggagggctttactaagcctcaacaaaagaccagattacaatgaaatggttggagaatgctggctgcagagtgccagggtagctagaaaggctggtcaccaccagacagcctacaatgctctccttaatgcaggggaatcacgactcgctgaactgtacgtggaaagggcaaagtggctctggtccaagggtgatgttcaccaggcactaattgttcttcaaaaaggtgttgaattatgttttcctgaaaatgaaaccccacctgagggtaagaacatgttaatccatggtcgagctatgctactagtgggccgatttatggaagaaacagctaactttgaaagcaatgcaattatgaaaaaatataaggatgtgaccgcgtgcctgccagaatgggaggatgggcatttttaccttgccaagtactatgacaaattgatgcccatggtcacagacaacaaaatggaaaagcaaggtgatctcatccggtatatagttcttcattttggcagatctctacaatatggaaatcagttcatatatcagtcaatgccacgaatgttaactctatggcttgattatggtacaaaggcatatgaatgggaaaaagctggccgctccgatcgtgtacaaatgaggaatgatttgggtaaaataaacaaggttatcacagagcatacaaactatttagctccatatcaatttttgactgctttttcacaattgatctctcgaatttgtcattctcacgatgaagtttttgttgtcttgatggaaataatagccaaagtatttctagcctatcctcaacaagcaatgtggatgatgacagctgtgtcaaagtcatcttatcccatgcgtgtgaacagatgcaaggaaatcctcaataaagctattcatatgaaaaaatccttagagaagtttgttggagatgcaactcgcctaacagataagcttctagaattgtgcaataaaccggttgatggaagtagttccacattaagcatgagcactcattttaaaatgcttaaaaagctggtagaagaagcaacatttagtgaaatcctcattcctctacaatcagtcatgatacctacacttccatcaattctgggtacccatgctaaccatgctagccatgaaccatttcctggacattgggcctatattgcagggtttgatgatatggtggaaattcttgcttctcttcagaaaccaaagaagatttctttaaaaggctcagatggaaagttctacatcatgatgtgtaagccaaaagatgacctgagaaaggattgtagactaatggaattcaattccttgattaataagtgcttaagaaaagatgcagagtctcgtagaagagaacttcatattcgaacatatgcagttattccactaaatgatgaatgtgggattattgaatgggtgaacaacactgctggtttgagacctattctgaccaaactatataaagaaaagggagtgtatatgacaggaaaagaacttcgccagtgtatgctaccaaagtcagcagctttatctgaaaaactcaaagtattccgagaatttctcctgcccaggcatcctcctatttttcatgagtggtttctgagaacattccctgatcctacatcatggtacagtagtagatcagcttactgccgttccactgcagtaatgtcaatggttggttatattctggggcttggagaccgtcatggtgaaaatattctctttgattctttgactggtgaatgcgtacatgtagatttcaattgtcttttcaataagggagaaacctttgaagttccagaaattgtgccatttcgcctgactcataatatggttaatggaatgggtcctatgggaacagagggtctttttcgaagagcatgtgaagttacaatgaggctgatgcgtgatcagcgagagcctttaatgagtgtcttaaagacttttctacatgatcctcttgtggaatggagtaaaccagtgaaagggcattccaaagcgccactgaatgaaactggagaagttgtcaatgaaaaggccaagacccatgttcttgacattgagcagcgactacaaggtgtaatcaagactcgaaatagagtgacaggactgccgttatctattgaaggacatgtgcattaccttatacaagaagctactgatgaaaacttactatgccagatgtatcttggttggactccatatatgtgaaatgaaattatgtaaaagaatatgttaataatctaaaagtaatgcatttggtatgaatctgtggttgtatctgttcaattctaaagtacaacataaatttacgttctcagcaactgttatttctctctgatcattaattatatgtaaaataatatacattcagttattaagaaataaactgctttcttaata

SEQ ID NO: 579282 - DNA, 445 bp, Homo sapiens
tgcatagttacacagaaaacctcatctgcctaaaaaggagaaaatgaagcatagaggagaggttattttttcattaagtcaacaaatgtttgagccttaggcaccgttctaggtactaagtatatagcaatgagtaaaacggtctctccccacatagatatatattcttgggggaaggagaatgatgaacaaatatttcatataatatcaagtagtactaagttttatttaaaaagcagggtaagggatagaaagtttgaagaagttgggttcagggaagccctctctgaggaaatagttggagcagaggtttgagccagttgggaaagcaagccaaaaatatatctggaagaaatgctttcaagctgcagtgctaggacatgcaaaaactttgagttgggagcattctggggaaattcaggagacacagtggcaagaagaaaag

SEQ ID NO: 579283 - DNA, 1863 bp, Homo sapiens
gtaattagctgggctcagtggcacactcctgtagtcccagctacttgggaggctgaggtgggaggatcacttgaccccaggagttggaggctgctgtgagctatgatgacaccactgcactccagcctgggcaacagagtgagacccttggcatcatactcagatccttccaactgctaggatgaagcatacagacaagtgcccactctggatataggtgttggtgttctctttctgtttctatgggtccagtctgtgttcttttgtaagatgtctgggcaagccagaccaaagtctcctatttttacttgctgatcagggccatgaagaaaaatatttctaggcttcagatctctgtttacaatacccatgttatgtatgtaaaacacaccttccactaaatcttgaaaattttttgttgcaacactggccataaggacaggcaaacttgcccacacactcttggccctgtttgtttctctcagctagccagtcccacagctggagcttgcacacctgcatctggatgtgcagcatcaggtggtactgcacctcgatccccaacaagttgaagttttctttggaagattcctcagtggatgtgaaattctcctctaggagggaattacacctgagcagcaggggctgtttcacaattgaccaggtagacaaaccagccaggccattttcctggagctccagggatgattcatattcactggtgtctcttaagacggaattgatggtgtagttcacagcttgttgttctgattttgagtgtcagattctgcaaagggtttttcttttctgaggtgagctccgcgaagataatgggtgagctgctattttcaccatttttaacaccgtattggtatctgtctgcttggtcggagaacacttccagaaatggcaactgaacggaagctctgtctgcttgtggttggaccacttgaacatgttctgtccacgcagtgtgataacgaatgatattagggtgctgaagacctgccagcaccttcattccccgtagttctttcatgtaatgtgtttctgttgcacccttaatcaggattttttaaattgcataatactgaccatctaatttattcctgaccttgtatactcttccatatccaccttttcctaagatggcaagttcttcaaattcatttaagtaacgtgaagtttgtgcttcaaagggtacttcccttgatctgattttctggatatgagaaatagcctcacaaggatcctgatgaactctctctttagtggacctcattaagtgagtaatagctctgtggtgatgtagtctcaatgagctaaacttgtcacaagtgaaagaagacagcagccccattttgataaaggtctggcaaagtaacttaaacacctgtcttgaatgaactgggtttggttcacgcacatggctcaagtgcttcaccaaagaaataagcggcagctggtttgcaactgcaaaagggaaagttggctgttgtaggggttattttaatacctggagttctgctggaacataagtcatatttggagtccaggctcttggcggaaaagtcgatggcagatggcacagcaacagtctccaccccgtggccctcctctttgtgctcgtgggctgcagcgcagcccaccagcccacccagcaccacctctgagaattattcttctaataacgttattcttccttttgcattcagatatgcttaagaaattgtacagttccaagtagctcacttagaacacccatttgcatgtactaacataatgtaaatattaggcagtacagcattgttatttgaatattcattgaaatgtttaagtcctaaacacttccaaagcagattt

SEQ ID NO: 579284 - DNA, 651 bp, Homo sapiens
aaaatttatttttcaagaattgtaatgtgtaaataattccctggtatttcacgtagtccaaaaacatgtccaagcagttaatgttgaatcaatcttgcgagcctccaaatcagtatcacaagctaactgtatttgtttaatttcttcttttcctgtatttgctcttacaaaaggggtattggtcagtaaaatggtattaacatttattaaatgtcaaaatataaagaaaggtagtaattccaaattattaacatctgtttttggttttatgtttcttctttttaggccaagacccatgttcttgacattgagcagcgactacaaggtgtaatcaagactcgaaatagagtgacaggactgccgttatctattgaaggacatgtgcattaccttatacaagaagctactgatgaaaacttactatgccagatgtatcttggttggactccatatatgtgaaatgaaattatgtaaaagaatatgttaataatctaaaagtaatgcatttggtatgaatctgtggttgtatctgttcaattctaaagtacaacataaatttacgttctcagcaactgttatttctctctgatcattaattatatgtaaaataatatacattcagttattaagaaataaactgctttcttaata

SEQ ID NO: 579285 - DNA, 838 bp, Homo sapiens
gatgatacctgctcatacgacgtcatggactcgttcctggaaaagttccagagccagatttagtgatggcggctttcatgaggaccattgtggataaggaattatgacctaggtccccgcgtatatatgtctagagcgctatctggagattgatcctcatagaagcaatcctggactttgtgctatttctccacgtcccatttagttgagggactgaaggatgcgtgctccatgacatgaagctagggccaatgagctataacagatgacgggcaatgattactttaaagaaaaatgactagcaagaaagctgtaagtttccatacactgaagggcttaccacgaagaaatgtgcagatcctgatttgagatgctgtcctttataccaagccgggcagcagcactcgtactatctgggcaatattcagtatctggtctcaactgatgtgacagcatgccagaaagctaaaaccctgatcacctcaaagcacataatacacgaggtgccttatgccatctggaactgaaacactttgccgaggccgtgaactggtgtgatgagggactgcaacatagatgccaaagagaagcagcttctggaaatgagggctaaagcagataagctgaagcgacatgaacagcacggactgtgcaggcaaagacaaactcgaaaagcaacagaagcggcgaagggaactcaaactgagggctacacacacagagcacacaaggctcaccaatactacggcacacccgacagcagccaggcaggcttcagcgcacaactcagaaaagctagagagacaaaccagaactgacgccagcaaagcgacccaac

SEQ ID NO: 579286 - DNA, 430 bp, Homo sapiens
  misc_feature (24)..(24): n is a, c, g, or t
  misc_feature (26)..(28): n is a, c, g, or t
  misc_feature (31)..(31): n is a, c, g, or t
  misc_feature (33)..(33): n is a, c, g, or t
  misc_feature (37)..(37): n is a, c, g, or t
  misc_feature (39)..(39): n is a, c, g, or t
  misc_feature (57)..(57): n is a, c, g, or t
  misc_feature (60)..(61): n is a, c, g, or t
aaaaaaaaataaaaaaaaacaaangnnntanangaananaaaaaaaaaaaaaaacancanntaggccaagacccatgttcttgacattgagcagcgactacaaggtgtaatcaagactcgaaatagagtgacaggactgccgttatctattgaaggacatgtgcattaccttatacaagaagctactgatgaaaacttactatgccagatgtatcttggttggactccatatatgtgaaatgaaattatgtaaaagaatatgttaataatctaaaagtaatgcatttggtatgaatctgtggttgtatctgttcaattctaaagtacaacataaatttacgttctcagcaactgttatttctctctgatcattaattatatgtaaaataatatacattcagttattaagaaataaactgctttcttaata

SEQ ID NO: 579287 - DNA, 120 bp, Homo sapiens
  misc_feature (71)..(71): n is a, c, g, or t
gatggtggcacagacatcactctccctgacggggaccaggagcctggatctgggatcagcaggcggacgtncccagctcatggcaaaactggcagaaggcgctggaaatccaactggcca

SEQ ID NO: 579288 - DNA, 249 bp, Homo sapiens
ctgtgtaacgacggcagtgcctcatcatagctggtacgctgtaaactgcgggcatgcctcaaactacgcgtatcagtgatccaccgcggcctcgaggagtcgcccgtggctgaatcgtagtagaaactaggcatccaggctgaggagatcatgatgctcaagaagcagctctattgcatctacgccaagcacaccaaacagagcctgcaggtgatcgagtccgccatgaagaggggatccggctgtctg

SEQ ID NO: 579289 - DNA, 565 bp, Homo sapiens
  misc_feature (29)..(29): n is a, c, g, or t
  misc_feature (471)..(471): n is a, c, g, or t
  misc_feature (476)..(476): n is a, c, g, or t
  misc_feature (478)..(478): n is a, c, g, or t
  misc_feature (482)..(483): n is a, c, g, or t
  misc_feature (488)..(488): n is a, c, g, or t
  misc_feature (534)..(534): n is a, c, g, or t
  misc_feature (539)..(539): n is a, c, g, or t
aggatcgagctcggtctactttcacaggngaaataaattgaacttaaatacttaaattgacacttttaaattttatcttataagtctttaattactcaactttttttatgatctagtatctactgtggattatgaagactatcagagtgtaacccgttttctagacctcataccccaggatactctggcagtagcttcctttcgctccaaagcatacacacgagctgtaatgcactttgaatcatttattacagaaaagaagcaaaatattcaggaacatcttggatttttacaggtctgaagttaatatagtgaatttaataatgaaaattaatgtggccagtcttttatgtttatgttgttcattttattgaatgttttatatgctatgcttagaagcttatagattagtggggagagataaacatcaatttggtataatattttaagtacagtaacacacatgtaccntgagnangganncttanctcatccatgtggaatagggtgggagatggaagcggatgagccagnggtcnggaatggcttcttggagatggtgtct

SEQ ID NO: 579290 - DNA, 361 bp, Homo sapiens
ctggcccagaatcctcaatttaaatgtatctgcaaagtctctttttccatgtaaggtaacattcacagtttctctttttctttcttcttcttttttttttgtttttgagagggagttttgctcttgttgcccaggctggagtgcagtggcacggtctgggctcagtaccacctctgcctcccaggttctagcggttctcctgcctcagcctccctagtagctgggattacaggcatgtgctacaacacctggctaattttgttttgttgttgttgttgttgttgttgtttttggagatggagtctcactccactgcactctagtttgggcaacagagccggactccatctcaaaaaaaaaa

SEQ ID NO: 579291 - DNA, 345 bp, Homo sapiens
  misc_feature (1)..(1): n is a, c, g, or t
naaaaaaaaaaaaaagaaaagaaaaaaaaaaggaaaaagtttataatttgtgcatttcaggccaagacccatgttcttgacattgagcagcgactacaaggtgtaatcaagactcgaaatagagtgacaggactgccgttatctattgaaggacatgtgcattaccttatacaagaagctactgatgaaaacttactatgccagatgtatcttggttggactccatatatgtgaaatgaaattatgtaaaagaatatgttaataatctaaaagtaatgcatttggtatgaatctgtggttgtatctgttcaattctaaagtacaacataaatttacgttctcagc

SEQ ID NO: 579292 - DNA, 8371 bp, Homo sapiens
gcctccacacggctccgtcgggcgccgcgctcttccggcagcggtacgtttggagacgccgggaacccgcgttggcgtggttgactagtgcctcgcagcctcagcatgggggaacatggcctggagctggcttccatgatccccgccctgcgggagctgggcagtgccacaccagaggaatataatacagttgtacagaagccaagacaaattctgtgtcaattcattgaccggatacttacagatgtaaatgttgttgctgtagaacttgtaaagaaaactgactctcagccaacctccgtgatgttgcttgatttcatccagcatatcatgaaatcctccccacttatgtttgtaaatgtgagtggaagccatgagcgcaaaggcagttgtattgaattcagtaattggatcataacgagacttctgcggattgcagcaactccctcctgtcatttgttacacaagaaaatctgtgaagtcatctgttcattattatttctttttaaaagcaagagtcctgctatttttggggtactcacaaaagaattattacaactttttgaagacttggtttacctccatagaagaaatgtgatgggtcatgctgtggaatggccagtggtcatgagccgatttttaagtcaattagatgaacacatgggatatttacaatcagctcctttgcagttgatgagtatgcaaaatttagaatttattgaagtcactttattaatggttcttactcgtattattgcaattgtgttttttagaaggcaagaactcttactttggcagataggttgtgttctgctagagtatggtagtccaaaaattaaatccctagcaattagctttttaacagaactttttcagcttggaggactaccagcacaaccagctagcacttttttcagctcatttttggaattattaaaacaccttgtagaaatggatactgaccaattgaaactctatgaagagccattatcaaagctgataaagacactatttccctttgaagcagaagcttatagaaatattgaacctgtctatttaaatatgctgctggaaaaactctgtgtcatgtttgaagacggtgtgctcatgcggcttaagtctgatttgctaaaagcagctttgtgccatttactgcagtatttccttaaatttgtgccagctgggtatgaatctgctttacaagtcaggaaggtctatgtgagaaatatttgtaaagctcttttggatgtgcttggaattgaggtagatgcagagtacttgttgggcccactttatgcagctttgaaaatggaaagtatggaaatcattgaggagattcaatgccaaactcaacaggaaaacctcagcagtaatagtgatggaatatcacccaaaaggcgtcgtctcagctcgtctctaaacccttctaaaagagcaccaaaacagactgaggaaattaaacatgtggacatgaaccaaaagagcatattatggagtgcactgaaacagaaagctgaatcccttcagatttcccttgaatacagtggcctaaagaatcctgttattgagatgttagaaggaattgctgttgtcttacaactgactgctctgtgtactgttcattgttctcatcaaaacatgaactgccgtactttcaaggactgtcaacataaatccaagaagaaaccttctgtagtgataacttggatgtcattggatttttacacaaaagtgcttaagagctgtagaagtttgttagaatctgttcagaaactggacctggaggcaaccattgataaggtggtgaaaatttatgatgctttgatttatatgcaagtaaacagttcatttgaagatcatatcctggaagatttatgtggtatgctctcacttccatggatttattcccattctgatgatggctgtttaaagttgaccacatttgccgctaatcttctaacattaagctgtaggatttcagatagctattcaccacaggcacaatcacgatgtgtgtttcttctgactctgtttccaagaagaatattccttgagtggagaacagcagtttacaactgggccctgcagagctcccatgaagtaatccgggctagttgtgttagtggattttttatcttattgcagcagcagaattcttgtaacagagttcccaagattcttatagataaagtcaaagatgattctgacattgtcaagaaagaatttgcttctatacttggtcaacttgtctgtactcttcacggcatgttttatctgacaagttctttaacagaacctttctctgaacacggacatgtggacctcttctgtaggaacttgaaagccacttctcaacatgaatgttcatcttctcaactaaaagcttctgtctgcaagccattccttttcctactgaaaaaaaaaatacctagtccagtaaaacttgctttcatagataatctacatcatctttgtaagcatcttgattttagagaagatgaaacagatgtaaaagcagttcttggaactttattaaatttaatggaagatccagacaaagatgttagagtggcttttagtggaaatatcaagcacatattggaatccttggactctgaagatggatttataaaggagctttttgtcttaagaatgaaggaagcatatacacatgcccaaatatcaagaaataatgagctgaaggataccttgattcttacaacaggggatattggaagggccgcaaaaggagatttggtaccatttgcactcttacacttattgcattgtttgttatccaagtcagcatctgtctctggagcagcatacacagaaattagagctctggttgcagctaaaagtgttaaactgcaaagttttttcagccagtataagaaacccatctgtcagtttttggtagaatcccttcactctagtcagatgacagcacttccgaatactccatgccagaatgctgacgtgcgaaaacaagatgtggctcaccagagagaaatggctttaaatacgttgtctgaaattgccaacgttttcgactttcctgatcttaatcgttttcttactaggacattacaagttctactacctgatcttgctgccaaagcaagccctgcagcttctgctctcattcgaactttaggaaaacaattaaatgtcaatcgtagagagattttaataaacaacttcaaatatattttttctcatttggtctgttcttgttccaaagatgaattagaacgtgcccttcattatctgaagaatgaaacagaaattgaactggggagcctgttgagacaagatttccaaggattgcataatgaattattgctgcgtattggagaacactatcaacaggtttttaatggtttgtcaatacttgcctcatttgcatccagtgatgatccatatcagggcccgagagatatcatatcacctgaactgatggctgattatttacaacccaaattgttgggcattttggctttttttaacatgcagttactgagctctagtgttggcattgaagataagaaaatggccttgaacagtttgatgtctttgatgaagttaatgggacccaaacatgtcagttctgtgagggtgaagatgatgaccacactgagaactggccttcgattcaaggatgattttcctgaattgtgttgcagagcttgggactgctttgttcgctgcctggatcatgcttgtctgggctcccttctcagtcatgtaatagtagctttgttacctcttatacacatccagcctaaagaaactgcagctatcttccactacctcataattgaaaacagggatgctgtgcaagattttcttcatgaaatatattttttacctgatcatccagaattaaaaaagataaaagccgttctccaggaatacagaaaggagacctctgagagcactgatcttcagacaactcttcagctctctatgaaggccattcaacatgaaaatgtcgatgttcgtattcatgctcttacaagcttgaaggaaaccttgtataaaaatcaggaaaaactgataaagtatgcaacagacagtgaaacagtagaacctattatctcacagttggtgacagtgcttttgaaaggttgccaagatgcaaactctcaagctcggttgctctgtggggaatgtttaggggaattgggggcgatagatccaggtcgattagatttctcaacaactgaaactcaaggaaaagattttacatttgtgactggagtagaagattcaagctttgcctatggattattgatggagctaacaagagcttaccttgcgtatgctgataatagccgagctcaagattcagctgcctatgccattcaggagttgctttctatttatgactgtagagagatggagaccaacggcccaggtcaccaattgtggaggagatttcctgagcatgttcgggaaatactagaacctcatctaaataccagatacaagagttctcagaagtcaaccgattggtctggagtaaagaagccaatttacttaagtaaattgggtagtaactttgcagaatggtcagcatcttgggcaggttatcttattacaaaggttcgacatgatcttgccagtaaaattttcacctgctgtagcattatgatgaagcatgatttcaaagtgaccatctatcttcttccacatattctggtgtatgtcttactgggttgtaatcaagaagatcagcaggaggtttatgcagaaattatggcagttctaaagcatgacgatcagcataccataaatacccaagacattgcatctgatctgtgtcaactcagtacacagactgtgttctccatgcttgaccatctcacacagtgggcaaggcacaaatttcaggcactgaaagctgagaaatgtccacacagcaaatcaaacagaaataaggtagactcaatggtatctactgtggattatgaagactatcagagtgtaacccgttttctagacctcataccccaggatactctggcagtagcttcctttcgctccaaagcatacacacgagctgtaatgcactttgaatcatttattacagaaaagaagcaaaatattcaggaacatcttggatttttacagaaattgtatgctgctatgcatgaacctgatggagtggccggagtcagtgcaattagaaaggcagaaccatctctaaaagaacagatccttgaacatgaaagccttggcttgctgagggatgccactgcttgttatgacagggctattcagctagaaccagaccagatcattcattaccatggtgtagtaaagtccatgttaggtcttggtcagctgtctactgttatcactcaggtgaatggagtgcatgctaacaggtccgagtggacagatgaattaaacacgtacagagtggaagcagcttggaaattgtcacagtgggatttggtggaaaactatttggcagcagatggaaaatctacaacatggagtgtcagactgggacagctattattatcagccaaaaaaagagatatcacagctttttatgactcactgaaactagtgagagcagaacaaattgtacctctttcagctgcaagctttgaaagaggctcctaccaacgaggatatgaatatattgtgagattgcacatgttatgtgagttggagcatagcatcaaaccacttttccagcattctccaggtgacagttctcaagaagattctctaaactgggtagctcgactagaaatgacccagaattcctacagagccaaggagcctatcctggctctccggagggctttactaagcctcaacaaaagaccagattacaatgaaatggttggagaatgctggctgcagagtgccagggtagctagaaaggctggtcaccaccagacagcctacaatgctctccttaatgcaggggaatcacgactcgctgaactgtacgtggaaagggcaaagtggctctggtccaagggtgatgttcaccaggcactaattgttcttcaaaaaggtgttgaattatgttttcctgaaaatgaaaccccacctgagggtaagaacatgttaatccatggtcgagctatgctactagtgggccgatttatggaagaaacagctaactttgaaagcaatgcaattatgaaaaaatataaggatgtgaccgcgtgcctgccagaatgggaggatgggcatttttaccttgccaagtactatgacaaattgatgcccatggtcacagacaacaaaatggaaaagcaaggtgatctcatccggtatatagttcttcattttggcagatctctacaatatggaaatcagttcatatatcagtcaatgccacgaatgttaactctatggcttgattatggtacaaaggcatatgaatgggaaaaagctggccgctccgatcgtgtacaaatgaggaatgatttgggtaaaataaacaaggttatcacagagcatacaaactatttagctccatatcaatttttgactgctttttcacaattgatctctcgaatttgtcattctcacgatgaagtttttgttgtcttgatggaaataatagccaaagtatttctagcctatcctcaacaagcaatgtggatgatgacagctgtgtcaaagtcatcttatcccatgcgtgtgaacagatgcaaggaaatcctcaataaagctattcatatgaaaaaatccttagagaagtttgttggagatgcaactcgcctaacagataagcttctagaattgtgcaataaaccggttgatggaagtagttccacattaagcatgagcactcattttaaaatgcttaaaaagctggtagaagaagcaacatttagtgaaatcctcattcctctacaatcagtcatgatacctacacttccatcaattctgggtacccatgctaaccatgctagccatgaaccatttcctggacattgggcctatattgcagggtttgatgatatggtggaaattcttgcttctcttcagaaaccaaagaagatttctttaaaaggctcagatggaaagttctacatcatgatgtgtaagccaaaagatgacctgagaaaggattgtagactaatggaattcaattccttgattaataagtgcttaagaaaagatgcagagtctcgtagaagagaacttcatattcgaacatatgcagttattccactaaatgatgaatgtgggattattgaatgggtgaacaacactgctggtttgagacctattctgaccaaactatataaagaaaagggagtgtatatgacaggaaaagaacttcgccagtgtatgctaccaaagtcagcagctttatctgaaaaactcaaagtattccgagaatttctcctgcccaggcatcctcctatttttcatgagtggtttctgagaacattccctgatcctacatcatggtacagtagtagatcagcttactgccgttccactgcagtaatgtcaatggttggttatattctggggcttggagaccgtcatggtgaaaatattctctttgattctttgactggtgaatgcgtacatgtagatttcaattgtcttttcaataagggagaaacctttgaagttccagaaattgtgccatttcgcctgactcataatatggttaatggaatgggtcctatgggaacagagggtctttttcgaagagcatgtgaagttacaatgaggctgatgcgtgatcagcgagagcctttaatgagtgtcttaaagacttttctacatgatcctcttgtggaatggagtaaaccagtgaaagggcattccaaagcgccactgaatgaaactggagaagttgtcaatgaaaagatggcaagttcttcaaattcatttaagtaacgtgaagtttgtgcttcaaagggtacttcccttgatctgattttctggatatgagaaatagcctcacaaggatcctgatgaactctctctttagtggacctcattaaaggccaagacccatgttcttgacattgagcagcgactacaaggtgtaatcaagactcgaaatagagtgacaggactgccgttatctattgaaggacatgtgcattaccttatacaagaagctactgatgaaaacttactatgccagatgtatcttggttggactccatatatgtgaaatgaaattatgtaaaagaatatgttaataatctaaaagtaatgcatttggtatgaatctgtggttgtatctgttcaattctaaagtacaacataaatttacgttctcagcaactgttatttctctctgatcattaattatatgtaaaataatatacattcagttattaagaaataaactgctttcttaata

SEQ ID NO: 579293 - DNA, 320 bp, Homo sapiens
gcggccgaagtgctgtactgtaggctgcctgagagggtcaggcttgacgtggcaaaaggatcagtagatagcctgaacgaaacagtctgatgcacatggatctgaaccttcgaaaggatcaccaccaaatggatcgatttttccaaaaggatcatccttgacaaggatcactgccaagcaaaaggatcagactggaacaaaatccaagttagtatctgcaactaggacctgtcagcgtaacttgcagtctacacttaaatggatcttcctctttgagaatgtctattattagtcgagttcagaacaatactttatgcagt

SEQ ID NO: 579294 - DNA, 8178 bp, Homo sapiens
gcctccacacggctccgtcgggcgccgcgctcttccggcagcggtacgtttggagacgccgggaacccgcgttggcgtggttgactagtgcctcgcagcctcagcatgggggaacatggcctggagctggcttccatgatccccgccctgcgggagctgggcagtgccacaccagaggaatataatacagttgtacagaagccaagacaaattctgtgtcaattcattgaccggatacttacagatgtaaatgttgttgctgtagaacttgtaaagaaaactgactctcagccaacctccgtgatgttgcttgatttcatccagcatatcatgaaatcctccccacttatgtttgtaaatgtgagtggaagccatgagcgcaaaggcagttgtattgaattcagtaattggatcataacgagacttctgcggattgcagcaactccctcctgtcatttgttacacaagaaaatctgtgaagtcatctgttcattattatttctttttaaaagcaagagtcctgctatttttggggtactcacaaaagaattattacaactttttgaagacttggtttacctccatagaagaaatgtgatgggtcatgctgtggaatggccagtggtcatgagccgatttttaagtcaattagatgaacacatgggatatttacaatcagctcctttgcagttgatgagtatgcaaaatttagaatttattgaagtcactttattaatggttcttactcgtattattgcaattgtgttttttagaaggcaagaactcttactttggcagataggttgtgttctgctagagtatggtagtccaaaaattaaatccctagcaattagctttttaacagaactttttcagcttggaggactaccagcacaaccagctagcacttttttcagctcatttttggaattattaaaacaccttgtagaaatggatactgaccaattgaaactctatgaagagccattatcaaagctgataaagacactatttccctttgaagcagaagcttatagaaatattgaacctgtctatttaaatatgctgctggaaaaactctgtgtcatgtttgaagacggtgtgctcatgcggcttaagtctgatttgctaaaagcagctttgtgccatttactgcagtatttccttaaatttgtgccagctgggtatgaatctgctttacaagtcaggaaggtctatgtgagaaatatttgtaaagctcttttggatgtgcttggaattgaggtagatgcagagtacttgttgggcccactttatgcagctttgaaaatggaaagtatggaaatcattgaggagattcaatgccaaactcaacaggaaaacctcagcagtaatagtgatggaatatcacccaaaaggcgtcgtctcagctcgtctctaaacccttctaaaagagcaccaaaacagactgaggaaattaaacatgtggacatgaaccaaaagagcatattatggagtgcactgaaacagaaagctgaatcccttcagatttcccttgaatacagtggcctaaagaatcctgttattgagatgttagaaggaattgctgttgtcttacaactgactgctctgtgtactgttcattgttctcatcaaaacatgaactgccgtactttcaaggactgtcaacataaatccaagaagaaaccttctgtagtgataacttggatgtcattggatttttacacaaaagtgcttaagagctgtagaagtttgttagaatctgttcagaaactggacctggaggcaaccattgataaggtggtgaaaatttatgatgctttgatttatatgcaagtaaacagttcatttgaagatcatatcctggaagatttatgtggtatgctctcacttccatggatttattcccattctgatgatggctgtttaaagttgaccacatttgccgctaatcttctaacattaagctgtaggatttcagatagctattcaccacaggcacaatcacgatgtgtgtttcttctgactctgtttccaagaagaatattccttgagtggagaacagcagtttacaactgggccctgcagagctcccatgaagtaatccgggctagttgtgttagtggattttttatcttattgcagcagcagaattcttgtaacagagttcccaagattcttatagataaagtcaaagatgattctgacattgtcaagaaagaatttgcttctatacttggtcaacttgtctgtactcttcacggcatgttttatctgacaagttctttaacagaacctttctctgaacacggacatgtggacctcttctgtaggaacttgaaagccacttctcaacatgaatgttcatcttctcaactaaaagcttctgtctgcaagccattccttttcctactgaaaaaaaaaatacctagtccagtaaaacttgctttcatagataatctacatcatctttgtaagcatcttgattttagagaagatgaaacagatgtaaaagcagttcttggaactttattaaatttaatggaagatccagacaaagatgttagagtggcttttagtggaaatatcaagcacatattggaatccttggactctgaagatggatttataaaggagctttttgtcttaagaatgaaggaagcatatacacatgcccaaatatcaagaaataatgagctgaaggataccttgattcttacaacaggggatattggaagggccgcaaaaggagatttggtaccatttgcactcttacacttattgcattgtttgttatccaagtcagcatctgtctctggagcagcatacacagaaattagagctctggttgcagctaaaagtgttaaactgcaaagttttttcagccagtataagaaacccatctgtcagtttttggtagaatcccttcactctagtcagatgacagcacttccgaatactccatgccagaatgctgacgtgcgaaaacaagatgtggctcaccagagagaaatggctttaaatacgttgtctgaaattgccaacgttttcgactttcctgatcttaatcgttttcttactaggacattacaagttctactacctgatcttgctgccaaagcaagccctgcagcttctgctctcattcgaactttaggaaaacaattaaatgtcaatcgtagagagattttaataaacaacttcaaatatattttttctcatttggtctgttcttgttccaaagatgaattagaacgtgcccttcattatctgaagaatgaaacagaaattgaactggggagcctgttgagacaagatttccaaggattgcataatgaattattgctgcgtattggagaacactatcaacaggtttttaatggtttgtcaatacttgcctcatttgcatccagtgatgatccatatcagggcccgagagatatcatatcacctgaactgatggctgattatttacaacccaaattgttgggcattttggctttttttaacatgcagttactgagctctagtgttggcattgaagataagaaaatggccttgaacagtttgatgtctttgatgaagttaatgggacccaaacatgtcagttctgtgagggtgaagatgatgaccacactgagaactggccttcgattcaaggatgattttcctgaattgtgttgcagagcttgggactgctttgttcgctgcctggatcatgcttgtctgggctcccttctcagtcatgtaatagtagctttgttacctcttatacacatccagcctaaagaaactgcagctatcttccactacctcataattgaaaacagggatgctgtgcaagattttcttcatgaaatatattttttacctgatcatccagaattaaaaaagataaaagccgttctccaggaatacagaaaggagacctctgagagcactgatcttcagacaactcttcagctctctatgaaggccattcaacatgaaaatgtcgatgttcgtattcatgctcttacaagcttgaaggaaaccttgtataaaaatcaggaaaaactgataaagtatgcaacagacagtgaaacagtagaacctattatctcacagttggtgacagtgcttttgaaaggttgccaagatgcaaactctcaagctcggttgctctgtggggaatgtttaggggaattgggggcgatagatccaggtcgattagatttctcaacaactgaaactcaaggaaaagattttacatttgtgactggagtagaagattcaagctttgcctatggattattgatggagctaacaagagcttaccttgcgtatgctgataatagccgagctcaagattcagctgcctatgccattcaggagttgctttctatttatgactgtagagagatggagaccaacggcccaggtcaccaattgtggaggagatttcctgagcatgttcgggaaatactagaacctcatctaaataccagatacaagagttctcagaagtcaaccgattggtctggagtaaagaagccaatttacttaagtaaattgggtagtaactttgcagaatggtcagcatcttgggcaggttatcttattacaaaggttcgacatgatcttgccagtaaaattttcacctgctgtagcattatgatgaagcatgatttcaaagtgaccatctatcttcttccacatattctggtgtatgtcttactgggttgtaatcaagaagatcagcaggaggtttatgcagaaattatggcagttctaaagcatgacgatcagcataccataaatacccaagacattgcatctgatctgtgtcaactcagtacacagactgtgttctccatgcttgaccatctcacacagtgggcaaggcacaaatttcaggcactgaaagctgagaaatgtccacacagcaaatcaaacagaaataaggtagactcaatggtatctactgtggattatgaagactatcagagtgtaacccgttttctagacctcataccccaggatactctggcagtagcttcctttcgctccaaagcatacacacgagctgtaatgcactttgaatcatttattacagaaaagaagcaaaatattcaggaacatcttggatttttacagaaattgtatgctgctatgcatgaacctgatggagtggccggagtcagtgcaattagaaaggcagaaccatctctaaaagaacagatccttgaacatgaaagccttggcttgctgagggatgccactgcttgttatgacagggctattcagctagaaccagaccagatcattcattaccatggtgtagtaaagtccatgttaggtcttggtcagctgtctactgttatcactcaggtgaatggagtgcatgctaacaggtccgagtggacagatgaattaaacacgtacagagtggaagcagcttggaaattgtcacagtgggatttggtggaaaactatttggcagcagatggaaaatctacaacatggagtgtcagactgggacagctattattatcagccaaaaaaagagatatcacagctttttatgactcactgaaactagtgagagcagaacaaattgtacctctttcagctgcaagctttgaaagaggctcctaccaacgaggatatgaatatattgtgagattgcacatgttatgtgagttggagcatagcatcaaaccacttttccagcattctccaggtgacagttctcaagaagattctctaaactgggtagctcgactagaaatgacccagaattcctacagagccaaggagcctatcctggctctccggagggctttactaagcctcaacaaaagaccagattacaatgaaatggttggagaatgctggctgcagagtgccagggtagctagaaaggctggtcaccaccagacagcctacaatgctctccttaatgcaggggaatcacgactcgctgaactgtacgtggaaagggcaaagtggctctggtccaagggtgatgttcaccaggcactaattgttcttcaaaaaggtgttgaattatgttttcctgaaaatgaaaccccacctgagggtaagaacatgttaatccatggtcgagctatgctactagtgggccgatttatggaagaaacagctaactttgaaagcaatgcaattatgaaaaaatataaggatgtgaccgcgtgcctgccagaatgggaggatgggcatttttaccttgccaagtactatgacaaattgatgcccatggtcacagacaacaaaatggaaaagcaaggtgatctcatccggtatatagttcttcattttggcagatctctacaatatggaaatcagttcatatatcagtcaatgccacgaatgttaactctatggcttgattatggtacaaaggcatatgaatgggaaaaagctggccgctccgatcgtgtacaaatgaggaatgatttgggtaaaataaacaaggttatcacagagcatacaaactatttagctccatatcaatttttgactgctttttcacaattgatctctcgaatttgtcattctcacgatgaagtttttgttgtcttgatggaaataatagccaaagtatttctagcctatcctcaacaagcaatgtggatgatgacagctgtgtcaaagtcatcttatcccatgcgtgtgaacagatgcaaggaaatcctcaataaagctattcatatgaaaaaatccttagagaagtttgttggagatgcaactcgcctaacagataagcttctagaattgtgcaataaaccggttgatggaagtagttccacattaagcatgagcactcattttaaaatgcttaaaaagctggtagaagaagcaacatttagtgaaatcctcattcctctacaatcagtcatgatacctacacttccatcaattctgggtacccatgctaaccatgctagccatgaaccatttcctggacattgggcctatattgcagggtttgatgatatggtggaaattcttgcttctcttcagaaaccaaagaagatttctttaaaaggctcagatggaaagttctacatcatgatgtgtaagccaaaagatgacctgagaaaggattgtagactaatggaattcaattccttgattaataagtgcttaagaaaagatgcagagtctcgtagaagagaacttcatattcgaacatatgcagttattccactaaatgatgaatgtgggattattgaatgggtgaacaacactgctggtttgagacctattctgaccaaactatataaagaaaagggagtgtatatgacaggaaaagaacttcgccagtgtatgctaccaaagtcagcagctttatctgaaaaactcaaagtattccgagaatttctcctgcccaggcatcctcctatttttcatgagtggtttctgagaacattccctgatcctacatcatggtacagtagtagatcagcttactgccgttccactgcagtaatgtcaatggttggttatattctggggcttggagaccgtcatggtggtcttttcaataagggagaaacctttgaagttccagaaattgtgccatttcgcctgactcataatatggttaatggaatgggtcctatgggaacagagggtctttttcgaagagcatgtgaagttacaatgaggctgatgcgtgatcagcgagagcctttaatgagtgtcttaaagacttttctacatgatcctcttgtggaatggagtaaaccagtgaaagggcattccaaagcgccactgaatgaaactggagaagttgtcaatgaaaaggccaagacccatgttcttgacattgagcagcgactacaaggtgtaatcaagactcgaaatagagtgacaggactgccgttatctattgaaggacatgtgcattaccttatacaagaagctactgatgaaaacttactatgccagatgtatcttggttggactccatatatgtgaaatgaaattatgtaaaagaatatgttaataatctaaaagtaatgcatttggtatgaatctgtggttgtatctgttcaattctaaagtacaacataaatttacgttctcagcaactgttatttctctctgatcattaattatatgtaaaataatatacattcagttattaagaaataaactgctttcttaata

SEQ ID NO: 579295 - DNA, 720 bp, Homo sapiens
  misc_feature (9)..(9): n is a, c, g, or t
  misc_feature (26)..(26): n is a, c, g, or t
  misc_feature (47)..(47): n is a, c, g, or t
  misc_feature (51)..(51): n is a, c, g, or t
tggtatcangcttaatgactttcgtntctgacgtatgcagtatttcnctangtcaccaaccatgtgccgctccctcctgggccagggccccaccatttcctttttgtctcttctttgatctttttctttttctttgggtttttttttttttgagacagttctctcactgtgtcatccaggctggagtgtggtggtgccaccatggctcactgcagccttgaccctctgggctcaagcaatgctcccacctcagcctcctgagtagctggactacaggtgtgcaccaccatgcctggctcatttttaaattatttgtagagatggggtctccctgtgttgcccaggctggtctcgaactcctgggctcaagccattcttccaccttggccgtcctaagtgctgggattacaggtgtgagccaccgtacttagccttccactttttgggcaaggaaaagggagacacactgtgggccactgagcctctggaggggcctggtgaggaagacaagttgtgggaagcctgtgtctcattgcatgactccgggggaaaggcacattctttggggttaccagcctttaattagtaattctgggctaagctgattccagtggttaaaatgtttttccgtcaatatttccaactacatttttacccgaaagcttaaatattaaactctgggggtcctatagaatgtagtatctccccaattaatgtgcg

SEQ ID NO: 579296 - DNA, 8551 bp, Homo sapiens
gcctccacacggctccgtcgggcgccgcgctcttccggcagcggtacgtttggagacgccgggaacccgcgttggcgtggttgactagtgcctcgcagcctcagcatgggggaacatggcctggagctggcttccatgatccccgccctgcgggagctgggcagtgccacaccagaggaatataatacagttgtacagaagccaagacaaattctgtgtcaattcattgaccggatacttacagatgtaaatgttgttgctgtagaacttgtaaagaaaactgactctcagccaacctccgtgatgttgcttgatttcatccagcatatcatgaaatcctccccacttatgtttgtaaatgtgagtggaagccatgagcgcaaaggcagttgtattgaattcagtaattggatcataacgagacttctgcggattgcagcaactccctcctgtcatttgttacacaagaaaatctgtgaagtcatctgttcattattatttctttttaaaagcaagagtcctgctatttttggggtactcacaaaagaattattacaactttttgaagacttggtttacctccatagaagaaatgtgatgggtcatgctgtggaatggccagtggtcatgagccgatttttaagtcaattagatgaacacatgggatatttacaatcagctcctttgcagttgatgagtatgcaaaatttagaatttattgaagtcactttattaatggttcttactcgtattattgcaattgtgttttttagaaggcaagaactcttactttggcagataggttgtgttctgctagagtatggtagtccaaaaattaaatccctagcaattagctttttaacagaactttttcagcttggaggactaccagcacaaccagctagcacttttttcagctcatttttggaattattaaaacaccttgtagaaatggatactgaccaattgaaactctatgaagagccattatcaaagctgataaagacactatttccctttgaagcagaagcttatagaaatattgaacctgtctatttaaatatgctgctggaaaaactctgtgtcatgtttgaagacggtgtgctcatgcggcttaagtctgatttgctaaaagcagctttgtgccatttactgcagtatttccttaaatttgtgccagctgggtatgaatctgctttacaagtcaggaaggtctatgtgagaaatatttgtaaagctcttttggatgtgcttggaattgaggtagatgcagagtacttgttgggcccactttatgcagctttgaaaatggaaagtatggaaatcattgaggagattcaatgccaaactcaacaggaaaacctcagcagtaatagtgatggaatatcacccaaaaggcgtcgtctcagctcgtctctaaacccttctaaaagagcaccaaaacagactgaggaaattaaacatgtggacatgaaccaaaagagcatattatggagtgcactgaaacagaaagctgaatcccttcagatttcccttgaatacagtggcctaaagaatcctgttattgagatgttagaaggaattgctgttgtcttacaactgactgctctgtgtactgttcattgttctcatcaaaacatgaactgccgtactttcaaggactgtcaacataaatccaagaagaaaccttctgtagtgataacttggatgtcattggatttttacacaaaagtgcttaagagctgtagaagtttgttagaatctgttcagaaactggacctggaggcaaccattgataaggtggtgaaaatttatgatgctttgatttatatgcaagtaaacagttcatttgaagatcatatcctggaagatttatgtggtatgctctcacttccatggatttattcccattctgatgatggctgtttaaagttgaccacatttgccgctaatcttctaacattaagctgtaggatttcagatagctattcaccacaggcacaatcacgatgtgtgtttcttctgactctgtttccaagaagaatattccttgagtggagaacagcagtttacaactgggccctgcagagctcccatgaagtaatccgggctagttgtgttagtggattttttatcttattgcagcagcagaattcttgtaacagagttcccaagattcttatagataaagtcaaagatgattctgacattgtcaagaaagaatttgcttctatacttggtcaacttgtctgtactcttcacggcatgttttatctgacaagttctttaacagaacctttctctgaacacggacatgtggacctcttctgtaggaacttgaaagccacttctcaacatgaatgttcatcttctcaactaaaagcttctgtctgcaagccattccttttcctactgaaaaaaaaaatacctagtccagtaaaacttgctttcatagataatctacatcatctttgtaagcatcttgattttagagaagatgaaacagatgtaaaagcagttcttggaactttattaaatttaatggaagatccagacaaagatgttagagtggcttttagtggaaatatcaagcacatattggaatccttggactctgaagatggatttataaaggagctttttgtcttaagaatgaaggaagcatatacacatgcccaaatatcaagaaataatgagctgaaggataccttgattcttacaacaggggatattggaagggccgcaaaaggagatttggtaccatttgcactcttacacttattgcattgtttgttatccaagtcagcatctgtctctggagcagcatacacagaaattagagctctggttgcagctaaaagtgttaaactgcaaagttttttcagccagtataagaaacccatctgtcagtttttggtagaatcccttcactctagtcagatgacagcacttccgaatactccatgccagaatgctgacgtgcgaaaacaagatgtggctcaccagagagaaatggctttaaatacgttgtctgaaattgccaacgttttcgactttcctgatcttaatcgttttcttactaggacattacaagttctactacctgatcttgctgccaaagcaagccctgcagcttctgctctcattcgaactttaggaaaacaattaaatgtcaatcgtagagagattttaataaacaacttcaaatatattttttctcatttggtctgttcttgttccaaagatgaattagaacgtgcccttcattatctgaagaatgaaacagaaattgaactggggagcctgttgagacaagatttccaaggattgcataatgaattattgctgcgtattggagaacactatcaacaggtttttaatggtttgtcaatacttgcctcatttgcatccagtgatgatccatatcagggcccgagagatatcatatcacctgaactgatggctgattatttacaacccaaattgttgggcattttggctttttttaacatgcagttactgagctctagtgttggcattgaagataagaaaatggccttgaacagtttgatgtctttgatgaagttaatgggacccaaacatgtcagttctgtgagggtgaagatgatgaccacactgagaactggccttcgattcaaggatgattttcctgaattgtgttgcagagcttgggactgctttgttcgctgcctggatcatgcttgtctgggctcccttctcagtcatgtaatagtagctttgttacctcttatacacatccagcctaaagaaactgcagctatcttccactacctcataattgaaaacagggatgctgtgcaagattttcttcatgaaatatattttttacctgatcatccagaattaaaaaagataaaagccgttctccaggaatacagaaaggagacctctgagagcactgatcttcagacaactcttcagctctctatgaaggccattcaacatgaaaatgtcgatgttcgtattcatgctcttacaagcttgaaggaaaccttgtataaaaatcaggaaaaactgataaagtatgcaacagacagtgaaacagtagaacctattatctcacagttggtgacagtgcttttgaaaggttgccaagatgcaaactctcaagctcggttgctctgtggggaatgtttaggggaattgggggcgatagatccaggtcgattagatttctcaacaactgaaactcaaggaaaagattttacatttgtgactggagtagaagattcaagctttgcctatggattattgatggagctaacaagagcttaccttgcgtatgctgataatagccgagctcaagattcagctgcctatgccattcaggagttgctttctatttatgactgtagagagatggagaccaacggcccaggtcaccaattgtggaggagatttcctgagcatgttcgggaaatactagaacctcatctaaataccagatacaagagttctcagaagtcaaccgattggtctggagtaaagaagccaatttacttaagtaaattgggtagtaactttgcagaatggtcagcatcttgggcaggttatcttattacaaaggttcgacatgatcttgccagtaaaattttcacctgctgtagcattatgatgaagcatgatttcaaagtgaccatctatcttcttccacatattctggtgtatgtcttactgggttgtaatcaagaagatcagcaggaggtttatgcagaaattatggcagttctaaagcatgacgatcagcataccataaatacccaagacattgcatctgatctgtgtcaactcagtacacagactgtgttctccatgcttgaccatctcacacagtgggcaaggcacaaatttcaggcactgaaagctgagaaatgtccacacagcaaatcaaacagaaataaggtagactcaatggtatctactgtggattatgaagactatcagagtgtaacccgttttctagacctcataccccaggatactctggcagtagcttcctttcgctccaaagcatacacacgagctgtaatgcactttgaatcatttattacagaaaagaagcaaaatattcaggaacatcttggatttttacagaaattgtatgctgctatgcatgaacctgatggagtggccggagtcagtgcaattagaaaggcagaaccatctctaaaagaacagatccttgaacatgaaagccttggcttgctgagggatgccactgcttgttatgacagggctattcagctagaaccagaccagatcattcattaccatggtgtagtaaagtccatgttaggtcttggtcagctgtctactgttatcactcaggtgaatggagtgcatgctaacaggtccgagtggacagatgaattaaacacgtacagagtggaagcagcttggaaattgtcacagtgggatttggtggaaaactatttggcagcagatggaaaatctacaacatggagtgtcagactgggacagctattattatcagccaaaaaaagagatatcacagctttttatgactcactgaaactagtgagagcagaacaaattgtacctctttcagctgcaagctttgaaagaggctcctaccaacgaggatatgaatatattgtgagattgcacatgttatgtgagttggagcatagcatcaaaccacttttccagcattctccaggtgacagttctcaagaagattctctaaactgggtagctcgactagaaatgacccagaattcctacagagccaaggagcctatcctggctctccggagggctttactaagcctcaacaaaagaccagattacaatgaaatggttggagaatgctggctgcagagtgccagggtagctagaaaggctggtcaccaccagacagcctacaatgctctccttaatgcaggggaatcacgactcgctgaactgtacgtggaaagggcaaagtggctctggtccaagggtgatgttcaccaggcactaattgttcttcaaaaaggtgttgaattatgttttcctgaaaatgaaaccccacctgagggtaagaacatgttaatccatggtcgagctatgctactagtgggccgatttatggaagaaacagctaactttgaaagcaatgcaattatgaaaaaatataaggatgtgaccgcgtgcctgccagaatgggaggatgggcatttttaccttgccaagtactatgacaaattgatgcccatggtcacagacaacaaaatggaaaagcaaggtgatctcatccggtatatagttcttcattttggcagatctctacaatatggaaatcagttcatatatcagtcaatgccacgaatgttaactctatggcttgattatggtacaaaggcatatgaatgggaaaaagctggccgctccgatcgtgtacaaatgaggaatgatttgggtaaaataaacaaggttatcacagagcatacaaactatttagctccatatcaatttttgactgctttttcacaattgatctctcgaatttgtcattctcacgatgaagtttttgttgtcttgatggaaataatagccaaagtatttctagcctatcctcaacaagcaatgtggatgatgacagctgtgtcaaagtcatcttatcccatgcgtgtgaacagatgcaaggaaatcctcaataaagctattcatatgaaaaaatccttagagaagtttgttggagatgcaactcgcctaacagataagcttctagaattgtgcaataaaccggttgatggaagtagttccacattaagcatgagcactcattttaaaatgcttaaaaagctggtagaagaagcaacatttagtgaaatcctcattcctctacaatcagtcatgatacctacacttccatcaattctgggtacccatgctaaccatgctagccatgaaccatttcctggacattgggcctatattgcagggtttgatgatatggtggaaattcttgcttctcttcagaaaccaaagaagatttctttaaaaggctcagatggaaagttctacatcatgatgtgtaagccaaaagatgacctgagaaaggattgtagactaatggaattcaattccttgattaataagtgcttaagaaaagatgcagagtctcgtagaagagaacttcatattcgaacatatgcagttattccactaaatgatgaatgtgggattattgaatgggtgaacaacactgctggtttgagacctattctgaccaaactatataaagaaaagggagtgtatatgacaggaaaagaacttcgccagtgtatgctaccaaagtcagcagctttatctgaaaaactcaaagtattccgagaatttctcctgcccaggcatcctcctatttttcatgagtggtttctgagaacattccctgatcctacatcatggtacagtagtagatcagcttactgccgttccactgcagtaatgtcaatggttggttatattctggggcttggagaccgtcatggtgaaaatattctctttgattctttgactggtgaatgcgtacatgtagatttcaattgtcttttcaataagggagaaacctttgaagttccagaaattgtgccatttcgcctgactcataatatggttaatggaatgggtcctatgggaacagagggtctttttcgaagagcatgtgaagttacaatgaggctgatgcgtgatcagcgagagcctttaatgagtgtcttaaagacttttctacatgatcctcttgtggaatggagtaaaccagtgaaagggcattccaaagcgccactgaatgaaactggagaagttgtcaatgaaaaggccaagacccatgttcttgacattgagcagcgactacaaggtgtaatcaagactcgaaatagagtgacaggactgccgttatctattgaaggacatgtgcattaccttatacaagaagctactgatgaaaacttactatgccagatgtatcttggttggactccatatatgtgaaatgaaattatgtaaaagaatatgttaataatctaaaagtaatgcatttggtatgaatctgtggttgtatctgttcaattctaaagtacaacataaatttacgttctcagcaactgttatttctctctgatcattaattatatgtaaaataatatacattcagttattaagaaataaactgctttcttaataaaaaaaaaaaaaaaaaaaaaaaaaaaaaaaaaaaaaaaaaaaaaaagggggggggaaaaaaaacggggggggcagtgcgacacaagggtcctgggtaaaagggggcgacccaaaaatgggcaagaaaaaatagacggcaagagggacccaaaagaaacaaagaaggacaagggaacacgagcaaccggagaacataggagaagacacccaacgatggggagaaaaaaacggacacaacgcacgagagagagacagcggcaaaaagacagggaagtaaacacgcaacagagaacaaaggaccagacagaatacaaacagg

SEQ ID NO: 579297 - DNA, 2995 bp, Homo sapiens
gtgactagaggacccgggatgaggaagtcactatgacagggctattcagctagaaccagaccagatcattcattaccatggtgtagtaaagtccatgttaggtcttggtcagctgtctactgttatcactcaggtgaatggagtgcatgctaacaggtccgagtggacagatgaattaaacacgtacagagtggaagcagcttggaaattgtcacagtgggatttggtggaaaactatttggcagcagatggaaaatctacaacatggagtgtcagactgggacagctattattatcagccaaaaaaagagatatcacagctttttatgactcactgaaactagtgagagcagaacaaattgtacctctttcagctgcaagctttgaaagaggctcctaccaacgaggatatgaatatattgtgagattgcacatgttatgtgagttggagcatagcatcaaaccacttttccagcattctccaggtgacagttctcaagaagattctctaaactgggtagctcgactagaaatgacccagaattcctacagagccaaggagcctatcctggctctccggagggctttactaagcctcaacaaaagaccagattacaatgaaatggttggagaatgctggctgcagagtgccagggtagctagaaaggctggtcaccaccagacagcctacaatgctctccttaatgcaggggaatcacgactcgctgaactgtacgtggaaagggcaaagtggctctggtccaagggtgatgttcaccaggcactaattgttcttcaaaaaggtgttgaattatgttttcctgaaaatgaaaccccacctgagggtaagaacatgttaatccatggtcgagctatgctactagtgggccgatttatggaagaaacagctaactttgaaagcaatgcaattatgaaaaaatataaggatgtgaccgcgtgcctgccagaatgggaggatgggcatttttaccttgccaagtactatgacaaattgatgcccatggtcacagacaacaaaatggaaaagcaaggtgatctcatccggtatatagttcttcattttggcagatctctacaatatggaaatcagttcatatatcagtcaatgccacgaatgttaactctatggcttgattatggtacaaaggcatatgaatgggaaaaagctggccgctccgatcgtgtacaaatgaggaatgatttgggtaaaataaacaaggttatcacagagcatacaaactatttagctccatatcaatttttgactgctttttcacaattgatctctcgaatttgtcattctcacgatgaagtttttgttgtcttgatggaaataatagccaaagtatttctagcctatcctcaacaagcaatgtggatgatgacagctgtgtcaaagtcatcttatcccatgcgtgtgaacagatgcaaggaaatcctcaataaagctattcatatgaaaaaatccttagagaagtttgttggagatgcaactcgcctaacagataagcttctagaattgtgcaataaaccggttgatggaagtagttccacattaagcatgagcactcattttaaaatgcttaaaaagctggtagaagaagcaacatttagtgaaatcctcattcctctacaatcagtcatgatacctacacttccatcaattctgggtacccatgctaaccatgctagccatgaaccatttcctggacattgggcctatattgcagggtttgatgatatggtggaaattcttgcttctcttcagaaaccaaagaagatttctttaaaaggctcagatggaaagttctacatcatgatgtgtaagccaaaagatgacctgagaaaggattgtagactaatggaattcaattccttgattaataagtgcttaagaaaagatgcagagtctcgtagaagagaacttcatattcgaacatatgcagttattccactaaatgatgaatgtgggattattgaatgggtgaacaacactgctggtttgagacctattctgaccaaactatataaagaaaagggagtgtatatgacaggaaaagaacttcgccagtgtatgctaccaaagtcagcagctttatctgaaaaactcaaagtattccgagaatttctcctgcccaggcatcctcctatttttcatgagtggtttctgagaacattccctgatcctacatcatggtacagtagtagatcagcttactgccgttccactgcagtaatgtcaatggttggttatattctggggcttggagaccgtcatggtgaaaatattctctttgattctttgactggtgaatgcgtacatgtagatttcaattgtcttttcaataagggagaaacctttgaagttccagaaattgtgccatttcgcctgactcataatatggttaatggaatgggtcctatgggaacagagggtctttttcgaagagcatgtgaagttacaatgaggctgatgcgtgatcagcgagagcctttaatgagtgtcttaaagacttttctacatgatcctcttgtggaatggagtaaaccagtgaaagggcattccaaagcgccactgaatgaaactggagaagttgtcaatgaaaaggccaagacccatgttcttgacattgagcagcgactacaaggtgtaatcaagactcgaaatagagtgacaggactgccgttatctattgaaggacatgtgcattaccttatacaagaagctactgatgaaaacttactatgccagatgtatcttggttggactccatatatgtgaaatgaaattatgtaaaagaatatgttaataatctaaaagtaatgcatttggtatgaatctgtggttgtatctgttcaattctaaagtacaacataaatttacgttctcagcaactgttatttctctctgatcattaattatatgtaaaataatatacattcagttattaagaaataaactgctttcttaata

SEQ ID NO: 579298 - DNA, 809 bp, Homo sapiens
ggaggacatgaatagtcgccaggcttggtggctcattgcgtctcccaaggacagaggagatcgttggtgtttcaaggccccgcggtcattatctcgtccggaccctgcggatagagttcttcactaccataacaaggagggatatgataggcggtgcagttggatataatctcctttagaaacaaatggaaattaagcttatgatacccatgcagtaggttcaggacttggaaactcatggatcttgacaaaacacaagcagaaaccaatgtctcagcgttcaactgcttgtatcaacatgtcagcctgtgttactatctataccgagatggtcactcaagctcaactggaaataacagtacaacagctaatggctcatttggatgctatcaggaaagacatggtcatcctagagtaaaagtgaattggcaaatctgagagcagagaatgagaacatgaacctggatttagaccaagtcaaggcagacgaactgaatggcatgaaaccagtcgcaatcacgagcagatacatacactggatatcagcttagaacggagcagagtaacagatatgtatacagactcagggaacaagcgaacttatggaaagcgaacgtagcagaatttacacaaaaaggatactcaaaccacaacgtctcatctccagagaccaagtaactaaccactggacgctgaacattgcttcctctacaaacccgtgcacggacatctaacaaaacttgcagacaattcgttatcttggagagttcggtgttacttgcctgggcattgcattggcactcactcga

SEQ ID NO: 579299 - DNA, 408 bp, Homo sapiens
caaggcgggtggatcacgaggtcaggagatggagaccatcctggctaacatggtgaaaccccgtctctactaaaaatacgaaaaattagccaggcgtggtggtgggcacctgtagtcccagctactcaggaggctgaggcaggagaatggcgtgaacccggaaggcggagcttgcagttagccgagatcatgccactgcactccagcctacatgacaatgtgacactccatctcaaaaaataataataataacaatataagaactagctgggcatggtggcgcatgcatgtagtcccagctactcctgaggctcagtcaggagaatcgcttgaacttgggaggcggaggttgcagtgagctgagctcataccactgcactccagcctgaacagagtgagatcctgtca

SEQ ID NO: 579300 - DNA, 273 bp, Homo sapiens
taggaagcatttcccatttttattcataaaatttttacttaaaattgcaaaagtaaatttacagaggcccagggaacaaaacaggaaatgaaatgttccaaactttcccaaaagtttcaaaaaaaccccccctagcctcaaaatctccggttaaaccggggttgcccaacagggtctatttattcctgcattttctcaataagttcttctttatattggcctttctcttttccaacttggccaaacttggctttgcgttcaaaaatttttttc

SEQ ID NO: 579301 - DNA, 153 bp, Homo sapiens
gtggcccgggaagcgcagcaggtggtgaccccgctcatggtggccgacaccaggtggttgcggtccccgtatggtgggggtggtcagcttcagggtgcggaagctgatgtcatactgggcctcgttatcaatggagtaggtttcatctgtgtt

SEQ ID NO: 579302 - DNA, 549 bp, Homo sapiens
tgagacagagtctcgctctgttgcccaggctggagtgcagtggcgcgatctcagctcactgcaagctccacctcccaggttcacaccactctcctgccccagcctcccgagtagctgggactacaggcgcccgccaccaagcccagctaactttttatatatatatattgccaggagagatggggtttcaccgtgctagccaggacggtctcgatttcctgacctcgtgatccgaccgtcgagacctaccaatgtgctgggattacaggcatgagccaccgcgcacagcctaagttttgtatttttagtagagacggggtttcatcatgttggccaggctggtctcgaactcctgacctgaggtgatccacccagctcggcctcccaaactgctgggattatgggagtgagccactgcgcccggcccaactgttttgttgtccaacctctactcttctggcactgcttcctccccaccactctgtttacatgttatagggaggcagccatttgtacacaaattatctgtccacccttgccacagctggt

SEQ ID NO: 579303 - DNA, 203 bp, Homo sapiens
tttcgtatgaggttcgaacacgggaaagctcacccgtggccggatacggtacacgcattgacagattgagtagctctttctcgcattccgtgtgtatgtgtgtgcattggccgattctttagttgtgtggtagcgattatgtctaggttaattaccgaataacgagacctcactaacgtaacccagtgtgtaccgaggctcgt

SEQ ID NO: 579304 - DNA, 365 bp, Homo sapiens
  misc_feature (34)..(34): n is a, c, g, or t
ggtcgtctagagatccacgatcggctagtcatgnaaatatgatctgtagcttaaagaaaatccagttatacaagacttcagatgaacattcagggacgtgatcagagcttcaagtgtgttgctcactttattataggcagattcaggtaggctaagaaagaagagtgttcccattgagacatgatctaagaatagccttctatagaggcaaattatgttctgtagaaactagctagccagccaccaagatgttaccaataaaggattccttgtactagcaactaaccatgtttaaaaggtcttagccagaattacaaaaacaaaacatttagagtaatacttatgaatacaagcataattggttc

SEQ ID NO: 579305 - DNA, 436 bp, Homo sapiens
aggttggcggagggaactccacaccattgatgactaaggtcaagctgggcagattctgaatgctgttacagttcacgagatcactgtccatactcattctcctgggcccctttggcctgcagaagagcactcattttctggtggtgcacattgagcatagatgtgccttgtgtcctcgattggcattagctcgtatcgagggactatctcatagtcctagctgcgttgctgtggttcccggctgctggtgtacgttccttgctaggtatccaggtctctgcatatgaactcgaccgggtcttcatttcttccttcagaatctgccggccaattcctaatttggagcttgtgcgatgtgcggtcaaaatcatcctcctctcctccagacgagaaccttctggctcggggcactttgggggacccatggtaggtccag

SEQ ID NO: 579306 - DNA, 710 bp, Homo sapiens
tagtaaaacaacctagtctttaattggcccaaggccggtggtggcaagcacgggggccccaaaatcttccaaaagggaaggggaggaggggcaaagcacggggcctaccagggtgcttgcctggccccgtccgtggtttccgtgcaggaggtgtgggaagggagagaaaagggacatttcgacggccatcaagttatctcccacagttttcagccactatatccaggtgggtggaggaggaaacgtgtaggacacacgcatcccccacaggcttcatactgacatagatccaaggtttaacttaattccctcaccctcagtctctatacccccagcaaaagtgagacgtgtaagacagcacgggggagggtcttcaggagcccactcgggtgtggccgtggagaagcgggggcaggccagacaggggttcaaggagcgtaggggagagtggggaggagaccaggaggaggctggcggcacatgaggagggacagacaagactgtgaacgtgagagcgatggagaggacaagcacggcaaagacaccacatatcagaggaggaaccaccaaaacgtgagggatacacaaataccgtgaatacgcaagggaggggagacaagggcagaaaacccacacaaacaggttacaaaaacaaggtaaacattgaagagaagaaaaaacccacccagacaatggcgaatcaagacaag

SEQ ID NO: 579307 - DNA, 488 bp, Homo sapiens
cgtgccgaggatccccgtcggtcgggtgtgccgggagcaggagtcagagctggcagagagtctcgggaatcaggccaacacggacaaaggcaaagaaaagaaggaccaaggcctccaggaagtcggggataatgtgagatgaccaaacctaagaaggatgggtgtacctgaggaagaagagaaatgtaaatgtggggaaaacatatttgagggaataataaaagttctccagccttgctagagaccgggacatccaaatagaagaagctcaaagaacacctgggaagttcatggcaaaaagttaataacctatgcacgtagtcatcaggttatctaaagtcaagatgaaggaaaaaatctgcatcaggtaacatataaaggaaaacctatcagattaacagcagacttctcagcagaaaccttacaagcgggaaaggattggtgccctatctttagcttccttaaacaacaaaacgataaacagccat

SEQ ID NO: 579308 - DNA, 209 bp, Homo sapiens
cagagttcaaacagtgccacatcatcataggacgccccgtgcgctgtcacctttcaccccacaaggccaacatttttctgtggctttagcaatggggccgtgcgcttcttcagcctggaggccgctgaggtcctggaggaacacacgtgccaccgaggagctgtcaccggcctgaccgccacccctgacagccgcctgctcttcagctc

SEQ ID NO: 579309 - DNA, 698 bp, Homo sapiens
  misc_feature (319)..(319): n is a, c, g, or t
  misc_feature (346)..(346): n is a, c, g, or t
  misc_feature (368)..(368): n is a, c, g, or t
  misc_feature (371)..(371): n is a, c, g, or t
  misc_feature (380)..(381): n is a, c, g, or t
  misc_feature (384)..(385): n is a, c, g, or t
  misc_feature (400)..(401): n is a, c, g, or t
  misc_feature (405)..(406): n is a, c, g, or t
  misc_feature (408)..(410): n is a, c, g, or t
  misc_feature (412)..(413): n is a, c, g, or t
  misc_feature (418)..(419): n is a, c, g, or t
  misc_feature (423)..(423): n is a, c, g, or t
  misc_feature (431)..(431): n is a, c, g, or t
  misc_feature (436)..(437): n is a, c, g, or t
  misc_feature (443)..(443): n is a, c, g, or t
  misc_feature (445)..(445): n is a, c, g, or t
  misc_feature (448)..(448): n is a, c, g, or t
  misc_feature (450)..(450): n is a, c, g, or t
  misc_feature (456)..(456): n is a, c, g, or t
  misc_feature (460)..(460): n is a, c, g, or t
  misc_feature (462)..(462): n is a, c, g, or t
  misc_feature (466)..(466): n is a, c, g, or t
  misc_feature (472)..(472): n is a, c, g, or t
  misc_feature (482)..(482): n is a, c, g, or t
  misc_feature (486)..(486): n is a, c, g, or t
  misc_feature (501)..(502): n is a, c, g, or t
  misc_feature (520)..(520): n is a, c, g, or t
  misc_feature (532)..(532): n is a, c, g, or t
  misc_feature (540)..(542): n is a, c, g, or t
  misc_feature (560)..(561): n is a, c, g, or t
  misc_feature (567)..(568): n is a, c, g, or t
  misc_feature (580)..(582): n is a, c, g, or t
  misc_feature (604)..(604): n is a, c, g, or t
  misc_feature (641)..(641): n is a, c, g, or t
  misc_feature (670)..(670): n is a, c, g, or t
aacccattgctaatttgtacgccttaaaaacctgtaactttaattttccattgacccacttctttttgtgaaaagccaaacagattttaaattgggttttcaataaaaaaagctcatttgggaataacctgcccttttctcccaaaaaataaccttcaaggcaaagcatttctttaagcctttttaggagagtatacctttaggtactaatgaaatggccaggtaatacgcaattgttcttataatgcaacttattttctataaaatgtgtttaccaagccaaaattatagattgtagaattctgaaaggtcaatttcntggattcacttctcaggaatttttttnaagttaatttgggaaattacancanttcactttnntgnnagtctttgccacatnngacnnannnannctgtnntttntacatttnaagcnnctgttntnggntntgtganagtncntgtnttattnaagcacaacngggnttgcactaaagaatnntcattgtaataacactanttggtagcctancttcatannngtattcttaattgcacannaagtcnntaatttgtcacnnnggggttttgaatgtttgctttnagtgttggctatttctatgttttataaaccaaaacanaatttccaaaaacaatgaaggaaaccaanataaatatttctgcatttggaaaaaaaa

SEQ ID NO: 579310 - DNA, 150 bp, Homo sapiens
cgcgggactagaggatccattgcgaggagctctactgtcagaaatcatggtggtactcatcacggcagtgctactacagacactgaagaaagatcatccaacatggataaatacctggttcttatcagatgtttgagaagtaatagagta

SEQ ID NO: 579311 - DNA, 347 bp, Homo sapiens
atactatgagatccctggtgaacatgtgactcattcactgagaagaggctacatattcaggctgtaagggtctagaaactgagaggccaagtcctggtaaagatacatttgacagacgtctctttcttactcctagctacagttagtgggactcttgccggcacctcgttgctggtcatttactccacagccttcacatttcagtccttgacgttccgatccccagcgcatctcaccacagtaatcacagcaagtcggagctttgtcagcctgtacatcgcgcgtctgtggacgaatctggaagtcttctactgtggctaaagaggtgtgagccaccgttgccaggt

SEQ ID NO: 579312 - DNA, 256 bp, Homo sapiens
cagccctttgggaaaccaaggggggtgggtccccttaaataaggggtttgagccccttctggccaacatggggaaaccccgttttttctaaaaatacaaataattggccacctggggggggagggccccggtaatcccagcttctttgggggtttaggggggaaaatcgctttaacctgggaggggggggtttcaaaaaaccgagggggggcccttgctttcccccctgggccacaagagtgaaactccttttcca

SEQ ID NO: 579313 - DNA, 278 bp, Homo sapiens
gagagtttaaagataaagagagtgaaggaggctgggtgcggtgggtcacacctgtaatacccagcactttggcgaagccagtgcaggcggatcacctcaggtcaggagttcgagaccagccttaccaacatggtgaaaccccgtctctactaaaaatacaaaaaaattagcagggtgtagtggcacagtgcctataatcccagctactggggaggctgaggcaggagaatcgctggtaacctgggaggccgagtctgccgtgagccaagacggtgccg

SEQ ID NO: 579314 - DNA, 96 bp, Homo sapiens
agagtggctcttagagaactacggcacgtatgtaggatgtggtcgtgccgtcgaaatgtctgtacggatcctcaaccaataaaatctcagtttatg

SEQ ID NO: 579315 - DNA, 837 bp, Homo sapiens
tggaaagttccagccggtggggaggaaaagaggtatcttttaaaatagagatagttccttttttccctcaatctaggcgggggtcactatgggggtgcaaggatttcatggtgggctagatcacatttggtataatcaggtatcctctgggtgtgcgggatagagatttaaatccgtgattttctccataaaacagtgagtattaagaaataattgccgggttgggagaaacgggagaaatcaccctttagggaagaaaccacgggaaatttcggttaaccaccaagatatttaagaggtgtacaatagtaggctgctcaaccaaatgatggaaggacagagtcgaagggaaaaaacggggagacggtcaaaaagtgacgcaaagaacgcctcatacaatgtcaaactcggtaaaaaaaccacataaatggtaaataaaggcccttcatccactggactacaggccgcagatggtctagaagctaaggacagcaattcctctgacaaaggcacaagtagatattgacaccagggggtggaaaactacgggccccgcggccggatttgacccagcctgataggagtggtggcaacagtagcacggatgtcacattgaaaggaagtcattagaggcaacagctttgtggtccgggaagtttacgatattagtcacgggccgtggacgcagggtggccacacccggtttaccataacttgtgaatcacaaaaaattaacttgggcgaggtcaacaaaccaaggtcgcaggggaggtacccaacccataggggcgcacaaacagaaccgcaaaagcaaaaaattggcgggcaaaaaaaaag

SEQ ID NO: 579316 - DNA, 814 bp, Homo sapiens
ccacgcgtcgctgaggtaccgcccgcgcgagcacacacaggacacacacacacacacacacacacacacacacacacacacatatcttccaggacccatcccctgcgtggcagctccgaagagccagagagagacagagcgcggacgccgcgggaggcagtgccgtggaccccatcgtgcccagggaagacgacgggacgcccggtgtctggtgagggctgcagaggcagggccaggccggtgcccgtgcccgtaagggacgaacaaaccctctcagcgggccctcgtgggccaccgagagcccaacaggctctccgtgcgtggccccagctatgatttcagagtcgaagtccaccgcgcgaattgttgtgacagcggaaacagagtcgccagaagagtccaaaagtcgtgcaagcacaaatattagcaatacccacaggaagaggggcaagcacggacatctaggagacgcagcggatggatgccacccacaacaggagctcggacaccagcaacatgatgcacgaacaaaagtggaagcgagcacatataacagacggacagaccagagactaaggagacacacagggaaacaaggggacgtcttgagaaacaacaacggcacagaacaacggacacaggaaaataatccgccacggaaacaaggtccaaggaacctctgaagacaatgaagcgatgaaatcaggggcgacgtagcgcgacagagaggagacacgatcgacatacaaaatgcgacgtaacgactcgagaagacaacaaagaacgagcgcgatggagaccagcaccgcccccc

SEQ ID NO: 579317 - DNA, 219 bp, Homo sapiens
cctgacgacgtgcctgtgacattacctgacagcacaggcacttccctgtcatcagagagtatcttgacgcctggcggggagttcatcaacagcagggaggaagcaaaacgtgtcctttcaccagctggcagccttgaccttaccatggacaaccccgcagcacaaaaagagtgacggcggaggaggcttccaaggcagatgaaaaaattgagctggtaa

SEQ ID NO: 579318 - DNA, 176 bp, Homo sapiens
aggggggggggccccccctttgtttccctccggtttgggccaaataaaaggggccggtttttccttccccttttaaaatgattgtaagtttcctggggcccccctaaaagcaaaaggtgttgggtttcctgtcccttttatgggcccgggggccaattaaccctttttttttttta

SEQ ID NO: 579319 - DNA, 126 bp, Homo sapiens
tgtgctgctcctatatcgccgacgcgtgtcaccatcggccttgcgctgtacggctgattatccccctgtgtcacccggtcatgcgagtgcttggaacaggagggacgagggagtcggatcaagagc

SEQ ID NO: 579320 - DNA, 1320 bp, Homo sapiens
cataaagcacaggaaagacttcaggaagaggacaaatatgacaaagaagaatataggaaacaaattaaggcaaagcatcgggagaaaagactgaacgaaagggaagccagcaagagaagccaacaagagacaagcaaaggccaaagatgaagaggcagcctttctggataggcagtgatgatgcatgatgatgatgcatgatggatttgatccaagcacactcccagatccagataaatcaccagacagctctgaagactcagactagctgaacgatatggcaaacataacaatacacgctgactacccacagcaagcaagccaggggatgacagaagaggagcacaccagtgcaagtggacagacgtgggacacaccaaacgtcataacacacgacacacgacaggccaggctgcggacaaattatacgcacgccatcacgcgcactaccgcgccctggtcttcagccaagaggatgacacgcagacgggctcgtcaccactctgcattcagacaatctccaagcgacttacgcctacaccatatcccttgagcgggccacggcgcataacatacccttatggacaacaactttgggctcaatggaccatgcagtacgagccacaacaaggttgcaacacaacagaacggaataccggccgacgacaacccataaccgcccaccaataaatgacacacaactaccccacaaaagagggcacagagcagaccaaggggagaacaaaaaggcgacaacccggaaatcacacaaagcatccgccacacatacacaagcgaacaaccgcacacctgccgcccaaaacaacatgaagaccacacctccacagacaccgaacgacacagcacataaaacaccaacgaaccaaagaaaaacaagagcaaccagacacgacggaccctggacagaaaccagaccccaagtcgaagcacccacccgtgcaccaccgaaaacacaggcccccgaggcacaaaacgccacaaacaccgcgagcacgcaaggtccagcggaacgaaggcgcagacagaccagcagacacaaaaacgaaaccgaaagcccgacaacacagctccagagcccggggaaacctttccgccgagcacacatgcaggaccgaacgacgagccactcacacgcggcggcgacccaccgcacgaaatcacaagaaaagcggccccacgatccgcaagaccacaaaccgaccacccgcaccaccccagcacgaggaagagcagacgcgagacagccacgcaacgccggagtacgcccccaccgcacacgcgagagagcacaagacaaac

SEQ ID NO: 579321 - DNA, 218 bp, Homo sapiens
  misc_feature (38)..(38): n is a, c, g, or t
  misc_feature (65)..(65): n is a, c, g, or t
  misc_feature (88)..(88): n is a, c, g, or t
  misc_feature (94)..(94): n is a, c, g, or t
  misc_feature (117)..(117): n is a, c, g, or t
  misc_feature (177)..(177): n is a, c, g, or t
aaacaaatggtcattgatgtccttcaccccgggaaggngacagtgcctaaggcagaaattcgggnaaaactagccaaaatgtacaagnccacancggatgtcatctttgtatttggnttcagaactcattttggtggtggcaaggcaactggctttggcatgatttatgattccctnggttatgcaaagaaaaatgaccccaaacataggcttgcaag

SEQ ID NO: 579322 - DNA, 616 bp, Homo sapiens
  misc_feature (462)..(462): n is a, c, g, or t
  misc_feature (581)..(581): n is a, c, g, or t
gagacagagtcttactctgtagctcaggctgcagtgcagtggtacaatctgggctcactgcaacctgcatctcccaggtccccattcaggaaagtttcctgcctcagtcccccaggtagctagcattacaggcatgcaccaccatgctcagctaatttgtgagtttttagttgagacgtggtatcaccttgctggccaggccggtcttcgaactcctgaccttgtgatccaccttgcttggccatccaaagtgttgggattacaggcaggatgcaccacacctggacgtctgttaaaacagagaaatagacctgctgaatatgccgatgagagtattaattggaatctgcatagcaatcgactgaccattgccttgaacatcacagggcatctgagtggccagataagaccatcacgttctattcatgctgataggcttgcaatggcatatagtactagctngtggatcctgctacttctagcttagagtgtatgcctgcgtactctgatgtaggctgaaccacatgtgctgatgatatgatcatgacgaagcatatgatctgagaggagctctgagagcntttcactagtgacactactagactgcatgttagag

SEQ ID NO: 579323 - DNA, 433 bp, Homo sapiens
agaggatccccgccagcactgtaggcagtagctttagctgtattggttggtctcctgtgaccatcatgaccttaattccagcactatcggacatgtgcccacggaatccggaacggccgcccgtggaggggcaatcatggagatcagccccacagagcacagttcatcgatagggaaatccatatcgtcagtgtcagactggaacccttcaggaaatcgatctgctggcatgcaggggtggcagtgacctaggattcgaactccgaggccccccagctccaaataggcgttctgaaaggcgtctttcagctcctcatccaggggctgctccttgccgtggaggaggatagagctgcaacggtctaggatcctttctggggcgcccttcatcaccaacaggtgttggggctccgatgtgttggggataacatca

SEQ ID NO: 579324 - DNA, 611 bp, Homo sapiens
  misc_feature (326)..(326): n is a, c, g, or t
  misc_feature (329)..(329): n is a, c, g, or t
  misc_feature (331)..(331): n is a, c, g, or t
  misc_feature (338)..(339): n is a, c, g, or t
  misc_feature (350)..(350): n is a, c, g, or t
  misc_feature (354)..(355): n is a, c, g, or t
  misc_feature (362)..(362): n is a, c, g, or t
  misc_feature (367)..(367): n is a, c, g, or t
  misc_feature (371)..(371): n is a, c, g, or t
  misc_feature (376)..(376): n is a, c, g, or t
  misc_feature (391)..(391): n is a, c, g, or t
  misc_feature (393)..(393): n is a, c, g, or t
  misc_feature (406)..(406): n is a, c, g, or t
  misc_feature (413)..(414): n is a, c, g, or t
  misc_feature (416)..(417): n is a, c, g, or t
  misc_feature (424)..(424): n is a, c, g, or t
  misc_feature (426)..(426): n is a, c, g, or t
  misc_feature (428)..(430): n is a, c, g, or t
  misc_feature (432)..(432): n is a, c, g, or t
  misc_feature (437)..(437): n is a, c, g, or t
  misc_feature (449)..(449): n is a, c, g, or t
  misc_feature (456)..(457): n is a, c, g, or t
  misc_feature (460)..(460): n is a, c, g, or t
  misc_feature (462)..(462): n is a, c, g, or t
  misc_feature (498)..(498): n is a, c, g, or t
  misc_feature (510)..(510): n is a, c, g, or t
  misc_feature (512)..(513): n is a, c, g, or t
  misc_feature (515)..(515): n is a, c, g, or t
  misc_feature (527)..(527): n is a, c, g, or t
  misc_feature (530)..(530): n is a, c, g, or t
  misc_feature (544)..(544): n is a, c, g, or t
  misc_feature (547)..(547): n is a, c, g, or t
cggtccccatgcacacttcgttccccatgcacagttcggtccccatgcacagttcggtccccatgcacagttcggtccccatgcacagttcggtccccatgcacagttcggtccccatgcacagttttaggatggacatgtttttcttatctcttgggtatataacaaggagtggaattgccagatcaaatggtgattctgtgtttaactttctgaggaactatcagctgcttcccaaagtggccatcccattattctcatattatttttatttgtttattatattttgagagtgtctcgctctgtcaccctggctggagtgcagnggngngatctcnnctcactgcaanctcnncctcccnggttnaagngattntcctgcctcagcctncngagtagctgggantacaggnncnngccaccncncnnngntaatnttgtatttttantagagannggntntcaccatgttggccaggctggtctcaactcctgacntcaggtgatccncnngncttggcctcccnaantgctgggattacangcntgagccactgtgcttgctgctatacttacttttaaaggaacctttgatcacactgtgctgggag

SEQ ID NO: 579325 - DNA, 336 bp, Homo sapiens
cggtccccatgcacacttcgttccccatgcacagttcggtccccatgcacagttcggtccccatgcacagttcggtccccatgcacagttcggtccccatgcacagttcggtccccatgcacagtttggtccccatgcacagttcggtccccatgcacagttcggtccccatgcacagttcggtcgccatgcacagctcggtcgccatgcacagcgcggtcgccatgcacagttcggtccccatgcacagttcggtccccatgcacagttcggtccccatgcacagttcatggcttgttcggcagcaacctgaatgctttacagccctagagccta

SEQ ID NO: 579326 - DNA, 948 bp, Homo sapiens
  misc_feature (54)..(54): n is a, c, g, or t
  misc_feature (72)..(73): n is a, c, g, or t
  misc_feature (78)..(78): n is a, c, g, or t
  misc_feature (187)..(187): n is a, c, g, or t
  misc_feature (216)..(216): n is a, c, g, or t
  misc_feature (228)..(228): n is a, c, g, or t
  misc_feature (259)..(260): n is a, c, g, or t
  misc_feature (306)..(306): n is a, c, g, or t
  misc_feature (311)..(311): n is a, c, g, or t
  misc_feature (313)..(313): n is a, c, g, or t
  misc_feature (379)..(379): n is a, c, g, or t
  misc_feature (381)..(381): n is a, c, g, or t
  misc_feature (393)..(393): n is a, c, g, or t
  misc_feature (396)..(396): n is a, c, g, or t
  misc_feature (432)..(432): n is a, c, g, or t
gtcagagagctgggatcatggtagagtggaaccctcctttactcctctcggagngccctggccttacccaannctggncgggctcccactccttgaagtatttccacacttccgtgtccggccggccgggggagccccgcttcatctctgtgggctacgtggacgacaccagttcgtgcgcttcganaagacgccggagtccgaggatggtgccgngggcgccgtggntggagcaggaggggtcagagtattgggaccnnggagacacggagcgccaggacaccgcaacagattttccgagtgaanctgcngnacgctgcgcggctactacaatcagagcgaggccgggtctcacaccctgcagtggatgcatggtgcnanctggggcccganggntgcttcctccgcgggtatgaacagttcgcctacganggcaaggattatctcaccctgaatgaggacctgcgctcctggaccgcggtggccaacggggctcagatctccgagccaaaacgtccaatgatgcctctgaggcggagcagccagagagcctacctggaagacacatgccgtggagttggctccacaaatacctggcagaagggcaaggagacgctgcttcactgaaagccccaaagacacacgtgactcacacccatctctgacatgaggcacctgaggtgctggccggcttctaccctgcgggataacagtgaccggccgcaggcaccgaaggccaaccaaggaaacgggcccgggaacccgccgcaggactgacttccaacggccagccggggggcccgacacccacaatccgcccgcgcacggacggtccacccgccggacgacggccgcacaccacggaagacgcccgacggcgacagaggcagacacgcgggaacaaggacacagaggcgacagagcatcaccaccaccaccaacacggca

SEQ ID NO: 579327 - DNA, 353 bp, Homo sapiens
  misc_feature (311)..(311): n is a, c, g, or t
cggtccccatgcacacttcgttccccatgcacagttcggtccccatgcacagttcggtccccatgcacagttcggtccccatgcacagttcggtccccatgcacagttcggtccccatgcacagtttagtattaatgcatctttggtcactcctctagatctgctcagatagcttccatgctttctacccacttagcctgctttacatacaaacaggatattctgacatcatattttttgtatttgtttatagtctctctccctaaaacgttcctcaaatgtatcaaacagactccgcgcttagaacccgngaaatggctattattttctgcctgcgacagtctcccctcctt

SEQ ID NO: 579328 - DNA, 479 bp, Homo sapiens
  misc_feature (194)..(194): n is a, c, g, or t
  misc_feature (197)..(197): n is a, c, g, or t
  misc_feature (199)..(199): n is a, c, g, or t
  misc_feature (206)..(207): n is a, c, g, or t
  misc_feature (218)..(218): n is a, c, g, or t
  misc_feature (222)..(223): n is a, c, g, or t
  misc_feature (230)..(230): n is a, c, g, or t
  misc_feature (235)..(235): n is a, c, g, or t
  misc_feature (239)..(239): n is a, c, g, or t
  misc_feature (244)..(244): n is a, c, g, or t
  misc_feature (259)..(259): n is a, c, g, or t
  misc_feature (261)..(261): n is a, c, g, or t
  misc_feature (274)..(274): n is a, c, g, or t
  misc_feature (281)..(282): n is a, c, g, or t
  misc_feature (284)..(285): n is a, c, g, or t
  misc_feature (292)..(292): n is a, c, g, or t
  misc_feature (294)..(294): n is a, c, g, or t
  misc_feature (296)..(298): n is a, c, g, or t
  misc_feature (300)..(300): n is a, c, g, or t
  misc_feature (305)..(305): n is a, c, g, or t
  misc_feature (317)..(317): n is a, c, g, or t
  misc_feature (324)..(325): n is a, c, g, or t
  misc_feature (328)..(328): n is a, c, g, or t
  misc_feature (330)..(330): n is a, c, g, or t
  misc_feature (366)..(366): n is a, c, g, or t
  misc_feature (378)..(378): n is a, c, g, or t
  misc_feature (380)..(381): n is a, c, g, or t
  misc_feature (383)..(383): n is a, c, g, or t
  misc_feature (395)..(395): n is a, c, g, or t
  misc_feature (398)..(398): n is a, c, g, or t
  misc_feature (412)..(412): n is a, c, g, or t
  misc_feature (415)..(415): n is a, c, g, or t
cggtccccatgcacacttcgttccccatgcacagttcggtccccatgcacagttcggtccccatgcacagttcggtccccatgcacagttcggtccccatgcacagttcggtccccatgcacagttttatgtactgaaattattatttgtttttgagacacagtctcattctgtagaacaggatatagtgcagnggngngatctcnnctcactgcaanctcnncctcccnggttnaagngattntcctgcctcagcctncngagtagctgggantacaggnncnngccaccncncnnngntaatnttgtatttttantagagannggntntcaccatgttggccaggctggtctcaactcctgacntcaggtgatccncnngncttggcctcccnaantgctgggattacangcntgagccactgtgcttgctgctatacttacttttaaaggaacctttgatcacactgtgctgggag

SEQ ID NO: 579329 - DNA, 375 bp, Homo sapiens
  misc_feature (10)..(10): n is a, c, g, or t
  misc_feature (48)..(48): n is a, c, g, or t
ggcaaaggtnctggaaaaccaagggcctagaggcctggacagaggccncagcacagcacacccatattttacctttaggcagcaagagcaactcaccaccagccttgggcccagaagcatgccctgtctccctgcccagtcccccggaagcctccacactcaagggccctccacctgaggcagcagaatccacaggaatgacccagctcctcccccacaggttacaaggggagagtggcccttccctcacaagtccgacatctccaggcccccactgaactccggggacctctactgactgcttgctgggacagtcaccagggttggggggaagggccacaaaatgaaaccattaaagacccttaagagccaaaa

SEQ ID NO: 579330 - DNA, 177 bp, Homo sapiens
ggcggagcactgggggtggctcagctctgttggaggcggagttccaccatcatgtacaacaccaactcctcctccagcaggaagagctacaagcactgaagtgctgcgccagtctcagtaccacagctctcaggcccctctctggctgcagagacctctcctcaggttagctgtcct

SEQ ID NO: 579331 - DNA, 621 bp, Homo sapiens
ctctacaggatccttaaggtggttgtgggtagggggcagcccaagtggcagccgtcctggcccagcatcgtgtggccctgagtgttcagcttcaggaggcctgcttcccacctggccccatcaggctgcaggtcacacttgaagacgctgcctctgccgcatccgccgcgtcctctgcacacgttgccctgcaggtccacccccactgcactgttgcagctctccaggagcaggtgttctcagagctcggtttcccgccagccgtgcaacgctgggtcatcggacggtgcctgtgtgtgcctgagcgcagccttgcctcttacggggttcggcaggatggggaccctgctttcctctacttgctgtcagctcctcgagaagccccaggtcagtcctcgatgggggtggggtgtgggaggtggggtgcagccccacagtcctgagctccaccccctcagccacaggacctagccctcagcacccccagaagatggacggggaacttggacgcttgtttcccccatcattggggctacccacaaacacctgcgcaggtggttgtgggtttcctaacacagaatgcgtgtagacgactccttagcacctgggttatcatcttgt

SEQ ID NO: 579332 - DNA, 408 bp, Homo sapiens
  misc_feature (37)..(37): n is a, c, g, or t
  misc_feature (42)..(42): n is a, c, g, or t
  misc_feature (50)..(50): n is a, c, g, or t
  misc_feature (169)..(170): n is a, c, g, or t
tgatgctgtggtgatcaccgatccttattacgcccanactcnacgatggntatgatgggtacaacaggtctataatcaaaccttataatgctggtgaatttcacattgaaaggctggttatggcacacatcaactccataatcccagacacctggaccactccatactnncctaacagatccatagaagacgcaatctcaattgcactccacactgtcctcgctcacctagtgtgtttttgtgattcttttttgtaacctttattctttctgtctctgggtgtgactgtgactgtgtctgtctctgggtgtgggtgtgactgtctctgggtgtgactgtgtctgtctctgtgtgtgactgtgtctgtctctgtctctgtgtgtgactgtgtctgtctctgtgtagggt

SEQ ID NO: 579333 - DNA, 1158 bp, Homo sapiens
  misc_feature (70)..(70): n is a, c, g, or t
  misc_feature (104)..(104): n is a, c, g, or t
  misc_feature (307)..(307): n is a, c, g, or t
  misc_feature (688)..(688): n is a, c, g, or t
ggcgcgcagggcgagcgtaggggcgctgggactgcgggttgactttggggtccattgatttatagttccntttggcgtgtatgtctccagtcgagagaattccngggcttgctggtgagctctcacgaagtcaatccatgctccatagaacaagtacttgggcctggattgtacaacgcacaacatgatggtagctgtgcgaaatggtactaatcttgctcagcgaggttcttggcgcgatgacgttttagggtaccgtcatgagtcttccggctagcaggagaagctctcgaaggcttgtgtgccnttatagtgcatcagggcaggaactcttaatagatggacgtgcgcgccttgagactggggcggaggcattttacttgagaagggtagtggactctttatcacgagacgatctacaacccagtcgatacgctattgggctaacttgcgcaccttgccattaagcgccgggactcgctcagtaacgcgcatccagtggcgctgtgggctcacgacccctcacgataggggcaacatcgcagcagctttagggagctgcgcgatgtaggtcagattttgagtagagaattcttcgttagaagccaaacatgatctatgcgccgatttccatcaccaaggcccgagcatgggcccgaaagcctcttggggagccgtcatgactccnttccgtactctgtcgccagccccccaagggcccgggcactcgcgttcccagtgtcatcttatgcgctggtgtctgtcgcggcgtcctttgagtttgacgcggcggccaattagcagacacctttggtctccggcggaatatctttcggtccacaagttttggggtgggtgctttccgaaatggttctcaacactgaagggtcacgccggcaggggttcctagtagcgaataggactcctccgttggggagccccacgcgacgaaagtaaattgagaatcgttgccgtccgctccgttgtggtaaaattccttcgcccacgaatgcgaaatctccgggagggataaagagccgtggacatacagccggttatcacggaaaggaacaccgccaaaattaggtggccccatgaatcgaattctttgggtagatacgaggccggggtccgctggtggaattggaaagtttggtg

SEQ ID NO: 579334 - DNA, 1845 bp, Homo sapiens
  misc_feature (29)..(29): n is a, c, g, or t
aatgccaggctgtacggagcggggtgcgncgtgtgggcgtggcgggggctggggtctgcgggcgaaggtggtagcccattggaggtcccgggagcgaagtccagctgccgttaggcgctgggatagtcgcacgctggatgcatctacgtccgccgagcccctggggcgaagaggccgcgtccgccttcagttgtggccggtgcttcgccccctgacccttcgcccccaaagaccagctctaacgtgagcgcctcggccgccctgccccagcctcgtacacgccgccagcctcgcccagccggtgtccggagaccctcgggccgtgtccatttgtgggcaaagccagcggggcaggcttggccagagtgcaccactcggcgccgtcccaggcccgacgctctgggcgcgcccggaaccccaggttcgcggcccgtgtttccgaccggcggagggggctcagcggcccgatcccacggaagcgcgctcggaggggtgggacccggccggaccggagatggcgccgccagcgggcggggcggcggcggcggcctcggacttgggctccgccgcagtgctcttggctgtgcacgccgcggtgaggccgctgggcgccgggccagacgccgaggcacagctgcggaggctgcagctgagcgcggaccctgagaggcctgggcgcttccggctggagctgctgggcgcgggacctggggcggttaatttggagtggcccctggagtcagtttcctacaccatccgaggccccacccagcacgagctacagcctccaccaggagggcctggaaccctcagcctgcacttcctcaaccctcaggaagctcagcggtgggcagtcctagtccgaggtgccaccgtggaaggacagaatggcagcaagagcaactcaccaccagccttgggcccagaagcatgccctgtctccctgcccagtcccccggaagcctccacactcaagggccctccacctgaggcagatcttcctaggagccctggaaacttgacggagagagaagagctggcagggagcctggcccgggctattgcaggtggagacgagaagggggcagcccaagtggcagccgtcctggcccagcatcgtgtggccctgagtgttcagcttcaggaggcctgcttcccacctggccccatcaggctgcaggtcacacttgaagacgctgcctctgccgcatccgccgcgtcctctgcacacgttgccctgcaggtccacccccactgcactgttgcagctctccaggagcaggtgttctcagagctcggtttcccgccagccgtgcaacgctgggtcatcggacggtgcctgtgtgtgcctgagcgcagccttgcctcttacggggttcggcaggatggggaccctgctttcctctacttgctgtcagctcctcgagaagccccagccacaggacctagccctcagcacccccagaagatggacggggaacttggacgcttgtttcccccatcattggggctacccccaggcccccagccagctgcctccagcctgcccagtccactccagcccagctggtcctgtccttcctgcaccttcatcaatgccccagaccgccctggctgtgagatgtgtagcacccagaggccctgcacttgggacccccttgctgcagcttccacctagcagccaccagaggttacaaggggagagtggcccttccctcacaagtccgacatctccaggcccccactgaactccggggacctctactgactgcttgctgggacagtcaccagggttggggggaagggccacaaaatgaaaccattaaagacccttaagagccaaaa

SEQ ID NO: 579335 - DNA, 1916 bp, Homo sapiens
  misc_feature (29)..(29): n is a, c, g, or t
aatgccaggctgtacggagcggggtgcgncgtgtgggcgtggcgggggctggggtctgcgggcgaaggtggtagcccattggaggtcccgggagcgaagtccagctgccgttaggcgctgggatagtcgcacgctggatgcatctacgtccgccgagcccctggggcgaagaggccgcgtccgccttcagttgtggccggtgcttcgccccctgacccttcgcccccaaagaccagctctaacgtgagcgcctcggccgccctgccccagcctcgtacacgccgccagcctcgcccagccggtgtccggagaccctcgggccgtgtccatttgtgggcaaagccagcggggcaggcttggccagagtgcaccactcggcgccgtcccaggcccgacgctctgggcgcgcccggaaccccaggttcgcggcccgtgtttccgaccggcggagggggctcagcggcccgatcccacggaagcgcgctcggaggggtgggacccggccggaccggagatggcgccgccagcgggcggggcggcggcggcggcctcggacttgggctccgccgcagtgctcttggctgtgcacgccgcggtgaggccgctgggcgccgggccagacgccgaggcacagctgcggaggctgcagctgagcgcggaccctgagaggcctgggcgcttccggctggagctgctgggcgcgggacctggggcggttaatttggagtggcccctggagtcagtttcctacaccatccgaggccccacccagcacgagctacagcctccaccaggagggcctggaaccctcagcctgcacttcctcaaccctcaggaagctcagcggtgggcagtcctagtccgaggtgccaccgtggaaggacagaatggcagcaagagcaactcaccaccagccttgggcccagaagcatgccctgtctccctgcccagtcccccggaagcctccacactcaagggccctccacctgaggcagatcttcctaggagccctggaaacttgacggagagagaagagctggcagggagcctggcccgggctattgcaggtggagacgagaagggggcagcccaagtggcagccgtcctggcccagcatcgtgtggccctgagtgttcagcttcaggaggcctgcttcccacctggccccatcaggctgcaggtcacacttgaagacgctgcctctgccgcatccgccgcgtcctctgcacacgttgccctgcaggtccacccccactgcactgttgcagctctccaggagcaggtgttctcagagctcggtttcccgccagccgtgcaacgctgggtcatcggacggtgcctgtgtgtgcctgagcgcagccttgcctcttacggggttcggcaggatggggaccctgctttcctctacttgctgtcagctcctcgagaagccccaggtcagtcctcgatgggggtggggtgtgggaggtggggtgcagccccacagtcctgagctccaccccctcagccacaggacctagccctcagcacccccagaagatggacggggaacttggacgcttgtttcccccatcattggggctacccccaggcccccagccagctgcctccagcctgcccagtccactccagcccagctggtcctgtccttcctgcaccttcatcaatgccccagaccgccctggctgtgagatgtgtagcacccagaggccctgcacttgggacccccttgctgcagcttccacctagcagccaccagaggttacaaggggagagtggcccttccctcacaagtccgacatctccaggcccccactgaactccggggacctctactgactgcttgctgggacagtcaccagggttggggggaagggccacaaaatgaaaccattaaagacccttaagagccaaaa

SEQ ID NO: 579336 - DNA, 665 bp, Homo sapiens
cgcacgagggcgcaaacgctataataaggtagaagataggcggctggccagggccgtgagtcttgggagtcatgtggctgcatagggcactccaggaaccgtagatagcccgctggtgcgcacggacagcctccctactatgaccaacggacatgttcccggggccctatcctaggaccccagaagaacgggccgccgcagcaagaagtataatatgcgtagtggaagactacgaaccttacccggatgatggcatggggtataggcgactacccgaagctccctgaccgctcacagcaatgagagagatccatggtatagctagggaccagccgggcctgaggttgaactggggtgaaccgatagcactggcacctaagacatgtacaacaggaaccgtgtggatacatccccctaacctgtttcttggccatgtcatagtgtatgcagctcttcggtttcctggctttcatgatattcatgtgctagggtagggggacgtgtacccctagtctaccagcctgtgggaccaaaagcagtatccttacaataatctgtacctggaacgagggcggagatccctccaaagaaccagagcgggtaggtcactatgagatctgaggaggcttcgtagagctttgggtcctctaactaggactccctca

SEQ ID NO: 579337 - DNA, 119 bp, Homo sapiens
caaatgtcgcggagaagcgattgggagggtcgacagacaccagaggggtgtgcagacattaggacgaggagcgaggcgaggcgcgatgtaaggagaagaaacgggggcggctttgcagt

SEQ ID NO: 579338 - DNA, 1913 bp, Homo sapiens
  misc_feature (29)..(29): n is a, c, g, or t
  misc_feature (1886)..(1886): n is a, c, g, or t
  misc_feature (1902)..(1902): n is a, c, g, or t
  misc_feature (1907)..(1907): n is a, c, g, or t
aatgccaggctgtacggagcggggtgcgncgtgtgggcgtggcgggggctggggtctgcgggcgaaggtggtagcccattggaggtcccgggagcgaagtccagctgccgttaggcgctgggatagtcgcacgctggatgcatctacgtccgccgagcccctggggcgaagaggccgcgtccgccttcagttgtggccggtgcttcgccccctgacccttcgcccccaaagaccagctctaacgtgagcgcctcggccgccctgccccagcctcgtacacgccgccagcctcgcccagccggtgtccggagaccctcgggccgtgtccatttgtgggcaaagccagcggggcaggcttggccagagtgcaccactcggcgccgtcccaggcccgacgctctgggcgcgcccggaaccccaggttcgcggcccgtgtttccgaccggcggagggggctcagcggcccgatcccacggaagcgcgctcggaggggtgggacccggccggaccggagatggcgccgccagcgggcggggcggcggcggcggcctcggacttgggctccgccgcagtgctcttggctgtgcacgccgcggtgaggccgctgggcgccgggccagacgccgaggcacagctgcggaggctgcagctgagcgcggaccctgagaggcctgggcgcttccggctggagctgctgggcgcgggacctggggcggttaatttggagtggcccctggagtcagtttcctacaccatccgaggccccacccagcacgagctacagcctccaccaggagggcctggaaccctcagcctgcacttcctcaaccctcaggaagctcagcggtgggcagtcctagtccgaggtgccaccgtggaaggacagaatggcagcaagagcaactcaccaccagccttgggcccagaagcatgccctgtctccctgcccagtcccccggaagcctccacactcaagggccctccacctgaggcagatcttcctaggagccctggaaacttgacggagagagaagagctggcagggagcctggcccgggctattgcaggtggagacgagaagggggcagcccaagtggcagccgtcctggcccagcatcgtgtggccctgagtgttcagcttcaggaggcctgcttcccacctggccccatcaggctgcaggtcacacttgaagacgctgcctctgccgcatccgccgcgtcctctgcacacgttgccctgcaggtccacccccactgcactgttgcagctctccaggagcaggtgttctcagagctcggtttcccgccagccgtgcaacgctgggtcatcggacggtgcctgtgtgtgcctgagcgcagccttgcctcttacggggttcggcaggatggggaccctgctttcctctacttgctgtcagctcctcgagaagccccagccacaggacctagccctcagcacccccagaagatggacggggaacttggacgcttgtttcccccatcattggggctacccccaggcccccagccagctgcctccagcctgcccagtccactccagcccagctggtcctgtccttcctgcaccttcatcaatgccccagaccgccctggctgtgagatgtgtagcacccagaggccctgcacttgggacccccttgctgcagcttccacctagcagccaccagaggttacaaggggagagtggcccttccctcacaagtccgacatctccaggcccccactgaactccggggacctctactgactgcttgctgggacagtcaccagggttggggggaagggccacaaaatgaaaccattaaagacccttaagagccaaaaaaaaacaaaacaaaaccaaaaaaaaaaaaaaaaaaaaaaanaacaaacaaacaacanaaacnaacaaa

SEQ ID NO: 579339 - DNA, 151 bp, Homo sapiens
atgccatctgccagctggtggcaggctaaagagcctagccaattgtgggcgtcactaacacgcaaaaacagggggtgctgtagaccggctgacggacaccagcagatacacggtcctcccacaagcgagcgcttcgatgagcagcggcaat

SEQ ID NO: 579340 - DNA, 1990 bp, Homo sapiens
  misc_feature (29)..(29): n is a, c, g, or t
  misc_feature (1963)..(1963): n is a, c, g, or t
  misc_feature (1979)..(1979): n is a, c, g, or t
  misc_feature (1984)..(1984): n is a, c, g, or t
aatgccaggctgtacggagcggggtgcgncgtgtgggcgtggcgggggctggggtctgcgggcgaaggtggtagcccattggaggtcccgggagcgaagtccagctgccgttaggcgctgggatagtcgcacgctggatgcatctacgtccgccgagcccctggggcgaagaggccgcgtccgccttcagttgtggccggtgcttcgccccctgacccttcgcccccaaagaccagctctaacgtgagcgcctcggccgccctgccccagcctcgtacacgccgccagcctcgcccagccggtgtccggagaccctcgggccgtgtccatttgtgggcaaagccagcggggcaggcttggccagagtgcaccactcggcgccgtcccaggcccgacgctctgggcgcgcccggaaccccaggttcgcggcccgtgtttccgaccggcggagggggctcagcggcccgatcccacggaagcgcgctcggaggggtgggacccggccggaccggagatggcgccgccagcgggcggggcggcggcggcggcctcggacttgggctccgccgcagtgctcttggctgtgcacgccgcggtgaggccgctgggcgccgggccagacgccgaggcacagctgcggaggctgcagctgagcgcggaccctgagaggcctgggcgcttccggctggagctgctgggcgcgggacctggggcggttaatttggagtggcccctggagtcagtttcctacaccatccgaggccccacccagcacgagctacagcctccaccaggagggcctggaaccctcagcctgcacttcctcaaccctcaggaagctcagcggtgggcagtcctagtccgaggtgccaccgtggaaggacagaatggcagcaagagcaactcaccaccagccttgggcccagaagcatgccctgtctccctgcccagtcccccggaagcctccacactcaagggccctccacctgaggcagatcttcctaggagccctggaaacttgacggagagagaagagctggcagggagcctggcccgggctattgcaggtggagacgagaagggggcagcccaagtggcagccgtcctggcccagcatcgtgtggccctgagtgttcagcttcaggaggcctgcttcccacctggccccatcaggctgcaggtcacacttgaagacgctgcctctgccgcatccgccgcgtcctctgcacacgttgccctgcaggtccacccccactgcactgttgcagctctccaggagcaggtgttctcagagctcggtttcccgccagccgtgcaacgctgggtcatcggacggtgcctgtgtgtgcctgagcgcagccttgcctcttacggggttcggcaggatggggaccctgctttcctctacttgctgtcagctcctcgagaagccccagccacaggacctagccctcagcacccccagaagatggacggggaacttggacgcttgtttcccccatcattggggctacccccaggcccccagccagctgcctccagcctgcccagtccactccagcccagctggtcctgtccttcctgcaccttcatcaatgccccagaccgccctggctgtgagatgtgtagcacccagaggccctgcacttgggacccccttgctgcagcttccacctagcagccaccagaggtaccagaggtggcacaggcaggggaggtggggggcagggcagaatccacaggaatgacccagctcctcccccacaggttacaaggggagagtggcccttccctcacaagtccgacatctccaggcccccactgaactccggggacctctactgactgcttgctgggacagtcaccagggttggggggaagggccacaaaatgaaaccattaaagacccttaagagccaaaaaaaaacaaaacaaaaccaaaaaaaaaaaaaaaaaaaaaaanaacaaacaaacaacanaaacnaacaaa

SEQ ID NO: 579341 - DNA, 319 bp, Homo sapiens
ttgttggttgtagtgagctgagatcgcgtctccactccaggctgggcaacaaagcaagactccgtcttaaaaaaaaaaaaaaagaaaaaaaagaaaaagaaaatggtttcttccacccagccatactctcatagccactttacaaaagggcaacacaatcaaaattttatggccgtccagcagtaaaagctcagaaggagaggaaaaataggccacatacattttaagctaaataagtggaggtcagggtccatacggagcagcaatcccatattctcatacctcttcatacctcttcagtgtgaaccaagcaaccctg

SEQ ID NO: 579342 - DNA, 1922 bp, Homo sapiens
  misc_feature (29)..(29): n is a, c, g, or t
aatgccaggctgtacggagcggggtgcgncgtgtgggcgtggcgggggctggggtctgcgggcgaaggtggtagcccattggaggtcccgggagcgaagtccagctgccgttaggcgctgggatagtcgcacgctggatgcatctacgtccgccgagcccctggggcgaagaggccgcgtccgccttcagttgtggccggtgcttcgccccctgacccttcgcccccaaagaccagctctaacgtgagcgcctcggccgccctgccccagcctcgtacacgccgccagcctcgcccagccggtgtccggagaccctcgggccgtgtccatttgtgggcaaagccagcggggcaggcttggccagagtgcaccactcggcgccgtcccaggcccgacgctctgggcgcgcccggaaccccaggttcgcggcccgtgtttccgaccggcggagggggctcagcggcccgatcccacggaagcgcgctcggaggggtgggacccggccggaccggagatggcgccgccagcgggcggggcggcggcggcggcctcggacttgggctccgccgcagtgctcttggctgtgcacgccgcggtgaggccgctgggcgccgggccagacgccgaggcacagctgcggaggctgcagctgagcgcggaccctgagaggcctgggcgcttccggctggagctgctgggcgcgggacctggggcggttaatttggagtggcccctggagtcagtttcctacaccatccgaggccccacccagcacgagctacagcctccaccaggagggcctggaaccctcagcctgcacttcctcaaccctcaggaagctcagcggtgggcagtcctagtccgaggtgccaccgtggaaggacagaatggcagcaagagcaactcaccaccagccttgggcccagaagcatgccctgtctccctgcccagtcccccggaagcctccacactcaagggccctccacctgaggcagatcttcctaggagccctggaaacttgacggagagagaagagctggcagggagcctggcccgggctattgcaggtggagacgagaagggggcagcccaagtggcagccgtcctggcccagcatcgtgtggccctgagtgttcagcttcaggaggcctgcttcccacctggccccatcaggctgcaggtcacacttgaagacgctgcctctgccgcatccgccgcgtcctctgcacacgttgccctgcaggtccacccccactgcactgttgcagctctccaggagcaggtgttctcagagctcggtttcccgccagccgtgcaacgctgggtcatcggacggtgcctgtgtgtgcctgagcgcagccttgcctcttacggggttcggcaggatggggaccctgctttcctctacttgctgtcagctcctcgagaagccccagccacaggacctagccctcagcacccccagaagatggacggggaacttggacgcttgtttcccccatcattggggctacccccaggcccccagccagctgcctccagcctgcccagtccactccagcccagctggtcctgtccttcctgcaccttcatcaatgccccagaccgccctggctgtgagatgtgtagcacccagaggccctgcacttgggacccccttgctgcagcttccacctagcagccaccagaggtaccagaggtggcacaggcaggggaggtggggggcagggcagaatccacaggaatgacccagctcctcccccacaggttacaaggggagagtggcccttccctcacaagtccgacatctccaggcccccactgaactccggggacctctactgactgcttgctgggacagtcaccagggttggggggaagggccacaaaatgaaaccattaaagacccttaagagccaaaa

SEQ ID NO: 579343 - DNA, 915 bp, Homo sapiens
gtggtcttcgcgttggccgcggggcccccggtagccgggtcctctttgttcctcccccaagtgggggtttttccctcgttggggaacgacttgttcccaggggccccttacccggggggccccccccccggttgtagtgggccacgagtcccgcccctggcacttggggaaccccttcggaaggctgcttacaagggtcccgcgatacctgtttcggacgcggtcatggccgttcttcggaccaacgcccgtcctgttgccgtgtgggcgtcttgtaactctccctccaaggcccaatgggttgcctctagtacacgccctgatctcaaaagacgaggggccctcccccccgtggcacaggacaaatgcgtgaaaacagggttctgctcatccagcagggcaatactcggcggcacggtccccgcggatgatggaaactacccaggccacgccctacagggcggcctacaccaagaacaggacttcaagtcaccaccaagcgtgggtcagagaaatcatcggtacaacgcctgcccccccgcctgggagcgcgcccccacacaatagggtgcgcgccaccacacagggcgtccccgcgtggcaccaggtttgttgacacccggtgtccggtgattaccccaccctccggggctctcgattcgccctgggggggggtgcgttcttacgcattaccccccctcccgcctcctttttgttttgttactataggctcttgtcaggggcccattactggcttcttgggttttctcggagatgcccaaaagagacagaaaccttgatcccacggacaaggagtagtcggtgatctggtaggagcggggagaacaaggttatgctgctcttgtgcgtgtgaaaaaacaagggaaacaaagaattgccccttaccacaaaaca

SEQ ID NO: 579344 - DNA, 151 bp, Homo sapiens
tagcaagcaaggattacacacacttattttataaaccagcacacaaaggtttaaaacagttttgaaaataagtttgctgtcttgagtcaagggaatccgctcctgcagcaggaggttcaagttctttcttcaaagagtcatcagaataact

SEQ ID NO: 579345 - DNA, 1732 bp, Homo sapiens
  misc_feature (29)..(29): n is a, c, g, or t
aatgccaggctgtacggagcggggtgcgncgtgtgggcgtggcgggggctggggtctgcgggcgaaggtggtagcccattggaggtcccgggagcgaagtccagctgccgttaggcgctgggatagtcgcacgctggatgcatctacgtccgccgagcccctggggcgaagaggccgcgtccgccttcagttgtggccggtgcttcgccccctgacccttcgcccccaaagaccagctctaacgtgagcgcctcggccgccctgccccagcctcgtacacgccgccagcctcgcccagccggtgtccggagaccctcgggccgtgtccatttgtgggcaaagccagcggggcaggcttggccagagtgcaccactcggcgccgtcccaggcccgacgctctgggcgcgcccggaaccccaggttcgcggcccgtgtttccgaccggcggagggggctcagcggcccgatcccacggaagcgcgctcggaggggtgggacccggccggaccggagatggcgccgccagcgggcggggcggcggcggcggcctcggacttgggctccgccgcagtgctcttggctgtgcacgccgcggtgaggccgctgggcgccgggccagacgccgaggcacagctgcggaggctgcagctgagcgcggaccctgagaggcctgggcgcttccggctggagctgctgggcgcgggacctggggcggttaatttggagtggcccctggagtcagtttcctacaccatccgaggccccacccagcacgagctacagcctccaccaggagggcctggaaccctcagcctgcacttcctcaaccctcaggaagctcagcggtgggcagtcctagtccgaggtgccaccgtggaaggacagaatggcagcaagagcaactcaccaccagccttgggcccagaagcatgccctgtctccctgcccagtcccccggaagcctccacactcaagggccctccacctgaggcagatcttcctaggagccctggaaacttgacggagagagaagagctggcagggagcctggcccgggctattgcaggtggagacgagaagggggcagcccaagtggcagccgtcctggcccagcatcgtgtggccctgagtgttcagcttcaggaggcctgcttcccacctggccccatcaggctgcaggtcacacttgaagacgctgcctctgccgcatccgccgcgtcctctgcacacgttgccctgcaggtccacccccactgcactgttgcagctctccaggagcaggtgttctcagagctcggtttcccgccagccgtgcaacgctgggtcatcggacggtgcctgtgtgtgcctgagcgcagccttgcctcttacggggttcggcaggatggggaccctgctttcctctacttgctgtcagctcctcgagaagccccagccacaggacctagccctcagcacccccagaagatggacggggaacttggacgcttgtttcccccatcattggggctacccccaggcccccagccagctgcctccagcctgcccagtccactccagcccagctggtcctgtccttcctgcaccttcatcaatgccccagaccgccctggctgtgagatgtgtagcacccagaggccctgcacttgggacccccttgctgcagcttccacctagcagccaccagaagggccacaaaatgaaaccattaaagacccttaagagccaaaa

SEQ ID NO: 579346 - DNA, 980 bp, Homo sapiens
gggcggggggataagagaccacacagtcgtctggaatccgctgacatcatacatagtctaccccttgcttgaaggatcccgatgaaagagtctcacaatgtcaataagcgaatggcatacgcatcttgccgtaatcgcactagaagcctgatcctcacattatccgctgcagtagatcttacctgcatggcagatcaaaccgaatgagcgccctcggtaggtaataccatgtctccatctcgtccaatcacaggacctcgctgaacatgtgtgtcagcggggccttcattccctatgatcgcccgcggacgtacgtcgactggacatatgtgctgcctagaatcttcactctgggggaggggtcacctctacagatggggtacatcatattcctctactacgttctatagggacctttgccaacaagtactactctgcaccgccacgtggggtcacactattttgatcgcatctgtactagtcgaagacactggccctagacctacgacgcatgtaactcgcacccacagggaatataattactaaactgggggatgaaactgctctgatgtcatagatgatgccacgaaagcgtccctgtagcgaagagtaatcagctacgtcccctagctatgaaggggactgcgcatgacatatatcgagaggcatatacatgccctctaagcatattgtagcagtagcacagatgaagggtataggtgcgtgcagccaggatttaactagtatgggaactctcaattcacttcgagaaaatatcctccagtgtgtgtttaagctgtttccccaaggttcttcggaaagccttaaacacgaacctcaatatccgtggttcctcgtctagagagagaacagggtctctgctaaccacggtgtgggggagctcttccgtttcacacatccggtttggcaacatcaggggacaggccgcctaaaaaggatcggccttgacacacaggccg

SEQ ID NO: 579347 - DNA, 1800 bp, Homo sapiens
  misc_feature (29)..(29): n is a, c, g, or t
  misc_feature (1773)..(1773): n is a, c, g, or t
  misc_feature (1789)..(1789): n is a, c, g, or t
  misc_feature (1794)..(1794): n is a, c, g, or t
aatgccaggctgtacggagcggggtgcgncgtgtgggcgtggcgggggctggggtctgcgggcgaaggtggtagcccattggaggtcccgggagcgaagtccagctgccgttaggcgctgggatagtcgcacgctggatgcatctacgtccgccgagcccctggggcgaagaggccgcgtccgccttcagttgtggccggtgcttcgccccctgacccttcgcccccaaagaccagctctaacgtgagcgcctcggccgccctgccccagcctcgtacacgccgccagcctcgcccagccggtgtccggagaccctcgggccgtgtccatttgtgggcaaagccagcggggcaggcttggccagagtgcaccactcggcgccgtcccaggcccgacgctctgggcgcgcccggaaccccaggttcgcggcccgtgtttccgaccggcggagggggctcagcggcccgatcccacggaagcgcgctcggaggggtgggacccggccggaccggagatggcgccgccagcgggcggggcggcggcggcggcctcggacttgggctccgccgcagtgctcttggctgtgcacgccgcggtgaggccgctgggcgccgggccagacgccgaggcacagctgcggaggctgcagctgagcgcggaccctgagaggcctgggcgcttccggctggagctgctgggcgcgggacctggggcggttaatttggagtggcccctggagtcagtttcctacaccatccgaggccccacccagcacgagctacagcctccaccaggagggcctggaaccctcagcctgcacttcctcaaccctcaggaagctcagcggtgggcagtcctagtccgaggtgccaccgtggaaggacagaatggcagcaagagcaactcaccaccagccttgggcccagaagcatgccctgtctccctgcccagtcccccggaagcctccacactcaagggccctccacctgaggcagatcttcctaggagccctggaaacttgacggagagagaagagctggcagggagcctggcccgggctattgcaggtggagacgagaagggggcagcccaagtggcagccgtcctggcccagcatcgtgtggccctgagtgttcagcttcaggaggcctgcttcccacctggccccatcaggctgcaggtcacacttgaagacgctgcctctgccgcatccgccgcgtcctctgcacacgttgccctgcaggtccacccccactgcactgttgcagctctccaggagcaggtgttctcagagctcggtttcccgccagccgtgcaacgctgggtcatcggacggtgcctgtgtgtgcctgagcgcagccttgcctcttacggggttcggcaggatggggaccctgctttcctctacttgctgtcagctcctcgagaagccccagccacaggacctagccctcagcacccccagaagatggacggggaacttggacgcttgtttcccccatcattggggctacccccaggcccccagccagctgcctccagcctgcccagtccactccagcccagctggtcctgtccttcctgcaccttcatcaatgccccagaccgccctggctgtgagatgtgtagcacccagaggccctgcacttgggacccccttgctgcagcttccacctagcagccaccagaagggccacaaaatgaaaccattaaagacccttaagagccaaaaaaaaacaaaacaaaaccaaaaaaaaaaaaaaaaaaaaaaanaacaaacaaacaacanaaacnaacaaa

SEQ ID NO: 579348 - DNA, 1877 bp, Homo sapiens
  misc_feature (29)..(29): n is a, c, g, or t
  misc_feature (1850)..(1850): n is a, c, g, or t
  misc_feature (1866)..(1866): n is a, c, g, or t
  misc_feature (1871)..(1871): n is a, c, g, or t
aatgccaggctgtacggagcggggtgcgncgtgtgggcgtggcgggggctggggtctgcgggcgaaggtggtagcccattggaggtcccgggagcgaagtccagctgccgttaggcgctgggatagtcgcacgctggatgcatctacgtccgccgagcccctggggcgaagaggccgcgtccgccttcagttgtggccggtgcttcgccccctgacccttcgcccccaaagaccagctctaacgtgagcgcctcggccgccctgccccagcctcgtacacgccgccagcctcgcccagccggtgtccggagaccctcgggccgtgtccatttgtgggcaaagccagcggggcaggcttggccagagtgcaccactcggcgccgtcccaggcccgacgctctgggcgcgcccggaaccccaggttcgcggcccgtgtttccgaccggcggagggggctcagcggcccgatcccacggaagcgcgctcggaggggtgggacccggccggaccggagatggcgccgccagcgggcggggcggcggcggcggcctcggacttgggctccgccgcagtgctcttggctgtgcacgccgcggtgaggccgctgggcgccgggccagacgccgaggcacagctgcggaggctgcagctgagcgcggaccctgagaggcctgggcgcttccggctggagctgctgggcgcgggacctggggcggttaatttggagtggcccctggagtcagtttcctacaccatccgaggccccacccagcacgagctacagcctccaccaggagggcctggaaccctcagcctgcacttcctcaaccctcaggaagctcagcggtgggcagtcctagtccgaggtgccaccgtggaaggacagaatggcagcaagagcaactcaccaccagccttgggcccagaagcatgccctgtctccctgcccagtcccccggaagcctccacactcaagggccctccacctgaggcagatcttcctaggagccctggaaacttgacggagagagaagagctggcagggagcctggcccgggctattgcaggtggagacgagaagggggcagcccaagtggcagccgtcctggcccagcatcgtgtggccctgagtgttcagcttcaggaggcctgcttcccacctggccccatcaggctgcaggtcacacttgaagacgctgcctctgccgcatccgccgcgtcctctgcacacgttgccctgcaggtccacccccactgcactgttgcagctctccaggagcaggtgttctcagagctcggtttcccgccagccgtgcaacgctgggtcatcggacggtgcctgtgtgtgcctgagcgcagccttgcctcttacggggttcggcaggatggggaccctgctttcctctacttgctgtcagctcctcgagaagccccagccacaggacctagccctcagcacccccagaagatggacggggaacttggacgcttgtttcccccatcattggggctacccccaggcccccagccagctgcctccagcctgcccagtccactccagcccagctggtcctgtccttcctgcaccttcatcaatgccccagaccgccctggctgtgagatgtgtagcacccagaggccctgcacttgggacccccttgctgcagcttccacctagcagccaccagaggtaccagaggtggcacaggcaggggaggtggggggcagggcagaatccacaggaatgacccagctcctcccccacaagggccacaaaatgaaaccattaaagacccttaagagccaaaaaaaaacaaaacaaaaccaaaaaaaaaaaaaaaaaaaaaaanaacaaacaaacaacanaaacnaacaaa

SEQ ID NO: 579349 - DNA, 210 bp, Homo sapiens
cggtgacgtagattcctctccgcagcatatggaggttcccaggctagggatctaatcggagctgtacttgccaagcctatgccagagccacagcaacatcggatctgagccgcgtctgcaacctacaccacagctcatggcaacgccggatccttaacccactgagcaaggccagggatcgaacccacaacctcatgggtcctagttaga

SEQ ID NO: 579350 - DNA, 518 bp, Homo sapiens
  misc_feature (357)..(357): n is a, c, g, or t
  misc_feature (365)..(365): n is a, c, g, or t
  misc_feature (424)..(424): n is a, c, g, or t
cacaacgctgactcttcccaacctgcactcgcgtgggaacgagaagacactcattggaggagtcggccgagcaggcacagcggtgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaggcacagcggtgccgatgagatggctgcttctcagagctgtctgtccaacctgcactcgacgtggaacgagaagacactcgtggaggcgtcggtagagcaggcagaccaaggagttcatcttctcagngctgctgnccaacctgtactcgcgtgggaacgagaagacactcgtggaggcgtcggcagagcaggcngaccaaggagttcatcttctcagagctgctgtccaacctgcactcgcgtggaacgagaagacactctggagcgtcgcagagcatgcgacagtag

SEQ ID NO: 579351 - DNA, 976 bp, Homo sapiens
catatcagagcacttgatcgcgctacgagaagtaccccatgagggtccaactgtgtgcacttgctggggtcagatccagatgaccgaggaggtcggggatatatctccgtcgaaggggcctggtgtgacagccttatgggctaagatatttgctgagagatgtagatcatgcacgatggccatcacgtggtgtgtctagaagctcgagccagctagtgactggagggctatgactgggtggccatgagccgggaatgtgatcatccggatgtcctcagtgcgcgcaactacttcggttgtcatcgtcgtggtaaccaagactgtctacttctatgtggaacactcggagagataagcttctataacagtgacttccttgactttggcagtgttgacccgcaggcgctctgcgtaggacggctgaggccaccactgttcacctgcggtacggttaacgcgccacgaccttaacgtttcgctgtaggtgaacacttgtcgcaacaactcagtcaggaagtatttgccagtgagaaccataatcattcgagcctacgctggaaacggagggggaagacggcatacaagtaaactcacatcgcgtgtccacgacactgacgccggtcacaacctcatttcaacacaaaatccgggatcatacagcacttgggaccccaaacacggcatgcggcccacgcatagcaaaccagcgacaggcgctccgggacagtcagacagcccggggacccacgctcaagacacgcaacccagccagctctggccctggccgcaagccgaccacgctcgggccaagagacacctagcccgccggcaacaggcgaacagcggcgagggtacaccagcccacctcgggcagcagaccggccgacgaaccgagacaggcaccacaccagcgcagaactacgacaagccccaccacgaacaccgccccgccgcccgccgcaggcacgcccccacg

SEQ ID NO: 579352 - DNA, 383 bp, Homo sapiens
tggtcttccccatctgtggcagctaaaacaaaaatcactcaaaatattcaggtttacttgtaagctctctctcatagggagctgccatacctcacagtccaaagtgtttcctatagatcagttaacattatcacgtgacatgtaatggcaatttaattatgcagcaaaaatgcattcagagaaagaaaaataaccttacaggtgtctgtatcaccttggtatacacaatggcttaagtaactcgtgctttaaaacattggtcactgggcataaaagtgcttatgctctgtataggaatgtcacagtgcaagatgctgtttagcccagcgcaacaaaggttatttaacaattaattgttggtgacaacaaaacaaaacaacaaa

SEQ ID NO: 579353 - DNA, 197 bp, Homo sapiens
tttttaaaaggggggggggttttttttttgaaatttcccaggggcttaaaaattgttttaaaaaaatttttaaatttggtccaattttttcattccccctttcattaaaaaggtttgcaaaaaaaatttaattttgggccccttaaaaaattttttggtggggtttacctgttttaaaaaaaacttttttagtttta

SEQ ID NO: 579354 - DNA, 346 bp, Homo sapiens
cgaacatgttaaccaaggctataagaatctgaaattagacccattcagaagaggtaaggaaatcgtatagttaacagatggacaagacataaccttccttaccttcactatacctcaatccatcactacacacatctactgcttaacaaaacttcctccctcctttactttctccctccctcctcctttctccttcccctctctattcctccctacccccgtctattccttcctccctttccttcccttcctccctttcctctcttcttcttgctctgttgcccagcatgcagtgcagtgacctgatcatggttccatgtaacctcgaactcttgagctacacagg

SEQ ID NO: 579355 - DNA, 249 bp, Homo sapiens
tgacgccttagctggcaagtaaaccccagcgcttagttcacattgctgattttgtgcactacttatcttcgccagctccggcttaggcaaccgctagcctgatatgacctgcaggagcagcatgagcttgagcccgactcgaaagccctcataaatgttctcgagctgtgcgcctgacttccgcagatgagagttgcaccatgccgagaagggctagcgctgctgcttactacaggccgggtgcagcag

SEQ ID NO: 579356 - DNA, 823 bp, Homo sapiens
ggagaataacgtgtgcttccaactgccacctgtgacggggtaggcgtgtcacaaagctgatgggcgaggaggccctgtgcgtgggtggcgacaagtcagacccgataccttaataaccccgcggacgaggacctatgcctatgctctgcggattctgccctaacgacctggctgcgtgatccagcctgtgccataaacccgcggagaaggctgccatggcaccgtgcatcatctcctcgcccattgctcagcgccgggcctgaggacctggtagccgccgctcaaatcggaggtgcctccgaattagtaaatcagaatacgtaagcaggaacgttcactcatcaggggtacgctctatggcacgtagagggcgcagagcaaaccatgtcacgccatccaatgaccaccagctggtcaggtcaacaacccctctggttaaaactcaagcaaataaagccgcttcctgtcattaagcatctcagaggaagcggccctccctcgatgggctcttagacccagagaagcccgcgctatcttggacccaccaagtcgaggcccagccttcctgctgccatcatactctgcttctccccagaggaacttagggatttcagccctggcttttaaagaaaaacgaaataccgataagccacaaggaccaatgtaggtattctccccggcccatcttcaaggtctcagcgactgaggctggaagatgatatggattggaacacgatgaaatctttgcttaatctttttaaaaagctgctgtggttttgctggtacactaagaattgtgatttgcattgtacggtttaggacc

SEQ ID NO: 579357 - DNA, 194 bp, Homo sapiens
aaaattgggggtttgaccccttttttttttatttacttttggtaaaaaggcttttaaaaaaaaaaaaaaaaaaaaaaaaaggggtggggggccaaaagccaacccattttccctgcctcaaaaggttttgggaagttatccccccccgtttgttgggtttgttttccactgttaaaaaaacctttgacccggta

SEQ ID NO: 579358 - DNA, 293 bp, Homo sapiens
acgaggatccccgacacgaggctgcgggcgagccgagctggctggagtggcgacgaccttcgggaaatgctgggctgcggggggtttgggccacccatcccggtagagcccggtcctcgacgaccatctgttccctagcccatggcggacaccatgctggacggctggggcagaccgaagcagaggctggaggaggcgtgcacgggcgtcggagtgatcaggatgcgtacggagtgcttgaagggcgggaggcggcccacaggtgccatgtgtccagccacggcagttgcact

SEQ ID NO: 579359 - DNA, 160 bp, Homo sapiens
ccccccccccccccccccccccccctttttttttttggggggagaagggggggccccccccccccaatattgtttttttgcggggggttttttcggggttttttggggggggggggcccccccttagggttttttttttttttattttgggcccccttta

SEQ ID NO: 579360 - DNA, 191 bp, Homo sapiens
  misc_feature (174)..(174): n is a, c, g, or t
tgctgacgccattaaaccgcagtaatatggcatgtgcagcaacatggatggacctagaaattatcatgctaagtgaagtcagtcagacagtgagacaccaatatcatatgcactcacttatatgtggaatctaaaaaaaggacacaatgaacttctttgcagaacagatactgnctccgtgggctaatttt

SEQ ID NO: 579361 - DNA, 289 bp, Homo sapiens
  misc_feature (36)..(36): n is a, c, g, or t
agagtgttggtgcattgcgccggtgtgctccccgtnagaccgggccccttcatatcatggtgtggccgaattgtcctgtgttcctttgcaatgtaacccaaagggtatcattctggtttgtgggtacagacccttcaaaaaatcacaccacttacctgctgtctgaggtgcaatcagtccatgaagaatgggacaaggaaccgggatcaactaatgccttcttgtctaaatgacacaaactctcggaatttgttaacgaatctcttgccacacgttgcaccacaccgat

SEQ ID NO: 579362 - DNA, 937 bp, Homo sapiens
  misc_feature (937)..(937): n is a, c, g, or t
gaaggtccaggtgtagcctgaagcttaaacaatcaggaggaccatctttataagagaatacaatgattaggcagagtcttgtgaaggggctcgagtaagctaggggtcttgaacttaattaaacatcagcttcccagtaaatctgctcctggggtgtgtaaattggaattactcttttggacggcaatgtgataacacctgggtaaaatgacaatgtgcttatcccctgtgacccaacaagtcacatcctccaagtgtctctgggagacatttccaacaggtaactacagaggcaaatatgagaatgttcttagcaatgctgtctgcaatagctagaggcagcaaattggaactatccaaagtgtctattaacagaagactgggtaaagcaaagtcaacatgttataaatctcagaacatcaatgttgcctggaaaagcatgtggcagaaggatacgtactgtaatgctggcattttcataaagtgcgaaaacatgtgaaacaatgccatgtgtagttcatatgtgtgcagtaaagtctaacctgtgcttggaagtgaacatcacattcagtctacaggtggcctggaggacggcgggagaggagagaatcagcatacggagggtgtctaaggaggcttagatggccaatctggaaagctttcaattttcgttagtacgtaacaggcaacccaggcaagtattagcaatggcaacggtgggcaaaagtatgtatgtgcccgcaaagaaggatagctcctcgggggttgaacgttcacggggcatatgtggagaatcattcacacacctttagcggcagcggggctagcatcggggtggcccccaatacattcgttttccccaaacgttatacgcctgtgccacggggttgcagctacaaaccacagcgcacgaaagaatagtcggattgttggtgcn

SEQ ID NO: 579363 - DNA, 110 bp, Homo sapiens
cattttctattaggagaaacgaaacaaacaaaataaaccactccagaaaaagggtccagagaagagcactgtagaaagtccaccagctgagcgccggcggatcacgaaga

SEQ ID NO: 579364 - DNA, 2119 bp, Homo sapiens
gaatggtgacaggtgacaacatcaacacagcccgggccattgccaccaaatgtggcattctgacacctggggatgacttcctgtgcttggaaggcaaagaattcaaccggctcatccgcaacgagaaaggcgaggtagagcaagaaaagctggacaagatctggcctaagcttcgggtcctggcgcgatcttctcccactgacaagcacaccctggtgaaaggcataattgacagcactgttggggaacaccggcaggtcgtggctgtcactggtgatggcacaaatgacgggcctgctctgaagaaagcggatgttggttttgccatgggcatcgcaggcacagatgtagcaaaggaggcttcagacatcatcctaacagatgacaacttcaccagcattgtgaaggcagtgatgtggggacgaaatgtctatgacagcatctccaagttcctgcagttccagctcactgtcaatgtggtggccgtgattgtagccttcactggagcctgtatcactcaggattccccattgaaagctgtgcagatgttgtgggttaatctgatcatggacacttttgcttcattggccctggccacagagccccctacggaatctctgttgaagcggcgcccctatggccgaaataagcctctgatctcacgcactatgatgaagaacatcttgggccatgcattctatcagctcatagtcatctttatccttgtctttgcgggtgagaaattctttgatattgatagtgggaggaaggcacctctacattcaccacccagccagcactataccattgtttttaacaccttcgtgctgatgcagctcttcaatgaaatcaactcccgaaagatccatggagagaagaacgtcttttcaggcatctaccgcaacattatcttctgctctgtagtcttgggcacattcatctgccagattttcatcgtggaatttgggggtaaacccttcagttgtacaagcctcagcctgtctcagtggctgtggtgtctcttcattgggattggagaacttctgtggggccagttcatctccgcaatacctacccgatccctgaagttcctgaaggaggctgggcatggcaccaccaaagaggagatcaccaaggatgccgagggactggatgagattgaccatgctgagatggagctgcgccgaggccagatcctctggttccggggcctgaaccgtatccagactcagatcgacgtaattaacacattccagacgggagcctcttttaagggagtcctaaggcaacaagaccgagtgtgctctgctaggctttgtcacagatctgaagcaggattatcaggctgtgcgtaatgaagtgcccgaggagaagctctacaaggtgtacacctttaactcagtgcgcaagtcaatgagcaccgtcatcaggaatcccaacggtggcttccgtatgtacagcaagggcgcctctgagatcatcttgcgcaagtgtaatcgaatcctggaccggaaaggggaagcagtgccattcaagaataaagccagagatgagctcccataactgaattggcctttggtccatgttttctccccatatgtatatatgccatatgtgaatatgccatatatatgtgccaacaaatctatctacgttgttcttttcaaattagcacgcagataggaattttgagtttcttcttcttttagtaactagtataacaagcactggtatttttgtacaaaaaagaaaaacaaaagattgactattgtggtctgcatgacataaacaaacaaatggtgatatcaaagcaacgtataccccagtccagtgtgtgttgccataatttgcaattcagcttaacagtgcacccaatctatatttgcattttgatattatttaagctctatgtacaaggttttgcatgtatttatatggttcttagggaaaaaaaatgctataaactgcaaatctgaaattcaaatgtgttgttccactgagaccagaagaagaagaggagttttaaaagggataatttgttggagccaataaagctttttgctgatgaacagaaaccaatactgctgtgcactgagaataaaaactcatgcccccttgt

SEQ ID NO: 579365 - DNA, 141 bp, Homo sapiens
tgatactcttaaacgggacccctaatgggggccccccgtttttcaacttggtcggtaaagcccgttaaccgtctcgggtgaggggtggaagccaagggggtggccccttgggctctgccggttcacgtcccccttccccct

SEQ ID NO: 579366 - DNA, 749 bp, Homo sapiens
atcccccgaatggagaccgaggcgatgttctgggcggaagcgcggcgatctcgcgggtccggcgacacccgagccgtgaggcggacgcgaggtcctgctacaggagcggtggatggggcatcctgctagattcgggtctgtgggcagaatggagtttaggactcagtggactcggactcaatgagtagaagcccctgtcaagatggagaagaatgcggagataagagatgaaagcctctcttggggccagaaaccgtgggtgaccactgggactgaggtcttgctttatgtgggacaagtctgtaggatgcgctgatcagataaggctgcagcttttagccagaatagaaacccacttctgatcaaggaggagcctcgtgcgatgttgaatgtatgccaattttctgaccatatatcactgaggaccatgaagctcgtcagcacctggcttcttgtgcttggtgggtttagctctgtgggaaacggcacctgggtgacaaggctggggacgagagcttgggaaagaggccccgttgccccagactgctcccacctgactttcgacggtggaatttctcttcaactgtggtggagtacgaatatatagtggcttatcaggggatacttcacaggccaaagctagaaacctcaatttatgtcaagtgctctgaaaagcagtgacgtggacaaactggagaataatacctcggaaaacccatccagtgagtaccctatggaattggggggga

SEQ ID NO: 579367 - DNA, 365 bp, Homo sapiens
ggcataataatagtccatgggcatgcagatgcatctacgagagaaacagcagtagtggttatcaaatcttttaacgagttaggggcagaggctttctaattatttttgagacagagtctcattctgtcacctagcttgtgcagtggcatgatctcggcttactgcaacttctgcctcccagactcaagcaatcctcccacctcagcctccagcgtagctgggaccgcaaacgtcaacaccacacccagctaatttttcgcatattaggtacagacggggttttgccatgtggcccaggctggtgtcactgagctaggcaatccacccaccttggtttcccaaagtgctaggatacagtagggaga

SEQ ID NO: 579368 - DNA, 1178 bp, Homo sapiens
atctaaccaaaaagtcttggttttatctgtaatccattgaaaagagttgttcttagtactccagggttgcattgattgctacaacagtcactaatattggctataacacattatcaaagtggttctggtgctaggtcaagaacattttcggtatgtatcagtgagttcagtctagtggatagaagtcagttgttgtaaattcacggtggctttgatgtttcacgtgtaggatggatctagagagactcgtaccacattgtgcaaattaccgtcgtaccaccctaactgttctatacggagaagagcacaaagtacgagtcaagctgtgggctacgattaaccgagcattcaaactagttctcgtgtggctagcgtgtctacgcgaggacacatttgtgtctgcgctcgtgcgtagttagcgcaatcgtgctacgtagccagagatacatctccaacacatctagtctcaatcatccgctagccctataatcattgcgcacagggttccctaagtaagcgcggtaccgtgttgtcaaccagtcggtcttctgctatatatcctagatctgagacgagacgagagacgcgaaataaacagaggagcacaactcgcacaattacatacacataagaaaagaccgagagaaaaaagaaatgtggacccaggagaggtcccacaaaaaaagcatacgttgaaacacacgtgcagagacagaggcgcacacgaagaatatcgagagaacagcaccatcaatgaagcacaatagagcactacagtaagctacatcaagggcacagaaccaaccatagtgacacaccagaggggcgcccaagatgcaccccaaagctcacacaaccaacagccgacggcgagaaattaacaattagagaaaaaacctacagaacgacagaacaactctaacacacaggcgagcacaacagagacatcacaacacaccggcagagaagactaacaaataaaaacaaatggaaaaagcgaccaaggcggcacgcaacaaccagacaccaacacagcaagcgcgacgccaacaagagacgcaatgtgaaccccctggctgacggaaacaaaacgcgacaacacacagccagacgaacaaagaaacacagaaagcggcaagaacagccaccgacggaggcacatacgaaccccccacgac

SEQ ID NO: 579369 - DNA, 152 bp, Homo sapiens
cccaggctggaatgcagtgacacaatcagcgctcaccgtagcctcaagccatcctcccacctcagcccctcaagtagctgggactacaggcacatgccagcatgatagggttttaccatgttgcccaggctggtctcaaactcctggactca

SEQ ID NO: 579370 - DNA, 148 bp, Homo sapiens
  misc_feature (27)..(27): n is a, c, g, or t
  misc_feature (29)..(29): n is a, c, g, or t
  misc_feature (77)..(77): n is a, c, g, or t
  misc_feature (112)..(112): n is a, c, g, or t
ggtatgggttcgcgtactcaagggtanantccgcgtgggggcgggctgaaacccttgtgttcccacgttgcgaagcngagtagctggcggggctgggcgcgccatcacctgntgcggatgtttaggggttctgccgggtttcgcgggc

SEQ ID NO: 579371 - DNA, 715 bp, Homo sapiens
tgcagtggctcatgcctagcaccttgggaggccaaggcaggcggatcacctgaggtcaggagttcaagaccagcctggccaatatagtgaaaccccatctctactaaaaatacaaaaattagccgggcatggtggcacgagcctgtaacaccagccacttgggaggctgcggtcggagaaccgcctgaaccccagaggtggaggttgcagtgagccgagatcgcgccactgcactccagcctgggtgacagagcaagactctgtctcaaaaaaaaaaggaacattcatcaatcatgcagaatatccaaaaaaaaaaaaaaaaaaaaaaaaaaaaactcttgttgtgcggccgcccttgggcccctggagaaaggcttttataaaaccacttcgcgtgtggggcgcccggggccccccatgtaagggtataggtgtaaccggtgggccactaggcgcgtgtttcaccaagagaggagaacccgtgggcccatagaacaatgggggcggcggggattcttccaacacatattataaaaagacccgcgggggggggacaccgcgagaggcgtgttttgggacgaaattccccggaggggggggggcttacgggggggcgcgatcacccggggggctcttttttcacagggggaggtgtctccagagaggggaggccctggtatttaaattttcgcccgggaggtcggtggggggggga

SEQ ID NO: 579372 - DNA, 843 bp, Homo sapiens
  misc_feature (843)..(843): n is a, c, g, or t
taaacaaccccggtcctggggtgggggggggtctaaaactaagtggagatgatatcattaaggggggaaggcgcttggggaagtaggccttatttctcatgggtccttccgaacagggaggaattggaagtaaatagaaaccgaccgtggattactccgggtctggaactcagatcacgtaggatctttactctgttggaacaaacggaacctttaatagcggttgcaccatggggatgtcctgatccaacatcgaggtcgtaaaccctatggtggatatggactctagaataggatggcgctgttatccctagggtaacttgtccgtgggtcaagttatgggatcaatggagtcatagtagtctcgcttggacttgggtgaagtcttagctatgtactgggctccgacaggtggggttcctggctccgaaggtcgcccacaaccgaaattttacaatggcaggtcgggaagttcaggaccggtgggggtctggcacaggctaccggttggcctccactaaatacaaggctccataggggactcacccgacctcgcggagtaatgcgccacgctctctcacagagggacaggcacaatgtccacactggttcaaacagagtagggccctggcccagacggccctccacacaacaaacccaaaaaattcagaccggccaactgtctttggacgcactgaaaggcggggggccaacgcactagattggtggtcacgatcatgggggtatccccacccgtgggtacaaattgggcgctgcatgatgtcatcaacctgctgtagtgcggaaacgaccacaacacacactgactggtatgacaccacn

SEQ ID NO: 579373 - DNA, 621 bp, Homo sapiens
  misc_feature (179)..(179): n is a, c, g, or t
  misc_feature (200)..(200): n is a, c, g, or t
  misc_feature (210)..(210): n is a, c, g, or t
  misc_feature (216)..(216): n is a, c, g, or t
  misc_feature (231)..(231): n is a, c, g, or t
  misc_feature (243)..(245): n is a, c, g, or t
  misc_feature (262)..(262): n is a, c, g, or t
  misc_feature (321)..(321): n is a, c, g, or t
gggtatatgtcaatggaggtattattttataatactttgcattgacatgaagtgggttcatgggggaaaaccatgagctgtgaatatatgcttgtttgctaccaatgttcacagctcatggtagcaaacaagcatatattcatttcaaaactttccttgcttttagcagagagaagccngtatatgttacatgtgtgacnttcagtagtntaaagngatgtttcaaaaaantgttgcatgttnnngatgcaatttgggaaantgtttacttcacaatgtagtcattcataaaaaattcatgaaaatactgaacatatgttngaggatttttcttttcctttttaaatttttttattttttctgagacggagatctgctcttacgcccaggctagagtgaagtggcgcgatcttggcttactgcaacctccaccccccaggttcaagcgattctcctgcctcagcctccggagtagctgggattacaggcgcccgccaccacgtccggctaatttttgtattttcagtagagacggggttttgctatgttggccaggctggtctcaaactcctgacctcaagtgatccaccttgctcggctctccaagtgttggataccggt

SEQ ID NO: 579374 - DNA, 1383 bp, Homo sapiens
  misc_feature (36)..(36): n is a, c, g, or t
  misc_feature (199)..(199): n is a, c, g, or t
  misc_feature (431)..(431): n is a, c, g, or t
gattttcccagctgctagcccaattaaacctgtctngccctttgggggcagtcccaaaaaaaaaaacaaaaaaaaaacaaacaaaaacatattttggggcgcgcgcgcttcgggcccttcagaaaacttttctaaacacctttcgtttggggcgcgccgcgggcccccaattgggtaaagggcgaccatgggccataancgagtggttcaccaataggggagagactccggggcaaagagagcacaagagtggctatgggaagttctctccacgcagcaatataaaacacaacgcggcagggagagggaaaacacccagagaacgcggtttcatgagcacaaaactctccacaagagtggagaggtactcagaggaggagccaacaagacaggggagacctctcatcacaacagcaaggaggaggctccanagaacggagagagggccaacgagaaaatcatataaagaattaacgagccccaccgagcctcgggggggaaagaacgagaaaacaggaaaaaaaggaacgaacagaaaacaacgaaaagaaagagaaaagaagacgagggcgagcaagaagacaagagagaagaaacacgacaaagaaacgaaacgagagcaagcgaaccaaaacaagacagagacaaaccggagcaacagcagaaataagcagacaagaacagaagaaaaagagagagaacagaagcacacgacaagagagcgaagaagagacagagagaaacgaggacagagaagatagaggagaagagaagaaagaagaacagaagaagaagagaaaagaagaacagaaagacaagagaacgacagaacaagaacagaacggagaagacagaagaaagtacagaacaagatgaagataagagacagaggaagagacagaacgaggacactgaacaaacaagataagagacagagcaaggagaacatacagcacaaggagacagagacgaagagagcaagaagagagagcagaaaggaaagaagagaagaagaaagaagaaaagagaagaacgaagagaagaagagaacaagaacgcagagagcgcgagaagagcgagcgagagcaagagacagacagagacaagaaagaacagagagaagaagagagaagaagcagagaagcgagaggaggaagcagagaaagatagcagggagacagcagagagagaagcacgagaccaaagagaggagaagagagaacaagacagaaagggagaagaagagaaagacagaaaagaaacagcagagaaatagagaatagagagagagaagaagacggtaagagagaagtcacagaggagaaagagaaaaagacaagagggatacaagaaggcgcaagagagcagagaagaaagagagga

SEQ ID NO: 579375 - DNA, 1051 bp, Homo sapiens
cggcctgggcgggagacagggaacggctcctctccggcgctctgcggagcgagaattagctgatcgctgaggctcagttggagttgcacccggcgtgtgtggcgtgaatcttgggatcactgcgactgtatgcatcctgggttcaagtgattcttctgcctcacgcctcctgatgtaagctgggactacaggctagcaacataagcacggtccagcgtgcatatgatcagacaggatggcaatgaatggtggcgaggacgtggcgccacaagtgagactcacgttcggcccctatgccgtgggaaattaaggccttgtaaataccagacacggttggggaggacagaggatcctaagctccatcaaccattgtacacgactcctgagtaaatgcctcgctatacaaaactttggaccattcgagtaccctaccagataccacagtgcaacccctgcaaatgcagcccatgggagttaatcctgctgacaagaatccacaacgtcctgtaaaatgctggccaaaagtgacgacgagccaataagcaagaaagaaaaacgcacgaaacgctgaccatacttcctacccagagatagactaatttgggtcctgtcgggggaagaggctcatatgccacctggatgaagcacttgcatgtgccatgaggtcgactagggaccagggatgtgtgagaccggagtccacagagcatctgacttggacaagcaactatctggcgcgagagtcacctgtatcattctgttttcatgctgctgtattgacgtagccaagactcgtgcaagtccaaagcggttccatgggcctgccgtgccactatgggcttgggaggcttgcgatcatcggtggatgggaaccccttctccagtcgttgaggccccgaaattttggcaccggaaacggagccctattaagccctaatttcgggcctcctttggaaaaccgcccgtgttcattctccctgggccccccaaaggtttgggacacccctgattgggccgacattaccgggaccaccaaaaatttttgaacccg

SEQ ID NO: 579376 - DNA, 183 bp, Homo sapiens
aaaatatgataatagatccacactataacttaatttaaattgggaaatcaataactgagtgtggggaaagaaaaaagtttttgcatatgcttgaagttaaattgttatttttttaaaaaaatactgttaaaactgtaagatattttattgtggttaccatgggacctacataaaatgtcgacg

SEQ ID NO: 579377 - DNA, 388 bp, Homo sapiens
ggtcgacagacctgcaagcttcattcatggtagatgacccacagaggtgcactactttttgtcttctatgctgtattttcactctacccttcctatgtttagctatgtttggatatacaaatattaccatgttacagttgcctgcagtattcagtacagtcacatgctgcacagattggtagcctaggagcaacaggctatgccatagagcccaggtatgtaatgggctgtaccatttaggtttgtgtaagtacactctatgatgttcacacaatgacaaaatcccctaatgatgtgtttctgagaacgcatcactgtcattgagcatcgttgtgtattaattcattttcaagctgctgatagagacatacccaagactgggcaattt

SEQ ID NO: 579378 - DNA, 336 bp, Homo sapiens
tttttccctgggcaaaaaaaggtttcccccccttttaggggaggggcattaaattttttttgccccctttttgtcccctttgaggggcctttaaaatggaaaaatcagttggggtttcagtgaatcatggtcccctgtatttattgttagaaaaaccctaagggtgggggaaaatattcatttgggttcggggttggctgaaacccctgggttggggggttgggggagaaataatggggagtcggggaaattttgggggttttttttttttttctttttggttcccagttgtgacaggttttgttcaaaggagaaccaataaagggataacccata

SEQ ID NO: 579379 - DNA, 440 bp, Homo sapiens
atcacctcggcccgtgatgtagaagctgcagtgagctgagactgagccactgcactccagcctgggtgacacagcaagattctgcctcataaacaaaaatacaaaacaaaagaaaataaagaggctgatgtggttttatagatgtgaaagacactgatgatatactgctacatgaaaagaacatgttacatgatcctcctgcttttatttatttatttacttattgtttttagagacagggtctcactctgtcgcccaggctggagtgcagtgccacaatcacagctcactgcagcctgaaactcccgggttcaggcagttctcatgcctcggccacctgagtagctgggactgcaggcatgtaccaccacacccagctaatcctgtttttataaagagatggggtatcaccctgttggccaggctggtctcaaattcct

SEQ ID NO: 579380 - DNA, 439 bp, Homo sapiens
gatttaaactcagatatttcagactccaaagtccacatcttccattgtatcataatttttcttttttgttctgatttagatcctgtaaataaacaccttagctagaggtagccaacaccttgttgaatgacgttactgcaagatagtgactacttaggggagtaaattaaatgggatttttggttcagctgattccattctgcctccagcaatgttctccttctgtacagatatcagcagctgcagataacctgggtttataaagccgatcattaaactgaaaagttacctgcattaaaatgaagttatctgcccatgggattctccttttagtttgcaaacacacccaccccgtatgtctgcagtttatatttaaaaaatttgttaatggacaactctgtgtttccttctgacctggagataaagaatttcagggcca

SEQ ID NO: 579381 - DNA, 242 bp, Homo sapiens
tttaggggggggggggtattttatggggcccaagccccctcatggtggaaatgagcaattttaaaatttgccccctgattgattaaataaaaaaacaggcaaaaaacaagatttttttccctcccagatgttggaaccccttggtttttaaaaatgaaatgttgaaaccttaatttttttatcaaacccagccttttgagatcagtcttttttaaaaaaaccggttttcttttatccgctta

SEQ ID NO: 579382 - DNA, 141 bp, Homo sapiens
cacacatctacaggagatggtgaacttcagccccatggcccgggaaggactcacggcgccggagtggcatgaagctggtagggactcatcttgcatggcaccgccggccagacactgaccaaggaccagtattggtcacta

SEQ ID NO: 579383 - DNA, 323 bp, Homo sapiens
ctacatgacactgcgccgacagctgtattaataactcttgaaaacgagaagcagcataaatcgcctttactaggggagtcgacaaattggcggatatcatagaatgaagcattattcattgctagacctaagtagctctcaggccacaaaaagaacatgtggacagttaaatgcctattgctaagcgaaactctacatactctatgcgtccaattatatgatattccggaaacgtgacttgcgctatagcaaaactattagagtctgctgcaaaagcacgcaatcctgagtaggtgaagtaccgccaattgtctagcagggcg

SEQ ID NO: 579384 - DNA, 292 bp, Homo sapiens
gggagtagttaagatagcaaattcagagtctttgctaagggggggcattgcctttttgacataggcactcctgggtcttaaaaataaaatctggcacatacttatggtggtttttaatatatggccaggctgtgccaggaggattttttacctatattgaaaacctaaggtatgacccaccacctcaaggattcattgaggcaaatgaatgtggtgaggatttggaaatgaaggattttgcacagtggtggaatccacatttttggatgatgatgggacccattctcctatg

SEQ ID NO: 579385 - DNA, 251 bp, Homo sapiens
agggaagggagaaaaattaactcactagtacaggggaaaagcctgaggattcaagaggcccagaaatgagtctgttagtcaaattgctgtggttgtgttttgctataacttgttttgcattttggatagtcgtaccttgaaaagcatagtatactgttttagcagttcgctactagccatagttccctagctacttctgtcaaaattgggtttccagtttattcttaggcttaggagtaataccacttaat

SEQ ID NO: 579386 - DNA, 123 bp, Homo sapiens
  misc_feature (75)..(76): n is a, c, g, or t
gcgcgactgtctcggtcccacgtgtgccagttgctacgatggaagttaaagggaaaaagcaattcacaaggaagnnttacaaaggcagcacaaggcaaaaaacaagttttcattaaaatatgg

SEQ ID NO: 579387 - DNA, 438 bp, Homo sapiens
  misc_feature (194)..(194): n is a, c, g, or t
  misc_feature (426)..(426): n is a, c, g, or t
  misc_feature (435)..(435): n is a, c, g, or t
tgagacagagtctcactctgttgcccaggctggagtgcagtggcgcaatcccggctcaccgcaacccctgcctcccgggttcaagcgatccccctgcctcagcctcctgagtagctgagatcacaggcatgtgccaccatgcccggccaattttgcaccttcagtagagaagaggcctcaccacgccggccagntgatctcgaactcccgacttcgtgatccgcccaactcggcttcccaaaatgctgggactgcctggcctcaaataaacaattctttggctaattctggaatttgtgtcagatgctgtgggatacttttattcctgatcacatttaacacaaaacttagtgtttatatactgtaaacaacataaattacatattgtaaaactctaggatcataaattgctcaatccatttcttnttgttcttntaa

SEQ ID NO: 579388 - DNA, 921 bp, Homo sapiens
gggctgaactgaacagctgggactatgcttgagccatacccagcttataaaagccccagtggcagcatgcatctgaatcagtcagaaaagatatacgtaagaagaaactgaatgtgaagctggattccttacaaaggaaaaacgaaagatcactattgtaactataccaataattactatattatgtgatgcgaacaaaatgcatagatatgaacaatcaatctaggtatgccgggagcggcaggtggctcatggccttgttgaatcccagctaacgtgttgggaggcctgaggctacgggtgccttctacgacctgtaaatcgcgcagccactttaggtaagctgaggcgggcggtatcaccatagaggtcgacgtagtaacgagtaccagcctggcctagagatgaaagaaactccaatctctactatatagataacaatgaattagccaggtatggtggcggcattgcctgtaactcccacgctacgtccgtgggaggctgagcgcgaaggagaccgtaattgctgtgaacctggggagcgcggagggttggcaaagggacgtcctgagatgcagcagccacttggtttctcacagctctagggggcatactgaggacgacgaaaatatctgtcatcatggacataaagtaggaagaatagctgtttaggtacatcaccatcagacataacacagagtgccccagtgggctgtcatagcttgccagggatgctagccataaaaagcagagggtagggaaaggctggaccctttggtggcaagtcatgcgagtgaacgctcgaccccaaggggtcggctgagtcactggaggagggggataatcccgacggatctccccgaaatgggaggacggcacccaccttgcaaagtacgcccccgtgaaaggttgcactataag

SEQ ID NO: 579389 - DNA, 485 bp, Homo sapiens
gaagacagagtctcgctctgttgcccaggttggagagcagtggtgcgatctcagctcactgcaacctctgcactccagcctgggtgaaagagccagactatgtctcaaaaaataaagtaaaataaaagaaatgctaacaatcatctgagcctatagtgaatcataatctttttgctggtagatggtcttgcctcaatgttgatgactgctagtggtggtttgctgaaggctgggatggctgtgcaatttcttaaaataaaaggacaattaagtctgccacactgattgactcttcctttcttttgctttcggttgttggggggcggactcccccttgagatagagtctcactctggaacccaggctggaaaagggaaactccgcctcttatatcataaatagaaaaattccctgggcatagtggcatgcacctgtggtcccagctactcaggaggctaaggcgggagtttcaccgaagcccaggg

SEQ ID NO: 579390 - DNA, 108 bp, Homo sapiens
cgtaacacgattcagaggattgatctctactcagccaggttctactcctttagcgtccttcaagatactatcccgggaggagacagaaagtcatggtagctattcctc

SEQ ID NO: 579391 - DNA, 200 bp, Homo sapiens
aattagggtatttcttccgtcatcttaggccaggatccgaaatctcaattatttatacgccatatggggcatgatgtcaagcccttcaagagatgtcattcggtctaaagagggataagggcgaagcccccgcggcaagaaagcggcaattaagataagtaggaaggaagacgccgcaataagcaggagatcacacggcc

SEQ ID NO: 579392 - DNA, 1220 bp, Homo sapiens
cagaatgagactctatctcaaaaaaaaaaaaaaaattgatttcagtggggtggattgctccttattaggttagccaaacacatttgatttaccgtggtagatctttaaggaatagaaattcaaagttagagcacgttcagcaagagcctcttgggtctcactccactcattttaaaaccagtattatttcagtagcttgaaggaaagagctctcccgtgagttcagcctggcaaaaggttctaattttttataggattgccactactttctcttccttaaattaatccattcttggagaacgtgtcagtgagtttagcaccagcgggctgtggagaattcagtagaagtgggcctcaacttagaacatgtgtttctggttctggcagacatttattttccattctcccagtccttctgtgccacgtgttccccacttgcaggcgaggtggtcgcaacctctagtgggcaccttcagaggagggtttcgtgccaatctttctccccacgttgtgcaagttagcttgtggcttcccctctcgtggcctggggtgccatttgggcagttttggcgcgctaatgtcccaccttccttaaagtgggcgctacctggagggaaaattcatcttttcagggccctggtccagatgtggtcctcgtggcaagtaggctccctaataagttacttcaactggtcgggggagatttttcttgtcccaccttttcttaaaaaaaagcgcttgtttatttccattttcccaattcgacatccattcgcggctttgtggtcccccctcatttctggtctatattcccttctatccttctccttgtgggtcagatcctcctgtggcccgttggccaacccccccgaaataatttttgtggtgttctccaccacacattttttcgtgggggcgtggggcctgtgggggcgggcctcacacacccctgtgtaattcgcccaggccgctttgggtgggaaagcggccacaaggggtggggggggggaaccactcctggagggggtccagcgtgtttttggagcacccccgtccctgtggtccacccttgtggtgtagaaccccccgggcgtctcttcatctttagagatttccgaacccattagccgggggccggtaggtgggcgggggacccctgataatcccttcgactaatccgggagggctctacgggcgcgagacactggcgagtgaatccg

SEQ ID NO: 579393 - DNA, 326 bp, Homo sapiens
aaaggagggaaagttccagcagtttcatgagatgcagtattgagtgttctagttcctggaattagttggcagagaaaatgctgcctagtgctacagatgtacattaaataccagccagcaggaggtgatcatagggcacagccagttctgacagttttttaggggcctggatattttttgatggaaaagattatattgccaaatattaaggagctcagctataaatgcctccaggatcagaggcactatgatgtagtactttagtgttctgtcctctatcagtttacaggggcatcccctccatgtcaggttctacagttgcctag

SEQ ID NO: 579394 - DNA, 591 bp, Homo sapiens
ttggggctccattcaggtgcggggctcaaggagggcagctccctcttccggtgagctgggccttagctcatctgagaggatcagcttccgtagctgggtcccacgggagtgtcgtggagtggaaatgtgcatgtctgaagaataggccccaagcaacagggcacacgggagggacaagttaaggctcgggcggcaacggtggactatgtagggcttaagggcatcacccacgtccacatccatgtggatgtacatgtaaagcaacgggggcagatagaagtccacgtcctcgtggcgaaagcagaagagccggttgccaatgtaggctggtactcaaggctcctgggagtaatacgggtatgaaagtggcagggagatgtcaaacagtttggactcaaacagcccaagaagccaagacggttaagctgagtggtacggccgccgtctactggctccttgggctgtgcctgagtgcacagggggccccatctcatcttcctcctccctgatctggggcaggtggatcatctaggcaacggatctcagtgaccacaccatccccattgcccactccaggggggtgcctctgtt

SEQ ID NO: 579395 - DNA, 172 bp, Homo sapiens
aagcctggtcgatatggtgaagccctgtttctgctcaaaatacaaaaaaattagccaggtgtggtggcaggtgctgtagtcccagctgctatgggacggctgagcgagaagacattgcttgaacccctggaggcagcaggttgcatgtgagctgacggtcacgccacatgca

SEQ ID NO: 579396 - DNA, 718 bp, Homo sapiens
ttgtggtggaagcccaaccccgcggggcggagggtccatgacggggagcttgcactgcgagagatgaaggggttgcactaagatgaaacccatcacttgatcacaagatctaactcttgatggcccatcggccaaacgggcaaaaacatccgcgttaacaatcgccattcatgacattgaaaggatgccctgttgtctacatattggcacactccgacatttaaggaagacttatgctctaatttggaaaaagcctttgtattgttctcctgggacaactttgtcgaagagaaaactggttgttatgtgtctaggaaagagagaaaaggctgagaaataaaatctgttttcttgagaaataagcttcagaccctgcaaggaaagttcaacattctattgagtataaaatcttataagttggcacctgaatacacatcattgctctctattctcaaaacaatcatggatgtgagagatgactacctcttgtagctaatggttctgcatcaagagcacatgtccacgttcattggcagtaccattgaagagtactgacatgatcatgtggaatacatgagcagttaatcataaattacggtactctataaacagatgtacatgaggaaatactgttcctgctagaatatgcgcatatccttgtataatcccaatgtgatgatggtcacttagtctgctcatcaagttccttaagagagca

SEQ ID NO: 579397 - DNA, 270 bp, Homo sapiens
gacgcatcacggtcagagctgttcctgatgtaacatcgagatatcctgaaaggagctattcttggtctcttcctccttggataaatgtcttgatgatctcctccttcttggcctggaggcgctcttcacggcgcttcgggtacttttggctaagacctgcggcctcagcctggtcagccaggagcttcttgcgtgccttgtctgcctctcagtttgtggatgtgtcccatgagaatccgctttgttaatgaacacattccccttcacctt

SEQ ID NO: 579398 - DNA, 180 bp, Homo sapiens
tcgacatactgtacatcatggatcatatctatatcctgtagttagatagttgtggcaggcacctgtagtcccaactgctctggcaggctgcaggcagtaagaatcaatatgaacccaggaggcagaggttgcagttagccgacaatcgtgccactgaaatccagcctgggcagcagagcg

SEQ ID NO: 579399 - DNA, 124 bp, Homo sapiens
agccccaggggtttcccccctgcccatggagtaaagcccgagatcctggcccttatgccagttttgacctggcatccccctaccccgagcccatgcagtttgggaacatgccgccttctctcca

SEQ ID NO: 579400 - DNA, 311 bp, Homo sapiens
tgctgctcctcttcacccaactacggaggagatctgagcacagagtccgggtcgggtcacaagctccgtctcggaggcctaatcaggatctgactgtcctcgaaaataaacggggaaaacccacagctgaaacaaatcgaggggctggtgaaggagctgctggagagggagggactcacagctgcagggaaaattgagatcaaaattgtccgcccatgggctgaagggactgaagagggtgcacgttggctgactgatgaggacacgagaaacctcaaggagatcttcttcaatatcttggtgccgggagc

SEQ ID NO: 579401 - DNA, 942 bp, Homo sapiens
tcgcgctgtaggaagcaacaacctctcctcttcgtttccgcatcagatcggaagtccgcgaagaaggaaccgatgcgtgagatgctctcgcatccacgtgggccaggctggtgtccatgatggccatgcctgctgggagcctctagtgcctgaaacacgggatccagcccgatggccagatgccaagtgacacagacacattgggggaggagatgattccttcaacaccttcttcagatgagacgggagctggcaagcatgtccccgggcagtgtttgtagacttggaaacccgcggtccattgatgaagtgcgcactggtacctaccgcagctcttccagcctgagacaacttatcacaggcaaaagaagatgctgccaataactatgcccgagtgccgctaacaccattgccaaggagatcatgtgacctcgtgtggacccgaattcgcaaagctggtcgaccagtgcacgggtctccaggctgctaggtttccacagttttggtggggagaacgtggttctgggttcacctcgctgctcatggaaacgtttctcagttgattatggcaagaagtccaagcctggagtctctattgacccggcgcccccaggtatccacagcttgatagttgaagccctaacaatccatcgtcagcaacaggacaacctggagcactcgtgattgtgccctcatgggagacaatgaggcacctaagacatctgggaaaacgcgcgaaatgagggatcaccgagactacctggaaagggaagggcaaggggccccccaccggccccgaaatggggggccgagtgtgacggagaatccaaccacggggccaccgggcacacccgggaaagccgaacagggaaaccacaaaaggcgggcgacacccggctggcccacggggatcccgcgaagtgcgcgcggggcaacagggac

SEQ ID NO: 579402 - DNA, 200 bp, Homo sapiens
ctgctgagggactccctgctatgcctttctgaggcaactggcacaagtgtcatcgtaggggtacctcctgatttccaaaacctctcaatgacccctatgctgctactgactggacgtacctggaagggagctgttcttggtggctttaaaagtaaagagtgtgtcccaaaacttgtggctgattttatggctaagaagct

SEQ ID NO: 579403 - DNA, 473 bp, Homo sapiens
aagcagtggtatcaacgcagagtgcccattatggccggggggggcgaaaaaaaaaaaaaaaaaaaaaaaaaaaaatttttgggccgccgcgcaagaaagttttaaaaccatttttttggggccccgggccccatgttaactgtggccagagctgtggtacccgaaagaaaaatccggcgcatggacactgacgtgcgtggtggtttttccacaaccaaataaaaaaaaagagcgcccggggcgggacacaccgcgaacggtgtgtttggaacaaatccccaagatggaggtcccggagagggcacacataacggcgtctctacaccaccgggcgggcttccagagcaagaggcgcatgatcaaaatttgaggcccccccgcggggagaaaagaaccgagcaagactatacagaccacaacgagcaacaagagaaacacaaagacaacacgacaacgacaacaacgcacaacaa

SEQ ID NO: 579404 - DNA, 609 bp, Homo sapiens
acgaggtgctggctgaatggggggcgccatgccagaggcccggcaccccgcacaggcgcctctgccctgcacgtggctgctgccaaggggctacattgaggtgatgaggttgctccttcaggctggctacgaaccagagctccgggacaggggacggatggaatcccctgtcacgcagcggcacactggggacgtggaggatgactgacggctgctggcgagacatggcggggtgcatggactcactgacccatgcggggccagcgtccctgtgacctggcgatgaggaagtactgacgcctgttggaggaactggcccggaaacaggaggaccttcggaaccaaacagaagcttcccagagccggggcacggagccccaagcgcctctagcagacaaacacagaaggagctctgctgtgtcgtcctgagcagtcgcgagaacgatttcccctccaggaacttgtacaaaggagcgccggcctggtggggctgggggggccccccatccaggacgccgatgagggggaaagatggtccaccgaacacaccgcaaaaacagaaacccactggagttcctccagacagaccagcactacacatccgtggca

SEQ ID NO: 579405 - DNA, 369 bp, Homo sapiens
ccttctttcagctcccccaacagtgagcatgcttcccaaaaaattacaacatcaaaaccaggaatgtccccgcatttactattaccagggttgcaattggttcaattttcccataaaaacatgtttgtccaaaagaagggaaactgtgaatttattccatgcccccaataaactttgcaagaagtttaacccacataggtttgcggcactgcaaaattgttcatgggtttatgtagccaatgattttttgccttgacaatcatgtatacaaatcaaaatttctatcaaaataataataaaattaaaaacttcctgttttcctccaataaaaacaattaatcccctttcaaaaaaaaattaataaaaaca

SEQ ID NO: 579406 - DNA, 858 bp, Homo sapiens
  misc_feature (443)..(443): n is a, c, g, or t
ttttcggcgctgcgcctggctcttttctctctccccgtgcggcaccaccttgaggtcccgggctccccccccgttgtcgacccccgttccgggcccccgtggggtcccctttggccgcccccgcccccccctcgagaattcccgctgggtcgagggaatattcacggggtcgccaacttttttcagcggacctattctgtcctcccggtgtttctgtctgaatttaccgagggggcctttaccgtcctcctccgctccacttcggggattttcaagcctgcccgtcccgggttactcagacgccccaacgcctttactgcggcccatgcttgattgcggggcagccctctacatcgagatccccggcggcgcgcttccccaggggacccaggaccagctttcgccggtctccctggagttcttctgaggggccctgcgagccngagcccatgtccttctcatttgcgttcccccagaaccccggggaccgagccccccttgctctccggaccctcagcgtttttggcctttgagattgtgagaccgcgggcatcccctctgtcccccagagacccgcacgcttgcttcatggccgacacgtttcgagagagatttttccggagacagaggagcgattgggccccctcgcgggctgggcatccggcccctcggggcccccccctgtcagacccggtgggttggaaccctgcagactcgctccttttccctgggtttgtcccccatttttattgtgccaataaccctccctcccaattagcggggtattttttgaagtttaaaattttgtttttgaaattcgaaatatttgcttttattttaaaaaaaatttatatttta

SEQ ID NO: 579407 - DNA, 220 bp, Homo sapiens
ggctccccaaaaaggtttccttcttgggggcccctgggtctcccgcccctttgttttttttcaaaggggggtttttttccccccttttttgtgtgggggggcacaaaaaagggtcccggtcccccacccaaagtaacaggcaaatgaagttgttttagacagagaccttgtctctcaatgcatttggtcaggggggcataaataaaggatacaggctcca

SEQ ID NO: 579408 - DNA, 178 bp, Homo sapiens
cgagagagagcgaggagcaaatagcagaggtcaaggaggccttctccatgtgtgacaaggatggccatggcactatcaccaccaaggagttgacgacagagatgagatccctgggacagaacccctctgaagcagagctgcaagatatgatcaatgaggtgcatgcatatggtaacgg

SEQ ID NO: 579409 - DNA, 449 bp, Homo sapiens
ccagtatctgtgtcgccgccgcccgcggcgtccccggtttggtgttgcggcgcccaccttcgggaggatcagtatctggcaccaattctgacccagtcatttgtgatcccgtggctcttgtgatatgctgaagatttccaggcagtttgtagtggaacaccatcccgcggtcccagcgtctaagttcaagcgaccagtataacacaacgaacattgcccttgggtccaaacttctggttggaagcggaaccctgggttaagttttccttgggaaacgttggggccccaaaacgaagatcaatactgacaccagaatggcagctactctcaagtcattaaaacttgtaagataccgagcattttgcagtccttctgcctttggtgcagtccgaagtgtgtcatactggaatgtgagcagcacacagcatgggggacaggaccctccagac

SEQ ID NO: 579410 - DNA, 203 bp, Homo sapiens
ggggggtttttaacccccccccccaattttttagggggggcccccgggataaaaataaacggggcccttcctagggaagggaaaggggaaaaaggtccgggggtttttccccccggttccccccccccgggggttttttttaaggaaggtttttttttcctaggaaaagccaaaatgggaaaccaaaaccccccctttgttta

SEQ ID NO: 579411 - DNA, 113 bp, Homo sapiens
agctacctagacgggtgtgctcttattagcagtacttaggtagctcgtcgggtttcgggggtcttagcttgggttctcctagcaaagttatatctagttaattcattatgcag

SEQ ID NO: 579412 - DNA, 221 bp, Homo sapiens
  misc_feature (213)..(213): n is a, c, g, or t
ggccaagcagcaccacccgaacaaatcctccaatcagtccacgcaccatgcccaacaccaattctccaatcagaccacgcaccatccataacacaaatcctccgatcaggccacgcaccatgcagaacacatatcctccaatcagttcacgcaccatgcccaacaccaatcctgcaatcagtccacgcaccatccccaacacacatctaccgngggcttat

SEQ ID NO: 579413 - DNA, 363 bp, Homo sapiens
ctccacccgacggggaggcaataaaaatctacataggaagacaaatctatttaaaaaaaagttttaataagatagcacaaaagcgagatgaaaaatactttttattaattatgagccccagccgggcatagtggctcattcctgtagtaatcctagcacttagggaggtcaaggcaggaggattacttgagctcaggagttcaagaccaccatgggcaacatagcaagaccctgtctctttaagtatgagttccaacttttctctatctgtaaatgtgaatttttattttttttttttttggagagggggtttacttttgaattccaagttcttgggttttttttaagggttgcctaaaggcc

SEQ ID NO: 579414 - DNA, 824 bp, Homo sapiens
ggccaattctcgcactcgggttcttccgccgatccgccgtcgtgttactctgccggtcgtaagtggacagaagagatcgccgcgctggtcattgagaatggttccggcatgtgcataagctggttgagctggggacgacgctctccgaatcgtgttatccttccatcgtcagggcgccccatacacacagggcgatcaatggtggtgcatggagccacgtaatggacgtacctacagtgggcgacagaggccgcatgatgcgaacgctgtggtgaatcctggagcctgtaagtatccccgacttgagcactggcatcgtgcagccaactgtggtacgacgatggtacgcaagatactggccgagcacagcaccgtatctatcaatggagcttgcgtcgtaggcctgcgggaggacgcgacccagtgcgtgctgaccgaggaccccgccgtggaaaccccgaaggtccggacagaggagacgatgacctcagattatgtttgagaccttcaataacccggttcatgtacgtggccatccaggccgttgctgtccggctctacgccattctgtggctgcagccactggtcattgtcatggactctgcgagacgtgggtcagccacatcggtgcccatctagcgaggtgctacgcccatcgcccctacgtcgcgatccttgcgtctgggaccctggcttggcgcgggacctgaccagaggtacctcgatgaatgatcctcaactgagcgagggctacgagcttcaccgaccgacggccgagcgggaaatcgtgcgcgaagatcaaggagaagcatgttgctacgtcg

SEQ ID NO: 579415 - DNA, 328 bp, Homo sapiens
caataaatcttgctgctgctcaaaaaaaaaaaaaaaaaataaaggggggcccccccacaaaacccctttgccccccggaaaacgtttgctttttaccctttaaaaaaaaaaccgggggggtgtaaaaaaaaaaaaaaacccccccctttaaaaaaaattggtggggaaaaaaaaaaacctttggggggggcccaaccgggaaaaaaaaagggccctttggggaaaaaaagccctttccaaaaaagggaaccccccttttttttttttttaaaaatggggggggggggggccccttaaaaatccccctgggggcatccaattttggcct

SEQ ID NO: 579416 - DNA, 108 bp, Homo sapiens
  misc_feature (20)..(20): n is a, c, g, or t
ttcttaaccggcgtcctttntttgtttgggacaagaacccacccacacccatattatgattcaactctactatagtaaatgcccccttccgcgaaacacttcatccgg

SEQ ID NO: 579417 - DNA, 823 bp, Homo sapiens
gtaactgcttccccccaggctggtgaaaaagaatgagtgaagctgctgatgaggtcttcaaagacatcatggagtccagccctgtgtgctcagccgcactgatcaaacctcggtggaggtcacagtggcctgctcgggctccccaaagaaagtgaaagggcagtgcttagggaccctgctgcagctgagccagtgacaccacagcaaagcaggctcaggtgcacagggggcacagaagggccccgcgagagtccaagtgaggaggcacaagcactcctctgagtcgccaggagggacaggggaaatcgtccaggtcaaacctgccccgccgccccacagcagcctctgcagggaaggctggaggaaagccctacgcagagcccgagccaggaggcggcggggaggcagtcctgggcgcacaagacacaaagccacgagtctggttgatgctgtgaacagtgacgctgccaagaccagccagacgggagagggcctcaaaaagcgcgtgctcccgagcactccaaagcacagaccgccaagccgccggggacccaatcaggccagcaccacgttacctccaaagttgcactcacgcatcatcggccctggagagagaccagccgtacttccaactgacctacatcgcttctcatataacccgagtgtccctctggaaaccagccagcataacagcggatagcagcggcgccaatcaccaatgtcaatggccatgcacaccaccggacgcgtagagcccccaatcatacgacatctgacacaaatgacagcacgtcatagcagaaggacggcacaactacaaggt

SEQ ID NO: 579418 - DNA, 247 bp, Homo sapiens
ccgttagatcatacttattttcagttcttgtacatttgtgtttttaacctgtaatttattatttaagttttaattaatgtctgtattgaaacgtaaagagtgtcagatgcttttctcttgatggtcattgtctttctttctttttttttcttcccaccactaccacggcatatggaagttcccaggcctgggataaaactgaaccagagctgcaacccacacaacagctgaagagtctcacggaagc

SEQ ID NO: 579419 - DNA, 782 bp, Homo sapiens
  misc_feature (13)..(13): n is a, c, g, or t
  misc_feature (66)..(66): n is a, c, g, or t
  misc_feature (227)..(227): n is a, c, g, or t
  misc_feature (229)..(229): n is a, c, g, or t
  misc_feature (234)..(234): n is a, c, g, or t
  misc_feature (249)..(249): n is a, c, g, or t
  misc_feature (308)..(308): n is a, c, g, or t
  misc_feature (349)..(349): n is a, c, g, or t
  misc_feature (392)..(392): n is a, c, g, or t
  misc_feature (394)..(396): n is a, c, g, or t
  misc_feature (399)..(399): n is a, c, g, or t
  misc_feature (401)..(401): n is a, c, g, or t
  misc_feature (423)..(423): n is a, c, g, or t
  misc_feature (431)..(431): n is a, c, g, or t
  misc_feature (444)..(444): n is a, c, g, or t
  misc_feature (448)..(448): n is a, c, g, or t
  misc_feature (481)..(481): n is a, c, g, or t
  misc_feature (489)..(489): n is a, c, g, or t
  misc_feature (491)..(491): n is a, c, g, or t
  misc_feature (504)..(504): n is a, c, g, or t
  misc_feature (509)..(509): n is a, c, g, or t
  misc_feature (512)..(512): n is a, c, g, or t
  misc_feature (527)..(527): n is a, c, g, or t
  misc_feature (529)..(529): n is a, c, g, or t
  misc_feature (552)..(552): n is a, c, g, or t
  misc_feature (554)..(555): n is a, c, g, or t
  misc_feature (745)..(745): n is a, c, g, or t
gcaaaaacaatgnaaggagcctttccagttatcttgagttgcagctctgtagtttcttgaggccanacacactgtattttacaagtcaaaatataatttacattaatcactatgttaatgagtatgtaaaacattcttttgcattgatgaattttgtatctgcttccattaaaagcataacagccatagttgttgcgtgttatttttaaaactatttgtcacaaagngnggggnggtaccacataacgnggtaacttttggttagtaatccagctgagaaacagcttgcccataaaaataacatcagngtattttatgaaaaattagcaaacaataggtatattaaccnccattttcagtcttttataaaaactattcacatctattaaaanannnccnangggacttcagccaagattcagngcctttcnacgggattccccntacnagatgcatccggaggggccctagtttactttcnccaatcananagccaccaggganttaanacnggaatatttaggggnanaaccggggagggcaattatacangnntaacttcatatgggggaggggaaaacaaacccggaaattaaacaatttggcctcatgtcctttagttttcccaaggcttccttgaaaaacatctagctcttggccaggcacggtcgctcacgcctgtaatcccagcactctgggaggccaaggcaggtggatcattaaatgaatggacttggtgatatantactaacaagcacgacctgaattctgggagtaagtgg

SEQ ID NO: 579420 - DNA, 355 bp, Homo sapiens
cgatgtgtaaataacaagatgcatgtcaaccctgggtaatagtggcccccagaaacaacccgcctgtaactcccccttccccagtgttattcaaggcacatggttgggatctccaaaaattgtgttcttataacgttgccgttgtccaacacagaatatattcaactcagaaagtatatcaccccctattggacagtgtgtgacaggcagacactatagtttatgaggtactcttgaattcagcaaaatgaccaaaacacgcacttgccggctggttctctacagatatttcacatcagataaaaattcagagagtatacccagaataaataatatgacagtgggtgggctatcg

SEQ ID NO: 579421 - DNA, 485 bp, Homo sapiens
agcctgatatcctgcacgttgagaagctgaagtgggatgatggcttgagcgcaggagtttgatgatcagcctggtgcgatactagacagactccatctctagtaaaaaaattatgcaagcatggtggtgtgcagctgtattcccagctctctaggaggctgaggtgggagtatcgtcataagcctgggattcgaggttgtcgtgagctcgtgatcacgccattgcactccagctgtagtgacagggtttaaatcagatggcctatacttgtgctggcgtaatttattttgtattatttcatttttatctcctttgttggcttattaaccctacctccattttcattttttgttgtttctcttaaaatttctagtgtacatctttagacttgtcacacttttatgtaatattctaccacttcacaggtagtagaacaacttagcaacagcacacactttcctgtctctttggctcttctgatgcag

SEQ ID NO: 579422 - DNA, 344 bp, Homo sapiens
ccgagcggaacagcgaggtgctcaagtttttatcatacttccagagaatctttttcttccatctcttctatttttggcctggcttggctgggaacatggttggtggttctccagtttcatgtccttattagggaaggcatttgagtggaggataggactccctgagtgtcctccacattggcttgtgactttgctgttgaagactagactgagcacattgaagaacggcaggagctgctccataccgcgcacggtgcagatggtgagcagcaagtgccctggttcccaacccaatgtgctccctgagtggtcttcctctggatgtttctttgcttgttccgctg

SEQ ID NO: 579423 - DNA, 740 bp, Homo sapiens
cggctgatgcagctgtagcggctgagaaggaggtcggctcagcctgttggctagtttgaggagctgctgcgcctcaaacgctaagtccctccttgtggtccatttctgggcactatggactccacagtgtgcactgatgaacgtaagttttggctagaggttagcattaatgaactcccttcaatgtttcatattggtgaacctgggaagcgtgataggctggttgcctgagaggtagtctggacgaaagtatgacagattagcctctgttcccacgttttctgtattttcaagaattctcagtaaaatcgaccgattagatggtgcacatgccccagagttgaccaaaaaagctcatgcagacatgcatctagtggctccttcctagccagtgctaatgaactatcttgaaagaagatctcaaccttcgcttgagagaagattgactcatgctgccccctgtcatgctgtgttatgacaggaactcctcaagaaccacgctgtggtttcagcaatgcagatggtggcaacattcttcacagatcgataatattcagttgtagcagtttgtgatatcttctcagatgaagaggttcgactgggactcaaagcctattccagtatggcctacctatcctcaggtctatgtttctggagagctcataggaggacttgatgataagttaaggagctagacgcatctgaagaactacgatacaaatttgtcccaaaagctccca

SEQ ID NO: 579424 - DNA, 451 bp, Homo sapiens
  misc_feature (77)..(77): n is a, c, g, or t
  misc_feature (311)..(311): n is a, c, g, or t
tccgtagggggggggggttttcccccctcttggcgcgggtcctttttttccctcaaggagggggcctctccctctcnggggggggggggggttctctcacccgccccgggagggtttttcccggggttttttcccccagaacccctccccaaaggggtttttttttgggcgcgggggggccccagggggggagagtccccccctttttttccccccccccccctttttttccccccctttttaaaggccccccccgggggggccctttttgggggggggggggccccccccccccccggggggggtttttnggggggtttttcccccccccccaagcccccttccccttggggggggggggggggggggttttttcccccccttgggccaagggttttttgggccccccctttttgggggtggggaaaaaaaaaaccctttttccccccca

SEQ ID NO: 579425 - DNA, 475 bp, Homo sapiens
tgtcggtggcatgtgatgtctgctgcttagactgatctgtgcattagcagggcaggtcatgatgacttcttggatcaggaacgctacatagatcagtaggatattcaactcgcaggatgtcgcagcccaggatagcaaggctgatcttctgaagccgaaggctcttgccacgccatgatgcgcatgtcgctgagataatatgattgcctctgactgatgacaacttctgagtcagcaacttggtctggccattggcaaggtacgtgtggcgggccaaaatggcagctttaggggaccacaattcgtgaacatgtaatctcaaagtccagcatggatggaaatctcatcaccttcacagaatcgttttctgtcaattcgagcagagacagacacccgcccatcaggaatgaacatgcaggaaacttccttatctttttaagcagacacaggtgccattaaatcaggggtatagcca

SEQ ID NO: 579426 - DNA, 568 bp, Homo sapiens
ggatggtcggctgcctggggacattgtcaccacgtcgccatgacggctggtccccacaggaccagctgggaggactggttgtgctgctggagaagggctggagaaggcaatggcatgctgccgctttgccagtccctagaagtcgcggtgcaggtgatggtgggagccgcgcctccagcgggcaggccgggagtgtactaccatggggcgctgtgcctccgcttccaggcccagcacatcgccgtggcggtgctctacctggccctgcaggtctacggagttgaggtgcccgccgaggtcgaggctgagaagccgtggtggcagatttataccatggacacagagatcccctaaggtcctggcccaggcctgcccaaagagaagccacatctgcgtttgtcctttgagaggactttgactacaatacaggcatgacatcaatgaaaggaaagtcatgaaatcgatgagactgaatccctacggatttcttaaaagccagatttgtagggagaatgaatgtgcaacgtggctgaaatctattttgtgtaataaaaggtgatacaagtca

SEQ ID NO: 579427 - DNA, 321 bp, Homo sapiens
  misc_feature (40)..(41): n is a, c, g, or t
  misc_feature (45)..(45): n is a, c, g, or t
  misc_feature (106)..(107): n is a, c, g, or t
  misc_feature (279)..(279): n is a, c, g, or t
ggcacgaggtaaaggactaaagaaaagctgctccataganncacncgagcgctgctggttgcccatttttatggttatttcttgattatatgctaaacaagaggcnnattattcatgccacccttttttagaccatattaagtaacttcctggcattgcatggcatctgtaacctgtcatggcgctggcgggagtgtggcagtgaggacgaccaagatcactctggtttgccatcttgggttttggtgggttttgggctgccttctttaccgcaacctntttttatcagcaaagtctttacgacctgtatcttgttgatga

SEQ ID NO: 579428 - DNA, 557 bp, Homo sapiens
ggcttgagctacactgtgatcgtacattctatacttggcctatgtgctgctcgcacctgaacatagctggtgcttatgccgagttatttgcgatgagtaaatatttagtttctttttcttcatatttataatgttgatctggcatcctcgaggctgcagctttattagcgttataacttactcatctctatcttaccagcaggctctgtattgttgagattcgcaattgttttgcttttccattggtggaattgaccataatcagttttttaattacataagatgcctgttatgctatttgggggcagcatcgcatgttcatattcgcaagcagtcacatttgtactgtagttcacataacaccgccaactgacgtattctgtagcctatatttttcatagagctcatgagcatttactgtacttgcttgggtcttgccaagatcatttatgccgctgcatagccaacagtgtcttcataccaaaattaaaggtgcgttacctatactgtggcattggaagttgtcagtaacattcacaggtattccatacggtgca

SEQ ID NO: 579429 - DNA, 157 bp, Homo sapiens
tccctcaggaagcgagattgggccagcgggcgtgtgacccaaggcgagcatgcaggggggggaataagtgaaccggaaggtgttaacgcacctgtgggggggcttagggtctgggtccggggcggttcttggggctcacagcctgttccggtggggg

SEQ ID NO: 579430 - DNA, 238 bp, Homo sapiens
  misc_feature (187)..(187): n is a, c, g, or t
  misc_feature (204)..(204): n is a, c, g, or t
tatactacccaccagccttatggcacacagagggctaccgggacacagagtatatatgaactaaaaatctccagcagtgatgttggcattctggtcattccacccttctttttttggcactactctgttgggaacatgttcagggtatctggagtggggttatacgttaggtgatatgggattaganagtggctggtcacggcnttactatttatggtatggtaagggatgtctcgtg

SEQ ID NO: 579431 - DNA, 535 bp, Homo sapiens
  misc_feature (108)..(108): n is a, c, g, or t
  misc_feature (136)..(136): n is a, c, g, or t
  misc_feature (263)..(263): n is a, c, g, or t
  misc_feature (266)..(266): n is a, c, g, or t
  misc_feature (268)..(268): n is a, c, g, or t
  misc_feature (365)..(365): n is a, c, g, or t
ggcggagtgtgttagtcttccagagggaggctggtccccaaggaaacaaagcctgtgtgcgggcagcaactgtgtgcgggcctgggggttgcatgtgtcacctggagntgggcactaaccatccaaccgccgcatncttgtttccacccctgggccggggctttggcccccaaagtgtttaggaaagctttctccctagatcgcactgtgggctggggccctggagggctgctttgtgttaataaaattgtaaggtttgcccnccncncctgttgccggcatgggggtagtattaacccccccccccatttgttcccagccccggaaaagggggtgctcaggtggaggtgtggggtatgcacctnagctcctgctttgcgcctgttgttttgccccaacgcgaccgctgcccggctgcccaaaggggtggatgcctgccggtccccgagcaagcctgggaactcaggaaaattcccaggacttgggagattttaaattttaagggccattttttttaataaaaggggcctttgga

SEQ ID NO: 579432 - DNA, 579 bp, Homo sapiens
taccgagatgggtcatgctaaagaagacaaagtgtagggattacaggtgtgggcgacgcacccagccaaatgacactgattttttaaattaatttacagatcagtacaagccagtgatttttatttttttttggtaggagtccacctgaagtattttgtcagggttcccttatgtggtctttccactgtgttacttaatccgtggttattcccggtagccaagaaatgtgggaacacgatgagcctaaggataagccatgcgtggcaaaaatgcatccataggggatgtagggggcttcatccgtgcagcacaggaggcagtcccgggttgccatgtcaccatactagttaagtggggccgtgttgtgatcaccgggttaggggtggtgtttaaccagtgttcctccattcctgtggattccataaagatgactctgtggtcctgtgggacttattactggatcgcttaagaacccagggcctcccattgggagcaccagaccagtggaaatagggctaaaggggaagaccccttgaaacctggaaggtgttactcggtggagctaagtaatggtggtg

SEQ ID NO: 579433 - DNA, 204 bp, Homo sapiens
  misc_feature (6)..(6): n is a, c, g, or t
gtatgnaatgttacatatttcattttaaaacctaactcatttactttattgatgaatcaaatttccatcgaataagaaaaaacatactgatttatctattgaatttaggagactgactgttatttttaaaaagttagaagcatcctgatgatctaaggacacacacacgctcagaacttttgctcatgtgatagttcctttcca

SEQ ID NO: 579434 - DNA, 180 bp, Homo sapiens
ctccacacagcactaggggcagttttctctggaggagaagagcctgtcgctgaataatcatgcaatacttttcccacttcatcagatcaggaaatcccatctaccctttatgagttctcatggaaagtacccacatttgcaaccccctggcctgactttgtaccttgttgctgtgtggag

SEQ ID NO: 579435 - DNA, 399 bp, Homo sapiens
  misc_feature (22)..(22): n is a, c, g, or t
  misc_feature (164)..(164): n is a, c, g, or t
aaattagtttaaattgaaaatncctgtttcccagaattttaaaatttccttaaagttgagagacatccataaggacagtagttctccaaatttttttggtctcaattacttttttagtctttcaattttttattaataaaaaaaatgtggctgagcatgggttntcacgcctgtaatcccagcactttgggaggccgaggtgggtggatcacgaggtcaggagttcaagaccagcctgaccaactggtgaaaccccatctctactgaagatacaaaagttagctgggcatggtggcacgcacctgtagtcccagctactcaggaggctaggcaggagaatcgcttgaacctgggaggcggaggttgcagtgagttgagatggggccactgcactccagc

SEQ ID NO: 579436 - DNA, 1280 bp, Homo sapiens
ggtgctgctccgatggcgaacgtgctcgcgccccggcgtcgggcgagaggcgagtgtgtggacgtagaggccagcttggtgcatcgcgacggaggtagagattgcggagcgactgggtcgtggttgcgtctgagagcagacccagcatccggtgcctggacaggcagacggccactcgtgggagggacagatgggaggtgagagggtgacagtagtagtaatgttttgagctgagtgtacgtgactcccctgggaggcaagccttgcactcttgcgcacaggcgggcacaggctgtagatgcgatgatcacacgatggtgctgagcgtggttgcgggaataatccgggtgcgccatgggaattaacaatctgacgtcgcatggaaggcgtcgaaacgaatggacaagactgatggcgcaagcgcaaggctgctgtcaatccgcagcaggaaaggtacaaagagacttctctgtatctcaggatgactacctcatgtcgggaggagtgtctaacactcttgatgggtttccatcagtagcgtatgtatggggaagaaaatcctgggctgggaagagggtggatagatgagaagttaatagatgtgccagagagtaaaaatattgtaatgaatttgtgtgaaaggggggccctggaatttactaaggaaacaggttgtatataggtttaggagtgagggagtgttcgaaaggtcccgtggttaggtcgccgaggaaaagtgagataaaggggttaaatttgggagggccggtaagagagggggttcaaaggaaggaacgccttagctggattcggattggatgtaccgtattttggaatgggggaaagtccgagagtgtggagggtatcaataggtctctttccgattaaggaatttaaattatcactgttaagttagttacggggggcggcagggagaaagaggtgattccccaaggggggaatcgtaacacgtaggttaagaaagtattaaaggttgttcccgcttgggtacgtactttgtggattccggaggaccaatagggggaaaggggttataacaggcacggattggcaaaagaagatgtaatggcattagggataggttcggcgaagagtttttctattggacaattcaaaggtggcctatggaggtgagtgaaaagttccgaaaaggaaatagaaggagagtaacagattgggcggcaagggaggggggtttggaaaccgtaggggcaacagggtagggcgaattgggggttctagagaagagagggatttga

SEQ ID NO: 579437 - DNA, 321 bp, Homo sapiens
  misc_feature (264)..(264): n is a, c, g, or t
gcttagtatactacaaaattcaattggcctatataaaaataagatagtaatattccttatatattttggatattaaatcctttactagggatttgattcgcaaatttttttcccccattctgtttctgtaggctctttgacattcttttgctttctcttttggaaaccaggtcttagtctgtagcccaggcttgagtaccgtggtgtgatcatcgctgactacagcctcgactttcctgtgttgtttccttctacaccacccanctcagcctcccaggtaaccaggactacaggtgtacactaccatgcctggcaaatcac

SEQ ID NO: 579438 - DNA, 123 bp, Homo sapiens
cactggcggcacgcgactgcaggtgctgtggcacccgtgcacgcagatgcgcgagcacccgcacaccctgccgctggtaccgatcgcccgcggtgaagtgcgcatggttgatcgaccacgatg

SEQ ID NO: 579439 - DNA, 890 bp, Homo sapiens
atcgaggacgcgtcacgtgtgtgctaggtgttctcacatctagtgatgactgctgtgcgcaccggcgatcgcactgacagtgtttctgtacctgctccgactgtccttagcgatgtcctgtacatccggcgatatctcccagtctatactaatctactagtctccgcaatactgaaaatcgatctactatcgaataatggtgtatgtgttgcaaggtgcatgctgtgtctatcaagactcagttcgccagctatggcagagaatgtaggacccactcactagtggattctcccaacaatcacatttaggggtgtgccgtacaacaatcactgctccacaacttgcttgctatatgccctcagagctactattggatcacttgtatgaaagatgtaaatgactctatgagtgattaggagtctggaatctgagaaatcctttattgcaatgatatgttggctgatttggatggagagtggtgcgtgagaacaaggtcaatagagagttgaatcaacattaagagagtgtaagtatcattgatctcacgataacataattgtcaaggaatggatcaaagcctataaagttctgctcgttcagaggcagaataaatccctgtgttagtgggggatgtcaacaactggggatactgcatgatgaatacgcctttattgattgccagtacatgatggcgagtctgacagtgcccctgattgcaaccccaagtgactgatttgaccatcaattaaaagctccgcgatggaagaatgggattatcggctggttgagccctgggagggacggtcataccatagtgttggcgcgccgatttgcattgcttacatgtatgggcattcaaatgaaagccctgatgggggcgtgatataact

SEQ ID NO: 579440 - DNA, 735 bp, Homo sapiens
atagctgttctgaggatccccactacagtagctatgccaagctttaaagaaaatcaagtggctccttctgcatataaacaggaaatgtattgctttacagtaaacattcacatacatcactcttcgtgtacttttcaggaaagaagtacaaaagcagtgccctattcacatgtgtggtttcacagaacttaagaagagttctgcaaaacccgagcccaagcagaagtgtattaattcgttctcacactgctataaagataccacctggatactgaataattataaacaaagtggtgtttagttgactcacagttccacatggctggggaggcctcaggaaacttccaatcatggcgagaaggggaagcaggcacctctgtcatggaggcaggcaggagagaaagtgaaaagcccagaggaaagccatttataaaaccatcagatctcctgagaactctctcactatcacaagaacagcatctaggaaactgccaccatgatccaatcacctccctccctccacacgtggggattacaattcaaaatgagatttgggtggggacacagagccaaatcatatcacagacagagtaaatttgtcctttcttttgcctttttattcttttgggaccctcaatgtgctgcatgatacccacctcattgatgagggagatcttcggtctactgattcgaatgctaatctcttctgaaaatagcctcacagatacctcaaga

SEQ ID NO: 579441 - DNA, 275 bp, Homo sapiens
cactggctgctttgtggcctatacctttgcttttttttttggtgtggagcctgagtctcgctcctgtggcaggagctggagcgcagtgtatgcattcctggctcacggcaacctcccccttccgggtacaggcggttctccggcctcagcctcctgagtagctgggattgcaggtgtgcgccaccacacctgactaattttcctgtatttctgtttagtggagatggggttccgctgtgttggccgggctggtcttgagctcctgacctcaggtg

SEQ ID NO: 579442 - DNA, 148 bp, Homo sapiens
  misc_feature (73)..(73): n is a, c, g, or t
agcagctgatgaacgcgctggagtgaagatgatcttacttcaggacggatctcagcatacgcatttgccaaanctctccgcatcattggggctccttacaaagtgcagcacgcctgtgagatggtgatggccatcctccgtgaacgtg

SEQ ID NO: 579443 - DNA, 178 bp, Homo sapiens
gcattcggcagagacatccctgaaatgtgcacatttgctgtttgaggcatatattggcaccctgggtttggggtgcggattgaggtatgggaaggcaggctgtcttcatgttagagcatgcccagcagcagcatgagtgtcatcagaggcttgtggagggtgtttgctatgtgatggg

SEQ ID NO: 579444 - DNA, 1060 bp, Homo sapiens
cacaaggtgtcgtgaaaactaccccttaaaagtccaaaatgggaaaggaaaagactcatatcaacgattgtcgtcattggacacggtactattcgggcaagtccagccactactggagcatctgatctactacaatgcggtggcactcggacaatagagaaccatatgaaaaaatgagaagaaggaggctgcgtgatatgggaaagggctccttcaagtatgcctgggtctggtgataaactgtaagacgctagagtcgatgaacgtggttgatcaccacttgatactcgtcctgtgttggcacagatttgtaggaccagcctacagtaactgatgctgactagtcataagagtgccccaggtacacgaggagaacttggattcaagaagagcaagtggacttaccaggggagcgatctacagggccttgactggttgctagttccgtgatctggtttgctcgctaggtgctttggtgaacttatgagagctgagtatactccaaagaatggcgcagacctcttataccccatgccctccttggcattaccacacctgggttgtgaaacaaccgtaacttgtctggtgttgacaatacatggccttcctacgtgagccacgccttacagagcagaaaagatatgagcaccatggtctacgtagtctggatactttacattgcgaaatagtaggctacaatcgcgggaccagcagcactgtgtgccaaatttctgggttgggatggggacaacttggtggaagcgaagatgctaacatgcctggtcgaaggatggaaggcagccgcatgtgggatggccggtaaccctgctgttggaggacggaggtctacacggacttgtgcaatgaagaccggaggcggcgtcccggagggtccaccatgcggatgggggtccctggcagggggacctgttccacccgaagggagccctcccgcatcaccgagaaaatgggagacaaccacacatcggggggacccaaaagtgaatgaggaggagaacaacatagaggaaaaacacacataaacggaacaaaaagcaaa

SEQ ID NO: 579445 - DNA, 107 bp, Homo sapiens
ctctagaggatgcccgctttggatgcggcctattttgctgtaacttctgtttaaaaacaaaccaaaactagccaggcatggtggctcacgcttgtaatcccagcact

SEQ ID NO: 579446 - DNA, 210 bp, Homo sapiens
cccagcatgtatgcgcatgatctgagacggaggacactgatacgctcatgctcatactcgctacgacagactgaagcgatgcagagaagtgctgggccgcagtcaatacttgtgccagctgtgccgactggagcaaggaaggaagatctctgggctaagagcaccctgtacttgggctctaatgctagggccttgagcgcttccaagagc

SEQ ID NO: 579447 - DNA, 164 bp, Homo sapiens
  misc_feature (73)..(73): n is a, c, g, or t
  misc_feature (158)..(158): n is a, c, g, or t
tcctccagggaaaggggcacacatatctgtcctgtcaccaaggcaaagctggaaggtctgcagacctacccancatgctgctggtgtcgtagtcaccaaccacagggcatcattctcgccatgagaattcatgtacatgtctagcatgtgaaccatcntaaggg

SEQ ID NO: 579448 - DNA, 567 bp, Homo sapiens
  misc_feature (41)..(41): n is a, c, g, or t
ctagaggatccccgtgataggcgacatttcaaaagggggtngcatagaccccggtatcaaaagatgtgtgtaatggaatattttaaaagacagttccccagagggcagcccagtggagaaacatttttaaaaagagaggaaaaaaaaaaaaaaaaggctacgggggggataactttatttcctattaaataacccaaaaaaactatggggcactccccctcgcatcaaggggtcatataaagctcaagcagcagcacatcgggacgcacccatcaatcctggattctggagtcagggcaccagagggctccatggttggagctccagggaaagcagctgggacaagagtgcctttaatcctaagaatatccattaataacccgggcaagccaactcagtcattcggctacacccaaaggattgacccaccacagtgaagctggtcattaaaatacaacatcagagattgggccaagattgggtacctctgaagccaagagcttagaaattataagccacttaaaaccatatctggtccctgcataaaagggtatcacaagccagata

SEQ ID NO: 579449 - DNA, 1324 bp, Homo sapiens
cggttggcttcgtggtcaccttcttgtgcgctgcactctccactcttggtggtggcggctactccaccatatagtgtggttttctctcctgggggtcagtcgcgtttgcacactgggtcgctctgtgttggtacatcacactctgtagtggtgggcgtcacacacaacaatgtgtttgtccggtgtgtctcctgctggggggcttctccccatactcaccctgtgctaccttgcgctttccccgatactctggtcttcgaggcacccctgttaccttcatcaccccgtgtttgcttacatgtgttccggcttcctaatcttgtggggccttccgcgctggagggctcagcacacctaccttcttggacacgtgaccccttggatcaagccaggccctcgaatgtgtcagtaccttgctggtatggtaccagggatgccgcgcaagggcctcgcaacatattctcacatctgctgggatgcccatcggttacacatcacgggacatacaccatgcaggatcccggagttcctgctgtatgcagcacgggatctccatgctgatggtatccaaacacagagacccactgggaacaaatgagacacaatatagactactgagacactgtgtgtacagtaggaccattgcactcacacccatctggtagaggagcccccggtataccaagcgagccagtgtgtgttcagacacacacatcacagcattgactcggctaatctgaggcccttccagtagctcggcagcagcttcccacgctcctccccaccaaatccggggttctagagttaatggatgtggcgatgtgtcagttataatgcctcagtcgtgactcctcaacttcagcagcaatttgagcgcggatgagaggggaagagcgagtctgccttttggaggcccccattgcacctgcagcttgtgatgccctgtccccttctctcctgtcctcaccatatgcccggatctccattctacctcgccctgctatgcaagtgcccctgtggctttgtcgcacaacccacgctcagccactagaagcatgcagctggggtacgagagtcaatcttgaagaatgcatcgaagtcagcgtctctccattccagaaacgacaccccactcttcgtttgggcgtataatgtggaagctggtttcagccctggaccctccactgaggagaggatgtagacaggtgggcaccaattctctacgaggcccttcgcaggcactggagaaggcattttacacacacacaacactatacacacacacacacacacacacatatcacatattcacgggccctgctga

SEQ ID NO: 579450 - DNA, 852 bp, Homo sapiens
  misc_feature (25)..(25): n is a, c, g, or t
ttgtattttagatcgcttacgtatnataaataaacaaactatattctagctttattctggtaggacttctggcgatgaacagaagcttccggtaaataagggccccgtcggcaatacagcatactgctgtcacaagtgcaaacaactggaaagaaagacaagtgttactgcccaaaccatggaccccactcctgtcattcacacaagttttaagtggtctgcctaccagattcctctcttgctagggtactcggattgctccctgtgcttcatctaatactaactgggagagacttcatagatcatctcatttcttctcattgctaagctttctatatacttgcctatacaaagagaaaacacccttaagggagcagaaaaataataaagctatgtgggctctgaaacagataaatgaatatcccccgaatatagacataatttaattatattttagacttgttttgcatcttacagtatataacgacttagcttacgacgttctggtattaactgttatattcaattactttctttatgtttatcgttgtgtgtgataaaataattaatcgatgctatgcttttttgttctttttatttcacttggctgtgagctgttatcttacgtgtcaaattgtttattgtaatgtagtaatttatgtacatcttctaaagttaagacacagctcagaaacgtcacgtttctgttttaagcgcgagagatctttttatcaaaattcaatgttgttcatgtaccaaaattgtctcttttgatattccgcctgatatgtcatagtatatatattgttctgtagtaatagattctaggtggatttgcacttgtttgttttt

SEQ ID NO: 579451 - DNA, 626 bp, Homo sapiens
  misc_feature (55)..(55): n is a, c, g, or t
cagtgtggaaacttgttctttcactctgcaataaatcttgctgctgcgcactttntgggtccacactgcctttatgagctgtaacactcaccgggaaggtctgcagcttcactcctgaagccagccagaccacgaaaccagccagaccacgaacccaccgggaggaaccccacggggaggaacgaacaactccagatgcgccgccttaagagctgtaacactcaccgggaaggtccacagcttttctcctgagccagcgagaccacgaacccaccagaaggaataaactccgaacacatccgaacatcagaacgaacaaacttcggacacgccgcctttaagaactgtaacactcaccgcgagggtctgcggattccttcttgaagtcagtgacaccaagaacccaccaattccggacacgataggagaggtctacaaggcatttctgacttccctaatacaaaaaaaaaaaaaaaacggaatcccgggtagggaagaaacagccagaacttccaagttcccgtgaattaaaagccgtgagaaattcagtggttaccctttaggaattcacattcccattcgtagtcagtgtcttatagtccaaaaaaccagagggtggggtgtta

SEQ ID NO: 579452 - DNA, 364 bp, Homo sapiens
atcatgccacaaggtaagcctgaagactagaaagaggagaaagaacagccttagaaagaagtggctaaaaatggaggacaaacacctattcagaaggaggacataccaatgtaatgaagagcgtgactaaataagtcaaaataatagatctagacagaagagaataaagaacccatgaaagaggttttgaaagaaactccgcctcaggaagtctagaaggaagttcagaaggaagaggtcatattattacttttaaaatccagaaagagggaataacactcgatgtcttagggctggagatgacacttgagtgtcatctccggttccagttcccatgtcgaggtcagcgttgtggggatcctct

SEQ ID NO: 579453 - DNA, 148 bp, Homo sapiens
tgactgtcaaggcattctatggttcgtagtcaatcacactgaaatccggaggctggtgtgagaactcacgagcggacaccgtgcatttaatattttttgcacacccacacagcaggccaaagtggtcaggcactctcctaacacagac

SEQ ID NO: 579454 - DNA, 412 bp, Homo sapiens
tgaagtgccaattggtgtaaaataagatggacgtacttctgctcatagtctagaaatgcttggtgcaggctggtggggcagtctgctggtgtagtcatgtggagacctgagggttcccattatgtttctcggccatctcctaaaggtgtgtgtcttcacctacacggcgatacaagttcagctctgtatgtgtgcggcccttaggaaagggagaataggaaagaggcgggtgagcagtttcctttgacacaaatgttgtccccttgattcatatgtccaagtgttaactcgcgcagctaactcaggatgtgaccttatttgaaactagggtcattacagatataattaaggtgatctgggcgtagggcgggcctctaatccaatgtgactggtgtccttataaaaagaggca

SEQ ID NO: 579455 - DNA, 398 bp, Homo sapiens
tcgatcctagaggatcagcagttgcaggtcatgcctcagacaagattgaaaacttggtgccggttaaagatcgaattcattaaaattagctttattgcagatgtgcttgcaagtctccaggggaactttaaacctcagcaaacagaattttttgtggtgccaggagagactgcacgggcgttttacagagcctaagaatctccttactgacaaaccagatttgggaatttcctacttacaattatggtcccatttgaagctggacagtattccattaaattacagctgtgtgacgattcctaagtgtaggaaggcctgtgaaacattacactgcagttaattgggtgggcctaaggactaagtaattttcctcctgctgaagtttaaagtctatagta

SEQ ID NO: 579456 - DNA, 264 bp, Homo sapiens
tgggtggatcacctgaggtcaggagtttgagaccagcctggcgaacatggtgaaaccctgtctctactaaaaatacaaaaattagccagatgtggtggtgggcacctataatcccacctactcgggaggctgaggcaggatcgtctcttgaaacctggaggcagaggttgcagtgagatgagatccaccactgcactctaacccaggcgccaagagtgaaactcttgacccacaaaaaaaaaaggagggaaggaaaatgaaaaa

SEQ ID NO: 579457 - DNA, 970 bp, Homo sapiens
ccaccaacatactcccatctgtgaaaggaaagagggaggtaaggaatacctgtccccctgcacgagactcattgacctgaggcccttctctccagacccctggatgcagccatcacagtccttaccagcagagcaccttagacagtccctgccactggactaactagaacattaggaccactgaggcccagagggcctgcaagggagatgagtgagagcacagaccctgaccctagagagaccacaaatggaaatgggcagagcagagaacatcccatgaaggccaccgcccaggactcagtcacatgagacaagcaccgggcatcatgccaacccatcacaccgcaaaaaagacgggacgagagagaggcatccaagaacaaacatagtaccagagaaagcccaagagaaaaaggcatcaaaggacgcagcccacaatacacatgaacttgctctaacagaagacaatccaatgcaagggacaagcacaggcacacaacgaaccaaagaaagagtacacaacaccccaaagacaacggccaagatttccatgtgcacatgaagagcatgagacactcacccactacacaacccatcatcatacgacagaccacatggcaaaaaaccaacgtggatcatacaagaccccagcccagaaagaaaccatacaatccaaataccacacaattaaggataacacaacaaccgacagacacgaggagcgaacggactttaccccatgaactggatacacccaaaggaactccccacatcgaacgactaacatgacatgggacccgaaaccacgggaaaaaggatggcacgggacacaatgggcccaagcggcaggtagcaggcataaacgataaggagagaacccatataatagagcacacaacagcgcacaaacatgccagtggatgagtcacaaccagcaggaacggcacccacaagaacacggagacagaca

SEQ ID NO: 579458 - DNA, 108 bp, Homo sapiens
tgtactgtcgatttgggaataaggtatctgtctcatagaatgagtatggaagagttccctccttatcactttttgtggggaccagtttgtaattaatcagtataagtc

SEQ ID NO: 579459 - DNA, 200 bp, Homo sapiens
tgtggtttgagtctgttacgaaggacctaaggcacatggctggtgatctttgcgtcatagacacgggtaagctcatggtgtaactcctccttagctgtaggtttccaggcttggcacagaggtaagggcagaatgttgggggtccctgtggatctccccaaaaacttcctccagggcaggatttcccacccagtgccagg

SEQ ID NO: 579460 - DNA, 193 bp, Homo sapiens
gctctggctggatgcgtccccctgattaggccaatctgtgctctcgtcagcctgcgcctggctctgcccctccaggacaggtatgggatggggctcactgttgtttgggctgagtacccccctccagtgaggcaccctgcagcagatagcatgtactgcgtgaccgacgcagggtggctgtgacagcagcaat

SEQ ID NO: 579461 - DNA, 178 bp, Homo sapiens
tcttaatgacagcatcgcaggtgcacacatcacagatgatgcccgcgtccatcttgaggccgtcaggagaaggaaggtttcagatggatgttgcccattctggatcctccgagcagctggcacacgtgacgtcaccatccacgatgctcaaagggcccgcagcatcgcccctgagatt

SEQ ID NO: 579462 - DNA, 665 bp, Homo sapiens
catgtggctcacacctgtaatgccagcactatgagaggctgaagtcaggaattcgagaccagcctgaccaacacggcaaaacccaatctctactaaaaatacaaaagttagtggtgcatggtttctactaaaaatatttaaaaattagccaggcgtggtggcgggcacctgcagtcccagctactcaggaggctgaggcaggagaacggtgtgaacccgggaggcggagcttgcagtgagccaagatcgcaccactgcgctccagcctgggcaacagagcgagactctgtctcaaaaaataaaaataacaatactaaactacaataaaaataaagaatcgggtcaggcacagtcgctcacacctgtaatcccagcactttgggaggccaaaggcagcaggatcactttagccccacgaattcaagaccaggctggcaacacagcaacatctcatctctagaaataaaacaaattagccagttgtggtagcacatgcctgtggtccagctaactaaggaggctgaggcaaggagacatggcttgagcacaggcggtgaggctgccagtgcaccaatggaatcggtaaccaacgcactcccagccctaaggtgacaggagcaaaacctggttattcagacaacaacaaacaaccaaaacaacccaac

SEQ ID NO: 579463 - DNA, 474 bp, Homo sapiens
  misc_feature (28)..(28): n is a, c, g, or t
taatatcggggcgaataaacccaagagnttaattttgggaagtgaataaagagggctttgggtggggaaaaaaaaaaaaaaaaaaaaaaaaaaacacatgtgtgtgtgcggcggcgcccttgggcccccgcgaaaaagtttttgtagacacacttcgcgttgggggcggcgggggccccggtagggagaagaggaaacatcgagggtcacacaacgtgggttcctcgaggagaaaacaccgcgggctccacggcaagacgggcggcggggaaatctcctccaccaataataaaaagaagcgcgccgcggggaggacaccgcgcggaggggtcggctgagcaaagacaaccaccgacgagagggcaatcttccggagagagcactcaacggcgggaccattctcaccaacacaagggagctcaccgaagaggaagctcggcgaatatatcacaattgacggccccgaagatggag

SEQ ID NO: 579464 - DNA, 239 bp, Homo sapiens
cagaaggggctgaagactgtgggaccgagagactagcagacgcacttaaaatgcattatagctcgttcctcgctggagagagagaggtggtggtgtacttaatggtggaactgccgcctccaacagagctgagagccacccccaagtggctctgcacactgctggaactagaagccaccatccaagcgccaacgaccacgtgccataggacgtagctgcattccatccacaccaggacc

SEQ ID NO: 579465 - DNA, 988 bp, Homo sapiens
agttatttgatatgggtaaagcgagtgggagtaccaagatgtcgtggatcgtaatgatattgtacaagtgttgttataagtaaaagtggacatgaataaaattcagaatcaatgagtgcgtaaatacggaaatgcttctgatgattgagccatggttgatgaagagggtgatgcaagagacgaatgaattatcctgagggagataaagagacaattgatcaggaaaatgcaggatgtgtaaacttttcacttaggaatttctcggttggtatttgctatcgcccgatggtcgttgtgtaacacaaaatagtgatcgatggacgagaaagagaccaacttgaagaaactggaacaacgatatcgcaataggcgagaaacgtggatggatacttgtaggaaatgccgggtgggcagaaatagccacgacacttgtgtcgtgctagagcttcctcgttgaccaagtaatctcccactatcttaaatccgcgaacttgactcgagtaatgaactacaacggcgattttgcggccgcggaaggaggactagccttctgacttaatccactacagtttgtcgaattctaaatcgcatatattgggtccccaatttcacctttgcttgctgaattcgcatttttaacacttttcccaagggcccaacaatgaccaagataacgtgaatggctcgtggaaacattgacacacgctttgggtccttccaacaaaatttaatcaaaacaccaaaaatttgggaggggagagacgtaaagcaattgggcctccattgtacaaggtctatcaagggattatcacaagcaaggtctttttcaaaaaaactaagaggagaaattcaaaaaaggggctgaatggaaggcttggaaacattgggggttgggctggtaatcccaagttaaaacttgggaaatttctggtagttaagtgtggtccttatcaaagaaggggcaaggctctttggcattaaagcgaag

SEQ ID NO: 579466 - DNA, 159 bp, Homo sapiens
gcttcgagttgccctcatttaataaatattatagtagcatataccatctcacttctaggaatactagtatatcgctcacaccgtcatatccgtccctactatgcctagaaggaatagatactatcgcgttcattatagacaactcgaaagccccaagcg

SEQ ID NO: 579467 - DNA, 819 bp, Homo sapiens
agcgggcgagcgcgcgcggaccgcgcacaggcggcggagccggtatgggcccgcctgaccctgggcgccgcgccgcacgatgcaccagcctacagccaggactgaagcttcaaggatggctgaccatggaccctgcagggacatcagccccacttccagtcaaatggtgagtccttcagtgcacgcgtggtgctgtggattatcctctcatcattccatgtacatccccttgagacgtgagtgtaagtgttcgctcatgctacgtctcagctggccctacctattggcgcgagcgagctgattgccttacctccatgagctgtggatgcctcatccgtatagcgcaaattggctccctcctctctctcaattccatcgatgggcaactgtgcgctccgtgtcattggcgaattggtagtcactgggaggccgtgctgtaccatggtgcccgagaagtaggtgtccctgctgtgcctaccatgattttcaaggacccgtaacccggcgtatcactggcgcccatgggttgatgcactgtgccacgctagccgcacatctatcttcactgcgcttatgtaccagaactgaacggccttccctgctgtggtcgcagccctgaccttctgacgctctacgcacccatggtggctggcgcgctggtccgtctgggcaccgtgactgtgatcaggcccctgggagcttatgcgtgacacagctgccggctcagcatgtgtcgtaccgggagctgggtgcctgtgttctgaactgcagttggctcacgggtggctggttgctcacttgtggctgggcttggggccc

SEQ ID NO: 579468 - DNA, 747 bp, Homo sapiens
tgtgcatctaaaaatattttaataaatactcaagtgctctcagagaaaaaaaaaaaaaaaccgggcttttctactattaagattacactggaagtggctttaaattccaatcatcttaggatcttgggtgacatcacagtggtggcatatttcccactggtcacgagacatccagtgctggctaacagtggatcatggcccagtggtctcccaccactaaccagtcccaatcttgatttaaaacgaccaaaatatgcatatgtcctcggggaattacatactgggctattgggaaagaaacctctggtgcttcgggtgacaacacattcaagacatcgacacatcgtggcattcgggccgcagagaccgtgagcgggcgagggggtactggcggccccctttttgtaacattacccaacagtgcggtgctccaaaaacctcaactgccaatcgccaattatgacgaaaaacctctccgtttaatagtcagccgttttgttaccaagcacaaagatcggttgtgggggccacaatgtttttgccgcccgcaaaaagggacaaacgtttcgcgtgattaacgacaacggctctgaacggtagtgtttatgacgaagtaactaagcaaatttctctcttgccaaagcctacttaccgcacgctggtgggggagtctaacttatactccccctataacaggcggggggaaaacgccccatcatgtacacctcatctcctgtgggggaagca

SEQ ID NO: 579469 - DNA, 319 bp, Homo sapiens
  misc_feature (291)..(291): n is a, c, g, or t
cctcttggaatattcagcctaaaaacctcatagggctatgaattcccccgaaattttcatttgccatcaggccgagcttttaaaaaaaaattgttctctaaccaggattgtaacaaaagtgtaaaaactgtttcaaagttgaaagttggtggggcaaatatgtaaataatgaactgtatttttacaatgatccccgcatgactatttccccccctttttaaaccccaaatctgttttccaaaaacgtcccccgcctttttcctgtggtttcttaatccagtaattgtattnctgcccttaaaggatgccgtttttttta

SEQ ID NO: 579470 - DNA, 956 bp, Homo sapiens
  misc_feature (3)..(3): n is a, c, g, or t
  misc_feature (67)..(67): n is a, c, g, or t
  misc_feature (112)..(112): n is a, c, g, or t
  misc_feature (175)..(175): n is a, c, g, or t
  misc_feature (185)..(185): n is a, c, g, or t
  misc_feature (234)..(234): n is a, c, g, or t
  misc_feature (262)..(262): n is a, c, g, or t
  misc_feature (265)..(265): n is a, c, g, or t
  misc_feature (282)..(283): n is a, c, g, or t
  misc_feature (285)..(285): n is a, c, g, or t
  misc_feature (342)..(342): n is a, c, g, or t
  misc_feature (347)..(349): n is a, c, g, or t
  misc_feature (372)..(372): n is a, c, g, or t
  misc_feature (382)..(382): n is a, c, g, or t
  misc_feature (386)..(386): n is a, c, g, or t
  misc_feature (395)..(395): n is a, c, g, or t
  misc_feature (403)..(403): n is a, c, g, or t
  misc_feature (407)..(407): n is a, c, g, or t
  misc_feature (418)..(418): n is a, c, g, or t
  misc_feature (430)..(430): n is a, c, g, or t
  misc_feature (435)..(435): n is a, c, g, or t
  misc_feature (439)..(439): n is a, c, g, or t
  misc_feature (445)..(445): n is a, c, g, or t
  misc_feature (450)..(450): n is a, c, g, or t
  misc_feature (460)..(460): n is a, c, g, or t
  misc_feature (477)..(477): n is a, c, g, or t
  misc_feature (485)..(485): n is a, c, g, or t
  misc_feature (488)..(488): n is a, c, g, or t
  misc_feature (510)..(510): n is a, c, g, or t
  misc_feature (528)..(528): n is a, c, g, or t
  misc_feature (534)..(534): n is a, c, g, or t
  misc_feature (567)..(568): n is a, c, g, or t
  misc_feature (576)..(576): n is a, c, g, or t
  misc_feature (579)..(580): n is a, c, g, or t
  misc_feature (582)..(583): n is a, c, g, or t
  misc_feature (586)..(586): n is a, c, g, or t
  misc_feature (594)..(594): n is a, c, g, or t
  misc_feature (878)..(878): n is a, c, g, or t
  misc_feature (918)..(918): n is a, c, g, or t
ggnccaggcagccgagccgtccgaacagctgggctgggagcagcggaacccggagctgggaatcggnagccgggcgcggggagctgcgcaaccggggcggagcacgcgagcnatgatgtcgacgtacaagcgggccacgctggacgaggaggacctggtggactcgctctccganggcgacgcanaccccaacggcctgcaggtgaacttccacagcccccggagtggccagangtgctgggctgcacggacccaggtgganaancggctggtggtgttganngnacttctggcggcaggactggtggcctgcttggcagcactgggcatccaataccaaanaaaannnccctctgtgtgcctgaacgaacntgtgtctcantgancaactccancttgaacnccanggaccccacantggacccctgcnatganttcntcagcnacgcntgtaggggcnttatcaaagccaacccngtccctgnttnccactcacgctgggggaccttnagcaacctctgggaacanaatcangcaatcatcaagcacctcctcgaaaactccacnnccagcgtnagnntnntanagagaaangcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaantgaaaacgagaacgtgctgaccggatatctgaactacatngtccagctggggaagctgcttggccgcggggacgagga

SEQ ID NO: 579471 - DNA, 359 bp, Homo sapiens
ctggtgtaattagaggatccgtggcgtgaggtagtcatatgtggttattatttgaggtgtgtccttcaatacctagtttattgagaatttttagcatgaagggaaactgaatacattgaaagtcttttctgtatctgctgagataatcatgtggttttttgtccttagttctgtttatatgatgaatcacatttattgacttgcatatgttgaaccgatcttgcatcccagggataaagcctacctgatagtggtgtattagctttttgatgtgctgctggattcagtctcccagtattttgttgaggatttttgcatctatgttcttcaaggatattatcctggagttctcttttatt

SEQ ID NO: 579472 - DNA, 441 bp, Homo sapiens
  misc_feature (54)..(54): n is a, c, g, or t
agtaagtaggagaagaaagcaaaggttctctgagagcccatgactcttcttagngaagacttagtaattaataacaccaataggtaataataatattgatcattcatcaagcacttgccaagagtcaggcactatcctaacattaccctttggttcaggcactattattttttccattttacaaaggagtaaattaagactcagagagattaaatgacagagccgggttctaacacaggccgagctgcatgcaacacctatgctttcaatttctatactcactccatcaatttgcttttcttggcttctggaccttgacaaagccgctctctcagtctgtacttgttagggtcctccagagaaatagaaccaatatatacatatatgtactccacaacataggatggggttacatcccaataaatgtatcataatatcaac

SEQ ID NO: 579473 - DNA, 253 bp, Homo sapiens
agacacagtaacaatcaacaaaatgaaaaggcaatgtacagataaggagaaaatatttgcaaaccatatatcaggcaaggttttaatattcaggatttaggaagaactcatacaactcaatagcaagacaacatataacctgattaaaaaaaagtggggaaaggacttgaatagacatttcttcaaagatgacagaaaatgaccaacaggtatatgttgtcttgcatttgagcttgtgtgttctttggttaat

SEQ ID NO: 579474 - DNA, 434 bp, Homo sapiens
ctgctactaatcacagagaaaaatgtgaagaaggaggagaagaggaaggctagaagcctgagcaagtgagggtagaaccttttgggactggcctttgaagctctggccagggatggggtgggggccaaaaggacagagcctggtatgtcttcatagtcattgagaatgtggagataccagttttgggtggggggtgatcaccaggggacctagggagatccccttcccaccccctaagttggctacagagtcaatcctgccccctctcctatcacttggtgctaacaagcacttcagtagggttggtgcccagggtaggaatgagagtcctcaggtatgaattgagtttgtatttctagaaccctgggtttttacatgtttggtctttttttgttttggtttgtcaccctcgataaaggaagtatattcatcca

SEQ ID NO: 579475 - DNA, 673 bp, Homo sapiens
  misc_feature (317)..(317): n is a, c, g, or t
  misc_feature (335)..(335): n is a, c, g, or t
  misc_feature (527)..(527): n is a, c, g, or t
  misc_feature (531)..(531): n is a, c, g, or t
ctggagggcagtgtgggcctcccggatggcggcgactcggtttgcgcgtctcgtagccgggctgccggccggggtgtgttggggtggcgtgggtgagtgcggccggcctggcttacgggaatgcccttccgtccgtttggaaatcccatgggaccatgtggcgcccctgccctctgggcagtgtggatggggctgatgtgcctggagctgtggcccatgcttgcctctgctggtgatgtgctgatgtatgtgtgaaactgcactgtgtgcatgttgcttgagaatgcctgtcttgtgctaggtaggttgtgcttgtnagctttcctgtgttgatncacatgctgacagtttatgtgtgaaacctattgtggggaaaactttttctagccttggttgttttagggttgagagccctgtaaggtgagcagtgagattggctgccgatgtggcccagatggggtcctgtaagcagctttgggtttacttctggttttaacaagtggtaacctttttgtgcagatcgcatnactnttcctcatggagagttagtggccagtttacacgagtggagtctctgtggacgtcttggcctatggtatcccccacctggagcacgagtgcgagtgcgacacagtacatttggtagctatcggagacgacgtctcaaggccgt

SEQ ID NO: 579476 - DNA, 347 bp, Homo sapiens
  misc_feature (13)..(13): n is a, c, g, or t
  misc_feature (213)..(213): n is a, c, g, or t
  misc_feature (266)..(266): n is a, c, g, or t
  misc_feature (270)..(270): n is a, c, g, or t
  misc_feature (306)..(306): n is a, c, g, or t
tttcggaacaggngattgcactgggggccatggtcatgcctgtaattccagcactttgagaggcaaagacaggtaggtcactggagctcacgagtttgagaacagcctagccaacagatgggagctacttttcccagcctttattttctttttcttgttttttttttgagatggagtcttgctctgtcgcccaggttggagtgcagtggcagntcctcagctcactgcaacctcctcctcccaggttcaagcaattctcctgcctnagtntcccaagtagctgacactacagttgtgtgccaccanacctgggtaatttttttgtgtttttagtagagactgggttt

SEQ ID NO: 579477 - DNA, 694 bp, Homo sapiens
cagcaatgttctagagtctggtctttccctttcctgcagcttcgggtccttggacctttcctgtatcctattcacttgggagtgtctgtcagcttgagcaccagttgttctggtgtgtcatttgattctacttgtagcataatcatttatacgagctattgggaggttccaaaccctacctagatttgtgtaggtgatgtatcaaattgagcaatataccgtctcatctgaaaatagtagcacacagccatatataggatatcacttttgctaaggactgtttcttcacattgagcagagcaggcatataatggtggcttatttagtctaaggtctttcatttctttatacctgattttcaacataacacgcaatgtggatgtcgagtagtgttgaagaatggtgctgcgtcctgacaagtgtatgttaactgtgttacattttgctatctgcagaattcatttctctacttactgaaccttttcctaacgttaaacactgtctttcgaagtctcgcttatttctcgaggaatacgttcgtctgtaactagaccctatgcacccttttacatagttactctctggaacaaggagggatttcatgtagatgaactaggaaatgcatactcacataagccacaaggttctacggcagaaagccccttggaattctgtgaccaacaggagcaagaac

SEQ ID NO: 579478 - DNA, 975 bp, Homo sapiens
gctccaggtagcaatgatgagacccttttatctgctgttgcagtgctttgcacacaagctctgcgcccaatcacagggcaagtctccgctgctgtggcaaaagaaccctgctgttgtggcttaacacatctcaacccctctgcaaaggcttacatggtcacagatgacgacatcaggaaccaggacgagcgagtacagccaagtaccgcacagacacattggcacacgaagccactgactggcagaccatctgtgtcgcgatgctgcctgactacagaagcacgcatgcgactactggcacacactgcgacacgcgccagactgaagcctaagaactactgattcaggtaacctctgcgaacggacttttacaccacagcagaaacactttcctaagacaattggaaccaaacaaatgtttccactgtggccttcaggccttgtaaggcaaacaccacaattggtacccagagccacatacgacgcttcttgttaactaaggcacttaacccaaatggccctttcacagcatgttacttgtcgcgatcgctatactactctagttacttcaaaacacaattcatgttcgcattcagggaggtccttaggaactttagcacattaaggccttttgggtaaagtatttcaggcagggaccccctaagacatgaaggcttgagcctattgggaatggccagggttgcaacatcctacctggaaaatggttcgcaccttaccgtttacaaaccatttgggtacccccccacaggttctcacataatgaaaacaagtattcagggaaattcttaactacattttatcccaggttaaaggactaatggtgcacttaccactggtgattctaccccatattcgcaaaaccttaattgccaaggggcccacctggatcacattcttcccaatcggacctgttacgcgacccttaaactggactaatattacactatagcacca

SEQ ID NO: 579479 - DNA, 342 bp, Homo sapiens
tttcagggggccctggaaaatgggggttcctgtcccccgggcccttttccccctgggggaagggggggccaaggaaaattttttgcggggccccccccccgccctttgggggggtgggggggcccccccttccccaggggcccccgtcctttaacccaacgggggggtgggacattaaacccaagggtgggggggggttttaacccccccgcccccgggcttggggggccccttggccccgaaatttggggggcccggggcgggggaaaaaattttggccccttgttttaagggggggggggaaacaagggggcccccctttaattggtttttttttcccca

SEQ ID NO: 579480 - DNA, 1280 bp, Homo sapiens
  misc_feature (263)..(263): n is a, c, g, or t
cggacgcgtggtgtacaggaccgggaacttccaggcgcggttcaccaaggtaggcagggacccttgtcctacgtatgagatactgttgactgtcctccgcggagcccacgggtctcatcagcaatcctcgggctcagcaggtccccgtatgctcgaccaaggtgcgagaccaatggtgggatagggatgacgacgtacccaggaaagcgtctaagaggcagggtgcagtacctgaatggagcgaggcaggctcggcgggggcngccgatggtatgtgggccctcgtgaacctggtgattgatcttccaggggtctccttgcttgcggaccaggagtctggcgcttcccatctcgaccaattggccatccaatggattgcaccatcagcttagcatacggattaagtcctctacgtgatttcgttgccatcaacatgccatctgtggagggctcaagtggactagccgctcggatcgccacacttcgttgggcttcgctaagcattggcacggtgtgacgcactggaatcgactcatggcacgcttggcttgtaagtaccgcatgtgcttggagctcatcatgtgcgtccactccacttggggggccctatgagcagagtgtccgacgaaagcacctatcaagaatgtatgaagcatttagacgcacatgggatggcgctaggtaggacggtgagcgtgatagggaggacttgtgagtggaatcagttgacgggaccatactgcagaatgtaaagaacttcggggatgtagttacgacatctatgtaagattaccctggagaatgttgacgtgatccgcgaatggatggctagggggagaatagctgtcgagatcttcccctgggccgccacaagacccgtcgctataatcgacaagggacaaccagggtttgcgaacagctcttagtcaaccggagggagacccaataaagttccataccatgacacacagtggacccactacgttatatttgattggccaccctggggaaaaggtccccgagggcttggggggaaccccttacagcgtttaggaggacacggggtcacacaccggtggatcccggtaaataccataagctgtcgcgcgctatccctatagctatccgccaagcctgggtcccagctagaagggaccacagagaggctcttacagcaagacacaagcactccatacaagaacgagacgcacttcaaacgacgacataaggcgggaggggcgaagaaaaaaccacatctagagggggaacacagaaggcag

SEQ ID NO: 579481 - DNA, 174 bp, Homo sapiens
tggtactctaaggaccaagctccaacaagaaggcttagattgatcatttgttctattctactaggaatatccctattcttaaggtctcagtgtactattgtgatgtgtacctgtgcttatttcattccctaggtgatcagctctgatcaactgctgctctcttgttgcgagctt

SEQ ID NO: 579482 - DNA, 318 bp, Homo sapiens
  misc_feature (132)..(132): n is a, c, g, or t
ctaaccagattatcagctagaattggtttgagcgtgggcgctggcgtgaagaccactgcactttgaggaagttgatgtgtcactgctctgggcatattctcaagctcttcttgtattcctccaggcaggtanagtagaactcgatgaagaacttggtgcggctggcttgtcttcacaatggcctcgatgctctcaaactcacgtgtaggcctggtctgaagtctttgagagccctttcttggagatgacactgggcaggtacctccaccctcgaaatgtcccaacagacggggccaatggtcagcctggtgcacgcat

SEQ ID NO: 579483 - DNA, 172 bp, Homo sapiens
  misc_feature (9)..(9): n is a, c, g, or t
gacactggnctgcaacaactctcgttggcaaatgccaacaactgacaccctggaggatatgaacagccagctcaactcattcacatggtcagatggagaacatcaccactatctctcaagccaacgagcagaacctgaaagatctgcaaggaacccacgcgggtaccgagct

SEQ ID NO: 579484 - DNA, 209 bp, Homo sapiens
gggttataggatgtaccactgcttcccagcctgcgcagacagagcaagaccctgtctcaacaaagaagtaaaaaaataacaatagatgtgggctgatggaccaccctgttgaccctgacatgttcgaaagactgttgtgagggacaacatggcctatatcgctagtgcctaggcactcccatacgcgacaccgctaaggcaacttactt

SEQ ID NO: 579485 - DNA, 195 bp, Homo sapiens
agagcaagactctgtctcaaaagacaaacaaacaaacaaaaaaccaaaaacccaccaatgcctggctaggtgcggtggctcacacctgtaatcccagagctttgggaggctgaagcgggtgggtcacttgaggccaggagttggagaccagcctggccaacatggtgaaaccctgtctatactgaaagtacaaaa

SEQ ID NO: 579486 - DNA, 1083 bp, Homo sapiens
  misc_feature (553)..(553): n is a, c, g, or t
ggaaatgaccagttgctaagaatgcaggtgttgaaggatcttggatagttgagaagattatgcaaagttgcctcagagagttggttatgatggtatggctggagattttgtgaaatatggtgggtagagaaaggaatcattgtacacgcgaacgagagatggttgctcgaggacacatgggttctatttggagatggcttagcgtgagatgatgtggacttctgctgattatactagatgaaggaagaggttagctcctaggaaaattccgaaataaagagaaggagctctgagatttgggtcgcactaggtgtggggcataggatgagggtggcgcaataggtcacggccttgcaatagtcactgattcatacacgtccagaaggtaatcccgtttgtgaccctaattagttaagattcgcctacttcgagtagagggtaagcgtcgctacacggagaagtgtatcgcggccctacgcacaagtgacagcattgcaaatttaactagatcacaggggtccgcgtaggaaaaagtgggagatggacaaacaangagcctaggtgcggggggatagattacctagggtcatcaaaagccatctacattacgttgtgacaaggcgcggtatgccagtttttaaggactatacacactttctttatacgataagggggtgcctcacaataggctctcgtctggtaggcgtcccaaataaggcccgtccactggaagtactacaagtttccaaggttggggaggctatcctcttatactggtgacaagtggacgattaaaaaaccactttgtgcggtgcaactatggtgcctctgagaatcgatctgggagctggtacacccaaaaagaaaggctcgagagggtgaacaccccctttcggtaatctaggaacattaagttcaataaactttttacatagtgtccaacctagggagggaggggactccctttttcacaaacttggaactttaattaaccgtagttcccaaacatccataccacgcgcatggtaagtcgcacgatcggcgcattggacccaactcgtatcctaggacatcgtgtacacc

SEQ ID NO: 579487 - DNA, 839 bp, Homo sapiens
ggacgcgtgggtcgatccacgcgtcgcaggcttgggtgatcctctctcctttgcctccgcaagtagccaggcatacaggtgtgcccccacacccaactccgcataattgctttggtgtttttcaaagcttgtaatgcatcagtcaggctgcaggtgggcaaatcacaaggtccagcagttttttagcatggggtgcagcacagcaccaattcctgttttttttcactgatttaaaattttgcagcacaagtctcactgtcacccaggttggggtgcagtggtaggatcatagctgtgctgcagccttgatctcccaggatcttgcctcagcctcccgagtagctgggactgcatgcttgtgccaccacactcggttaatattctgtacgagatggggtctatgctatgttgcccaggctggcttcaaaactcctgaaacttaaaaagcctcctgttcagctaccgggcacgaaaatcaccttcatgcaaccaccacctcgagcagatggcagcctaggtccccaaaggagcaacggccagacaagttgcgcgaggcaccaggccacggcgcacacggacacgaagacggcccactcggggcacacgacggaaaaacacgcataccaccacgccccccggccgaaacacggggactcacgggggtgcccagggcaacaggaccaggacggcacgcgccctcccaggagaccaactggtgggcaccacaggtggaagcccgaacgcgtgcagcaccacggcaccgggacaccgccaccaacaccagacgccactacaccgcgtacaccctgggaccccacgatagaagccaacaccaagcc

SEQ ID NO: 579488 - DNA, 432 bp, Homo sapiens
  misc_feature (164)..(164): n is a, c, g, or t
tcgaattcgacggtttctcagctacaacagccatgccctgtgtggctttgaagttacagaggggaggctgcagagtggcagaatgggaccctctagcgctctactctagcatcttttcttgtaaagcgtaaaattatccctgaactacgtttattttttaaaantaaccattccatttgccgggcacggtggctcacgcctgtatgtccagctacttgagaggctgatgcaggagaatgggagtgaaccccacgaggtgtagctctcacgtgagcgtgtagaactcgggcaattgaattccaggcctgggcaacagaagtgagactccgtctaaaaaaaaaagaaacagcaacatgtcaatgcttttggtgttaatttataacagttttcaaattattcaattaaaaataccagtaggtccttttattctga

SEQ ID NO: 579489 - DNA, 556 bp, Homo sapiens
agaatgctaaaaacagtcccccaatctcttctgacttgtaaagtttctgctgagaagtctgctgttagcatgatgagttatatgaccctttctctagctgtctttaagattctttcttttgtattgaccttggaaagtctgacggctatgtgctctggggatgatcatcttgtacagcaggaagagtcattctcaccctcgatcttagcaaccttagcatatgatttttattcccttgcttaaattaataacttttaccttttcgctttaagaaagcactttacagcttctctggcatatctgaattgctagcatcattacacttgtgctttggggccattagtaagataaaggttacttgaaaacaagcactgagatacagtgacagtccgtgacaactgagatggctactaagtgactaatgggtggggagaatttaagcatgaatatgccccacaaagcaagaattcacatcatggatgctactcaaaatagtgggtaatttaaaaacttatgaattggttattttctgaattttcccattaatatttttaga

SEQ ID NO: 579490 - DNA, 518 bp, Homo sapiens
  misc_feature (169)..(169): n is a, c, g, or t
  misc_feature (171)..(172): n is a, c, g, or t
  misc_feature (174)..(174): n is a, c, g, or t
  misc_feature (475)..(475): n is a, c, g, or t
  misc_feature (481)..(481): n is a, c, g, or t
  misc_feature (483)..(485): n is a, c, g, or t
  misc_feature (492)..(493): n is a, c, g, or t
  misc_feature (515)..(515): n is a, c, g, or t
gagagtgacagggctgtgcgctctggggcacctcatgcagacgggagtagggaggctgttttttgcgcgtgcatatggcggtggcgggtggggggaagggggagatcctgctgactggccgcccaagttggggggcgagctcggtggtgacgcgcggccctcacgtgancnngngctgcgagcgacgcagccttcggtgcagtcgtcactcgcgtctggctaccagctccccgctgccctgagctcggcgggctggcattcggcccggggaaaagcggagcaggtctgcgaggctaagtgtctccgcggcgcacctcgcggcgagaatccggaggagaaggagactgcaaggataggcccaggaaaacgaagagatggagcagcctatgcagaatggagaggaagaccgccctttgggaggaggtgaaggcaccagcctgcaggaaatcgacggggacaggctcgccgacttgcncctaantnnncgatggnncatacccaataggcagatcaantga

SEQ ID NO: 579491 - DNA, 108 bp, Homo sapiens
acggtggtatcatgggtcaagcaggcttttgccaatttattcaacacgtaaatggtggcggggtgcagtggctcacccagccaaccgtggactagtgggtacggagct

SEQ ID NO: 579492 - DNA, 1008 bp, Homo sapiens
  misc_feature (169)..(169): n is a, c, g, or t
  misc_feature (171)..(172): n is a, c, g, or t
  misc_feature (174)..(174): n is a, c, g, or t
gagagtgacagggctgtgcgctctggggcacctcatgcagacgggagtagggaggctgttttttgcgcgtgcatatggcggtggcgggtggggggaagggggagatcctgctgactggccgcccaagttggggggcgagctcggtggtgacgcgcggccctcacgtgancnngngctgcgagcgacgcagccttcggtgcagtcgtcactcgcgtctggctaccagctccccgctgccctgagctcggcgggctggcattcggcccggggaaaagcggagcaggtctgcgaggctaagtgtctccgcggcgcacctcgcggcgagaatccggaggagaaggagactgcaaggataggcccaggaaaacgaataaatagaagcagcctatacatgaaaaagaagaaataccgtccctaaatagaaagaaaagaccaccaaccgacatgaaaaacgacaaaaacaaacacaccaacaaccccaaaaaaacaaaaaccagacccaaaatacagaacaagaaaaaaataaaaatacaaaaaaaaaataaagcagtaaggaggagaagagagaaagacagaagaaaagctagaggagagctaactaggggaaagaaagagagacgaacggtaaactgagagagggggaagtcgacgacgaaaaaacagccaaaaccagacagaaaggaagatgtgtacctgaaaagccgaaaactaccctaatgcatgatgaaacagaaatagagagaacgaagataaacccactaagagggcgaagaggccaacgagaaaagccaaagaaaagcgagaacgaaagaccataggacgaaaagaaccccaagaagaaaatgccagagagacaagtaaggacagagaggaagtcaggtgagacgaagggaaggaatatctaaatagcgacaggagaagtgtgcaagacagcagaattgaggcacccaaagagtaaatgaaaaagagagagctaaaaaagcaagtgaaagatgcaagaaggagaga

SEQ ID NO: 579493 - DNA, 874 bp, Homo sapiens
  misc_feature (169)..(169): n is a, c, g, or t
  misc_feature (171)..(172): n is a, c, g, or t
  misc_feature (174)..(174): n is a, c, g, or t
  misc_feature (608)..(608): n is a, c, g, or t
gagagtgacagggctgtgcgctctggggcacctcatgcagacgggagtagggaggctgttttttgcgcgtgcatatggcggtggcgggtggggggaagggggagatcctgctgactggccgcccaagttggggggcgagctcggtggtgacgcgcggccctcacgtgancnngngctgcgagcgacgcagccttcggtgcagtcgtcactcgcgtctggctaccagctccccgctgccctgagctcggcgggctggcattcggcccggggaaaagcggagcaggtctgcgaggctaagtgtctccgcggcgcacctcgcggcgagaatccggaggagaaggagactgcaaggataggcccagaaaaacaaccagaaaaaaaaaatctcagtccatggccaaaaagtatttcaccagtgacaaaacgaacgaggattgggacgcaggccccttatgttgcacgacaagtgggacggaaggagcaaacgaaacccgggccccccttgtgtggaggccggaaacgggggcaacgcggctttggaacaacggcgggccgcaaacccccaaaggtcctcctttggcaacgcaggaacacaatctccggaaccnggtggcggcgggaacccaagggcctcttcctggccccggaaacactttttggccgcccccccttttaagattgtgttcgtccgcaatgtggggtggggccccaattttatctcgccgcaaaaagtataacggcgggcgaccaggaaatccgacatgtttggaacctttgggggcggaacattggcggagtcattggtggcacacgcaaatttggggacacgccaactttgacacattaagtttgggggaacaaccgacagtgttat

SEQ ID NO: 579494 - DNA, 334 bp, Homo sapiens
caaacacgcatctgtcagcttgtatcaccaaccacttggctgagtgcagtcagtgttcttcccagaccaggccagaaaaaaatgagatacgattctgagaaaagtcttaagactacaccagtcaggctgggcgcggtggctcacgcctgtaatccccgcactttgggaaggccaggcgagtgttcatgaggtccagagatccagaccctcctggcccacatggtgaaaccctgtctcttctaaaaataccaaaattagctgggcatggtggcgtgtgcctgtagtcccagctacttgggaggctgaggcaggagaatcacttgaacccgggagg

SEQ ID NO: 579495 - DNA, 469 bp, Homo sapiens
  misc_feature (63)..(63): n is a, c, g, or t
  misc_feature (469)..(469): n is a, c, g, or t
catagacccaaaggaagacaaatctgtaggtcgtgcacctggcccatatacaagaaaaatgangcaaacactgctgcgcacttttggataaggaatcactttcagagaatcctactttggagtacctgttctatagggagaactgagggaactgcacattcatccaatactcagatgtggatttcacgggtgctccagtgcaaagaaactacctgtctagcattccaggcattatggattatctgactccagaaaaagaacgcgtacaggaagatcttgggctgctgcaataccacatttgcggagaagaagaggtcgtcttccaagaagagcactccagactcagaactcagcaattgtaaaagatgatgaaggccaagaagattatcagtttgatgaactcaacacagagattctgaataacttagcagatcaggagttacaactcaatcatctaaagaactccatn

SEQ ID NO: 579496 - DNA, 935 bp, Homo sapiens
  misc_feature (169)..(169): n is a, c, g, or t
  misc_feature (171)..(172): n is a, c, g, or t
  misc_feature (174)..(174): n is a, c, g, or t
  misc_feature (455)..(455): n is a, c, g, or t
  misc_feature (488)..(488): n is a, c, g, or t
  misc_feature (892)..(892): n is a, c, g, or t
  misc_feature (898)..(898): n is a, c, g, or t
  misc_feature (900)..(902): n is a, c, g, or t
  misc_feature (909)..(910): n is a, c, g, or t
  misc_feature (932)..(932): n is a, c, g, or t
gagagtgacagggctgtgcgctctggggcacctcatgcagacgggagtagggaggctgttttttgcgcgtgcatatggcggtggcgggtggggggaagggggagatcctgctgactggccgcccaagttggggggcgagctcggtggtgacgcgcggccctcacgtgancnngngctgcgagcgacgcagccttcggtgcagtcgtcactcgcgtctggctaccagctccccgctgccctgagctcggcgggctggcattcggcccggggaaaagcggagcaggtaagggctccggggcccgtgagccccggccatgccagcagcggctgaccgacctcggcgacaggcgcagaacagcgcagggggtccccgccagctttctccacaccccaacatgcttgggaacacagaggcccccagggatggggaagcaggggcggctgggtttccaggngcggcagagccaccaagagcgatggaaacccanccccgagtccctgcaggaaaacagcgaacaccgcggggggctgggcgttcgagggtggggtgggggtggggggcgggagacgcggggcgctggcagcgaggggagcccgggctcggagcacggaaagggccgggcggcggcgggtcttcgctagcgttccgctgcagcagccccgacccccccagaaccgcgcaccccggctcgacatgcaggtctgcgaggctaagtgtctccgcggcgcacctcgcggcgagaatccggaggagaaggagactgcaaggataggcccaggaaaacgaagagatggagcagcctatgcagaatggagaggaagaccgccctttgggaggaggtgaaggcaccagcctgcaggaaatcgacggggacaggctcgccgacttgcncctaantnnncgatggnncatacccaataggcagatcaantga

SEQ ID NO: 579497 - DNA, 120 bp, Homo sapiens
cagcggtgttctcgcgcttccgaacgggggcttccggctcggctcgcggggacttttcacgaggtttggcgacgcgccgggccccaagatcaaggccgaagagatcgggagcccgcggga

SEQ ID NO: 579498 - DNA, 394 bp, Homo sapiens
gatgtacgagtgcaattctattatcatccctcctctcttgtgcctccttcacgttttatcaaattttcttacagttcgatgattgcccttctgttaaataaacttgaaatagagtttagcctttataggtatttaaaattcatcttgattttatttcatgataagttaaggttaacttataccttaaaatggaaatcaataatgatagcaatagtaagattttaaacaaaggtcacacataactatacagttaaaattatgactatatcaactggttttgagtatgcataaatcattcataccacagaattaaccacgcatgtatggaagagcatgttttattaaaacacctaattatttaatgttttaaataaaacagtttcattgtcacatt

SEQ ID NO: 579499 - DNA, 1168 bp, Homo sapiens
  misc_feature (46)..(46): n is a, c, g, or t
  misc_feature (53)..(53): n is a, c, g, or t
  misc_feature (1097)..(1099): n is a, c, g, or t
aagaaatattagggattcgcttcttaatgaaaaacaacacaaaagnctttgantataccaacctcagttattcaaagactccatcaccagagagaaagtcagattgtcactttggggagtcctctgccctgtatatatcccatattctttcagataagtgaaattagcatgcctgggtattacagttgtttatgccatactactataaatacttctaagagaagatttatcttgacttaagacttggaattttgttaaattaatgcacaaatgtatatgaccataacttaacgatgatttgtatattagctgagtcaagtggcatatataaaagcaatgaaggtttcttggacattctacactgaaatgtttagaatgtttaaaaaatttatctttctattttccaatagtgtggtaaatgtaaagtgcttagcactttgcgtgacacatggtagggcctcaaaaaatattagctattatcattataaaccagaggccctgttatgtggcagtttgtatctctctcttgactaatagaagcactttgcagatgatatgtcacacaatctagaaaggtagtgcttaaaggaatagacttatctccttattttacaaatgaggacattgaggccctaggaagttaaatgacttagacaaaatcacaaaggtaaagtggaaagcccaggagaaatcccctggccttcagcctgctgtgatttctaccaactatagattagaacttttcagacaagtggcacctgcaagtgtcttcgagcaaggcctcaacctccagcacagctcttgccacctgcaaacaccagggaagagcaagattgagttacatggcttggaagaagagtgaaacacctcgcaagacccagagaaaactccacatccatttgcagctaattttaaagcccaaataaaagcacaatctttggaatcactctatctttggtcaggcaaatgtttaaagagcaatattatatacatctagggtaagaacaattcattaatttagatgaatgaattgtcaaaaggttgttttgcctgtaaatgtgagtaaattgaatatcaagtcatcatgaaatgtaaannnctggcctcgttggcctcagcggtggagctctgcggccgtactcatactattagatatgatgatctgagc

SEQ ID NO: 579500 - DNA, 350 bp, Homo sapiens
  misc_feature (263)..(263): n is a, c, g, or t
  misc_feature (271)..(271): n is a, c, g, or t
  misc_feature (313)..(313): n is a, c, g, or t
aaggatcaattcccatcggaaagatgtcctttatatcctggaaaagagaaacctccctatcatccttccaaattttttgtcaaattcaaaaaaccgacttcctcagaaacagatgtcaatgactcaatatatgaagataacttcttgggagctccgttccgcagagttgaagatatatcatcaggccaacctgatatctggttttttccttacccagatagtatggaagatcttcaaattcgatattatcggaaagcaaaagnatttatgntcaagcgtgttcaacggagatgattgttttctaactcgcagnaaatccatgccacatttttggacatcctccaacggta

SEQ ID NO: 579501 - DNA, 1163 bp, Homo sapiens
  misc_feature (1092)..(1094): n is a, c, g, or t
ctcaccaagcttataagagagagtgcgggggagaggaaggggctagggtattacaacctcagttattcaaagactccatcaccagagagaaagtcagattgtcactttggggagtcctctgccctgtatatatcccatattctttcagataagtgaaattagcatgcctgggtattacagttgtttatgccatactactataaatacttctaagagaagatttatcttgacttaagacttggaattttgttaaattaatgcacaaatgtatatgaccataacttaacgatgatttgtatattagctgagtcaagtggcatatataaaagcaatgaaggtttcttggacattctacactgaaatgtttagaatgtttaaaaaatttatctttctattttccaatagtgtggtaaatgtaaagtgcttagcactttgcgtgacacatggtagggcctcaaaaaatattagctattatcattataaaccagaggccctgttatgtggcagtttgtatctctctcttgactaatagaagcactttgcagatgatatgtcacacaatctagaaaggtagtgcttaaaggaatagacttatctccttattttacaaatgaggacattgaggccctaggaagttaaatgacttagacaaaatcacaaaggtaaagtggaaagcccaggagaaatcccctggccttcagcctgctgtgatttctaccaactatagattagaacttttcagacaagtggcacctgcaagtgtcttcgagcaaggcctcaacctccagcacagctcttgccacctgcaaacaccagggaagagcaagattgagttacatggcttggaagaagagtgaaacacctcgcaagacccagagaaaactccacatccatttgcagctaattttaaagcccaaataaaagcacaatctttggaatcactctatctttggtcaggcaaatgtttaaagagcaatattatatacatctagggtaagaacaattcattaatttagatgaatgaattgtcaaaaggttgttttgcctgtaaatgtgagtaaattgaatatcaagtcatcatgaaatgtaaannnctggcctcgttggcctcagcggtggagctctgcggccgtactcatactattagatatgatgatctgagc

SEQ ID NO: 579502 - DNA, 1168 bp, Homo sapiens
  misc_feature (1097)..(1099): n is a, c, g, or t
atatgagaaatagtgagattttaatattctagtcagaagaggggcatgttagttattacaacctcagttattcaaagactccatcaccagagagaaagtcagattgtcactttggggagtcctctgccctgtatatatcccatattctttcagataagtgaaattagcatgcctgggtattacagttgtttatgccatactactataaatacttctaagagaagatttatcttgacttaagacttggaattttgttaaattaatgcacaaatgtatatgaccataacttaacgatgatttgtatattagctgagtcaagtggcatatataaaagcaatgaaggtttcttggacattctacactgaaatgtttagaatgtttaaaaaatttatctttctattttccaatagtgtggtaaatgtaaagtgcttagcactttgcgtgacacatggtagggcctcaaaaaatattagctattatcattataaaccagaggccctgttatgtggcagtttgtatctctctcttgactaatagaagcactttgcagatgatatgtcacacaatctagaaaggtagtgcttaaaggaatagacttatctccttattttacaaatgaggacattgaggccctaggaagttaaatgacttagacaaaatcacaaaggtaaagtggaaagcccaggagaaatcccctggccttcagcctgctgtgatttctaccaactatagattagaacttttcagacaagtggcacctgcaagtgtcttcgagcaaggcctcaacctccagcacagctcttgccacctgcaaacaccagggaagagcaagattgagttacatggcttggaagaagagtgaaacacctcgcaagacccagagaaaactccacatccatttgcagctaattttaaagcccaaataaaagcacaatctttggaatcactctatctttggtcaggcaaatgtttaaagagcaatattatatacatctagggtaagaacaattcattaatttagatgaatgaattgtcaaaaggttgttttgcctgtaaatgtgagtaaattgaatatcaagtcatcatgaaatgtaaannnctggcctcgttggcctcagcggtggagctctgcggccgtactcatactattagatatgatgatctgagc

SEQ ID NO: 579503 - DNA, 566 bp, Homo sapiens
  misc_feature (481)..(481): n is a, c, g, or t
agcagaccagtcacaagcaaaggtcatggcaacagttttgggatgctcaaggcattttgcttattgactttcgggagggccaaagataataaaatctgcttattatgagcgtgtttttgagaaagccaaaattttagcagaaaaatgcccaagaaaactgcgccagagtcctttcccactatgacaatcctcctgctgattactcacataacataaggaaaattctgcaaaagtttggatggaaaatcactaggcattcccctcatagacccaatttggctgtttctgacttccttttgttttgtaatctttaaaaaaaatagtgggcgctcattagtctgcaggtaagaatgtaaaaacgactacattggaatggttaaattcccaggattctcagttctttcaggatgaactaagtggctggtatcatcacttacaaaagtgtcttgaacttgatggaacttatgtggagaaataaagnttatattttttattcttggattttaattcctttggccaaaaacttttttgaagtcctctggtatgcatcatctcagatagttacc

SEQ ID NO: 579504 - DNA, 210 bp, Homo sapiens
agagcggaaaggtcctccatagtatgagagaaaccctccactaaacctggagtgactattaatggaatgccccccacccctcatccagcacactttggaggacccgtagtacattaaattctatgccccaaaaaggtgaaggagatcgaacccccccaggctggttttccaagcccaaccccactggcctcccctgacttttaccaaaaa

SEQ ID NO: 579505 - DNA, 728 bp, Homo sapiens
tctcggctcactgcaacctccctgcctgattctcctgcctcagcctgccgagtgcctgcgattgcaggcgcacgccgccacgcctgactggttttcgtattattttatggtggagacgtgggtttcgctgtgttggccgtggctggcctccagactcctaaccgcgatgtgatcctgccagcctacgtgcctccgtgaggtagcctgggattagcaagacggtagtctaggttacactacagtgctcaataggtgcccagtgctggatgtgcatgtgcgcgtgatctacggctcagctacaaccatccacctaaccagaccgcctagccttaggcctacccgaaatgtgcctgagatatgcacgcctactagcccgtgccgcgcaccccttctaaggaagctgacggagcgtctctagcctaggccgccacatacgtcgtgaggatgtataggacgcccctacttgcctgagctagccacagatcgtggaagagtgacggaagcgtctttgcgccggccgccatctccatctaggaagtgagcgagcgccttcttcccggacgccatcccgatctaggaagtgaggagcgtactcttgcccgagcgcccatcagtctgagcctgtgggcgagtgccttttggcccgccgccccgtctgcgatgttgaggagcgcctactgaccggtcgcgacccgtctgtgagtgaggagcgtatttgccagcgccca

SEQ ID NO: 579506 - DNA, 1168 bp, Homo sapiens
  misc_feature (1097)..(1099): n is a, c, g, or t
aaacagataattcctagtaaataaataccaaacacaacaacaagaacttaggtgttaacaacctcagttattcaaagactccatcaccagagagaaagtcagattgtcactttggggagtcctctgccctgtatatatcccatattctttcagataagtgaaattagcatgcctgggtattacagttgtttatgccatactactataaatacttctaagagaagatttatcttgacttaagacttggaattttgttaaattaatgcacaaatgtatatgaccataacttaacgatgatttgtatattagctgagtcaagtggcatatataaaagcaatgaaggtttcttggacattctacactgaaatgtttagaatgtttaaaaaatttatctttctattttccaatagtgtggtaaatgtaaagtgcttagcactttgcgtgacacatggtagggcctcaaaaaatattagctattatcattataaaccagaggccctgttatgtggcagtttgtatctctctcttgactaatagaagcactttgcagatgatatgtcacacaatctagaaaggtagtgcttaaaggaatagacttatctccttattttacaaatgaggacattgaggccctaggaagttaaatgacttagacaaaatcacaaaggtaaagtggaaagcccaggagaaatcccctggccttcagcctgctgtgatttctaccaactatagattagaacttttcagacaagtggcacctgcaagtgtcttcgagcaaggcctcaacctccagcacagctcttgccacctgcaaacaccagggaagagcaagattgagttacatggcttggaagaagagtgaaacacctcgcaagacccagagaaaactccacatccatttgcagctaattttaaagcccaaataaaagcacaatctttggaatcactctatctttggtcaggcaaatgtttaaagagcaatattatatacatctagggtaagaacaattcattaatttagatgaatgaattgtcaaaaggttgttttgcctgtaaatgtgagtaaattgaatatcaagtcatcatgaaatgtaaannnctggcctcgttggcctcagcggtggagctctgcggccgtactcatactattagatatgatgatctgagc

SEQ ID NO: 579507 - DNA, 549 bp, Homo sapiens
  misc_feature (9)..(9): n is a, c, g, or t
gtcgactanaagacgacagaaggggagggaaagcattaggagatatacctaatgtaaatggcaagttaatgggtgcagcaaaccaacatggcacatgtatacatatgtaacaagcctgcatgttgtgcacatgtaccctagaacttaaagtataataataataaaaaagaaattaaaaggggtaagaaaaaaaaagtttaggacaacatgctcaccaacaaatttataataggactatcagatggagaggagagagagaaaggagcagaagtatttgaagaaagaatggctgaaaatgtctcaaatttgatgaaaaacattaatctacacatccaagaaactcatccaagaaactcaacaaactgaaagtaggataaccacagatatccatacccagacatatcatagtcaaactgtcaaaagccaaaggtgatgaacaatctcgtgctgaaataaatattgaatggcattttttttcttttatttctcacgtttcagtgttctggcttctatcttttgggggccttaggcaattcaccagcttctggg

SEQ ID NO: 579508 - DNA, 806 bp, Homo sapiens
atttctgtctcttgcttcaacattgtatgagaatggaaacaaaatctcgttattactcttcatttcacactacttccgaattgtcccttcgcgtatatcctactctcgattttgtcaagcactcacgtgtgatccattcattctcgagtgcatcattatagactttttaggatgaccctgtccatacatcggattttttgtaggttagcttccattcttcgattcagtacaatccattgagccttccgagatttcgtcgagaattatttcaatccggaagattggggtgtcaagacccgtgaacatatcggatcgaattgggtatctgacagggactactagaactaactcctctactaggagccttcgtaattgtcgtgagacagtgcattgaatgtaggcattcattggacacaaggcatgttgcatgctcaatttcatttcacggtgaaaacctggcacagtaaggaggagaggcacgggggggcttaaagtaaaacgtgctatctaggaaagaaatagcttaaaaaccaggacgatggttcgagactgacagacttctacgttactcgatggggcatctaactaagggccacgtgtggatatgattgcaagatgaggagttaaaaaacgcccattatgccagtagaaagtgcaaggcgaaatgggttcgtgcattgaaaatagccttgatccaagtgccccattttagcattctatccaagccccggggattggtgtcctggtcggagtcgactcatctctgatgatcttccattggcagatcactattgccatagaatgag

SEQ ID NO: 579509 - DNA, 1173 bp, Homo sapiens
  misc_feature (1102)..(1104): n is a, c, g, or t
acctcgccgcatctcagagatgatacttgtatcgagagacgaacagtgccttagatgttaacccaacctcagttattcaaagactccatcaccagagagaaagtcagattgtcactttggggagtcctctgccctgtatatatcccatattctttcagataagtgaaattagcatgcctgggtattacagttgtttatgccatactactataaatacttctaagagaagatttatcttgacttaagacttggaattttgttaaattaatgcacaaatgtatatgaccataacttaacgatgatttgtatattagctgagtcaagtggcatatataaaagcaatgaaggtttcttggacattctacactgaaatgtttagaatgtttaaaaaatttatctttctattttccaatagtgtggtaaatgtaaagtgcttagcactttgcgtgacacatggtagggcctcaaaaaatattagctattatcattataaaccagaggccctgttatgtggcagtttgtatctctctcttgactaatagaagcactttgcagatgatatgtcacacaatctagaaaggtagtgcttaaaggaatagacttatctccttattttacaaatgaggacattgaggccctaggaagttaaatgacttagacaaaatcacaaaggtaaagtggaaagcccaggagaaatcccctggccttcagcctgctgtgatttctaccaactatagattagaacttttcagacaagtggcacctgcaagtgtcttcgagcaaggcctcaacctccagcacagctcttgccacctgcaaacaccagggaagagcaagattgagttacatggcttggaagaagagtgaaacacctcgcaagacccagagaaaactccacatccatttgcagctaattttaaagcccaaataaaagcacaatctttggaatcactctatctttggtcaggcaaatgtttaaagagcaatattatatacatctagggtaagaacaattcattaatttagatgaatgaattgtcaaaaggttgttttgcctgtaaatgtgagtaaattgaatatcaagtcatcatgaaatgtaaannnctggcctcgttggcctcagcggtggagctctgcggccgtactcatactattagatatgatgatctgagc

SEQ ID NO: 579510 - DNA, 997 bp, Homo sapiens
  misc_feature (46)..(46): n is a, c, g, or t
  misc_feature (53)..(53): n is a, c, g, or t
aagaaatattagggattcgcttcttaatgaaaaacaacacaaaagnctttgantataccaacctcagttattcaaagactccatcaccagagagaaagtcagattgtcactttggggagtcctctgccctgtatatatcccatattctttcagataagtgaaattagcatgcctgggtattacagttgtttatgccatactactataaatacttctaagagaagatttatcttgacttaagacttggaattttgttaaattaatgcacaaatgtatatgaccataacttaacgatgatttgtatattagctgagtcaagtggcatatataaaagcaatgaaggtttcttggacattctacactgaaatgtttagaatgtttaaaaaatttatctttctattttccaatagtgtggtaaatgtaaagtgcttagcactttgcgtgacacatggtagggcctcaaaaaatattagctattatcattataaaccagaggccctgttatgtggcagtttgtatctctctcttgactaatagaagcactttgcagatgatatgtcacacaatctagaaaggtagtgcttaaaggaatagacttatctccttattttacaaatgaggacattgaggccctaggaagttaaatgacttagacaaaatcacaaaggtaaagtggaaagcccaggagaaatcccctggccttcagcctgctgtgatttctaccaactatagattagaacttttcagacaagtggcacctgcaagtgtcttcgagcaaggcctcaacctccagcacagctcttgccacctgcaaacaccagggaagagcaagattgagttacatggcttggaagaagagtgaaacacctcgcaagacccagagaaaactccacatccatttgcagctaattttaaagcccaaataaaactggcctcgttggcctcagcggtggagctctgcggccgtactcatactattagatatgatgatctgagc

SEQ ID NO: 579511 - DNA, 173 bp, Homo sapiens
cccgttatgagacagaagggaggaaattagaaaagaattagaggctgggcatggtggctcacacctgtaatcccagcactttgggaggccaaagtggtggatcacctgaggtcaggagttcgagaccagcctggccaatgtggtgaaaccccatctctactaaaaatacaaaa

SEQ ID NO: 579512 - DNA, 1021 bp, Homo sapiens
ggtgccagaaagcgcaagcagttgctaacccagtgggacaggcggattggaaaagcgggaaggtcctggcccagagcagtgttagacacttccctctgtgatgcatgaaaatctggggtgtctgcattgctgatggcctggtttggtgtcctgaactgtgtgcaggccgaatttcttcacctctattggtgcacatgactgatcctgatttactgccaagagaatagagctggtgtcgaagtctctgaagagagctatcatccttgtggaggaagtccaagaccttttccaagattcaaggagctggggccaacaaagatggaacggccttgactagtcaagtcagctgctgatgctgagggctacctggctcaccctgtgacatgcctactagaagctggtgacagacgagtaaacactagactgggctgctggctggacgtgaccttgtcctgcaggactcagcgtgcatggtgttatctggcaacctctctgtgcagcggaagttcttccccaagctgagttcaggacgagataggagctgtcaaaggcctgtatgagacttcagcgacgacgatacagggctggacccaggcacaagttccagaggggaacttccaggaaccaagtaccaggcaatgctgagtgtgggatgactgctttggggaatgggccgctcggggcctaccaagtgaagggggacctatcaaccatacgggtggttgtgggattggacccacggttgctaacaagcaatttgaggccaggtgaggtaaggccaccaccaaccaaatcaccggtttgtcggaataaactccaataatctcgctttccagttgggttgcattggcaccgggccctggagacctcaaccgacgactgtcttcccttgaccaaccaaaaaagttgagggaactgcggaattggaccgcttaaggaatgagcttgagaaaaaaatcccgcctttggcggcaacagaaacaggacgaatcacccataaagagacggcacagagatacgc

SEQ ID NO: 579513 - DNA, 1001 bp, Homo sapiens
  misc_feature (46)..(46): n is a, c, g, or t
  misc_feature (53)..(53): n is a, c, g, or t
aagaaatattagggattcgcttcttaatgaaaaacaacacaaaagnctttgantataccaacctcagttattcaaagactccatcaccagagagaaagtcagattgtcactttggggagtcctctgccctgtatatatcccatattctttcagataagtgaaattagcatgcctgggtattacagttgtttatgccatactactataaatacttctaagagaagatttatcttgacttaagacttggaattttgttaaattaatgcacaaatgtatatgaccataacttaacgatgatttgtatattagctgagtcaagtggcatatataaaagcaatgaaggtttcttggacattctacactgaaatgtttagaatgtttaaaaaatttatctttctattttccaatagtgtggtaaatgtaaagtgcttagcactttgcgtgacacatggtagggcctcaaaaaatattagctattatcattataaaccagaggccctgttatgtggcagtttgtatctctctcttgactaatagaagcactttgcagatgatatgtcacacaatctagaaaggtagtgcttaaaggaatagacttatctccttattttacaaatgaggacattgaggccctaggaagttaaatgacttagacaaaatcacaaaggtaaagtggaaagcccaggagaaatcccctggccttcagcctgctgtgatttctaccaactatagattagaacttttcagacaagtggcacctgcaagtgtcttcgagcaaggcctcaacctccagcacagctcttgccacctgcaaacaccagggaagagcaagattgagttacatggcttggaagaagagtgaaacacctcgcaagacccagagaaaactccacatccatttgcagctaattttaaagcccaaataaaagcgtggcctcgttggcctcagcggggagtttgcggccgatattttcacgccaacaatatcttgcgcgcactct

SEQ ID NO: 579514 - DNA, 1027 bp, Homo sapiens
cggctccggtcggagacaatcgcgctgagcgggcgccgcagcgggagcgggagccggagctgcgaggcgcggcgcagagctggggctgcgcggggccgggcgagcgggaccaggcgggagccatggaccgctagggcccggcctagccccgcgatgccgccggcgagtggccccagcgtcctcgcgcggctgttgccggctgctggggcttgctgctcggcagcgcctcccgggctcccgggcaagtcgccgcctggatgccccccagcccgcaggagatcctgatcaagggtgcaggtgtatgtgaggcgggggatgctggtgcccctgtggcccggggcctcagtggatgtgtttgggaaccggactctgctggcagctggcaccaacagactcagaggggttgtggccacccttgcccctcagttatcgctttgggcaccttgggtgctggtcactggctgcccgccctgggcttccttcaccgaaagtcctgtgccctgggccgtgttgaccaaggcttgccctttgtattgcgtctgtcgaggcctctaccttgctccctggagcggccgggcccacgctcatcctcttgtgagggacccttggtgccgcatttcttccttagggctctcccggttgccccgctcccaggccctttggttgccatgttccagcgccgggcttgccggcctgccttgtcagctcccacgtacaggccaggctcttggccgtcaccttaccgccttggccaggcacccgagcagcggaaattgcggggcttttcccctgcctttccttggggcaccttgatggcctcccagctcagggcacatggcttccttggcttggagcttgaattgccccgtgaggtgcttttgaaccggttgcaacttgctgacaaggtaaatggggaccagaagggtgccggctactcagtgcccccaattcaactgtacctggccggtgccctacggaaaactctgcctacaaggtgtggcacaagattccagcctgcaaattgacc

SEQ ID NO: 579515 - DNA, 267 bp, Homo sapiens
  misc_feature (48)..(48): n is a, c, g, or t
  misc_feature (55)..(55): n is a, c, g, or t
  misc_feature (96)..(96): n is a, c, g, or t
  misc_feature (181)..(181): n is a, c, g, or t
  misc_feature (227)..(227): n is a, c, g, or t
  misc_feature (265)..(265): n is a, c, g, or t
gttggatatttagaggacattatcatggatgacgagttccagttattncagaganatttcatggacaagtactacctggagtttgaagacacagangagaataaactcatctacacacctatttttgatgaatacatttctttggtagaaaatacattgaagacagctgctgcagcggatncctgagttcaacatggcagccttcaccacaacattacagcaccatnagggtgaagtggctggtgacatattccgacatgctgcnca

SEQ ID NO: 579516 - DNA, 658 bp, Homo sapiens
gcatatgaatgatctgctgcagtgctctgagccctaggattcatctttcttttcaccgctaggtggcctgactggccttgtattagccaactcatcccttgacactcgtgctacacgacacgtactacgttgtagctcacttcccgctatgtcctatccataggagctgtatttgccatcataggaggcttcattcactgatttcccctattctcaggcgtacacccttagacccaaacctacgcccaaatcccatttcgactatcatattcatcggccgtaaatctaacatttctttccccaccaacacatttttcggcctaatccgggatgccccgagcgttatactcggaactatccccgattgcatacacccaccactggaacactcctatcatctgtaggctcaattcatttcttctatacacgcccgtatatattaataattttcatgaatttgagaagccttcgcttcgaagcgacaaagtcctatatagtagaagagaccctccataaacctggagtgactatatggatgccccccaccctaccacacattcgaagaacccgtatacattaaatttagaccaaaaaggaaggaatcgaacccccccaagctggtttcaagccaaccccatggcctccatgactttttcca

SEQ ID NO: 579517 - DNA, 187 bp, Homo sapiens
cgctcggccctcacatttactattgatgatggctgtgtgcgtccaggtgtctggtgcgtgacagtggccatggcagacgcctgattaaaccatagcccagtgtaaagggcagggcacacgcttggagtccaagcatttgctgatgcattactcattattcccaaggttcttgctcagcaactctggt

SEQ ID NO: 579518 - DNA, 585 bp, Homo sapiens
  misc_feature (59)..(59): n is a, c, g, or t
  misc_feature (190)..(190): n is a, c, g, or t
  misc_feature (210)..(210): n is a, c, g, or t
  misc_feature (212)..(214): n is a, c, g, or t
  misc_feature (230)..(230): n is a, c, g, or t
  misc_feature (234)..(234): n is a, c, g, or t
  misc_feature (236)..(236): n is a, c, g, or t
  misc_feature (255)..(255): n is a, c, g, or t
  misc_feature (260)..(260): n is a, c, g, or t
  misc_feature (290)..(290): n is a, c, g, or t
  misc_feature (299)..(301): n is a, c, g, or t
  misc_feature (382)..(382): n is a, c, g, or t
  misc_feature (384)..(384): n is a, c, g, or t
  misc_feature (448)..(448): n is a, c, g, or t
  misc_feature (456)..(458): n is a, c, g, or t
  misc_feature (462)..(462): n is a, c, g, or t
  misc_feature (464)..(464): n is a, c, g, or t
  misc_feature (467)..(467): n is a, c, g, or t
  misc_feature (471)..(471): n is a, c, g, or t
  misc_feature (476)..(476): n is a, c, g, or t
  misc_feature (480)..(480): n is a, c, g, or t
  misc_feature (482)..(482): n is a, c, g, or t
  misc_feature (497)..(497): n is a, c, g, or t
  misc_feature (500)..(500): n is a, c, g, or t
  misc_feature (503)..(503): n is a, c, g, or t
  misc_feature (517)..(517): n is a, c, g, or t
  misc_feature (550)..(552): n is a, c, g, or t
  misc_feature (579)..(581): n is a, c, g, or t
  misc_feature (583)..(583): n is a, c, g, or t
tttattaatattttaaaatatgaaaactgtaaaacatagtttttttgttaacacctgangactgttcaagtaggtacagcatcttcatacaaacaatttgaaagaagaccaagtttaagtaagaatcttatgacatgtaaggaataacattgatgaagctattctttaaatagttgcattcatgtctaangtccatttcgctttctaaancnnnaaggtacattcttgcntctngngaccattttcttgacattncagcnaatcgctattggtgatagccccacttctcntagctcgtnnnccttatatttgttacacaatgtaataccaaagttataactttatcccaaaataattgtgttgaccatgtttcccttgcccntnctccctttcccgatccccccccccccgcttcgtctgtttttttgtttctttctttgtgttgctngttttttnnntctntnttncgcntgttntttngnggcgttgcgttgggnggnggncttccctgtttggnggccaatcttcagattgtttcttgtcctctagnnngttagttgagaggtactattgatggcnnntntt

SEQ ID NO: 579519 - DNA, 197 bp, Homo sapiens
tggagaagggagtctggccctgtggcctaggcgggagtgcaagggcgcaatctgggtccatggcaccctccacctccggggttcaagcaattctcatgcctcagcctcgcgagtaagctgggaattcacgggtggccccaccaccggtaaatccaccaccggccgggctaaattttgggtaattaggcaacataagg

SEQ ID NO: 579520 - DNA, 98 bp, Homo sapiens
gaaaagcatttgtagttaagatgaaaagttgtctatttatcagatccaggcgcctcaacttcaccggatcacctcgcactcgtctttggatctcgtgt

SEQ ID NO: 579521 - DNA, 116 bp, Homo sapiens
gaggagacactccagagctgcccaggaaggggtttgaacggctgtataacgaccccctaactcccctatccatgcactcacgttctcttacgctgggtccatccctctctggctgt

SEQ ID NO: 579522 - DNA, 566 bp, Homo sapiens
ccccccgtgtggggtttttccctttttaacacaaggggcctcttgtggtgtttccgagacgggggggtagaatgtttctccccccccagagggaatgggggtttttttgggcccccctttcccccttgggggtgggggtggggacccggccggtttttttttggggggggcctctcttcccccccccaatggggggggtgggtgtggtaaaccccccctataaaggaaggcgggggcgggggttttctcctaaaaaatttgggacccgtttttccccttggggggggttttccccgggggtgccccccccccccccttttttgggggaccccccccctttctatgggggtttttcccccgggggccccccctttggggggggccttggaaaaataaaaaaaggggggggggggtttcccctttttgggccccaaaaaaccccccccccccccccgggtgggggggaattccccccctgggggggggggggggccccccccccccccccccccccccggggggggggtttttggggccaaaaattttttttttccccccccccccca

SEQ ID NO: 579523 - DNA, 305 bp, Homo sapiens
actctacgagtatccccgcctggagctcaggatcctcagagacatcttaacgcttcaacatctgccgccaagtttccatggtagttacaggtgacagcaggtacagatcgaagtctccacattaacaaccctccattaacccgtggactcttctgaaaggcctccatcaaacactgccggagtccgtcaacaggagtttgtttggttttcaatagcagtgttttcgtttttcgcactaccgtcctttgttcctccctgtccgtctggagagagccgtcacatcttgggatgcttgttctggatct

SEQ ID NO: 579524 - DNA, 848 bp, Homo sapiens
gcttcgctcgccgctcgcgcgaagatagaagcgctgcgggaagcagggacagtggagagggcgctgcgctcgggctacccaatgcgtggactatctgccgccgctgttcgtgcaatatgctggagctccagaacagctaaacggagtcgccacaccactgttgtgtgctggatcgcagcgctggcctttccttatgaagaagaacaccaaacttggattctcactgtgcattttatcttcagacggctcctattttaatcctctcgtcaaaacctgacgggatctgcagggaactcgtgtgacctaataattgtaaaagacgtcactaaatgtggtggcaaatcttccaaaagactacatgataacctccaaaatatggtccccgggatggatgttttgccaagtcattgttggataagcgagatggtagtacaatttgtcagacaggtttgattgatcttctgtacaagtttttcaaatatttctgaaggcttgagtaattattccatcatagaccaaattgtgactatgtggatgaccttgttggagtgcgtgaaaagaaaactcatctaaggatctcacacaaaatccattcaagaagccagaacccaggctcttttactcctgaagaaattctttaggaactttttaatagatcccatggttggctttcaaggacttggtagtggctctgaactacgtgcttgtggggcttcctcaccattagtctgggaaagatccagagtcggggtcaaaaccatttatgtacccgtgtgagcagcccttgaagaaggggcagatgaagggaaaacccggaaccgcaaggggccgcagcccagtccaaaggg

SEQ ID NO: 579525 - DNA, 205 bp, Homo sapiens
tgccctttagattctaccccaaattgttaccattaattaaacacattttatttttaaaataactctatctgattgggggctcttctctgtcaatctggttttctcttataaaacaagtcaactctcaacagcctacgttattaagggaaaatgtaattaaatgcagaagtagtctatttgccaacaggtccttccaggttcttcc

SEQ ID NO: 579526 - DNA, 682 bp, Homo sapiens
acccccccctgcacctttacaagtccacgggcaagaagtcccaggaatcccgggatttgattaagttgtggaccagcagccttattgacctttccagactttccaccccaaatcacaagaatatcatttttttagcaccacaccaccacgatttcaaaaattgcccacaactgggaagtaaagctctcctcagcaaatgtaaaagaacagaatttatacaaacttatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacaattcaaaagctaccagaaggcaagaaataactaaaatcagagcagaactgaaggaaatagagacacaaaaaacccttcaaaaaatcaatgaatccaggagctggttttttgaaaggatcaacaaattgatagaccgctagcaa

SEQ ID NO: 579527 - DNA, 273 bp, Homo sapiens
ggatgatagcccagagcgcgggccatgcgtgaagcgtacgtgcccattcccgtgctggttacgcgcaccagcagcgtgccgttttcactgcgggtgcccgcgaacaccgggctgcccatgcctttaagcttcgtgtcgcttcgagtccgagaacgattcggccacgaagccggagccgaaagttaccacgccgtcggccgggaacactccctggggtggcacgcggcaaatgtgtccttcccgtaacgtctcggtgggaacgaggccttcgat

SEQ ID NO: 579528 - DNA, 402 bp, Homo sapiens
  misc_feature (119)..(119): n is a, c, g, or t
  misc_feature (290)..(290): n is a, c, g, or t
  misc_feature (301)..(301): n is a, c, g, or t
  misc_feature (323)..(323): n is a, c, g, or t
  misc_feature (340)..(340): n is a, c, g, or t
cacgaggccgtggctgtccccacaggcagccaagcaggcgggcgccgggttacccgatgtcagggtcacgatccaggagacgatgccgaccgatatcaggtcctggtgggagcatcaanagaagatgccgttggccggactgttcgtcggcaaccatcagcgaaagactgctgcgatcgaggaagtcggcatcatgagcggcttgcggttcgtcccgcaaccgtggcggggacgcgcactggtggtgctgagccacctcaacaaggatgatccccggctgtggccgcggntcatcaccggngacttgaccatccgccacctgnagtgcacccacatgtcnatcgtgcgcgagccgcatatcggcgccgtggccgccatgatcgacgaggtgctgggccacta

SEQ ID NO: 579529 - DNA, 541 bp, Homo sapiens
gcatcacattcaaatgtagaagggcggtgagcacagcgaccccatgcatctccagagaccctgccccatcactctgactcttactagcgtggtgtgcgaccctaggcaagtcatttgatttctctagactcttagttgtttaatgtatcactatgcctgccattgttcacttgctagcagataggcttgggtccctccagcttcgggatctgagaaccggccccctccccgggttaccatgccggtcagcctctgaggtcagggggatgccatctttatctggtcgttgcttgagctgtgttgtgtaccacatccaggctgctgtgctccggccacatccatggaatcaatactcagatcgggaaggcaggaaaagcaggctaaggtactgggacccgagggacaaggggatgtgggttctggaggggaaggggatcctgggccgtgtcttggggccgaacgggatgcggagcaggaggttgtcctggggtccagtccagaagctacgggtgtgaggatgctgaagtctggcagccacatg

SEQ ID NO: 579530 - DNA, 277 bp, Homo sapiens
atttgaggaattccccatgaccccaacgacctacaaaggctctgtggacaaccagacagacagtgggatggtgctggcctcggaggagtttgatcagatagaaagcaggcattgacaagaaagcggctttaggtatctgaagcagatagagagaaggccccttacttcagcattttcttttctgcacttataagatagatcaaagactttaaaactttcgatatatgctctactggtatttactacaaacttcaaaagaggaaccaggatggacaac

SEQ ID NO: 579531 - DNA, 309 bp, Homo sapiens
cgggtcataattgaaaaacttttttcaaaggggtttcctagaaactcctaccagcagtaaccaactcaaggaaaactgttatagattgaagatcatttaaactacttgggaaagaaagactcccatattttttccttcctttgctttgtttttggggactcattgtcaaggatgaaatgttccatttagcttttaagtgaaagcctttgggcattcattcaattttttttaaacaaacttgactccttttgttttttgtcccaagccccttgtcatgtcccatcaataaagtcccctgggttcccccca

SEQ ID NO: 579532 - DNA, 127 bp, Homo sapiens
ggagaacatcatgtgtgtcaacaagacgggcaccaggatcaagctcatcgactttggtctggccaggaggctggagaacgcggggtctctgaaggtcctctttggcaccccaggtcctcttctctcc

SEQ ID NO: 579533 - DNA, 195 bp, Homo sapiens
gccccagtaaattaaagcattacccaggatttatcaggattttttaaacaccccggccctttttaaaatctttggttaggcagtcaaatttttgtctggaagattaaaaggttttacggccctccctttttggacaaatctggattggattaatttttggaagcaatttttcaaatatttaaattatcccggcca

SEQ ID NO: 579534 - DNA, 147 bp, Homo sapiens
tcgaatcgacggtttctctcgtactgtagcaggattaccatggcaacaacaccacgccctggtaatttttgtatttttagtagaaacagagtttcaccgtattggtcaggctggtctcgaactcccaacctcaaagtgatccacctg

SEQ ID NO: 579535 - DNA, 9046 bp, Homo sapiens
ccttgtttgtgtgctaggctgggggggagagagggcgagagagagcgggcgagagtgggcaagcaggacgccgggctgagtgctaactgcgggacgcagagagtgcggaggggagtcgggtcggagagaggcggcaggggccagaacagtggcagggggcccggggcgcacgggctgaggcgacccccagccccctcccgtccgcacacacccccaccgcggtccagcagccgggccggcgtcgacgctaggggggaccattacataacccgcgccccggccgtcttctcccgccgccgcggcgcccgaactgagcccggggcgggcgctccagcactggccgccggcgtggggcgtagcagcggccgtattattatttcgcggaaaggaaggcgaaggaggggagcgccggcgcgaggaggggccgcctgcgcccgccgccggagcggggcctcctcggtgggctccgcgtcggcgcgggcgtgcgggcggcgctgctcggcccggccccctcggccctctggtccggccagctccgctcccggcgtccttgccgcgcctccgccggccgccgcgcgatgtgaggcggcggcgccagcctggctctcggctcgggcgagttctctgcggccattaggggccggtgcggcggcggcgcggagcgcggcggcaggaggagggttcggagggtgggggcgcaggcccgggagggggcaccgggaggaggtgagtgtctcttgtcgcctcctcctctccccccttttcgcccccgcctccttgtggcgatgagaaggaggaggacagcgccgaggaggaagaggttgatggcggcggcggagctccgagagacctcggctgggcaggggccggccgtggcgggccggggactgcgcctctagagccgcgagttctcgggaattcgccgcagcggaccggcctcggcgaatttgtgctcttgtgccctcctccgggcttgggccaggccggcccctcgcacttgcccttaccttttctatcgagtccgcatccctctccagccactgcgacccggcgaagagaaaaaggaacttcccccaccccctcgggtgccgtcggagccccccagcccacccctgggtgcggcgcggggaccccgggccgaagaagagatttcctgaggattctggttttcctcgcttgtatctccgaaagaattaaaaatggccgagaatgtggtggaaccggggccgccttcagccaagcggcctaaactctcatctccggccctctcggcgtccgccagcgatggcacagattttggctctctatttgacttggagcacgacttaccagatgaattaatcaactctacagaattgggactaaccaatggtggtgatattaatcagcttcagacaagtcttggcatggtacaagatgcagcttctaaacataaacagctgtcagaattgctgcgatctggtagttcccctaacctcaatatgggagttggtggcccaggtcaagtcatggccagccaggcccaacagagcagtcctggattaggtttgataaatagcatggtcaaaagcccaatgacacaggcaggcttgacttctcccaacatggggatgggcactagtggaccaaatcagggtcctacgcagtcaacaggtatgatgaacagtccagtaaatcagcctgccatgggaatgaacacagggacgaatgcgggcatgaatcctggaatgttggctgcaggcaatggacaagggataatgcctaatcaagtcatgaacggttcaattggagcaggccgagggcgacaggatatgcagtacccaaacccaggcatgggaagtgctggcaacttactgactgagcctcttcagcagggctctccccagatgggaggacaaacaggattgagaggcccccagcctcttaagatgggaatgatgaacaaccccaatccttatggttcaccatatactcagaatcctggacagcagattggagccagtggccttggtctccagattcagacaaaaactgtactatcaaataacttatctccatttgctatggacaaaaaggcagttcctggtggaggaatgcccaacatgggtcaacagccagccccgcaggtccagcagccaggtctggtgactccagttgcccaagggatgggttctggagcacatacagctgatccagagaagcgcaagctcatccagcagcagcttgttctccttttgcatgctcacaagtgccagcgccgggaacaggccaatggggaagtgaggcagtgcaaccttccccactgtcgcacaatgaagaatgtcctaaaccacatgacacactgccagtcaggcaagtcttgccaagtggcacactgtgcatcttctcgacaaatcatttcacactggaagaattgtacaagacatgattgtcctgtgtgtctccccctcaaaaatgctggtgataagagaaatcaacagccaattttgactggagcacccgttggacttggaaatcctagctctctaggggtgggtcaacagtctgcccccaacctaagcactgttagtcagattgatcccagctccatagaaagagcctatgcagctcttggactaccctatcaagtaaatcagatgccgacacaaccccaggtgcaagcaaagaaccagcagaatcagcagcctgggcagtctccccaaggcatgcggcccatgagcaacatgagtgctagtcctatgggagtaaatggaggtgtaggagttcaaacgccgagtcttctttctgactcaatgttgcattcagccataaattctcaaaacccaatgatgagtgaaaatgccagtgtgccctccctgggtcctatgccaacagcagctcaaccatccactactggaattcggaaacagtggcacgaagatattactcaggatcttcgaaatcatcttgttcacaaactcgtccaagccatatttcctacgccggatcctgctgctttaaaagacagacggatggaaaacctagttgcatatgctcggaaagttgaaggggacatgtatgaatctgcaaacaatcgagcggaatactaccaccttctagctgagaaaatctataagatccagaaagaactagaagaaaaacgaaggaccagactacagaagcagaacatgctaccaaatgctgcaggcatggttccagtttccatgaatccagggcctaacatgggacagccgcaaccaggaatgacttctaatggccctctacctgacccaagtatgatccgtggcagtgtgccaaaccagatgatgcctcgaataactccacaatctggtttgaatcaatttggccagatgagcatggcccagccccctattgtaccccggcaaacccctcctcttcagcaccatggacagttggctcaacctggagctctcaacccgcctatgggctatgggcctcgtatgcaacagccttccaaccagggccagttccttcctcagactcagttcccatcacagggaatgaatgtaacaaatatccctttggctccgtccagcggtcaagctccagtgtctcaagcacaaatgtctagttcttcctgcccggtgaactctcctataatgcctccagggtctcaggggagccacattcactgtccccagcttcctcaaccagctcttcatcagaattcaccctcgcctgtacctagtcgtacccccacccctcaccatactcccccaagcataggggctcagcagccaccagcaacaacaattccagcccctgttcctacaccaccagccatgccacctgggccacagtcccaggctctacatccccctccaaggcagacacctacaccaccaacaacacaacttccccaacaagtgcagccttcacttcctgctgcaccttctgctgaccagccccagcagcagcctcgctcacagcagagcacagcagcgtctgttcctaccccaaacgcaccgctgcttcctccgcagcctgcaactccactttcccagccagctgtaagcattgaaggacaggtatcaaatcctccatctactagtagcacagaagtgaattctcaggccattgctgagaagcagccttcccaggaagtgaagatggaggccaaaatggaagtggatcaaccagaaccagcagatacgcagccggaggatatttcagagtctaaagtggaagactgtaaaatggaatctaccgaaacagaagagagaagcactgagttaaaaactgaaataaaagaggaggaagaccagccaagtacttcagctacccagtcatctccggctccaggacagtcaaagaaaaagattttcaaaccagaagaactacgacaggcactgatgccaacattggaggcactttaccgtcaggatccagaatcccttccctttcgtcaacctgtggaccctcagcttttaggaatccctgattactttgatattgtgaagagccccatggatctttctaccattaagaggaagttagacactggacagtatcaggagccctggcagtatgtcgatgatatttggcttatgttcaataatgcctggttatataaccggaaaacatcacgggtatacaaatactgctccaagctctctgaggtctttgaacaagaaattgacccagtgatgcaaagccttggatactgttgtggcagaaagttggagttctctccacagacactgtgttgctacggcaaacagttgtgcacaatacctcgtgatgccacttattacagttaccagaacaggtatcatttctgtgagaagtgtttcaatgagatccaaggggagagcgtttctttgggggatgacccttcccagcctcaaactacaataaataaagaacaattttccaagagaaaaaatgacacactggatcctgaactgtttgttgaatgtacagagtgcggaagaaagatgcatcagatctgtgtccttcaccatgagatcatctggcctgctggattcgtctgtgatggctgtttaaagaaaagtgcacgaactaggaaagaaaataagttttctgctaaaaggttgccatctaccagacttggcacctttctagagaatcgtgtgaatgactttctgaggcgacagaatcaccctgagtcaggagaggtcactgttagagtagttcatgcttctgacaaaaccgtggaagtaaaaccaggcatgaaagcaaggtttgtggacagtggagagatggcagaatcctttccataccgaaccaaagccctctttgcctttgaagaaattgatggtgttgacctgtgcttctttggcatgcatgttcaagagtatggctctgactgccctccacccaaccagaggagagtatacatatcttacctcgatagtgttcatttcttccgtcctaaatgcttgaggactgcagtctatcatgaaatcctaattggatatttagaatatgtcaagaaattaggttacacaacagggcatatttgggcatgtccaccaagtgagggagatgattatatcttccattgccatcctcctgaccagaagatacccaagcccaagcgactgcaggaatggtacaaaaaaatgcttgacaaggctgtatcagagcgtattgtccatgactacaaggatatttttaaacaagctactgaagatagattaacaagtgcaaaggaattgccttatttcgagggtgatttctggcccaatgttctggaagaaagcattaaggaactggaacaggaggaagaagagagaaaacgagaggaaaacaccagcaatgaaagcacagatgtgaccaagggagacagcaaaaatgctaaaaagaagaataataagaaaaccagcaaaaataagagcagcctgagtaggggcaacaagaagaaacccgggatgcccaatgtatctaacgacctctcacagaaactatatgccaccatggagaagcataaagaggtcttctttgtgatccgcctcattgctggccctgctgccaactccctgcctcccattgttgatcctgatcctctcatcccctgcgatctgatggatggtcgggatgcgtttctcacgctggcaagggacaagcacctggagttctcttcactccgaagagcccagtggtccaccatgtgcatgctggtggagctgcacacgcagagccaggaccgctttgtctacacctgcaatgaatgcaagcaccatgtggagacacgctggcactgtactgtctgtgaggattatgacttgtgtatcacctgctataacactaaaaaccatgaccacaaaatggagaaactaggccttggcttagatgatgagagcaacaaccagcaggctgcagccacccagagcccaggcgattctcgccgcctgagtatccagcgctgcatccagtctctggtccatgcttgccagtgtcggaatgccaattgctcactgccatcctgccagaagatgaagcgggttgtgcagcataccaagggttgcaaacggaaaaccaatggcgggtgccccatctgcaagcagctcattgccctctgctgctaccatgccaagcactgccaggagaacaaatgcccggtgccgttctgcctaaacatcaagcagaagctccggcagcaacagctgcagcaccgactacagcaggcccaaatgcttcgcaggaggatggccagcatgcagcggactggtgtggttgggcagcaacagggcctcccttcccccactcctgccactccaacgacaccaactggccaacagccaaccaccccgcagacgccccagcccacttctcagcctcagcctacccctcccaatagcatgccaccctacttgcccaggactcaagctgctggccctgtgtcccagggtaaggcagcaggccaggtgacccctccaacccctcctcagactgctcagccaccccttccagggcccccacctacagcagtggaaatggcaatgcagattcagagagcagcggagacgcagcgccagatggcccacgtgcaaatttttcaaaggccaatccaacaccagatgcccccgatgactcccatggcccccatgggtatgaacccacctcccatgaccagaggtcccagtgggcatttggagccagggatgggaccgacagggatgcagcaacagccaccctggagccaaggaggattgcctcagccccagcaactacagtctgggatgccaaggccagccatgatgtcagtggcccagcatggtcaacctttgaacatggctccacaaccaggattgggccaggtaggtatcagcccactcaaaccaggcactgtgtctcaacaagccttacaaaaccttttgcggactctcaggtctcccagctctcccctgcagcagcaacaggtgcttagtatccttcacgccaacccccagctgttggctgcattcatcaagcagcgggctgccaagtatgccaactctaatccacaacccatccctgggcagcctggcatgccccaggggcagccagggctacagccacctaccatgccaggtcagcagggggtccactccaatccagccatgcagaacatgaatccaatgcaggcgggcgttcagagggctggcctgccccagcagcaaccacagcagcaactccagccacccatgggagggatgagcccccaggctcagcagatgaacatgaaccacaacaccatgccttcacaattccgagacatcttgagacgacagcaaatgatgcaacagcagcagcaacagggagcagggccaggaataggccctggaatggccaaccataaccagttccagcaaccccaaggagttggctacccaccacagccgcagcagcggatgcagcatcacatgcaacagatgcaacaaggaaatatgggacagataggccagcttccccaggccttgggagcagaggcaggtgccagtctacaggcctatcagcagcgactccttcagcaacagatggggtcccctgttcagcccaaccccatgagcccccagcagcatatgctcccaaatcaggcccagtccccacacctacaaggccagcagatccctaattctctctccaatcaagtgcgctctccccagcctgtcccttctccacggccacagtcccagcccccccactccagtccttccccaaggatgcagcctcagccttctccacaccacgtttccccacagacaagttccccacatcctggactggtagctgcccaggccaaccccatggaacaagggcattttgccagcccggaccagaattcaatgctttctcagcttgctagcaatccaggcatggcaaacctccatggtgcaagcgccacggacctgggactcagcaccgataactcagacttgaattcaaacctctcacagagtacactagacatacactagagacaccttgtattttgggagcaaaaaaattattttctcttaacaagactttttgtactgaaaacaatttttttgaatctttcgtagcctaaaagacaattttccttggaacacataagaactgtgcagtagccgtttgtggtttaaagcaaacatgcaagatgaacctgagggatgatagaatacaaagaatatatttttgttatgggctggttaccaccagcctttcttcccctttgtgtgtgtggttcaagtgtgcactgggaggaggctgaggcctgtgaagccaaacaatatgctcctgccttgcacctccaataggttttattattttttttaaattaatgaacatatgtaatattaatgaacatatgtaatattaatagttattatttactggtgcagatggttgacatttttccctattttcctcactttatggaagagttaaaacatttctaaaccagaggacaaaaggggttaatgttactttgaaattacattctatatatatataaatatatataaatatatattaaaataccagttttttttctctgggtgcaaagatgttcattcttttaaaaaatgtttaaaaaaaa

SEQ ID NO: 579536 - DNA, 385 bp, Homo sapiens
gctatacgaagaattacaatcaagcatatcttaagtactgaaaaacgaaattgtatgccgtacatggcgtgctcacaccttgagtccaagcactttgggaggccgatgctgacgatcatgaagtcaggagagcgagaccattctgggtaacacggacaaaccagaggtctactataaatatgattagccacaggtgcgtgaagactcctgaagacgaagatactcggaaggctgaggcaggtggtgggcacctgtgaagcagagcttgcagagagcctagatcgagctactgcactacagactgggtgacagagctagactctgtctgagctacttatatattttggtcattatacagtctgggcatgtacgatcaggcaagttg

SEQ ID NO: 579537 - DNA, 4335 bp, Homo sapiens
ccttgtttgtgtgctaggctgggggggagagagggcgagagagagcgggcgagagtgggcaagcaggacgccgggctgagtgctaactgcgggacgcagagagtgcggaggggagtcgggtcggagagaggcggcaggggccagaacagtggcagggggcccggggcgcacgggctgaggcgacccccagccccctcccgtccgcacacacccccaccgcggtccagcagccgggccggcgtcgacgctaggggggaccattacataacccgcgccccggccgtcttctcccgccgccgcggcgcccgaactgagcccggggcgggcgctccagcactggccgccggcgtggggcgtagcagcggccgtattattatttcgcggaaaggaaggcgaaggaggggagcgccggcgcgaggaggggccgcctgcgcccgccgccggagcggggcctcctcggtgggctccgcgtcggcgcgggcgtgcgggcggcgctgctcggcccggccccctcggccctctggtccggccagctccgctcccggcgtccttgccgcgcctccgccggccgccgcgcgatgtgaggcggcggcgccagcctggctctcggctcgggcgagttctctgcggccattaggggccggtgcggcggcggcgcggagcgcggcggcaggaggagggttcggagggtgggggcgcaggcccgggagggggcaccgggaggaggtgagtgtctcttgtcgcctcctcctctccccccttttcgcccccgcctccttgtggcgatgagaaggaggaggacagcgccgaggaggaagaggttgatggcggcggcggagctccgagagacctcggctgggcaggggccggccgtggcgggccggggactgcgcctctagagccgcgagttctcgggaattcgccgcagcggaccggcctcggcgaatttgtgctcttgtgccctcctccgggcttgggccaggccggcccctcgcacttgcccttaccttttctatcgagtccgcatccctctccagccactgcgacccggcgaagagaaaaaggaacttcccccaccccctcgggtgccgtcggagccccccagcccacccctgggtgcggcgcggggaccccgggccgaagaagagatttcctgaggattctggttttcctcgcttgtatctccgaaagaattaaaaatggccgagaatgtggtggaaccggggccgccttcagccaagcggcctaaactctcatctccggccctctcggcgtccgccagcgatggcacagattttggctctctatttgacttggagcacgacttaccagatgaattaatcaactctacagaattgggactaaccaatggtggtgatattaatcagcttcagacaagtcttggcatggtacaagatgcagcttctaaacataaacagctgtcagaattgctgcgatctggtagttcccctaacctcaatatgggagttggtggcccaggtcaagtcatggccagccaggcccaacagagcagtcctggattaggtttgataaatagcatggtcaaaagcccaatgacacaggcaggcttgacttctcccaacatggggatgggcactagtggaccaaatcagggtcctacgcagtcaacaggtatgatgaacagtccagtaaatcagcctgccatgggaatgaacacagggacgaatgcgggcatgaatcctggaatgttggctgcaggcaatggacaagggataatgcctaatcaagtcatgaacggttcaattggagcaggccgagggcgacaggatatgcagtacccaaacccaggcatgggaagtgctggcaacttactgactgagcctcttcagcagggctctccccagatgggaggacaaacaggattgagaggcccccagcctcttaagatgggaatgatgaacaaccccaatccttatggttcaccatatactcagaatcctggacagcagattggagccagtggccttggtctccagattcagacaaaaactgtactatcaaataacttatctccatttgctatggacaaaaaggcagttcctggtggaggaatgcccaacatgggtcaacagccagccccgcaggtccagcagccaggtctggtgactccagttgcccaagggatgggttctggagcacatacagctgatccagagaagcgcaagctcatccagcagcagcttgttctccttttgcatgctcacaagtgccagcgccgggaacaggccaatggggaagtgaggcagtgcaaccttccccactgtcgcacaatgaagaatgtcctaaaccacatgacacactgccagtcaggcaagtcttgccaagtggcacactgtgcatcttctcgacaaatcatttcacactggaagaattgtacaagacatgattgtcctgtgtgtctccccctcaaaaatgctggtgataagagaaatcaacagccaattttgactggagcacccgttggacttggaaatcctagctctctaggggtgggtcaacagtctgcccccaacctaagcactgttagtcagattgatcccagctccatagaaagagcctatgcagctcttggactaccctatcaagtaaatcagatgccgacacaaccccaggtgcaagcaaagaaccagcagaatcagcagcctgggcagtctccccaaggcatgcggcccatgagcaacatgagtgctagtcctatgggagtaaatggaggtgtaggagttcaaacgccgagtcttctttctgactcaatgttgcattcagccataaattctcaaaacccaatgatgagtgaaaatgccagtgtgccctccctgggtcctatgccaacagcagctcaaccatccactactggaattcggaaacagtggcacgaagatattactcaggatcttcgaaatcatcttgttcacaaactcgtccaagccatatttcctacgccggatcctgctgctttaaaagacagacggatggaaaacctagttgcatatgctcggaaagttgaaggggacatgtatgaatctgcaaacaatcgagcggaatactaccaccttctagctgagaaaatctataagatccagaaagaactagaagaaaaacgaaggaccagactacagaagcagaacatgctaccaaatgctgcaggcatggttccagtttccatgaatccagggcctaacatgggacagccgcaaccaggaatgacttctaatggccctctacctgacccaagtatgatccgtggcagtgtgccaaaccagatgatgcctcgaataactccacaatctggtttgaatcaatttggccagatgagcatggcccagccccctattgtaccccggcaaacccctcctcttcagcaccatggacagttggctcaacctggagctctcaacccgcctatgggctatgggcctcgtatgcaacagccttccaaccagggccagttccttcctcagactcagttcccatcacagggaatgaatgtaacaaatatccctttggctccgtccagcggtcaagctccagtgtctcaagcacaaatgtctagttcttcctgcccggtgaactctcctataatgcctccagggtctcaggggagccacattcactgtccccagcttcctcaaccagctcttcatcagaattcaccctcgcctgtacctagtcgtacccccacccctcaccatactcccccaagcataggggctcagcagccaccagcaacaacaattccagcccctgttcctacaccaccagccatgccacctgggccacagtcccaggctctacatccccctccaaggcagacacctacaccaccaacaacacaacttccccaacaagtgcagccttcacttcctgctgcaccttctgctgaccagccccagcagcagcctcgctcacagcagagcacagcagcgtctgttcctaccccaaacgcaccgctgcttcctccgcagcctgcaactccactttcccagccagctgtaagcattgaaggacaggtatcaaatcctccatctactagtagcacagaagtgaattctcaggccattgctgagaagcagccttcccaggaagtgaagatggaggccaaaatggaagtggatcaaccagaaccagcagatacgcagccggaggatatttcagagtctaaagtggaagactgtaaaatggaatctaccgaaacagaagagagaagcactgagttaaaaactgaaataatccaggaggtggaggctgtagtgagctatgattctcggcacagcagtccagcttgggtgacacaag

SEQ ID NO: 579538 - DNA, 186 bp, Homo sapiens
taagtagcgccatgaatatcctgtattgagacatatattcaagcccagattctctatttgaactcctgatgtactgacaagagattctaaacattctgtgttgcacaggtacactgactatttcagagatttgaacgaaccccgggcaaggtctggagtgttaatggaagataccgcccaaaccca

SEQ ID NO: 579539 - DNA, 240 bp, Homo sapiens
atgtccgacctataacgcgctaccggtttgcataagtaatcatgattgtctggagttggagattcaaaatctgctgttcacatcccggcgtaacgtcttgtctcgaacgagccctagctgtccacgtagttcgaccagccagtttgccaaggaggtgccgcccaagttacttcaagcacaacaacatggccagcttcgtgcggcagctcaacatgtatggcttccggaaagtggtccaca

SEQ ID NO: 579540 - DNA, 314 bp, Homo sapiens
ggctttctaattttaaccattcagtaggagtgcaagaatagccagcttccgttttacatatgttcttagcatatttaagattaagtgcatatccctcttcaaaaaatgtcttttttttttaaaggattttaatattcctttaaaagaacatttatcatgcaagcattaataacccaagaatgtctgacctctaccctttacaacagtttagggtcctaggaagtccgtttaaaggtcattactcatcatctgtcagtaaaaggattggaagaatatttgcatcaataggacaattctgaaatatctcttagtcc

SEQ ID NO: 579541 - DNA, 470 bp, Homo sapiens
tgggaggaggagtcttgctctgtcacccaggcgggagtgcaggggcgcaatctcagctcattgcaacctccacctccggggttcaagtgattctcgtgcctcagcctcccgtgtagctagatattacaggcttgtaccattgcgcccgggggctcattaacatttggtattagcaaaaatgggggtggggggctggctgatctctctgcactccctcccctcacattttggggtacctacaagggtggctacttgatgtttaataggggctgtacccccacataacccctaaggagggcatggaaaacacctgtgttctcaaggaaaagccgtgagattaaaggacttagcgagagttggccacggtgaggaattcagacttgggttctgcctctgactctgttgtccctgaatcagtactggagttcccgtgtcctcacttggtccagtggagaggcaggggaagccga

SEQ ID NO: 579542 - DNA, 297 bp, Homo sapiens
atggcaacaatgaggagaacaatagacaccaatgccttctggagggcagaaggtgggaggagggtaagggttaaaaaactacctgtcagcttactgtgctcattacatactgtgactgaagtcatttgctacaccaacacccctattgacacgctaatttagaccatgcttacaatacctagcactcgattcacccatgaacctcaaaataaaacgttaaaacaaggaaacaataataacaacaggactacacctattaaacacatgttcttaaactttctatcctttataggagct

SEQ ID NO: 579543 - DNA, 103 bp, Homo sapiens
ctgaggtactggaacagttgaggcaagaatctgaacaagcgttgcatcattacatgctttccgagcatactgaatctgattccgcagttgttctgcttcttga

SEQ ID NO: 579544 - DNA, 358 bp, Homo sapiens
agcggattgccgccgtcgcaccggtcggagctcctctctcgcgcgtctctcctccgatggagctctgggcgccgccgacgccgccgctgccccgaaccctgagcggggccgccccggctcggaggaaccgcgccgcccacgtccagaggagctgcagacgcagccaggagcacctctgtccgcggcttgcgtggcagcagtgctcctgcgggaaccgagacaacgtcgcgcgtcatactctgcgctggtgtcccttggagccgcgccgccgtgcgggcaccacctgggctctcgaccgacaccaggggcaagcaggcgcgaggcaccaaccctgcccagaacccgacaatgcctcccc

SEQ ID NO: 579545 - DNA, 473 bp, Homo sapiens
agacaccagtcatgacgcctcccacagtgctgggattacaggatgtgatcacactgtgtcggccaaatatcgatagtattctaagcacaagtattatatacttctctccagtaacaacttgactgctcaacacacaggaaatgcattttccttttatcagctgaagtcaattcactaccatccgctagataagcagatcaagttttattttagggtaggtgatctaaacaatgccacaatatgaaatttggaatcaaccaatatatattgcggatatgctttatgacatgtgtaatatcacgtgtattacttcacttattcctcacaacaacccgtgaagtaagtattaccaaagcctatgtgtagatggggaaacttaagatacagtaacgctatataacttgtgtcacgcttgctgagctgacagatgggagaatcaggacacaagtctggtttctaaggcatcctccttc

SEQ ID NO: 579546 - DNA, 141 bp, Homo sapiens
ggggtgggaggctgatgattatttgacaaagtgagttatgaagactggtgggcaggagtagtgaggttgtctgagccagtgtctgatgtgcccagctgggaagctgatgaatagctgagattctgtagctgaggaccatcg

SEQ ID NO: 579547 - DNA, 258 bp, Homo sapiens
  misc_feature (123)..(123): n is a, c, g, or t
tatgttctgcggatcccgtaatctcgagagttgtgcaggatggtctcaatctctgactcaggtgatccgcctgccttggcctcccaaagtgcttggattacaagcatgagccactggcacctnagccccctttttttttttggagagacagagtctccctctggtggcccagcctgggagtgcagatggcacgatcttgggctcactggcaacctctaactctcccagcttcagagcgattggtcctggccttcagct

SEQ ID NO: 579548 - DNA, 180 bp, Homo sapiens
agaagggttgaaaggcaaagctttgggccaaaaacaggggttggggggtcccccctcaagtttggacccgtttccgtggttgtaacaaaggatcggaggttgggttcctgattaaacttccctgtgtgttttctatctgggatcccagtttttgaagacaacttgctttgtttcacccta

SEQ ID NO: 579549 - DNA, 423 bp, Homo sapiens
agggggggatggtggcctcctggtgtgggggttccaggcccatgttttccttcggcacggcgcgggtagaggtctccaagaggttctgcctcggcaggaggcttctgcctgaaacaggggggggcggtaggggcggatccttccccatgggttaatcttccggatgctgatctcctgatagtgagttctcatgagatcgggtggtataaccgagtgtggcacctctttcctctcggtgtcttcttcctactcctgccatatggaacatctcatggtcactgggccttcgggtatgagggggaggcttccttagtcctcccagaagcagaagccattggctgccttacagccggcagaaacatgagccaattaaacctctttaaaaaataatattacagaaaattcggtcggtagaagggagcc

SEQ ID NO: 579550 - DNA, 856 bp, Homo sapiens
  misc_feature (598)..(598): n is a, c, g, or t
  misc_feature (629)..(629): n is a, c, g, or t
  misc_feature (638)..(638): n is a, c, g, or t
  misc_feature (686)..(686): n is a, c, g, or t
  misc_feature (701)..(701): n is a, c, g, or t
  misc_feature (742)..(742): n is a, c, g, or t
  misc_feature (770)..(770): n is a, c, g, or t
  misc_feature (777)..(777): n is a, c, g, or t
  misc_feature (796)..(797): n is a, c, g, or t
  misc_feature (807)..(807): n is a, c, g, or t
  misc_feature (827)..(827): n is a, c, g, or t
  misc_feature (834)..(834): n is a, c, g, or t
tttcatggagaaatggaatcacacttcaaatgatttcatttgttgggtctgcttcccccaaatcaaactggaatatttctcttgtgccttatcatcctcatattctttctggcctcggtgggtaactcggccatgattcacctcatccacgtggatcctcgtctccacacaccgatgtactttcttctcagccagctctcccttatggacctgatgtacatctccaccaccgtccccaagatggcgtacaacttcctgtccggccagaaaggcatctccttcctgggatgtggtgtgcaaagcttcttcttcctgaccatggcgtgttctgaaggcttactcctgacctccatggcctacgaccgttatttggccatctgcactctctctattatcctatccgcatgagtaaatgatgtgtgtgaagatgattggaggctcttggacactggggtccatcaactccttggcacacacagtctttgcccttcatattccctactgcaggtctagggctattgaccatttctctgcgatgtcccagccatgttgctcttgcctgtacagatacttgggtctatgatatatggttttgtangtacagctctctctccttttccctttcattnggcatcacntcttcctgtgggccgagtcctatttgctgtctatcatatgcactcagnggaggggagagaaangccttcaccaccatttcacacatttactgtagtgatctttnactatgcacttttgtctacactatctcngcccagnatctccgctcaccagctgnngacagatctngcagtctctacaccatcctnaccccangcccatccatatctcagctgag

SEQ ID NO: 579551 - DNA, 1252 bp, Homo sapiens
gcagaacacatggtgtcgtgaaaactagccctaaaagccaaaatgggaaacggacaagactcaatatcaacattgtcgattcattgagacacgtacgattcgggcaagatccaccactactggccatctgactctactaaatgtcggtggcatcgacaaaacgaaccattgaaaaaacttattgactgaacggaggcatgctgacgactgggacatgcggctcctatcaacgtatgcctggtgtctgtaggataacatctgacagactaatggccgtgaacgtgaggtataccctacattgatacttctgcctctgtgagagactttggaagacgacaaagtgagataacctcatgtggaacttcctacagtacgcatgaccctcaatggaacaaccatgacgcactttatagtttccaaacaaagcacatagcatctcaccagggggcagcatacttgccatggcctagaacctaggtagctagtctcattcgtagtataggttagccttagcatggggatggatcccgagtgaaagtctccgaagacgtgggatcctctctcgacggggacattcggggcgaatggaacgcaacgaggaagcgaaggtgccgcgtccccatggacgtgacgaccacgtgacagatgtgcgaaccagagaccatcgtgagaaccgggatgacggacgacgacaatgggagtgcccaccaacgaagtgcagaccaaagcaggagcaagacacaaagaatatagaaggggacaaatgggaagaaagggaacagggaccagccaaagcaaaaaccagtgacacggaaataggcaggcggcagcgaagaaaaccccacggacgacaagaagtagacaatagagggagcacaaagacgaacaaggcgaagagaaacagaggcgaaccgagaaagaggccttgcgaacgccaaaagagggcataaaacagagacacaaggcaaatcaaagagggagaaagaaagagagacaccgagaaaggagcaggcgaagaggcacaagcaaggtaggcagccggcagcagaagaaagggatctaggaagaggaagtgcgaaccacagaagagagaccaaacgaggaagacagaggacgaagagaagacgacagagaagcgcacaagaaaaacgcaggcacaggacactgggacgggggggcgagaggagagaacgactaagagaaagcgagagcagagagaaagcaggaggcagaaaaggaacaaggaacggaa

SEQ ID NO: 579552 - DNA, 207 bp, Homo sapiens
  misc_feature (29)..(30): n is a, c, g, or t
  misc_feature (139)..(139): n is a, c, g, or t
cccaaaccacccaccaaactgccgagccnnatgggacaattacaacaacgtggccacggtccccaccacggagcatatcccgagtcctgtggcttaggcccatctccaggggtagagcaggtccctccagcacctcttncccctgctagctaccctcctgccacctccacgaacaagcggaccaacttgtagtaggccaactcggag

SEQ ID NO: 579553 - DNA, 377 bp, Homo sapiens
  misc_feature (53)..(53): n is a, c, g, or t
  misc_feature (66)..(66): n is a, c, g, or t
  misc_feature (81)..(81): n is a, c, g, or t
  misc_feature (142)..(142): n is a, c, g, or t
  misc_feature (188)..(188): n is a, c, g, or t
  misc_feature (191)..(191): n is a, c, g, or t
  misc_feature (210)..(210): n is a, c, g, or t
  misc_feature (242)..(242): n is a, c, g, or t
  misc_feature (244)..(244): n is a, c, g, or t
  misc_feature (278)..(278): n is a, c, g, or t
  misc_feature (280)..(280): n is a, c, g, or t
  misc_feature (377)..(377): n is a, c, g, or t
gtgatagaaaggaatccacccccaccaagccaaccatggagctaaaaacaganacaacaagaaggncaaaactggccactncctgccccaccccttcacagcccaaagcagaaaaaggtctgctctactctcaaggtgagtnacaaagagccggtactgtttctgcccctggcataccctgagaaccnatntaacttctgtagtgctcancccctgtgcccttcctgggcctgatccacatntntcaacacacacactccctctcacagtctccaaanancactgcagagcctagctgcatctgccaagttcaaagaggaatttttcacattttctcacttccaatctccatcttccttcctctgtctcccactctn

SEQ ID NO: 579554 - DNA, 254 bp, Homo sapiens
gctctgtcaggcgtatctattgaagccttcagtagagcagaagggaagctttcctgccacccggtacatccttacgcagattgactaccaaccttataaagtctcatagaagtgggtactattgtatcatcatgtgttataacaatttgtagttactttctattttccttattaattgaataccatttgagagcagagtaaatgtcatatttatttctcttacttgttcaacagtctgtttttttttctttttt

SEQ ID NO: 579555 - DNA, 457 bp, Homo sapiens
gtggagccttttctgggcctgccaatggcccaatcagcacacacttcttccccgctgaggtccataaaaaccctgggctcagccagagcagcgcagagaatagccagaggatgaagatggtagagacgaggggacaggatgaccagctgcagagagcagtaccctctctgctgatagctggagacggtggggtgaccagctacagagaggagtaccttctccgctgaaagctacagagaccacctgccagcagagaggagctacactctgctgcgagcttcagagacctgcagagacattggaatgacttgcctgcggagaggagccactctctccagggcctcctctctgttgagagctgaatgcttgagctcatgggacaatctgtctccagagaggagctacccactcctctgagctcttctaacactaaataaaactcctcttcacccttcaa

SEQ ID NO: 579556 - DNA, 675 bp, Homo sapiens
ggtgttctgtcccagtgcggtgactcctcttaatttccccactgctctctgtgagtgagaaatttagcctatgctccaatcaaattactgtacccttcgacatgtactgttacagctttctgtgcagagatgactgtccaactgcaacaagcctacgattgaaatgaaaactctattgttacctctgagttgtgttccacggaaaatgctatccagcagatcatttaggaaaaataattctatttctagcttttcatttctcagctgtccttttttcttgtttgatttttgacagcaatggagaatgggttatataaagactgcctgctaatatgaacagaaatgcatttgtcattcatgaaaataaatgtacatcttctatcttcacattcatgttaagattcagtgttgctttcctctggatcagcgtgtctgaatggacagtcaggttcaggttgtgctgaacacagaaatgctcacaggcctcactttgccgcccaggcactggcccagcacttggatttacataagatgagttagaaaggtacttctgtagggtcctttttacctctgctcggcagagaatcgatgctgtcatgttcctttattcacaatcttaggtctcaaatattctgtcaaaccctaacaagaagcccgacatctcagttggatcct

SEQ ID NO: 579557 - DNA, 760 bp, Homo sapiens
tctggcacttgctggacatgtcccctaccctcttcccaagaggagccgtcccacatttgggtagttagtacccaggactggttggactgatcgggttagggaccctagagggttaagtggaacaatcagacgtatggggctgcaatgccctgttctggcaatcatccgcatcgtacccagcgtggggtggtttctgattgtgtgctcatgcctggttgcataatttggtttttaacccacaaattgtgattattttttaagaaagccaaacagatttgggcaggagttagaataagtcccggaggcctgggcttctctgttcttggccctccgtaagtctccctccgaaggaggagcgccctgagggaggaggaggatctcagcgggcctctagccggttccagatgcagtctggggagtgggctgaagggtgaacgggctggaaggctgtgggtccactctccctatctgaggaggcagtctgcagactcgaggccctaagtagcactctttgccctgtggcctctcccttttccccccttctggttggaggagggagaagtgggaagtagcttggcgaactggtctgtccaccataaatgttccccatctgttccttgggcggcctctgggcagagtctcctggccaggcttgtgtagagatgggcctggtccacagggacctgaagggagaaaccctttgcctcgggaggaggtgcccctaccgtgttacgggccgggcccgccccccttacggggg

SEQ ID NO: 579558 - DNA, 532 bp, Homo sapiens
cagcagcatagatattacggagtaaaatgctgccagttttgtgttattgactgtatttcaataatgacagaaaaaatgttatgaagcccagggtcctaaatctttgcggtagctgatcaaataatctctgaccaaacaatagtattctgtcctattagtcactcactaattcattaccattttcaaacaagttctctaagtcttacttaaacttagtacttcttgaagaacagattataacaatacgggctcaaaatatctccaaatatatttttttcctaaaatgcataagctggtaatagcaatcataacaacagattccatcactgtagctgcttagaaaagatgctcatatctcaatggattcttccaataatcctgtgaaagtaggcaaaattagaattactgccacatttaatagccaagggtcagatatatgaaattatacacttaagatcatagttagtcagggaacatccagaaacagaacccagatatttagactcccagtttagtgctctttccaacaaac

SEQ ID NO: 579559 - DNA, 1195 bp, Homo sapiens
gccctttctgcctgtttgcatgtgtgggtatgtctgtaggatattttcctgaactgggaacactgagtccaagtcagtaattttggtagacattgccaaactcttctccatcagggtagtggcattttatcatctaccagtgatggagaggagtgcctgttttcccagagtatgttgtaaacttgtggatttctcctgatctgataggttaaaggtggtatctgtgtctgcttatgatgacataaaaagatgttctgaggtcagaacatcttttcttaatgttatagaccatttgattttcttatgaagtgtctctttatgtcctttacccattattctgtagggtcattgagcttctcaatttctttacatactagggagagtagcctttcatctgtgattaagagttgaaatattttctccagttgtcattggaccgtgtttgtggggttttttccaccatgtggaagttgtttttacataatcaaattaatcaatcttgccttttatggcttctagatttgagttataggtagaaagcccttccctactcgaaggttataaagaaatttacctgttattttctgagtatttttacagctacatattttatacatgattttttcttatttgttgagagctcctcttgttgtatggtatgaaagaatgatctttttttcctaaatggctatccagtggtcccagtggcaattatttccttttttacacccctgatttaagatgctacttttatcatatgctaaatgccttgtatatatttggatttattccgaacttcctatgataaatagtactttggaagagagaaataatctgatgctcaaagacatctagccagaaggagagtacaaaggcatatgcttgattacgtatcacaaagatgccatgaagatggagggttgttgagtgtggtgtcgtcacgcttatctaggagagagacctgaggagacgcacagactcgcagatctaagatagtcccgtcagcacggggcttacgctgatccgcgcttggggccgggggggtcactaaggccttgaccgctgccacagtgaaccttttggttaggcaaatgcggaagggcgcgatcaggcggcggagaactgacacgggggggcaccccccggggaggactaaaaagacatcgggtttaaggcttcctgcactctcattatc

SEQ ID NO: 579560 - DNA, 775 bp, Homo sapiens
gccctttctgcctgtttgcatgtgtgggtatgtctgtaggatattttcctgaactgggaacactgagtccaagtcagtaattttggtagacattgccaaactcttctccatcagggtagtggcattttatcatctaccagtgatggagaggagtgcctgttttcccagagtatgttgtaaacttgtggatttctcctgatctgataggttaaaggtggtatctgtgtctgcttatgatgacataaaaagatgttctgaggtcagaacatcttttcttaatgttatagaccatttgattttcttatgaagtgtctctttatgtcctttacccattattctgtagggtcattgagcttctcaatttctttacatactagggagagtagccttttccacttcctggttggaatttacaagcaagttttttggaaaacaaacacaacttttaaaattttttcttctacccttttcccccccaaagggttttcttggggtcccccattttgtgggggagacccccggggtggattctacacatacggcattgcgagggagaggacggactatatcacaaattgttccccccaaaccccccaaattgtgtttgtggggccaacaaaggtttctctcgggcttgttctctttaacccaatttcacatttccccaacaattttcctaaatttccccaaaatttccttttgggccgcttttttttatataggggctttttccttaaagaaatctctcgggaagtttcatcaaggttacagcaca

SEQ ID NO: 579561 - DNA, 446 bp, Homo sapiens
  misc_feature (14)..(14): n is a, c, g, or t
  misc_feature (35)..(35): n is a, c, g, or t
  misc_feature (53)..(53): n is a, c, g, or t
aaaatgactcaggntgggacacctagctagcctcnatgatgaggctggccatncagaaagaccaagtgattagaggatgagagggttggaactttcaaccccacccaccaaccactaggaaaagtggaggccgaaggagtccggagatcaaactgtaagactcttgaacaatgagatttgatgagcttctgagttgctgacatgtgtaggtgctgggagggtggctggccaagagagggcatggaagctctgtgtccccctttctataccttgccctatccatctccatctggcattcatcagtatcccctctaatatactggataaaaaaccagtaaatgggtgaggtgcagtggctcacttgtaaccccagtgctttgggaggcccaggcagaagcatggcttgaggccaggagttccaggccagtttgggcaacatagtgaga

SEQ ID NO: 579562 - DNA, 359 bp, Homo sapiens
gaaccgcgctgcgtaatcttgtgtatcccgggtcagaatggttgtgtaactcattgatggtcctggcgatggtaggtgatgcagctgctggcagcctaacggatgtctccatggtgtagttaggtgtgcttgagtcgaagatgagcgcctcctgtatgagctggtggtcgccctccagctgatcaatctttggcttgtagttgacgatgctcctctcatactgccgcaggtggtgagctggtcctccagggtcccatgcatcttcaatggagaatctcccgatctcctccatcttggcttggatccaggggctcgatgacattcggctggggtccaaattggttgagaagcctctcatt

SEQ ID NO: 579563 - DNA, 368 bp, Homo sapiens
ctccacagcatgacttgtgtgcagcaggagtatgagaccctctgggcaaagaattaaagacaaatgcgggtcttgcactgtcacccaggctgcagtgcggtggctcaatcacagctcaccacagcgttgaactcctgtgctcaagcaatcctcccacctcagcctcctgagtacctggagcacagtgcctttgtgagctgtgacactcatggtaaaggtctgtagcttcatttctgaaaccagcgagacccccaacccaccaggaagaacaaacaactctagacgcggtgccttaaaagctctaacactcaccacgaaggtctgcagcttcagtcttgaaccaccgagaccacaaaaccaccagaaga

SEQ ID NO: 579564 - DNA, 184 bp, Homo sapiens
atctggggacacttggtggacagcagatgtgccttccattcatcatcatcatcatgagacccagcttctgtacacgggggtccccggcacgaggcacgatcccgtggtgtcatctaaacaaaactaaggcagaaggcttacggaagagtacgaagaattgggaaggccttacatatcgtagctt

SEQ ID NO: 579565 - DNA, 1171 bp, Homo sapiens
  misc_feature (50)..(50): n is a, c, g, or t
  misc_feature (104)..(104): n is a, c, g, or t
  misc_feature (119)..(119): n is a, c, g, or t
  misc_feature (145)..(145): n is a, c, g, or t
  misc_feature (155)..(155): n is a, c, g, or t
  misc_feature (171)..(171): n is a, c, g, or t
  misc_feature (173)..(173): n is a, c, g, or t
  misc_feature (177)..(177): n is a, c, g, or t
  misc_feature (179)..(179): n is a, c, g, or t
  misc_feature (227)..(227): n is a, c, g, or t
  misc_feature (274)..(274): n is a, c, g, or t
  misc_feature (278)..(278): n is a, c, g, or t
  misc_feature (290)..(291): n is a, c, g, or t
  misc_feature (321)..(321): n is a, c, g, or t
  misc_feature (329)..(329): n is a, c, g, or t
  misc_feature (351)..(351): n is a, c, g, or t
  misc_feature (378)..(379): n is a, c, g, or t
  misc_feature (383)..(383): n is a, c, g, or t
  misc_feature (450)..(450): n is a, c, g, or t
  misc_feature (532)..(532): n is a, c, g, or t
  misc_feature (575)..(575): n is a, c, g, or t
  misc_feature (602)..(602): n is a, c, g, or t
  misc_feature (607)..(607): n is a, c, g, or t
  misc_feature (636)..(636): n is a, c, g, or t
  misc_feature (655)..(655): n is a, c, g, or t
  misc_feature (704)..(704): n is a, c, g, or t
  misc_feature (717)..(717): n is a, c, g, or t
tacccaagctccagtggttccatactggcgcctgcctggtttaggcattntcatctacctgctgaaacagagtgctaatgatttcttcagctattatgacagtnatcgacagagtgtcngcacagccacaaaatgcagagcagcnccccccagangagacaaaagagtggngncagncngcgacgcccgccggtgttgacaaaacccccaccgcccagaaaaatggnctagcaagacggcgcttggtgaaggtgatcaacaaccgagctaaacngctncccctttgttcnnttatcatagagacccgcccatttatccttnggcgccanctggagtactacttgttacatngcatgcccacggatccccaagaccccnnattngccccgagaaccttgtttaaaagcagaagaccgcaagatccccccgccccagaaaccaatctagatnttagaagtgggctggctatagtgagccaacatgatttagaccagcttcaggctgatgcaaccaacgcttttggagaatcacnacaaaagaaacttctggacattgaaggattatattcaaaagtncgatctcgatatagtttcatacaggcncttgncagacgtacccgtggcctcttgaggatancaaggaactgagagcccgngcttatgctcttctatgagagagatgaattggggagaattgtctccatnttatagattagtntctttctaaattatgaccaaaaatattttgctatttctttctttgtatatggacatctttgctgtaaacttcttccctattcatcctcactagtaaaataatactttaaaaacaaaaaaaacaaaaaaaaaaaagggggccgcaaagtccccgaggccagacggaccattgccagggcccaaggagcgtaaacagcacgccgggtaaaagggaaggaaacggacggacaccggaagaaccctttaatttggtggggggggtgaacaatatgtgggaacaaaatatacccatcaggaagaatttaaaagctcttacaggaaaaattatacacattttaaagggtgatatatcacgggtgtaaaaattagcgtgatatattgcgatgcagctggaaaagtttgggataatggaatttttgattaggaaaattttataccgtgacatatatacaggg

SEQ ID NO: 579566 - DNA, 573 bp, Homo sapiens
ggaggagctcagctgctcacgtaatgagatggcgcccttctagtgaggccttctgcccctggcacctgcttcaatttgtcctccacagcactgattggcatgccacaagctggtccggtctgtctgtctcatgtttgtcttgtgctcggttaggcgcaacggcgggttagtgcctagcacaccagcatataatgagatgctggatagaattgtggtgcatattgattgtactcaagcaccaccgggtccgtgagagtgggtgtcgacctggagactttctggagatgcgcgtctcgctctgtatcgcccaggtctcggacgagtggatatcgggactgatcttggcgtcactgcaaagactccaactcctgggttcaaggcgatcctcctggctcagacctcccgagtagctggtgatccacaggtgggtgtacaccaaagccagctcagtattgtcattacacgcagtagatggggtctcgaccatttcgcccaggctggtctaggaaactcctgactatcaaattacctcaatctgcctcagactcagcaaagtgctggcattacacggcg

SEQ ID NO: 579567 - DNA, 296 bp, Homo sapiens
ggtggtgatacgatggcccggaaggaatccattgtttagtttacagcacagagatctttctctcaatgggaattgtgctcttggttacagcaataagtgaaggaaaaaagatcttgcccttttgaagttctgaggggaggtgtagggtgtccatgttagtacggttggataggatatgctctcatggtaacgcgtccaagttggaatggtcttccagtctccatggcatccacatgctactggcgttagttccagatcttgaggaagctatcccaggaccctgtcgccacagccat

SEQ ID NO: 579568 - DNA, 254 bp, Homo sapiens
  misc_feature (33)..(33): n is a, c, g, or t
  misc_feature (103)..(103): n is a, c, g, or t
  misc_feature (112)..(112): n is a, c, g, or t
  misc_feature (193)..(193): n is a, c, g, or t
ttgtgtgggacttcgatgccctgttaccggttntatccatcctggtttccaactataacccaaaggaatttgtaagtggtgttcagaattatttggaaaacanttggcttcnacatgagaaagctcctaccgaagaagggaaaaaagagctgctgttcctaagtgacgcgatcccctcgctgctggagcggcnctgtgcctacctctaagccaagatcacaaaaaagagacgctcacagtgggcttctgctttg

SEQ ID NO: 579569 - DNA, 251 bp, Homo sapiens
  misc_feature (6)..(6): n is a, c, g, or t
cgtgcnacaggccactgggttcagcagcagagcatcgcattcttgcgggcacatgggttggcacttcggctgcttgtcgtgatggtaaaggaccacgtcagaggcgtgctcaggccccctgtcaggttgaccaaggtgctgtggccaaacttatggatcttgaagacacgattattgatgtaggtgacaccatagatgttatcctcaaagacgtcgatgctgacggggtgacttaggcctcgtttgctgtc

SEQ ID NO: 579570 - DNA, 378 bp, Homo sapiens
  misc_feature (6)..(6): n is a, c, g, or t
  misc_feature (28)..(28): n is a, c, g, or t
  misc_feature (53)..(53): n is a, c, g, or t
  misc_feature (55)..(55): n is a, c, g, or t
  misc_feature (59)..(59): n is a, c, g, or t
  misc_feature (63)..(64): n is a, c, g, or t
  misc_feature (71)..(71): n is a, c, g, or t
  misc_feature (73)..(73): n is a, c, g, or t
  misc_feature (82)..(82): n is a, c, g, or t
  misc_feature (90)..(90): n is a, c, g, or t
  misc_feature (149)..(149): n is a, c, g, or t
  misc_feature (170)..(170): n is a, c, g, or t
  misc_feature (193)..(193): n is a, c, g, or t
  misc_feature (257)..(258): n is a, c, g, or t
  misc_feature (290)..(290): n is a, c, g, or t
  misc_feature (329)..(329): n is a, c, g, or t
  misc_feature (368)..(369): n is a, c, g, or t
  misc_feature (373)..(373): n is a, c, g, or t
tttctntttgtaaggacttgtgcctctngggagacgtccacccgtttccaagncngggncacnngcatctncngagtgtgcnggggtctnggaggcaggtcccgagccccttgtccttcccacggccactgcagtcaccccgtctgcgncgctgtgctgttgtctgccgngagagcccaatcactgcctatanccctcatcacacgtcacaatgtcccgaattcccagcctcaccaccccttctcagtaatgacccnngttggttgcaggaggtacctactccatactgngggtgaaattaagggaaggcaaagtccaggcacaagagncggacccagcctctcactctcagttccactcatccaacnngggncctca

SEQ ID NO: 579571 - DNA, 856 bp, Homo sapiens
  misc_feature (413)..(413): n is a, c, g, or t
aaaaaagaaaaaaatagaaaaaaaaaaaaaaaaagctgtgatctctatcagaacttcctttcaacgggtcctcccctccaagcagaccacctgttccccttctatcccagctcaaaagcagctgacccaactcagaaattcttctttctccttacaggattgaagtgtgccttttgtgaagttggttatttttaagcccgagaagtttaattttttctacacaacattatttctccagaacattcttttatagtcttttataattggctcttagaattacttattaagaagaatgaccattgacaattttctctagaaaccgtggtagcgtgtgtgttgtttgtgttggcggggggggttgcgtgaaggggaggggaaagttgaagtctccacgaggaaagccttgttccccncaaacgagggtgttgtgcacttgctctctgacacaacacccgtgggtggcatttgctgcgagggttccgaggcctcccgtaatataggacagagattccatgaacttaatgtcattgtgttctcccactcatttttggaccccagtttgggcaactgtttctgcacatggtgtgtggcttcaacaacttttagggaacacaaagtagatttaattttcatctctattcatttctggatgggttgcacaagttttgtctaggaggtccccatttttctccttgaaagggtgactatccgtgtgcacttcgtgctcctccacattattgccatacattttggtgtaacagggcggtactggctgggggaaagccaggtaacaagaaaccctaaaaaccttgggtattaagaaaccgtgctggcttaaactcttcctttccaactg

SEQ ID NO: 579572 - DNA, 860 bp, Homo sapiens
gctgtactggtgcggtatacctgagatatagtcgactgataatgctccgctcgtgaacggctggactaatggctgccagcttaccgctgaataccttacctggcatagcattaaacaccacttccgcatcgtcgccaggagccagtcgcagcaaggagttctgacggaactgcgccacgattagtcgtttctgatcgggtataaacaccatcaccgagacgtaacggagcgacagctggcataggtaccctggacagaatcagtacctgggtcacataaccatcgctcggcgcacgcactatcgtctgctcacaggttatattttgcttccagcgagctgtgctttcaggctggcgcattttgacaatgttcacccaacaccaggctatccagctggtctggatctggattatgtaccgccgaccgatgacttacactgtgatgcttcctgcgacagataattttgccgcgccacatcgatatcgcgtctgaaaacgggtaaccttacgcctggctgaccagtgcgtaacgctgatactctatagcgaattatccccgacgtggcacttatgctgcatgagtattcgcacgcatctcatctaactctgcgaccaccgccccagctgtatattgtcctgcagataaacgaatatccgccaatcagccgatccaacccggcgcctgaataacgcgtagggtccagtagaactagcacataactttataaaatcagcgactatacttatccgccacttcaatcagacaaccaggacactgtatgacaccagaatagaaaacccgcattaagacataaaggctaggacgttatagaccaccactgacagctaaaaatttcaccg

SEQ ID NO: 579573 - DNA, 122 bp, Homo sapiens
gaatgcagatcgagagcctgaatgtagagctagccgtacatgacgaaggaatcatgaagaggatataatggaatttatgcagaccagagtggtcggccaggtcaacgtggagatcgatgcca

SEQ ID NO: 579574 - DNA, 346 bp, Homo sapiens
ccagaagacgccgctacacaaatggagtctcgctctgtcgaccaggctggagtgcaatggtgcgatctcggctcactgcaatctccgcctccgggtgagaggtgaagccagctggacttcctgggtcgagtggggacttggagaacttttctgtctagctaaagatttgtaaatgcaccaatcagtgctgtgtctagctaaagtttgtaaacgtaccaatcagcactctgtaaaaatgggccaatcagcactctgtaaaatggaccaatcagcactctgtaaaatggaccagtcagcaggatgtgggcggggtcaaataaaggaataaaaagctggtagccgaaaa

SEQ ID NO: 579575 - DNA, 1214 bp, Homo sapiens
gccttccccgcgagcggacgcggcagcgcctctgtctcgctttttcttatttttcccccctttccccttttcgttttttattatttttctgttttctttttcttcctccttcccccccttttaagccaatttccccttccggaaggcggatgttccccgggcgcaagggcgcaagagccgggtctcaacccgcgcgcaacaacagacgggtaccctggaacagagcggaatgtggcagccacaagaggccggacaccgagaacacaccataaccggagagcataacaacgcgcgcagcagagaggggcaaaccaacggtgcgcagagaagcaccaacgcgagtggaaaaagcacaacagggcgccgtgaaacacagggcgtgcgagaagaagcagcgacgaaaaaagcagagatggaacaaccccaacagagagacccacatagggcagacaaaagaagagaggaccgggaggcaagaacccacacggaagagacaaacaaccaaccaggacgcaaagtgagataacaccgagcaccacacaacacgaaaaaccattctacaacaaaaaccacgtaatagagggcagaccgcagacgagtagagaaccacccacacagctaccaaacaacagacacgacgacacacgaccaaaagaacctcaccaccaaattcaacacacaacaccacgtagaccaaaaggagagaaacaaaccgggcgcaccacccccgaggagggaaacacgacggagagagcaaggcccacccagcacccacaacgacagcggaacagcagagagcaaggagaggaagaacaaaaaaaacaagaaaagcggcagcaccagaaccacagacgtaaaagacagcaagaagaacacacaagcaagcatgcgaaacaactagacgcccacgacacacaatgacgtaggaacaacttaagacaggcgacactaagaactcaccacactggcagacagaccgaaagacagcacaagcgtgggacacccccacgtggccacacaacaaacagagagacgaaagacgaccacaaccgcaacacagcccacggaggaacacaagcaaacaccgcaacaggatgaggcaccaaaacacaaagcagaaacaacaaccagagacaggcgaatagctaacagacgcaacagaggaagaagagaccaaacagcgagaaagccaaacaactgagaaagcaaggaag

SEQ ID NO: 579576 - DNA, 1107 bp, Homo sapiens
ccccccgcgtatatatcccttgcaacaatgccccactcgttcgtcattctattgtttaaagcggtgtcctacgacgcctacatatctcttatcaacaccccgcccctctgagacactgctacgtgtaccctacctcgttccccactcaccggtgctgctcggttaaccaatccgacttaatttcctttgttaactaccttattgcgatcgtttttctcctcgtacacaactgactttggaagtgctaacaaccccctgcaagatggccctcattacctggacaacgggatcgtccacattgcaactgctcggaataatgtcctccaaatttcgtccttggtgtggcaataaccctcggttacctcttcgtatacatgcgcgggtttgcccttttgggtaactctcggccactcacacgtgaaatcgcttcccaaaaacgcttcgtgtcagtctcacgtttgctgcattacgcgcgcagtgtcctctcctaagtggcacgctcaggtgcatcgccctaacctcttattttacgccggtactctaagtgcacctcgcaactccagcgaatacacactctcggtccaactagtcacccatgatccactgcctatatcactctccatacggtgcatgaactcgcactcgattcgacgcgaacgctcctcgacttcgaggcatatgtcttggtgaacgcatacaagctcagagccttacactggatggtaactacgtcatgccgatcgggttaaagctcatatacgacacggacgcctcttggacagagattgatacgttcataaccctgtgtccatacatgaccaatcaatggcctccgtgaagcatattcaaataacgcactcgggcgcgtgaatcaccataactggcgaaccttgcgcgtcgactcgaatcctgtatcagagtacatctgagtgagagctactgcaatgccctatgcctcatcaatcccttgcctttgtactcttcagtcactcctcacttattctaatttcccaaccccctcccaacttgtttgtgtgatctcagaatctgtgccaagcatgacactgggacaaagggagaatattataccccctggtgagtcagcct

SEQ ID NO: 579577 - DNA, 520 bp, Homo sapiens
  misc_feature (125)..(125): n is a, c, g, or t
  misc_feature (129)..(129): n is a, c, g, or t
gcccaacttgctgtatcagaagtttgtgaagatggctacattgacttcaggtggagagaagccaaacaaagacttggagagctgcagtgatgacgacaaccaggggtccaagtccccaaagattntgantgatgagatgctgctccaagcctgtgaggggcgaacagcacacaaggctgcccgtcttgggatcacaatgaaggccaagcttgctcgcctagaggcccaggagcaggccttcctggctcgtctcaaaggccaggaccctggggcccctcaactgcagtcagagagcaagccccagggtcctggccaagcttgctcgcctagaggcccaggagcaggccttcctggctcgtctcaaaggccaggaccctggggcccctcaactgcagtcagagagcaagccccccaaaaaaaagaaaaagaaaaggaggcagaaagaggaggaagaagctacagcatctgaaaggaatgatgcagatgagaagcacccagaacatgctgagcagaacatcag

SEQ ID NO: 579578 - DNA, 387 bp, Homo sapiens
  misc_feature (232)..(232): n is a, c, g, or t
  misc_feature (237)..(237): n is a, c, g, or t
  misc_feature (311)..(311): n is a, c, g, or t
  misc_feature (317)..(317): n is a, c, g, or t
  misc_feature (366)..(366): n is a, c, g, or t
cacggtttttgtacagcaccaaagcctgcgagtttttcggctcggcagcttcccagctgcgtgcctgccagtagcgccaacggttggtggtggccaggtcctgtgggagtttgcgggtcaactggtaggcgtcttcccagcgcgctaggcaaaccagcaggcgcagacgccacctcggaaaccgtattgtcgcgcaactcggggtcgtacttggtcatgacctccagcgcgngcggngtcgaagcgctttggccagggtcaagccgatctcgcgggcaatcgagactttttcgtcacgggagaagtgcatnctgctngcgtaaaccgtcgagcagcgacatggcttttgttccggatcctgcccgngccagggaacgcaggcccagg

SEQ ID NO: 579579 - DNA, 501 bp, Homo sapiens
  misc_feature (13)..(13): n is a, c, g, or t
atgaaaccagccncccaggccagttgaccaaaatgcagacccataaccaaatccacattagccctaactgacttttgacaaaagtgccaagaacacacttggggaaagtacaccctcttcaataaatggtgctgggaaaactggatattcatatgcagaaaataaaactaggcctctatctttcaccatataaaaatcaactcaaaatggattaaagacttaaatgtaagatccaaactataatactaccagaagaaaatataggggaaatgagtcaggacattggtttgggcaaagattttatgaacaaaacttcagaagcactggtaatgaaagcaaaaatggacaaatgggcatatatcaatctaaaattgctctgcacagcacaggaaacaaatgacaaggtaacaaccaacagaatgggagaaaatattcacaaattatccatctgaccaggagtgaataatcagaatatataaggaattcaaacaattgaatagc

SEQ ID NO: 579580 - DNA, 82 bp, Homo sapiens
atccaaaatgtgtgattccatttatatgaaatgtccagaacagggaaaacctattttagacaacagagacacacagtcgatc

SEQ ID NO: 579581 - DNA, 100 bp, Homo sapiens
gagctataggtgatccatcccccacattggtggcatctttcccaatatttctccttgatgacattcttcaggtagtggtaaaactctgcgtcgcatgcgc

SEQ ID NO: 579582 - DNA, 175 bp, Homo sapiens
aggaacttcttaaccaacacttgacacatgttctcttcccccacaatgaaggaggtcctgctatgatatcgcgttggcactgccgcagtagagagagccctagacattctacgtctgcagacttctgtacactgctgacatctttgctatatgtcgcatttaagtgccatttccc

SEQ ID NO: 579583 - DNA, 361 bp, Homo sapiens
tttccccccttttttttccggggaaagggccccctgttcccggggggggttggggggctaaaaaaaacctcccgatttaaattttttaaatttggccggtttcccaacccggggaaaaaaaaaaaggggggggtttggctgggggaacccctcccggttttccttgttttataaaaaaaaagggggcccctaaggggggcctggttcccctttccccaattttggttaactttgggagggcccttttttgggaataactggaccccggtggaaaattgggcccggttttaaagggtgggtaatgggggggggggggggggggttccttttttaaaaaaaatttttttcccgccccctttta

SEQ ID NO: 579584 - DNA, 709 bp, Homo sapiens
  misc_feature (17)..(17): n is a, c, g, or t
  misc_feature (19)..(19): n is a, c, g, or t
  misc_feature (21)..(21): n is a, c, g, or t
  misc_feature (27)..(27): n is a, c, g, or t
  misc_feature (52)..(52): n is a, c, g, or t
  misc_feature (111)..(111): n is a, c, g, or t
  misc_feature (127)..(127): n is a, c, g, or t
  misc_feature (474)..(474): n is a, c, g, or t
  misc_feature (494)..(494): n is a, c, g, or t
  misc_feature (502)..(502): n is a, c, g, or t
  misc_feature (518)..(518): n is a, c, g, or t
  misc_feature (562)..(562): n is a, c, g, or t
  misc_feature (597)..(597): n is a, c, g, or t
  misc_feature (604)..(604): n is a, c, g, or t
  misc_feature (613)..(613): n is a, c, g, or t
  misc_feature (619)..(619): n is a, c, g, or t
  misc_feature (660)..(660): n is a, c, g, or t
  misc_feature (667)..(667): n is a, c, g, or t
  misc_feature (686)..(686): n is a, c, g, or t
  misc_feature (701)..(701): n is a, c, g, or t
cctaaaagaaacagctngngnttgcgntaagtttagtagacagtagatcacnataattatcttcatcgtccacataaagcatctgttattagttacttgctgtgaatggcnaattgcttctcttccnaaaaacctgtcatttctgaagtgagaaaggaagggggatgggtacgtatgtggtagttaaagacattaaggggcatgaaattacccagtaatggccttctcttctgataatggctttagtgttcaaatggtattgaagctacgccaccaagctcattaggaataatgaatcctggaagaatttaagcacaacagacagtgacttctaaacacaagtcttcctatcataagatccaaaccaggttgggtttcatattcagtttagtcttgtttctaactggctcctatccccagctttttccatccttcctcacctcctgtcacaccacttgaacctgggaggttgangctgcagtgagccaagattntgccactncacttccagcctgggntgacagagcgaaacttcagctcaaggaaaaaacggccaggggtnggtgaggaaatcatttaaccaaatccctcaatggntaagggntaaaacttnaatccngggggttttggctcccagagcaggagggtacacaatagttncattggnattactgtggatgttttgnttttgccccgggggnttgcaccc

SEQ ID NO: 579585 - DNA, 98 bp, Homo sapiens
  misc_feature (35)..(35): n is a, c, g, or t
  misc_feature (85)..(85): n is a, c, g, or t
cggcatcctgtggtataggggaagcgcctccgggncctggaatccctaccgccgtccctttgggtttagcacgatgagctcaatngcacgggtatgac

SEQ ID NO: 579586 - DNA, 481 bp, Homo sapiens
ttaaaaaattaccctggctgggtgcagtggctcacacctgtaatccctgcactttgggagaagaggcaggaggatcacttgagcccaggagttcaagactagcctgggctgtagtgagaccgtgtctctactaaaaataaaaaaaattagcccgatgtggtgacacatgcctgtggtcccagctacttgggaggctgaggcgggaggatcccttgagccccagaggtcaaggctgcagtgagctgtaattgtgccacttcactccagcctgggtgacagacaccctgtcccaaaaaagaaagaaaaaaaaaaaaaagagtaccttgatagcatgtacatatgttggagtctcaggaatggactatctagacttataaatggatatattgtcacctagctcattggtttcctatgcacttgatagtgtgagtcacacgcctgtaatcccagcactttgggagccaaggcaggtggatctcgc

SEQ ID NO: 579587 - DNA, 234 bp, Homo sapiens
gcgcccgctgcggggcctccgcgccttgtgttgcgtgctgcttcttccttctcgcagttcttcattctgtcgggcggttaaagtacttaaattccaccttatgttatgaagtttccagcaattgtttgtgtagcaggctttctgcagactttatagacttcacaacaaatttcttctgtacctattggaagcctgtacttttgacttatcagttaaccatctttacctgttttg

SEQ ID NO: 579588 - DNA, 627 bp, Homo sapiens
ccgggcgcggtggctcacgcttgtaatcccagcactttgggaggccgaggcgggcggatcacgaggtcatgagatcgagaccatcctggctaacacggtgaaaccccgtctctactaaaaatacaaaaaaattagccgggcgtgatggcgggcgcctgtagtcccagctactcaggaggctgaggcaggagaatggcgtgaacccgggaggcggagcttgcagtgagccgagattgcgccactgcacttccacctgggccacagagcgagactccgtctcaaaaaaaaaaaaaaaaaaaaaaaatgatgtaaaaaaaaaaaaaaaaaaaaaaaaaaggaaaagaaaaaaaaaaaaaaaaaaaaaaaaaaaaaaaaaaaaaaattaaaaaaaaaaaaaaaaaaaaacatgcggccgaaattggggctaattgggccaattggccctatggggggccgattaacaattaactggccgcggtttaacaacgtcgggactggaccctggggttaccaatctaattcgctctggaggaaatccccttttcgccagtgccgtaataccgaaggggcccgaacggatggcctttcccaacaggttgccaaccctgaagggcattgcttgggcct

SEQ ID NO: 579589 - DNA, 225 bp, Homo sapiens
  misc_feature (110)..(110): n is a, c, g, or t
  misc_feature (152)..(152): n is a, c, g, or t
taaaaaaacggggtctcagggtgtctccaaaaggggagtacaggggcacaatcagggctcagggcagcctgaaactccagggcttcaagttgatcctcggtgctgtgagncctccttcagaaggggggaattgcggggtgcatgtgccaccnacacccagtttagttttcaaaattattgggataaagcagggggttctggttagtgtggcccaggggggttctc

SEQ ID NO: 579590 - DNA, 190 bp, Homo sapiens
ctgaaaccacgatctgtcctcacttctcaggtggtcgtggggccaaatatcacgctgcctgagggctcggtgatctctttgcaccccccagatgcagaggaagatgaagatgatgccgagctccccgatgattataggggtgcacaaggaaaggagaaagtcaaggtgaacgtcacattcagcagggagg

SEQ ID NO: 579591 - DNA, 464 bp, Homo sapiens
aattgggacttaggagttttgattttgataagaaactgggataattttctgaactttttttcctctgtatcacatttatttactatttttaaaaactttgacatttaacacttgggacaacatttattataaatgattagaaaaattcttagaggtttgtctacccacagtgtcatggaatcttctctgaatactaatccataaagttccctgtagtaattggtcagaatgatctttctgaaccatttgaaaacttgttctagatcagttgcttatatatagtaggattttactttttcctgtttttgttctactatatgcttataatacctggaggaatacttactaatgaggtagtaaccatctctgatggtgggtttctgggggaatttttgtttttgtctgttttctatatgtgaaatcttttgtagtatgtatttttcttaattgaagagaatatgatt

SEQ ID NO: 579592 - DNA, 541 bp, Homo sapiens
cagggagtgcaggacggcagatgaagctgtgagtctacaccgtgaggtctggtgttgtgctttgctggaaatcatggaggagaagcaatgtgtgtacctgattctggagatacttagagacaccatcgcaagctgcgagtatggaaatatggaagtgaggcttggggaaaatcgggacccagggtggactttgggagcctcctaccttatgaacgtgcaggtcacggacgccagagtgtgacggtgtgcatgtcgggagacacggacggcaaaggaaacgccacatttggaactggaggacgggtcggaagaccccagaaacggccctgtttagagtccagagaagagctgcctggtgcagttccctaaatgcccagagctgagagttcccaggacaatgtcccacgtgttgctgaacaccaggggggttgggactcccagctggaggcagcgaggggcgcctggtggcccttgattcctgggagcaggcagagccctagggggtcacggcggacgctggtgagacagcgcagggatgccg

SEQ ID NO: 579593 - DNA, 319 bp, Homo sapiens
  misc_feature (1)..(1): n is a, c, g, or t
  misc_feature (215)..(215): n is a, c, g, or t
  misc_feature (232)..(232): n is a, c, g, or t
  misc_feature (265)..(265): n is a, c, g, or t
  misc_feature (269)..(269): n is a, c, g, or t
nggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaaaactttagaactgggtgcagtggctcatgcctgtaatcccagccagcactttgggaggctganatgggaagatcacttgngcccagaattagagataagcctatggaaacatngcangacacttgtctctacagggggaaaaaaaaaaaaggaaactgacccttaaa

SEQ ID NO: 579594 - DNA, 137 bp, Homo sapiens
cccccccccgggggggggggggtttttttttggggggaaaaaaaaaaaaaaaaaaaaaaaaaaaaggaaaaagtggaaaaggaaaaaaaaaattaaaaaattttaaattacccatgggaaaaaaaagggattaaaga

SEQ ID NO: 579595 - DNA, 210 bp, Homo sapiens
cgagaaataggctgggctgcggcatgttcacacgctgccctcccatactacttgggaggctgggtgcaggagaatcgcttgaacccaggaggcgggtgttgcagtgagtcgagatcgcaccagtgcgctccagcctgggccacagagtgagactccgtcttacagaaaaaaaaaaagacagacatgaaaaagagaaccagctcagggatc

SEQ ID NO: 579596 - DNA, 391 bp, Homo sapiens
tggtctccctcaaatattatctccaaaggtaagaataaggatgcatcatgtgccacatctacctacaccgcaacaaagtaactatcgagaactgctgtgtccaccaccaatcaatgaggatggcttccgatgtcaatgccacccaatcataccacactctttcccatcaaaatagccataggattactggaacatctcctcccattacatggcgacttcagcacctggctgtatttccctcttctccattccctgcatcatcctatgacttttccgagacgctggtctcatgatttcttaaaaacatctactttgccatccatattagcaacttctttggatacatcttcatttttctttcctctgtctcttttagtaatggtcattcaac

SEQ ID NO: 579597 - DNA, 895 bp, Homo sapiens
  misc_feature (556)..(556): n is a, c, g, or t
  misc_feature (596)..(596): n is a, c, g, or t
gcggagtggcctggcaggccccgtccgttgctaggaatcgccccgtaatcgcgtctgcgcccgtgcgtgtagcggccccaagacccgcgccgccgtctgtccgcgttgcgggggcggggaggttcggggcgccaggagccgtggcggcgggaagatgctgggcggctgctgtggcacccggcagggctcggcattggccggccgcgcgccgttctatcggctcctgccgctgcgtggtgtcgcattgcctgcatgcacgcgcctgtcctcgagttttccgagtcgctgtagcgaggagggcttgacgggcgggacgaaggcgcgatcgtagttctgaggacgagtagaacccgagtgtgggtaggcctcctgccgccgcgcgtcgtccggatgatgcgggtcaagcgccctgtgacgcccccgctcggggaatcttcgcgggccgacagcccgcgcaactcggggcgggtgacgcgaggtggccgaggggagcacgtacgaggggccgacgccggttaacaaacatggtaaaggtgcggtgggtctgggggaggcnttgggggcccgggggcgcctgacggcagcgtcaccccccntttggtgcgttccctgccaccccatggggcccagcccatggggggcgaacacctgcggagttggctaacaaagtggtcgcggactggcctggcataggctggcaactcggggattcaggacgtaccttcggttcagcccatcattttacttttgggttcgccacctgaaggttcctcggtgcgtaccgaatagaggcgttggccaggcctcaattattgtcccgaggcctgctgtcattgtgggggatgcgcagggggtgaagccacaatttccttcatttttccttggtaagttgaac

SEQ ID NO: 579598 - DNA, 305 bp, Homo sapiens
tgagacgccaggagctctccaggaagcacctggtctgtaaaatagagatggccccctgcaggcctaaggcacataccatgagctcataccctgacagcacttacgaaagaggcctaagctggccgggcactgcgtctgacgcctgtcatgccacctctttgggaggctgagtcgggcaaatcccacggtccggagttgaacaccagcctggccaacatggtgaaacccaatgtttactgaaaatacaaaataattggccaggtgttagggcacgagcctccaattccacctcttttagaggcttt

SEQ ID NO: 579599 - DNA, 306 bp, Homo sapiens
tcagactgggagtgcttcctaacggaactggaagaggctacaatctagtagacgcaagtgatgctttccatgacaaccgtaggtctcttgcaaggaatctgccctcagacagccaggacttgggtcaacctggcatcgccgcaggatttcatgtcctcacacgaggcatttccccaccttgacaccaggcaatgtagttcgcatattttactgtcccatggttatctgattagggttgggccaacgaattttatagacctttttaaccctctgaacaagacgcttaagttttatcatccttttttt

SEQ ID NO: 579600 - DNA, 207 bp, Homo sapiens
acgcttacgtgctgacaggttcacacaggcagcgaggtgctttgaaacgcccaggacattgtggccaggtttcacattggccacggttattatgtccatcagcagcaagctgcagaacaaggagcatgtgattgaggccctcgactcactgacgggcttccggatgtgctgcccccactcttaatactcaccaataaattctacttc

SEQ ID NO: 579601 - DNA, 816 bp, Homo sapiens
cgctgaggaggcgcctgagccgtgcagcgctgcgggggaggcgccgtgctgatgctgggggcccatggcccatggtaacacctagccgagctgtatgacgccgtgcccatccagtccagcgtggtgtatgttcctgcccatccccatcaagtggtgaggacccagactgagtccagcacgccccctggcattcctggtggcagcaggcagggcccgccagtggacggcactgcagccgagcctcggcccggcgccgagtccctgcaagatgcccagctccgccgagctcggaagaagctgtgcctgaggacttcagcgtttgggaacaatccttggggaaggctctttttccacggttgtccgtggctcgagaaacttggaacctccagagaatatgcgaccaagggccaaatcatccgtgggaacagcgcagtacgttctccagagcgtgctcacggagaagtccgccttgtaagagttcagacctttgggctcttggatgcctaagtataccagcgttgtggcaaggagtcccaagcaattccgagcttggaaacgagtatcttatattgcagaaagatcattaagttggaatatgacgtttccgagaaaagattcttccataagtgcaagagaactcgtgggagaaaaatagggggcaagcatgccacaaaggcggaaagcgctggtgacgagacaattggaccggatacgggacctcataaagagcacaacaccgcgactatcagagtcccgacaacgtgggcgcaaccctgcaccagacagagagacgcccagaagattcccccgctaacc

SEQ ID NO: 579602 - DNA, 122 bp, Homo sapiens
gtggttgagaatgagtgtgaggcgtattataccagtagccgcctagatcttaatagtactgcggcaagtactattgacccagcgatgggggcttctgacatgggctttagcggagtcataag

SEQ ID NO: 579603 - DNA, 93 bp, Homo sapiens
ggaataagttggttttcacaagacatcacaagatacgtgtgtacccaacaatttctgatctctgctgatcttttgcttagacgttaacttgat

SEQ ID NO: 579604 - DNA, 760 bp, Homo sapiens
cgcctgtaaagtgatgtccaagtgggcggagagccgtccctgctgccgccgctcatgttctacagagcctgactgtccgtgccgcctggcacatgctgcgcgctggctggggcagctgctcgtccccccgcgcccccggcccggacacttgtgctgtggtgccacgatggaccctgcaagcatgcactgtgcgtgtccccctggcgttcctgtggctgtgttctgtgccgcctgtgctgcggacctcggcgggagttggggctgtgggtgggcgggcgtgctgtgtggggcgtgacatgccggtggtgctgcacttgtggcccccctggccatggcggcgaatggtggacctgagcacctccaccgactgtgaagtgatggcgaaatcctttcttgaagggcctgagtgacaagcagcgggaggaacattacttctgcaaggactttgtcaggctgaagaagatcccgacatggaaggagatggcgaaaggggtggctgtgaaggtggaggagcccagggtataacaacggacatgcagctcaatgagaaaaatctccctgctccgcaggcgacatcaccaaaggctggagtgtggacgccattcgtcaacgcctgcaacagctcctgctcggagtgcggtggcgttggacggctgaattcatcgggccgcgtgccctgttaccgaagattgctggacctgagagctgtagacttgcaggcaagatcacggcggttcggtccggccagtacgtctcaccg

SEQ ID NO: 579605 - DNA, 217 bp, Homo sapiens
cggcacgaggagcatgtacaactgcacaataaattgcacgtagatgtacagagagaaagggaacggtgaacacaaaattctggacagtgatgacctctgagatgcggaagtccgggaggggctgcaccgtgcttggatgctgggatcctctgtgtcttccacagagccctagtgcctgttattatttgtagaattaaatgttaattatacaaaaaga

SEQ ID NO: 579606 - DNA, 334 bp, Homo sapiens
agagagagagagagagagagagagagagagagagagagagagagcgagagagagagcgagagactgagcatatcgtgagcctgttctttatagagctacttgtgtaacggttgccatactggtcacacatctctactacttcatacattactgtgttttccattcaaattgctctgcctgggttccggacagcagagtactcccttacttggtctcctttgctgcttctgctatcacttcatatgctgacatcttgtctgcctctgcttgttgtattgcttcctttccactactatcctccctctccttgtcatgctgattgcctcttttccct

SEQ ID NO: 579607 - DNA, 183 bp, Homo sapiens
ggaagttatacaacactacaaaccaagtcagagcctaacaggcattatacaacacatacaaagcaacctctgaccaacaggtgtctatacaacactacaaaccaatcagacccaacaggcatctatacaacactccacccaacaagagcaggatagatattcttcgacactttgcatccagag

SEQ ID NO: 579608 - DNA, 201 bp, Homo sapiens
gttatcgttttttggggatgttgtgccaacaataaaaaggacccgggtttttttttttggccttaaaaagaaaggaccccccccacaggtggggtgggggcgatccccggctgtttggcatgttccccccgggagtgccgggcaggagcatgggggggttggttgtttccttcctaataaaataaacccgggtccccctta

SEQ ID NO: 579609 - DNA, 406 bp, Homo sapiens
gttttctctcagcctaggaatcagcccaaagtgaaagcttaatgtcttctcaggtcttttctgagcatgtgccttgcctgcatgtgtgtggcttgctaaactcccccatatacagggttgcttttgaatgccttaatttccagtcttgccccagcttctcccccaggctttaaattgcctgctatatgtctgcctccataatctcttgccccaggaatctgtggctcagtagttgccttacagtggttatgagcagtgtccatagcttttcccacctgacttctgagttaggaaaaacagagatgaatgcttcatgctagtccttcaggtatttccccaggtggtttggaacagccacaagcaataatttaccaataaagtctgctctgcttcctccagtttaaag

SEQ ID NO: 579610 - DNA, 198 bp, Homo sapiens
tttaaacagatggcttggggtctataagacaaattgtttgaaaatctgaatgtaggtactatctacctcatcagctagaacaaagaaagtctagatcatcatagtttgttgtgtagctggcatctcacctcataactttaataagaaaggttctcaagtttgtcttataaaccacaagccatgttagagattcggtca

SEQ ID NO: 579611 - DNA, 115 bp, Homo sapiens
  misc_feature (81)..(81): n is a, c, g, or t
  misc_feature (100)..(100): n is a, c, g, or t
aaaggcgcaaacaaagaaaaaataatgtatatttttaagtatttgtccttgaattgttagctccttgttaaacaaacaaanggagagaaaatcccgaggnaagttttcctgggat

SEQ ID NO: 579612 - DNA, 333 bp, Homo sapiens
ctcatcaagaccattttaggggttatgaatttggctaacagtgtcaaaagggtcatgttcctggggactgagaatatggtgtgatgacctcacaattgttaaatccagaccttgtttaacaatcgccagtgtgtatctagccccatttcaggttgcagagagagcactctattatttggataatgaatacatcatgagtttgatagaagaaaactctaacgtcatccctcccatcatgttttcagccttataggatttcaaagaccaattgaatccgctattttggcgttgggacaagtgttgaaggcattatggaatgaccagaccatgttg

SEQ ID NO: 579613 - DNA, 281 bp, Homo sapiens
ggctcccgagtagctgggataacgggcacgtgctgcatgccaagttaatttttggtattttagtagagacggggttcaccatgttggtcgggctaagcttgagattcgtggcctcaggtgatccacccggtttggcctcccaaagtgctgggattacaggtgtgagccaccatgcctggccccaagggtgtgtattgaagttaggtcaggattaaggggaatcaagaggctgaactacctcctaatgcaggcttgtccaacccacggcctgtagggtgcat

SEQ ID NO: 579614 - DNA, 151 bp, Homo sapiens
gctacacatagctcgcaatgcaaaccacttactaccaggccattactgtgtacactggagagcttgagctcacactacaaagatcagaggacctacagagagggctcattggttagaggaccatggcttaccttacctgcctttgacccat

SEQ ID NO: 579615 - DNA, 867 bp, Homo sapiens
gttgccccgtggccgcccgggccccggcttggctgagctgggcatgtgcggcctggctgccctgggagctgggccattgactgatgctgctgccgcctgctgctggtgcctgcctgacgccggcctacgatgctgctgctgagaatgacaccggcgcccgccgagggtcagtgctgctggacttctgtgagcttctacggtggtgctggccggagactggcccagcgggccgaactgctgtggcctgcctggcgcggtggcttcggcgtggaccacggcaggtggctggagcagagctgccggcgtgctccatcttgcgccaagcagcatgcgtgggagtgctggctggtgctttgcttgcatgtggccgaggcaccgtggctgctgctactgcgcttgtgttgccagcgcatatctgcgtgcctcttccgaccacattcaggcaatgcttggactgtgctggctgtcgcgcttccttggtgcatgcttgctgggcctgaccttgcttggaggcgcttgcatgtgcccctcaagcctggttggatgggggggccggaccgtccgggacagttgacttgggtgttgcttgaacatggaatagctctcaggaattggttttcctccgggttcctgaaaccctagagagggggttacctggccattcaccggttgtgactgcgcttccagaaaactcagttgaaggcttgaggcttgtgcattccttgtaacagacctgggattgggcatgaagcgcctgggttgggcccttcccggacggtgtacactccttttctccctgtgcgacccctgtggagccctggtcgtttgccgttgctggttgggactctccggaacatccagggcacg

SEQ ID NO: 579616 - DNA, 596 bp, Homo sapiens
aattcgcggccgcgtcgacagaagacgacagaagggtgggcaggggggacagagtctcgctctgtcacccaggctggagagcagtagcgcgatctcggctgactgcaacctccgactccccggttcaagcaattcttctgccccaccctcctgagtagctgggactacaggcgcccgctgccacgcccggctatttttttgtacttttttagcagagacggggtttcaccgtgttgcccaggctggcaacccgcccaccttggcctcccaggtaggattacaggcatgagccaccgcgcctggccaattttgtattttagtagagatggggtttcactatgttggccaggctggtctggcactcctgacatcgtgatccacccgcctcgccctcccaaagtgttgggattacaagcatgagccatcgcgcccggccatcttgtttccacatttcaagctgcaaaggcagggcttgggccagctgttcagaaattaattagtttactaagagacgtcagattcccctgctctcatgtcactagtgaggtcttatacacacacataattgttcagcgtgctgactaaacgtggtgttg

SEQ ID NO: 579617 - DNA, 216 bp, Homo sapiens
aaactaatagggtggggtttttgttttgttttggggttttgttttgtttggttttacattttagttactgaacccttccaaggttatgtagaaagaaccctttttttgtccccaaaatagccaagagaatgcggtcaatattggggtactgtaatgtgaatttatgggggggaaaacaattttttgttccccttattaaacccttagggtccttta

SEQ ID NO: 579618 - DNA, 467 bp, Homo sapiens
  misc_feature (5)..(5): n is a, c, g, or t
  misc_feature (7)..(7): n is a, c, g, or t
  misc_feature (37)..(37): n is a, c, g, or t
  misc_feature (40)..(40): n is a, c, g, or t
  misc_feature (332)..(332): n is a, c, g, or t
  misc_feature (339)..(339): n is a, c, g, or t
  misc_feature (380)..(380): n is a, c, g, or t
  misc_feature (428)..(428): n is a, c, g, or t
  misc_feature (442)..(442): n is a, c, g, or t
attgncnttgcctgaaatgacctagccggctatcganggntcagccagcactccacaaagcaataaccattgacttacccctacaccaagcttggcgacatgtgctcggccagatcagagattgctgcccttcagaggcaccctcttcaggatcagagctttgtttctgagtaagagcaactagtattggctgggttgtgaggcccaagagctctaacttgagaaaatgccccaaatctaaacctttatccactgcccagcatgacatctgccataggttgaagcgttgtgggtcctgtgctacttgggacaggtgagagaaacaggtttgnaagccgnataccacagacccacagttcccgactccctccctggctggntcccgcgggtggccggcccctcatcctttcctaggctgggcctgtggnttcctacctttccntggttctcatgctcccaaagggtgt

SEQ ID NO: 579619 - DNA, 275 bp, Homo sapiens
tcgcgaacgtccgtaacaacgccactctgctaatactaagctaccgtgacgcctaccccttcgctggtgttctagctagtaggagtcggtatgcctcaatcccttctcgttcatgccttgagcgagcaagtcccgtctgttgtctagggggcaagaagccgcaatcccttatttccgcaccccaacctcttatctctgcaccccaatcccttccgagccccaacctcgtatctctgcaccccaatcccttatttccacgccccgacctcttacct

SEQ ID NO: 579620 - DNA, 116 bp, Homo sapiens
cgaaaacattcggagcgggggacatagcggatcgcttcacacggccacgttggtattgcagcttaccagctggctatgcgatataaagagaattctaaagtggattccattggggg

SEQ ID NO: 579621 - DNA, 614 bp, Homo sapiens
gggcttgggttcctgggtcggcagcccgggccccgaaggacctgggtgggcgcggagttgggcccggggtggtcgtgggctccccttgtcttcggctacgtcactgaggatggggacacgtgagtgaaccttaggctgccaaacggagccctaggacccggcgtcccattcctcattaatttctgatccctgaggcttggtaacctcatactcctaaatttgacttccgatggtgaacttcctgacctctaacccccgagtcctaacttttaacaaaaccaattttctatctagctatgatcctaacccaatcattttttcccttcttttcttgaacaatgattttcagctcctggaatccccattgtatcccctgataccccaaacctgactccagtcctgagacttttgttagaactggggcttttcctgacttttaccccccaaaaatgatctttgatttttagttcccgatttgagccctagagtttgatttccgaaattaaaacttggtccctgactttaagatcctgttttttgagcagggtttttcaaattttaaattcaaagagagagaaggtaagcttttttatgttgaattcctaattaaagta

SEQ ID NO: 579622 - DNA, 4143 bp, Homo sapiens
ccgctccacctctcaagaattccctggctgcttgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggcccccgggctccaccgcccccccagcccacggtgtcacctcggccccggacaccaggccgcccccgggctccaccgcgcccgcagcccacggtgtcacctcggccccggacaccaggccggccccgggctccaccgcccccccagcccatggtgtcacctcggccccggacaacaggcccgccttggcgctccaccgcccctccagtccacaatgtcacctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgccctctgagctgagtggccagccagtgccattccactccactcaggttcttcaggccagagcccctgcaccctgtttgggctggtgagctgggagttcaggtgggctgctcacagcctccttcagaggccccaccaatttctcggacacttctcagtgtgtggaagctcatgtgggcccctgaggctcatgcctgggaagtgttgtgggggctcccaggaggactggcccagagagccctgagatagcggggatcctgaactggactgaataaaacgtggtctcccactg

SEQ ID NO: 579623 - DNA, 186 bp, Homo sapiens
ccctccagccagagatattccaactttgcaataaaactttccttcacacagaaacatttgcagcctgcggtaggctcccccttcctaaacccttaaatgcccttagtttgtaaaagaatgtccctgaccgaaatcggccagaagcccctttcaggtttattcccaaaataaacctgtttttgttga

SEQ ID NO: 579624 - DNA, 1738 bp, Homo sapiens
ccgctccacctctcaagaattccctggctgcttgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccgcccccgggctccaccgcccccccagcccacggtgtcacctcggccccggacaccaggccgcccccgggctccaccgcgcccgcagcccacggtgtcacctcggccccggacaccaggccggccccgggctccaccgcccccccagcccatggtgtcacctcggccccggacaacaggcccgccttggcgctccaccgcccctccagtccacaatgtcacctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgccctctgagctgagtggccagccagtgccattccactccactcagggctctctgggccagtcctcctgggagcccccaccacaacacttcccaggcatggaattcc

SEQ ID NO: 579625 - DNA, 2255 bp, Homo sapiens
ccgctccacctctcaagaattccctggctgcttgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccgcccccgggctccaccgcccccccagcccacggtgtcacctcggccccggacaccaggccgcccccgggctccaccgcgcccgcagcccacggtgtcacctcggccccggacaccaggccggccccgggctccaccgcccccccagcccatggtgtcacctcggccccggacaacaggcccgccttggcgctccaccgcccctccagtccacaatgtcacctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatggtgagtatcggcctttccttccccatgctcccctgaagcagccatcagaactgtccacaccctttgcatcaagcctgagtcctttccctctcaccccagtttttgcagatttataaacaagggggttttctgggcctctccaatattaagttcaggtacagttctgggtgtggacccagtgtggtggttggagggttgggtggtggtcatgaccgtaggagggactggtcgcacttaaggttgggggaagagtcgtgagccagagctgggacccgtggctgaagtgcccatttccctgtgaccaggccaggatctgtggtggtacaattgactctggccttccgagaaggtaccatcaatgtccacgacgtggagacacagttcaatcagtataaaacggaagcagcctctcgatataacctgacgatctcagacgtcagcggtgaggctacttccctggctgcagcccagcaccatgccggggccctctccttccagtgcctgggtccccgctctttccttagtgctggcagcgggaggggcgcctcctctgggagactgccctgaccactgcttttccttttagtgagtgatgtgccatttcctttctctgcccagtctggggctggggtgccaggctggggcatcgcgctgctggtgctggtctgtgttctggttgcgctggccattgtctatctcattgccttggtgagtgcagtccctggccctgatcagagccccccggtagaaggcactccatggcctgccataacctcctatctccccaggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtgagattggccccacaggccaggggaagcagagggtttggctgggcaaggattctgaagggggtacttggaaaacccaaagagcttggaagaggtgagaagtggcgtgaagtgagcaggggagggcctggaaaggatgaggggcagaggtcagaggagttttgggggacaggcctgggaggagactatggaagaaaggggccctcaaaagggagtggccccactgccagaattc

SEQ ID NO: 579626 - DNA, 648 bp, Homo sapiens
ttgcattaaccccatttggtcccgtataagcgggggttgcgccttgtgtgttccccgcccccgtggtttcttaacgatctgaggggcgccccccgggcatgccggtggtgtttacgcgccccctttttggggggcggtttataggcacagcgcttgggccccctttgggtttatcaccccccctcgcgtcagacaccccgttattggctgtcttcgtcttgaaatttatgtggggtacaatcttcgtctctatagccatattatttagctgaaccagagaaaaatagactgtctcaacccacaaatgcttccacgtttattatttcacaccaatacaccccatttttgcgaatacccccacataaactcaccccgcctcatttctttattccctcccccctaaacgtttcactcccttcttttttccgcgcgctcgtcataaatacatcccccgcattcattccacaaacactaacggcgcctccccacatagcgaaacaagggcacacccacaatattctctgctccacgaataaagcacgcccccctgttaaacatttaatatgtccccccccccgccccccccagaaatagaagaatcatttttttcatcacaaacataaacaaataaaaaaacaaatcataaca

SEQ ID NO: 579627 - DNA, 1646 bp, Homo sapiens
  misc_feature (135)..(135): n is a, c, g, or t
  misc_feature (208)..(208): n is a, c, g, or t
  misc_feature (264)..(264): n is a, c, g, or t
  misc_feature (429)..(429): n is a, c, g, or t
ctcttgcatccgacagacatcatctctcttgtttgtcttagatgttattatcttttatatctgttgttgtttgtcaatacttgttcattcttcttcttcttactgtgttttattgttacatcatttgctgttggngaataaatattcgtttgcgagatactccaccattagctttctgttggatataattctatcgctccacgtttgngttgtggtggccgccccacgataataacatttcctctcttcttgtttggtggcctnctatatttatatcttccctcgtgtttttgtcatacaaccacattagtcccccaccttttattagagtattctcccactaagttccccacgcctttgtggttattactccttctaaacatcattcctgtgttgattattctcacacgagcacgactgttgtttttntcgccccctataattgtaaccctgttgtcttgtgtcccggctgtcccaatatattctccatgttgtaaattatcctttggccgccaccacagaattacccgttgtttccccccctcttgagccaaatccctgggatgtttaaaatttgtctcgcgcgttgtgcgcttttttggtccatgtgcggttgtccctccccccaacttttgaaaattaaggtttatccgttggaaacccttattaatcggccaaccgttggatgtcctaataaattgtggaatgtttttcacacgtcgccacacggttggtgaatggcgaccgccaatttgatgttctcccaggtggtgggacccaccccccttggtgactcccagaggtgttccccgaatgttagatcttgggaaaaagggggtcacattttggcgcaatttgtggtcccgcccatatagtttaacttcccaggagatatgtgcccacaatagtgaataacagattctctgcacatattttaccccccaggttttggagtttcttccgtggtgctcgcacttttgcacaaaatttgttgaagattttataaaattctatatcggtgtgttacacttttttgttgtatacacaccttataacagtggagatcgcgtctattacaaaggtggcgcacaggtgaaatttatgagcgacgcacactctatggggtgttgttttgagaagacgcacatttctcggcaccacattttggttatatactaacacgcacacatcctttgcttgcagatataaagtaataacatctccacgcggtgtgcgtgcacactccacatggaacacacacatggtatgttaacgcacacgcgtttataaatttagcacattctctttcttatacctcgaatacgttttcacctcactttaatatatccacgctatggagagagacctcgttctaagaatgttggggcacgcttctattgactcttaaagttctgtaaccacatcgttaataacctcgaaatttagtacccctagttttgttaacgctattaggattttctaatagaacttactccccctgcctccccacgccttaatgtttcttttaatgaactttctggagtcctgaggctccctttgcacgtctgaaaaaaggtaattgccacgtcagaactgtgtactgatgatataaagcctcctggtagccaataaaaagttgtccctta

SEQ ID NO: 579628 - DNA, 374 bp, Homo sapiens
  misc_feature (34)..(34): n is a, c, g, or t
  misc_feature (38)..(38): n is a, c, g, or t
  misc_feature (72)..(72): n is a, c, g, or t
  misc_feature (117)..(117): n is a, c, g, or t
  misc_feature (137)..(137): n is a, c, g, or t
  misc_feature (164)..(164): n is a, c, g, or t
  misc_feature (174)..(174): n is a, c, g, or t
  misc_feature (178)..(178): n is a, c, g, or t
  misc_feature (180)..(180): n is a, c, g, or t
  misc_feature (370)..(370): n is a, c, g, or t
gggccggagctgcggggagggagttggcgcctangcangctccatccccgactctgcagtggactcggccgnagaatcggggtcccgggctcctggaacttgtcccccccaggccgnggcgaggaggtcactgcagncggtgggacccgggccgggggcgggtnactggaaccngganangcgggaaggaggaggggatcgggcccaagggacacgaggtgggtcgcgggaccccgatatctcgggacaggcgtcttgccgcttccgggcccagccgccccctttcgacacatacttcgatgcatgagacaatggggggtgtccttttgttcgttcctgggcggggaaccccgggccccacccccaattncaag

SEQ ID NO: 579629 - DNA, 135 bp, Homo sapiens
gcggccgcctactactactactgctcgaattcaagcttctaacgatgtacggggacatgtgcaataagctctccataagtaaataaagtttaagttgtagtcatttttttcccacacttgtgtggaatgaaaaaa

SEQ ID NO: 579630 - DNA, 563 bp, Homo sapiens
  misc_feature (362)..(362): n is a, c, g, or t
  misc_feature (439)..(439): n is a, c, g, or t
aattttagtgttaaaaaattgttcgtatcctgaagggagggattattggagagaatgaatgatgtaggatgaacttgtaaattcagttttcggcagagtctaaaattaagtgatgattggcacttaatgaagctactaaaatttatgtagattttaatgtctcattagtaatcgcatctgtatctggttttataaaagtaatgaaattgaagacctgtacaaatacagaatgaatgaagcaaattctgctaacatcatgttgaatgttttctcagaaaaagaggaaatacgaagagaagagatttgttttgactgtgatttaccctcacccccatggatactttctttacttcctacctttnttctttttcttttccttctaaagattctggcaatgggtgtttcagtgttttttaagcttaatatttctggtactcanttatgtaaagtgatttctgaatgttaaaggagatttctttttaaatatattttcacttatttttagctttatgatgagaatcttattttttaaatctgtaacttgttatggctacatgattagt

SEQ ID NO: 579631 - DNA, 2231 bp, Homo sapiens
gatgtgggcacgcctcagagccagaagtttatggctcccacctgctcaatctgacaggaagcttctgctccccagttctccccagccactgtggtctacagattccaggaaacccatccccctgtgacctcagggtgtgctctgttctccaccctagggaccagaaggagccaggagtaaagaactggcttacttggccgccactgggaaattctgggtaattcgagacgccctggaatttggacccactccgctgataggtggtgggcagggttctagggaacacaagaggcggagccaggtggcttccctgtgctggcattcttggctctctctctctctctttctctctctctgtctctctctctctctctgtctctcagccttgaagccgtttccctctgcgattcatgtaagtgtgactcgatttcagggaaagggaactcgcgtgggctgaggagaccggagtggacgggctggggaaggcaccgtgatgcccgcaaccccgtccctgaaggtggtccatgagctgcctgcctgtaccctctgtgcggggccgctggaggatgcggtgaccgttccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtgttctgcagggagggtcccacgcaccaggcgcacaccgtggggttcctggacgaggccattcagccctaccgggatcgtctcaggagtcgactggaagctctgagcacggagagagatgagattgaggatgtaaagtgtcaagaagaccagaagcttcaagtgctgctgactcagatcgaaagcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagagtcaaccagagcaggtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcaggggtcatcactctggaccctcagaccgccagccggagcctggttctctcggaagacaggaagtcagtgaggtacacccggcagaagaagagcctgccagacagccccctgcgcttcgacggcctcccggcggttctgggcttcccgggcttctcctccgggcgccaccgctggcaggttgacctgcagctgggcgacggcggcggctgcacggtgggggtggccggggagggggtgaggaggaagggagagatgggactcagcgccgaggacggcgtctgggccgtgatcatctcgcaccagcagtgctgggccagcacctccccgggcaccgacctgccgctgagcgagatcccgcgcggcgtgagagtcgccctggactacgaggcggggcaggtgaccctccacaacgcccagacccaggagcccatcttcaccttcactgcctctttctccggcaaagtcttccctttctttgccgtctggaaaaaaggttcctgccttacgctgaaaggctgaagtggggcgcgcgaagggcggcgaagcggagacggcggctctccgggatccagctccgcccctggccagtgtgcggcccgggggctccctgtgcccgcgtgaggcgagagaacaggggacttgagtctcgaacagcggttgtttttactttatttatcttaggccctcagctccctgacgtcctgagcctccctgtgacgctctggccttctctgcacctcagagtgcagaaccacagacggcttcggctgtgcctagggcaacagccaacctaggagccagcgggctttcggggaaaaaaaagaaaaagacatctaaaataaaatgtttaaactgtttc

SEQ ID NO: 579632 - DNA, 378 bp, Homo sapiens
gacggtgagcagatggttgggctaacttagagcagagggacagcttttcattggagactggaaggaaatgaggatgaagggagcttacagagtgggccaataaagtaagggagggtgccatgatggcctgtttgctctgaagggaagatcaggtgtctgctggacaagcagagtagggaatttggtaaagagttgggaaaaagtgatgaaggcctccaaaagctgttgagaaaaatgagagaggaagctgatcaagaacatttaaaaggttgcctggcctaattaagggcccaactaagaatggttgccacaagcttaaactggcttagtctgcacagttgtggttacacagcatccctcagcagtctgatggaatat

SEQ ID NO: 579633 - DNA, 367 bp, Homo sapiens
agttgttcaagcaacatcaccatcaaagaaatataagttaataccataatgtgatattactacacctccatgcatggatctttccacattgcttatgggtaatagtatgaccactctggaaaatggtttagtggtttcttacaaaactaataatacacctactatactattcagcaatcatattactgggtgtgtatctcagagaaatgaaaacatacatccatacaaaaacctgtacatgaaattcgttcatagcagagctgttttcaatgatcaaaaaacagaaacaacccaggtgtttggttaataggtgaatggttaaaaaaattatggtacatccataccatggaatactactcagtgatta

SEQ ID NO: 579634 - DNA, 145 bp, Homo sapiens
gggacacatgacaaattataaccaagcataatatagcgaggactaacccctataccttctgcataatgcattaactagacataactttgcaaggagagccacactaagacccccggcaccagacgagctacctcagaacagctaa

SEQ ID NO: 579635 - DNA, 366 bp, Homo sapiens
  misc_feature (3)..(3): n is a, c, g, or t
gtntcatacacggatcccgacctagacgtacacaggacatttgagtttatcaaactgaatgttgtccagagtttgaatcaaacccctggacttttttgtgtgacgttctcttaggaagctttcattgatggtagaatagtttcgttcctcggtccttttagatacatgtctcatcttagacaattctttttgaattttatacttttatgtttatccttaaaataactgtggtagcgtaatatattttactttcagttatggctagctcggatagactcttactgagaagtagttctatgggtgtattattacattgctatttatcctgtttgacttaaacagtgaatcactgttttacttctagtt

SEQ ID NO: 579636 - DNA, 164 bp, Homo sapiens
ctccaggcgctgttgggcactcgggacataagccaaatgctgattaaattgtggaaggagaattctttgtagatggatctctctcacttaattccgaccatactgctgctataaggtcaagtatagccttggttcctctacctctgcagttcaaccctgtgtag

SEQ ID NO: 579637 - DNA, 628 bp, Homo sapiens
  misc_feature (25)..(25): n is a, c, g, or t
  misc_feature (241)..(241): n is a, c, g, or t
  misc_feature (243)..(243): n is a, c, g, or t
  misc_feature (251)..(251): n is a, c, g, or t
  misc_feature (253)..(253): n is a, c, g, or t
  misc_feature (279)..(279): n is a, c, g, or t
  misc_feature (299)..(299): n is a, c, g, or t
  misc_feature (303)..(303): n is a, c, g, or t
  misc_feature (305)..(305): n is a, c, g, or t
  misc_feature (311)..(311): n is a, c, g, or t
  misc_feature (313)..(313): n is a, c, g, or t
  misc_feature (344)..(344): n is a, c, g, or t
  misc_feature (346)..(346): n is a, c, g, or t
  misc_feature (370)..(370): n is a, c, g, or t
  misc_feature (374)..(374): n is a, c, g, or t
  misc_feature (378)..(378): n is a, c, g, or t
  misc_feature (421)..(421): n is a, c, g, or t
  misc_feature (515)..(515): n is a, c, g, or t
  misc_feature (538)..(538): n is a, c, g, or t
  misc_feature (561)..(561): n is a, c, g, or t
  misc_feature (627)..(627): n is a, c, g, or t
atcagaaaagccaattgcagcaagncataaggcacattagtttgtatgtatactgtgctagtttagaaaacttgggaagaagattcagaaaagagttagaattgtggcacacaattttatgcagttcgtggagactgatggtgtctccactgggagtctcaccacttctctttagactgttccgaagctgcatggtttttggtgcattatatcaggatattttcatctggacaatggagananggatattnanactttaataaagtatgaaaaaaatanccatagccacttaaattaanaaangncatcantnagatcgaaataataagattctttcatttgtntngttggattaatttcactaactganttcnaggngtgtccaggatattttggggatgtcgtgtctggaaaatctganattgggttaaatgaaaggccatttgggtctatctggatatcagggatacaatcataatcactctatatggaagctgagtgatataggaggaatnatagttgcaatgagataagagtnataaaaatcagaaaaggtaactnttacaactgacttggctagggaagggatgggtagttgagcccttctgtctactctatgtgtctgtnc

SEQ ID NO: 579638 - DNA, 518 bp, Homo sapiens
tcagcctcccaaagtgctgggatcacaggcgtgagccactgtgccctgcctcctccatcactttcttcaggggaaagagcatcatatagcatctttgggaagagcattcatgggaagccactgaagaattgtaagcaggagtggatgacatctgtgtttgttggagatcgccttagaggagaatagtttcaggttgctgtgtcacacaaccaagtgatactatttacatagaaaaagtgcaaaatagccttaaataagagcaggtaagacagggcaggaagacttacaggaggctactgaaatgagctgtctctgcagtaggattagggaagagggaatgaaaagaagtatttaagcagggagaatttacgagactagtatggaggaggaggaggtgtgcacagagatttgtaggtgtgataggagaaaggcggactggtaagtttcttccttaggcatcttgagagaaagatggcaccatttcctaaaacagggaatagaggcagaagaacagttta

SEQ ID NO: 579639 - DNA, 758 bp, Homo sapiens
gctcactgcagaccttcgagtcgtacttgctcttcgagggcgagaatgaagatcaccattaagaaggacaccgagatggtacctcaatgcactgtctagttcaccattcaaccaaagaagactcacatactggtgaaacatccattaaatcacaacatctcataaaagacccgccacagtgcatcatatttgctggactacgaatatgtccctctcaatcctcgttatggtagtcacgaaaggagtccatacatcccggatgtgccacgagcgacggccaaggaactacaggctcgccgcaaggcaagcactttatacggctaacgctcaatgtacccggaccgcgtccatccagcgtgaagcttgtcccctgtgctatgaggagcgatgcccgcatgttccgcggtgtggccctaataaagagatgacccataggccaaggcaaagggcacactgtgacgggctaaggtgtggtccgaatgaacgcgggggcgtcattgctgttcgaggccctgtttgacgccactcggttttggcctaaagcgttgttgggtctttgtaactcacctaccgggggttaccaatgtgataagtcgaaacaaccccgcacgcggacgaaagccggggtcgcctggagcttcaagcctaaggtgcgcaacttggggttaccctggcacccatgttggtctatgtgggcacaggaacgcccacccccatttgccaaagagactcccccccctttgagggaaaaccccaaa

SEQ ID NO: 579640 - DNA, 427 bp, Homo sapiens
actgggctagctgatagcctacgaggatagtgatgactcgctacagtctacgctgcaagagtcgaccatgcagaatcaaaacgagaggagaatagtttcaggttgctgtgtcacacaaccaagtgatactatttacatagaaaaagtgcaaaatagccttaaataagagcaggtaagacagggcaggaagacttacaggaggctactgaaatgagctgtctctgcagtaggattagggaagagggaatgaaaagaagtatttaagcagggagaatttacgagactagtatggaggaggaggaggtgtgcacagagatttgtaggtgtgataggagaaaggcggactggtaagtttcttccttaggcatcttgagagaaagatggcaccatttcctaaaacagggaatagaggcagaagaacagttta

SEQ ID NO: 579641 - DNA, 171 bp, Homo sapiens
  misc_feature (87)..(87): n is a, c, g, or t
  misc_feature (127)..(127): n is a, c, g, or t
tagactactcctgaggaacacatctacatacagatctacttcctctatggaaagctacccatcatatctcagtcacctggtgacttnccaaatactaaagatatttcggagcattcctgacaacccnctttcttaagaacgagtgagggaaacgtcattttggttctttca

SEQ ID NO: 579642 - DNA, 403 bp, Homo sapiens
ctgtgaggaaaggtattcctgctaatgctaggctgccaatggtgagggaggttgaagtgagaggagaatagtttcaggttgctgtgtcacacaaccaagtgatactatttacatagaaaaagtgcaaaatagccttaaataagagcaggtaagacagggcaggaagacttacaggaggctactgaaatgagctgtctctgcagtaggattagggaagagggaatgaaaagaagtatttaagcagggagaatttacgagactagtatggaggaggaggaggtgtgcacagagatttgtaggtgtgataggagaaaggcggactggtaagtttcttccttaggcatcttgagagaaagatggcaccatttcctaaaacagggaatagaggcagaagaacagttta

SEQ ID NO: 579643 - DNA, 1028 bp, Homo sapiens
  misc_feature (102)..(102): n is a, c, g, or t
  misc_feature (146)..(146): n is a, c, g, or t
  misc_feature (151)..(151): n is a, c, g, or t
  misc_feature (184)..(184): n is a, c, g, or t
  misc_feature (218)..(218): n is a, c, g, or t
  misc_feature (220)..(220): n is a, c, g, or t
  misc_feature (226)..(226): n is a, c, g, or t
  misc_feature (239)..(240): n is a, c, g, or t
  misc_feature (243)..(243): n is a, c, g, or t
  misc_feature (245)..(245): n is a, c, g, or t
  misc_feature (248)..(249): n is a, c, g, or t
  misc_feature (255)..(255): n is a, c, g, or t
  misc_feature (302)..(302): n is a, c, g, or t
  misc_feature (305)..(305): n is a, c, g, or t
  misc_feature (307)..(307): n is a, c, g, or t
  misc_feature (321)..(321): n is a, c, g, or t
ccacgcgtcgccacgcgtcgctggctccagttctagtgactcagagggctctagccttcctgtgcaacctgaggtggcactgaagagggtccccagccccancccagccccaaaggaggctgttcgagagggacgtcctccggagnccaanccccagccaaacggaagaggcgctctagacagnttccagttccagctcctcctcttcatcttcactncntcctcnctcctcctcctcnntcntnacnncctccntcttcctcttcttcttcttcctcctcatcttcctcctcctcgtcgtnttncntccacttcccctgnctaagcctggccctcaggccattgcgccaaaacctgcaagcccccaagaagcgcacacccctggacgagacggaggtgagatgcatgtacttgcactgacgttgaacacggatggagcatggcgggcagtgcacctctgtcccacgcacgacagaggagccacctgaggcaatggtgaacgcctcaccacagacttggcgactggttacctcaaccgctggaccctttgacgaccccattcctagcgtcagctgagacggcagcgaagcggcactctggcttcctaccatacggtcccgcaccaatggcgctacggattcggcacacacacagggactacattgggcccgaaagcgctgccatggccggcacattccaacaacgtcgagacggccaaccaagagcgacagggaacgcaaggggagggggtaccgttgagaaaggacaccattaacgcctcactcgcccataccgcattcaaaaccaaacaattaaagcgcaggggatttcacacaaagggagtatagtattaaagacctagtcgggactacgtccccccactgattcagagcataacattggagaacaggcagggacgtcactggcgttctctagtgacaccaacgacagaatccgatatccctataaacatcacacaggaatcagataccttgaacgcacccacaactgggccagtacctacccca

SEQ ID NO: 579644 - DNA, 211 bp, Homo sapiens
cacccctgatgcatcttattttctattgtaatgcacgatgcagtaagcattctcttaattcttccgcaaagattacgatacgatttaaacgttacctcgtctatcgctccggatgcaaaaatcagcttgagccagctctcggtttcggcacactccttgcgagcaatttcaaattttgaatgcatatccgcaaggctttggggatattgag

SEQ ID NO: 579645 - DNA, 720 bp, Homo sapiens
  misc_feature (102)..(102): n is a, c, g, or t
  misc_feature (146)..(146): n is a, c, g, or t
  misc_feature (151)..(151): n is a, c, g, or t
  misc_feature (184)..(184): n is a, c, g, or t
  misc_feature (218)..(218): n is a, c, g, or t
  misc_feature (220)..(220): n is a, c, g, or t
  misc_feature (226)..(226): n is a, c, g, or t
  misc_feature (239)..(240): n is a, c, g, or t
  misc_feature (243)..(243): n is a, c, g, or t
  misc_feature (245)..(245): n is a, c, g, or t
  misc_feature (248)..(249): n is a, c, g, or t
  misc_feature (255)..(255): n is a, c, g, or t
  misc_feature (302)..(302): n is a, c, g, or t
  misc_feature (305)..(305): n is a, c, g, or t
  misc_feature (307)..(307): n is a, c, g, or t
  misc_feature (321)..(321): n is a, c, g, or t
ccacgcgtcgccacgcgtcgctggctccagttctagtgactcagagggctctagccttcctgtgcaacctgaggtggcactgaagagggtccccagccccancccagccccaaaggaggctgttcgagagggacgtcctccggagnccaanccccagccaaacggaagaggcgctctagacagnttccagttccagctcctcctcttcatcttcactncntcctcnctcctcctcctcnntcntnacnncctccntcttcctcttcttcttcttcctcctcatcttcctcctcctcgtcgtnttncntccacttcccctgnctaagcctggccctcaggccatggaccccaaaggctgcaagcccctacagaagccagcgcgcaccatggagagcggaggtcccgacagcacacccggaacgccaatagactaccctcagggaccatcatacggtcccgtcagctactcgcctgatggagcgttcggcccgaacaccactcggcacacccaagcaccatcaacccaacggggaaacccaagccagaagcaagaccaagacaagatggaaagcagcagaggtacaccgggaagcaagggcccaaacggtggggggaacaagcacgcatcccacacaggacaaaaaggcagaaggcgaggcgcagcaaacaatagaacacatcgaagacacaagaagaacaaacgacgaactacaagggaac

SEQ ID NO: 579646 - DNA, 123 bp, Homo sapiens
gtcgactctaaggatccggcatcctggaccttctccacacacacacacacacacacttgcttcttctgcatcgggaactggaagccagcctaggtgtggtggctcatgcctgtaatcccagca

SEQ ID NO: 579647 - DNA, 891 bp, Homo sapiens
  misc_feature (657)..(657): n is a, c, g, or t
tcccggccaaaaaggtgcttaaggtttttaaggggtccaaaatttccgggcaaaaataaggggatctgagggtttcttttcaaacctaggatttgcggggttgaaaacgcatgggcagggggcggtggggccccaggggttggccttcagagggccggtcgttccaggggaagacgcagcagcaggagaaagacgcctcaggagaagattgaccccttcaggggatgtggcttgtgtcctctcctcaccaaggggggcctgtgaagccgggttccctcacattctcccttcaagaacacagtaaaatctgctcgctaacaggagacacagctgctcacaggagaggcgcacgccccgggtctgggccggagaaggtcttctcacatccatgtctggtcaggagaatggccggggtgtccccacagcggccaatgttggttgggttgagaggtgtccaggtctacaacagcaggggtgtggggttgggggccaacaaggagggttgcgcgcgcagatcgtagatgtgacacgcagtctggcaagaagctctcgcccggaaaccccttgttgggttgggccacacaggggggtctgagaaaagagtaagatctggcccacttcattgagaggcgagacacccggctaaatatactccgngatataaaaaagtgtctcattgagaccaaaaccgagaattaatctctcagggagggaaacaccaagttgtggctcatatggattggtcctttctacaccccccggggagaaaggcgcacgaccaggcttgccgtaaaaaccaggaaaattcgccgggaaaaaaaccttacggcaaaattttgtaccaaagaccaagcggggttggtcatcttttcggattgggaatcaagaacc

SEQ ID NO: 579648 - DNA, 371 bp, Homo sapiens
acgctgtatttcaaccgcaacccttgatagaaaggagtacgcagccccgaattaataccaagtagaagggcaatgcttttcagcattaaacatgcaaggtgacttaaaccagcttaaagtttagtttaaaagttgtaggtgataaaacatatttgacggcgcacttttaaaaagagattcaaaccgcaaggtgattcaaaagaccttgcaaatcccatgacgccagggcgcaattgacgtgatttcaaagcctcagttacacgcatttactcaaacgccagacgcaaaatggcaaagattcaattagggcagtggtcaggcatgcaaaccaatttgggcagcaagcatagcaagttctgcacagtggcaaa

SEQ ID NO: 579649 - DNA, 271 bp, Homo sapiens
cacgatggcgcgtcacgccggagcacagagcctcgccttttgctgatccgccgcccgtcacacccgccgccagctcaccatggatgatgatatcgccgcgctcgtggtcgaaaacggctccggcatgtgcaaggccggcttcgcgggcgaggatgccccccgggcggtcttcccctccatcgtggggcgcccccaggcaccagggcgtgatggtggggcatgggtcagaaggatacctatgtgggcgacgaaggcccagagcaggagaggc

SEQ ID NO: 579650 - DNA, 119 bp, Homo sapiens
gttagggtgcactcgggtgggccctgacatgcatggagtccccgcataaaggtggcccctgcaggagtcaggcctggtctcacactcaataaagacctgactgaagatgcacaaatgga

SEQ ID NO: 579651 - DNA, 170 bp, Homo sapiens
attgtagagaaggctccaaaagccaggatgcctgatctggaacagaggaagtacctagtggcctctgaccttactgttggccagtactacttccttatccggaagataatccacctgagaactgaggacgccttattcttctttgtcaacaacacaccacaacaaaccaa

SEQ ID NO: 579652 - DNA, 161 bp, Homo sapiens
tgtaagcggagcatcagtagcggacgcggtcacgcctgctgggggtatgttgtgttgcctaggcttgtctaggaactcctgggctcaagggatcttgtagccttagcctcctaaagtgctgggattataggcatgagtcactgtacccggcctgctccgct

SEQ ID NO: 579653 - DNA, 134 bp, Homo sapiens
  misc_feature (5)..(5): n is a, c, g, or t
cgaanaccttcagcgccgctgactgcatcacgccgctgactgcatccaacgccgcctgactgcatccaacgccgcctgactgcatccaacgccgcctgactgcatccaacgccgcctgactgcatccaacgccg

SEQ ID NO: 579654 - DNA, 800 bp, Homo sapiens
aggctcaaaaaaaaaaaaacccattggcagaggcagtttggccaacacaagggctctttcaagccgactttcacaaagagagccggactggtaagtgggcttctggtctctttagagccaagaaaatagtaattaggtgggcctagatataggaagggcagaataagcacttactcccccggccttccaagatgcaagaggagaagcaggccaaccctcaataaattggcaagcctgaagagaagtggatcttagagaaagcagagaacagaatgggcactggggatagacatctggactctattcagcccggtagtctggtgatctgggagagtccagttaaggtaacccagatttttggacaaccgccttcctggtgagccaaagttttctcattacccctccactgggggaagcagctgaggcccaggccttgtgctccctggggaaattctcttctctccatcttccggttgcatgggccatgttactggtgccaaagtgtcttaattctgtgtcccatctattctcaggggcctggaacccacataggagtcgggggggagggatggcatgggtatcatgcacgtagtagatccgggtggtgtgtatcatataagagagacgcctccccttatagtggtcgacgcagccgtcctccctgaccagggattggaaataaacaccatggctctgttactgtaaacataaacagacacacacaaagacagaagccacaaaaacaaagacaaaacactaacacacaaacaacaaaccaagagcaaccacagcgcggggcc

SEQ ID NO: 579655 - DNA, 312 bp, Homo sapiens
cactacctagcctacgtagagcaccataggctcccaggccacgcacgttacccgcacaggggctactcatacccctagacagcccagctaccaagcaacagacaccccagcggcctgtactactaccagcggagcaaagagcctagagcccgcagcctagctagggctaatacacgcagccgcgccctacataggcctgccccagctagtaccctatgcaggacgctacaccagctactagtagctaggtggcactgcctggctaccacagggaccatgagctacacgccctagctaccaacccctactacc

SEQ ID NO: 579656 - DNA, 447 bp, Homo sapiens
cacgaggggcccgatgagcgccccgccagtccgatcgaaccgacgaaacgaaggagatctgtcgtgatcgacgtcaacgtgatcgaaacgtcctcgctgggtgaccgcagctacctggccaccgacggggaggtggcggtggtggtcgacccgcagcgagacgtggaccgggtcctggccctggccgggcggctcggggtgcggatctcgcacgtcgtggagacccacgtgcacaacgactacgtctccggcgggctggagctcgcccgcctcaccggcgcggcctatgtgatgtcggcgcgcgacgatctggcgttcgcccgcaccggcgtggtcgacggtgacgtgctggaggcctcgccgcggctgcggctgcgggtgctggccaccccggggcacaccttccatcacctgtcctacgtgctggagggcccggacgggccgcag

SEQ ID NO: 579657 - DNA, 135 bp, Homo sapiens
cccgccggatatgtgtctcatcactgatctgccttatcgctgtagtgagctgaagaaggacacaggacaccagcgcccatctgagcggataagaagaacctggaacagacggtgaaggacctgcagcatcgtctg

SEQ ID NO: 579658 - DNA, 270 bp, Homo sapiens
ttataatatttttggaacttttctgtgagtttaaaaccacttcaagataatattttaacacaaactttaaacagaaagaagaaaaaaagagaaaaggtagaaaaatacactaacatttctaacattatcgagagagagagagagagaaatacaggtgcagtggctcatacctgtagtcccattatgctgggagatcaaggcaggaggatcccttaggtccaggagtttgagactagcctgggcaacatagcaagacctccatctctacag

SEQ ID NO: 579659 - DNA, 363 bp, Homo sapiens
  misc_feature (124)..(124): n is a, c, g, or t
  misc_feature (164)..(164): n is a, c, g, or t
  misc_feature (310)..(310): n is a, c, g, or t
cctggtactgcaggtgcacctatgattggttatccaatgccaacaggatattccccataaggctttagaaggaaatggaaagggctggttttcaaaaatgctctttaaaatgggggttatctgncaagaaagttatttaaaaaacatgggaattgcaaaaatgnctgcagggcaccagtaattatggggccctttttcgctatttaaggtggaaatttttctacattcctgaaacaatttttagggtttttttggcctagaaaaagcaggcagggttttccccaaagtaaatggccagtggttttaaatncaataaattaaggcaatggatggccttccaataaaaaatatttgaaggctgga

SEQ ID NO: 579660 - DNA, 790 bp, Homo sapiens
  misc_feature (1)..(1): n is a, c, g, or t
naaagaaacaaaacttgagttccaccccgtggccgtccgtttataactaagtggtcccccggcctccaggattaggtctaaagaagttcttggtttaacaatggccttccgccccgcccgttgttaccgttattgtaaaccaagcggtacccaaattttggcttctgcaaggtgtcacctgatgccaggattcgcttttttgccctgggcggaaaaaagcaagaagtgaataagtttccgcttggtggccacacggtgtcagattaatatagcaacttgtctcttgaagccatgaagctcgcccgaaattagtgccaataagccatcggtcaaaagttgtgacaaagatgtctccaatatctgggtgcggctcgccccctttctacgtcatccgcatcacaaatatgttgtcctgtcttgtggataacaggctccatacaggcatgcgatgtgcctttggaaaccctcagtgcactgtggccaaagttcacattggccaagttatcatgtccatccgcaccaagctgcagaacaagcagcatgtgattgagtccctgcgcaaggccaagttccagtttcatgcccgccataagagtctcatctcaaacaagtgaggtttccacgagttcaatcttcatgaatttgaagacatggtggcttaaaatcggctcatcccacatggctgtgtgggtcaagtacatcaacagtaatggccctctgcacaagtggcgggccctgcactcatgagggcttccaatgttccgcccccctcttaatactccccaatatg

SEQ ID NO: 579661 - DNA, 262 bp, Homo sapiens
  misc_feature (205)..(205): n is a, c, g, or t
  misc_feature (241)..(241): n is a, c, g, or t
tgaagacatactaaaatatacattctgaaatattacagaaccgtcattttatccattgtcctcattaatttgcaagagctatccatatgattgtaataacctatgaccttcggcaatttttaaaaattaagttaatcactgtaaaaaatgtttgtttttaccaaaaagctctaatttctcaaatatcttactgggcttccagganaaatgttttgctaatgtttacctgtaggggacaagnctctcaggaaggtggaaatct

SEQ ID NO: 579662 - DNA, 1012 bp, Homo sapiens
ggcaatacgatatagctaccgcaagggaaagatgacacattactagccaaagcactaagtatagcacggactaacccctataccttctgcatcatgaagttatcgtagaaataagctttgcacagggatgaggccatcacgctacagcacgccccgaaagcagagcgagctatctatatgaagcagcataaaagagactcacccggtctatgtagcaaggatagtgggaagatttataggtagaggcgaaaaagcctaacacgatgccaggaagatatgctggattggtccgagggattagaagactctgacgttgcaaatctctcacaatttagtcccaacgagatatccgctctaatatgcaccctgtggtcagagatctgatagctaggttaagtcccagagagtaggagagcacgctgcttctcgggaacaaccttagggtaaaaatggaaaccttgttgacaagggacgaagtaagaatagaaagtgtttagaagctagcacaccatgtcagatcatgtgaccctttagaaatacgactatgtcccactccaaactgtaaggggaaaataaggccgattgaccaatggggctccaagaagaaaccatacttaaacccttaaaaaatagtcctcggataacattgaatagatcctgtgaaaccgtcccgttcaagcaagcccccaaatctgttgggaacgctaaaatccgttaagtgctagccaccgttaattagggaaagggaaaccttaaaatgggtttgaaggttaatatacacggttaaaaaccaatttgaaagagaaccaatatttcctccacatacccccgggcaattaaaaggccccttgtccggtttccacggacattctcacacacaaacccaacgtggtaaaaccgtggacccaaatttcacacgccaaggcgcccccaaaattaattacgttaccacaattgccaaaacgcccaaaatcgaaaggttcccaatttaattttaaaccccccgttccag

SEQ ID NO: 579663 - DNA, 202 bp, Homo sapiens
ccgtggtggaggcagccttaggctgtgcccgcgacaggggccctgcatgctgagcaacagactcaccttagcaggctgcacgggctcctctccacgggagccttcaccgccggggctgtgagcttgagcaggggttggtccccgccctgccctgataaccacacgtcaaggcctggggggtcaccgcgtgtcaccagagcag

SEQ ID NO: 579664 - DNA, 129 bp, Homo sapiens
tctatcatactatacaactcgtgggttcagctagttcgaagggcctagagaatcgatatcatagtacgtagtatgtgggggagcagcttctgatgctgcgtctgagggcttggctcctgagaccgtccg

SEQ ID NO: 579665 - DNA, 565 bp, Homo sapiens
  misc_feature (184)..(184): n is a, c, g, or t
cgggagatcgggccagatgaagcccttctacactgtgggccagacgcaggcctggaggattgaaggtccttcagctgccactgtaatgggggttgggctggcccccctgccagggagcccaggcctgggcctaaaaaaccagtataaagccagggcccctgccactgcttctttttttccctgntgccacttttccagtcctggaaatactttgtcccactcttgctttattcagtttcaggtcaaccctcccaagcacacaccccgtttcccttggaatccctgaggggtagaaggggccagaaaaaacgcttataaaaccagaggccctttgagatcatgtgagtcccccatggcaaggaaccagttccagggagagtcaggttccagctagttagggctgccagcctagggctttgggcctacccctccctaagcccatggagaggtcccaaatgggccgggcccgggcaaatgggccccaaaaaattttggcgaaggtcggtaaagggttaagctgttgtctgccctctttcatcataaagtcccttttttccccggccta

SEQ ID NO: 579666 - DNA, 696 bp, Homo sapiens
  misc_feature (547)..(547): n is a, c, g, or t
  misc_feature (643)..(643): n is a, c, g, or t
  misc_feature (648)..(648): n is a, c, g, or t
  misc_feature (696)..(696): n is a, c, g, or t
ttcaagatgcttgtaaatgatatcaaccgtttatttagtccacccctgaagaactgagggtcctgggaactgaaccatatcaatgcaatcttttctacattattaactgaagaaaaatgggtactttttaaactttttttttttaagattaggaaacaaaaagaagtcagaaggagccaaatctggactgtaaggtgcatacctaatggtttcccatcaaaactcttacaaaatttctcttttttgatgagaggaatgagtagaggcattgtggtgcagaagtctctagtgaagctttcccaggcatttttctgccgaagctttggctaactttctcaaaacactcataataagcacgttatcattctttgttccttcagaaagtcaacaagcaaaatgtcttgagcatcccagaaaactgtttccatgatctttgctcttcatctgtctgcttttgctttgactgaatcacttctgcctcttggtggccattgccttaattgtgctttactatcttcaggattatactgggaaaagaatgctttangtatcctgggccctacttgttgaaaaatttccattgaaaagctctgcttttgcaagctgatcggggaatgcaagtgggtttttgggtaccccatcnaagtnggaaaggtttactcaaactttaaattcctcaagtcaaaaaattggttn

SEQ ID NO: 579667 - DNA, 793 bp, Homo sapiens
  misc_feature (30)..(31): n is a, c, g, or t
  misc_feature (284)..(284): n is a, c, g, or t
  misc_feature (300)..(300): n is a, c, g, or t
  misc_feature (371)..(371): n is a, c, g, or t
  misc_feature (412)..(412): n is a, c, g, or t
  misc_feature (414)..(414): n is a, c, g, or t
  misc_feature (442)..(442): n is a, c, g, or t
  misc_feature (462)..(463): n is a, c, g, or t
  misc_feature (478)..(479): n is a, c, g, or t
  misc_feature (485)..(485): n is a, c, g, or t
  misc_feature (488)..(488): n is a, c, g, or t
  misc_feature (490)..(490): n is a, c, g, or t
  misc_feature (493)..(493): n is a, c, g, or t
  misc_feature (495)..(495): n is a, c, g, or t
  misc_feature (517)..(517): n is a, c, g, or t
  misc_feature (523)..(523): n is a, c, g, or t
  misc_feature (535)..(535): n is a, c, g, or t
  misc_feature (566)..(566): n is a, c, g, or t
  misc_feature (631)..(631): n is a, c, g, or t
  misc_feature (647)..(647): n is a, c, g, or t
  misc_feature (656)..(657): n is a, c, g, or t
  misc_feature (659)..(659): n is a, c, g, or t
  misc_feature (667)..(667): n is a, c, g, or t
  misc_feature (680)..(680): n is a, c, g, or t
tttacaaatattcgtgttcattttctggtnnagcatgctatatttagaaactcatggggagaccttagactttgtttaatcctttatgtttcaacctttaaatgttccattcttatagtattactttaaatcaattctaaaactgaacttgtttgttacataaatgtcgcaggcaaaaataacactacttatagattttacctattatggtaaaaaataggaacatatgtcattctttttttttttttttttggagaacagagtctcactctgttcgccaggcntggagttgcgtgggcncaatctcggctcactgaacctccgcctccggggttcaatcgattctccgtgcctcagcctcctgagtagcngggactacgggtgtgtgccaccacgcccagccaattttttngntattttagtagagacggggtttcaccantgtgggccaggagggtctcnnatctccggacctcgnngatctngcncngcntnagctcccaaaggtgcggggatnacaggnttgagccaccgngccgggcggtcattcattctggcaacaagcntttatggagcacctacggtgtgctcacagtaaagaaacgtgatcttatcccagtagaggtagatnttctgaaaaagaatanttcttaaanngnttaaaacnggggtcccacccnaggcacagaccagtaccagtcgtggcctggtatggaccaggcaccacacgggtgaccgtggtaagtgaacagtcaactgtattaagtgctcccaaagatgataaggcgaaatg

SEQ ID NO: 579668 - DNA, 228 bp, Homo sapiens
  misc_feature (25)..(25): n is a, c, g, or t
  misc_feature (35)..(36): n is a, c, g, or t
  misc_feature (83)..(83): n is a, c, g, or t
  misc_feature (194)..(194): n is a, c, g, or t
tccagcaggataacccctccctttnatggcatttnntctctcagacaaggcgaccagccagctcctgttggagacagattggnagtccattttgcagatctgcgacctgatccgccaaggggacacacagtgagttagcggggcctgtgccctgatgcggaggagcagccgtgcactaagctgggctcgcttgngtgcccgttggggctccacgacgtagctgaccgt

SEQ ID NO: 579669 - DNA, 215 bp, Homo sapiens
ctagagcatccccaaaagcccattgaagatcctttagaggcagagactcagcctatagtttgaaatgtcagactcattgaaagaagaatggacggactattaaggaagccagacaaaggacgccccaggtgaggatgaggaggaagatggcgtcagcgaagcggtcagactagaggaacctaaggaagaggatcaaggagaacgctagttggcag

SEQ ID NO: 579670 - DNA, 1769 bp, Homo sapiens
gggcaggtcccacggaggggatgctgcggccaggctccgtggggtggggcaccctgcgacgggctgctcctcttcccagggccaccggtgagactctcagtgcacagagtgcggttctgtgtggaggtgtgggatgcatctcctggccctcccgtagtggggtgcaaccccaagtgaagaccccgtggctcatgtcaagtgccctcagggctggggctgcccacccgcctgcctgggccgtcttgacaccggagctgcctgcctggatgttggagcgcccagtggattgagtgggaagtgggcctgggtgcttacaggcgatggggtcaccagagcccacccaggggcctcgcctgtcccccattctcattccaaactctgggaggcggtacaaggtcgggagggccagcggggctctctgccaccaggactcacttccgcccatcttggaactgggcctcactttcctgcgagcttctgctgggttctcagtgcccaccagcagctcctttgctctccctgagcccttgaggtcactctgccttgggaatggggagggtttgggtctcagcctcacgctcacggtcctggcttggattttaggcctcagtggcactctgggagcgcttgtgctcttcatggttgccactgggattttccaggaggctctgtggcatttgctgttgctctctttttctgtggaagctctgccttgcttttttttttttcccttttttctgctctgtaggtgcttgagggcggagttgcagatccagcagagactcgatggcactctctcactggatctgatgcgacttgagagcgatggggagacaggatgtgccgcagagtcctcggtgctgcagggtgcacagctgatcgccgtggcctcctcggaccccgcggcggcgggcgtggatgggtcgccactccagggcagcgacatccaggttcagtacgtgcagctggcgccagtgagtgaccacacggccggggcacagacggccgaagccctgcagcccacgctacagccggagatgcagctcgagcacggggccatccagattcagtgagcggtgcccatggcaccaggagcccctcgccggctccgcctacggcccggcccccacgcgccctgctctcacggcctcggcacaggcagcggctgcacgtgttctgctgaagtgcgtctgaaggccgctgcctccgcggggaacagcatcctatcaactgaaagagcagccgccgccgcccccagccggagacccctttcgtttgagtcctgctgttggtgtcggagcacgaggggaggcacggtgcggagagcgtcgcatatgcgcgggaaatcaagaactatgatatttttctgtttaaacagctttttttaatttgctatggtgtttataacaaaaaagaaaatttgaaaaaaaaaatcccaggggagtagcaggagccctttgctgtgtgctctgtccagtgtcatgagacgggagccctttgctgtgtgctctgtccagtgtcatgagacgggagccctttgctgtgtgctctgtccagtgtcatgagacgggagccctttgctgtgtgctctgtccagtgtcatgagacgggagccctttgctgtgtgctctgtccagtgtcatgaggcaggtgtttgcaaagccagctctcggttccgatggggtattgctgacctacttttctaggggaaatgctcttaaacactgtaattatgcatttctaatgaaataaaatgtatttatgaccac

SEQ ID NO: 579671 - DNA, 294 bp, Homo sapiens
gcagatagaagcttatagtgaggaatgacacgggctctcctcttaccgccatcttggttcctgtgtagtgcctgctgggaacgggacttctaaaaggaactatgtcttggaaggctgtggtccaaggccatttttgctaggtataagcggggttccggaaccaaagggagcacacagctcttcttaaaattgaaggtagttacgcccgagatgaaacagaatactatatgggcaagatatgcgcttatgtatataaagcacagaatcacacagtcactcctgatggcaaaccaa

SEQ ID NO: 579672 - DNA, 121 bp, Homo sapiens
agctggtacctctccacttccctgactctgggaataactaatatttaatgcaggtaagatgagaagcaatggggtctcagttctagtgaatacagtgctagttgattgtcctggggttgtt

SEQ ID NO: 579673 - DNA, 127 bp, Homo sapiens
tccctggggagaccccggatgaggagggaggtccacccaacatggctgtccttgggaagacttgggtcatcacaaattgtgttccatggtatatgtgggtggaaaaatatggtttcaagatttgtca

SEQ ID NO: 579674 - DNA, 1643 bp, Homo sapiens
gggcaggtcccacggaggggatgctgcggccaggctccgtggggtggggcaccctgcgacgggctgctcctcttcccagggccaccggtgagactctcagtgcacagagtgcggttctgtgtggaggtgtgggatgcatctcctggccctcccgtagtggggtgcaaccccaagtgaagaccccgtggctcatgtcaagtgccctcagggctggggctgcccacccgcctgcctgggccgtcttgacaccggagctgcctgcctggatgttggagcgcccagtggattgagtgggaagtgggcctgggtgcttacaggcgatggggtcaccagagcccacccaggggcctcgcctgtcccccattctcattccaaactctgggaggcggtacaaggtcgggagggccagcggggctctctgccaccaggactcacttccgcccatcttggaactgggcctcactttcctgcgagcttctgctgggttctcagtgcccaccagcagctcctttgctctccctgagcccttgaggtcactctgccttgggaatggggagggtttgggtctcagcctcacgctcacggtcctggcttggattttaggcctcagtggcactctgggagcgcttgtgctcttcatggttgccactgggattttccaggaggctctgtggcatttgctgttgctctctttttctgtggaagctctgccttgcttttttttttttcccttttttctgctctgtaggtgcttgagggcggagttgcagatccagcagagactcgatggcactctctcactggatctgatgcgacttgagagcgatggggagacaggatgtgccgcagagtcctcggtgctgcagggtgcacagctgatcgccgtggcctcctcggaccccgcggcggcgggcgtggatgggtcgccactccagggcagcgacatccaggttcagtacgtgcagctggcgccagtgagtgaccacacggccggggcacagacggccgaagccctgcagcccacgctacagccggagatgcagctcgagcacggggccatccagattcagtgagcggtgcccatggcaccaggagcccctcgccggctccgcctacggcccggcccccacgcgccctgctctcacggcctcggcacaggcagcggctgcacgtgttctgctgaagtgcgtctgaaggccgctgcctccgcggggaacagcatcctatcaactgaaagagcagccgccgccgcccccagccggagacccctttcgtttgagtcctgctgttggtgtcggagcacgaggggaggcacggtgcggagagcgtcgcatatgcgcgggaaatcaagaactatgatatttttctgtttaaacagctttttttaatttgctatggtgtttataacaaaaaagaaaatttgaaaaaaaaaatcccaggggagtagcaggagccctttgctgtgtgctctgtccagtgtcatgagacgggagccctttgctgtgtgctctgtccagtgtgcaggtgtttgcaaagccagctctcggttccgatggggtattgctgacctacttttctaggggaaatgctcttaaacactgtaattatgcatttctaatgaaataaaatgtatttatgaccac

SEQ ID NO: 579675 - DNA, 1868 bp, Homo sapiens
gggcaggtcccacggaggggatgctgcggccaggctccgtggggtggggcaccctgcgacgggctgctcctcttcccagggccaccggtgagactctcagtgcacagagtgcggttctgtgtggaggtgtgggatgcatctcctggccctcccgtagtggggtgcaaccccaagtgaagaccccgtggctcatgtcaagtgccctcagggctggggctgcccacccgcctgcctgggccgtcttgacaccggagctgcctgcctggatgttggagcgcccagtggattgagtgggaagtgggcctgggtgcttacaggcgatggggtcaccagagcccacccaggggcctcgcctgtcccccattctcattccaaactctgggaggcggtacaaggtcgggagggccagcggggctctctgccaccaggactcacttccgcccatcttggaactgggcctcactttcctgcgagcttctgctgggttctcagtgcccaccagcagctcctttgctctccctgagcccttgaggtcactctgccttgggaatggggagggtttgggtctcagcctcacgctcacggtcctggcttggattttaggcctcagtggcactctgggagcgcttgtgctcttcatggttgccactgggattttccaggaggctctgtggcatttgctgttgctctctttttctgtggaagctctgccttgcttttttttttttcccttttttctgctctgtaggtgcttgagggcggagttgcagatccagcagagactcgatggcactctctcactggatctgatgcgacttgagagcgatggggagacaggatgtgccgcagagtcctcggtgctgcagggtgcacagctgatcgccgtggcctcctcggaccccgcggcggcgggcgtggatgggtcgccactccagggcagcgacatccaggttcagtacgtgcagctggcgccagtgagtgaccacacggccggggcacagacggccgaagccctgcagcccacgctacagccggagatgcagctcgagcacggggccatccagattcagtgagcggtgcccatggcaccaggagcccctcgccggctccgcctacggcccggcccccacgcgccctgctctcacggcctcggcacaggcagcggctgcacgtgttctgctgaagtgcgtctgaaggccgctgcctccgcggggaacagcatcctatcaactgaaagagcagccgccgccgcccccagccggagacccctttcgtttgagtcctgctgttggtgtcggagcacgaggggaggcacggtgcggagagcgtcgcatatgcgcgggaaatcaagaactatgatatttttctgtttaaacagctttttttaatttgctatggtgtttataacaaaaaagaaaatttgaaaaaaaaaatcccaggggagtagcaggagccctttgctgtgtgctctgtccagtgtcatgagacgggagccctttgctgtgtgctctgtccagtgtcatgagacgggagccctttgctgtgtgctctgtccagtgtcatgagacgggagccctttgctgtgtgctctgtccagtgtcatgagacgggagccctttgctgtgtgctctgtccagtgtcatgaggcaggtgtttgcaaagccagctctcggttccgatggggtattgctgacctacttttctaggggaaatgctcttaaacactgtaattatgcatttctaatgaaataaaatgtatttatgaccacagcagccttacgcttttcctcctgcgagacggttcgccagagagtgcctgtccctggggggttgggctcgctggccttcaggccacgctgctgccctct

SEQ ID NO: 579676 - DNA, 1912 bp, Homo sapiens
  misc_feature (1690)..(1690): n is a, c, g, or t
gggcaggtcccacggaggggatgctgcggccaggctccgtggggtggggcaccctgcgacgggctgctcctcttcccagggccaccggtgagactctcagtgcacagagtgcggttctgtgtggaggtgtgggatgcatctcctggccctcccgtagtggggtgcaaccccaagtgaagaccccgtggctcatgtcaagtgccctcagggctggggctgcccacccgcctgcctgggccgtcttgacaccggagctgcctgcctggatgttggagcgcccagtggattgagtgggaagtgggcctgggtgcttacaggcgatggggtcaccagagcccacccaggggcctcgcctgtcccccattctcattccaaactctgggaggcggtacaaggtcgggagggccagcggggctctctgccaccaggactcacttccgcccatcttggaactgggcctcactttcctgcgagcttctgctgggttctcagtgcccaccagcagctcctttgctctccctgagcccttgaggtcactctgccttgggaatggggagggtttgggtctcagcctcacgctcacggtcctggcttggattttaggcctcagtggcactctgggagcgcttgtgctcttcatggttgccactgggattttccaggaggctctgtggcatttgctgttgctctctttttctgtggaagctctgccttgcttttttttttttcccttttttctgctctgtaggtgcttgagggcggagttgcagatccagcagagactcgatggcactctctcactggatctgatgcgacttgagagcgatggggagacaggatgtgccgcagagtcctcggtgctgcagggtgcacagctgatcgccgtggcctcctcggaccccgcggcggcgggcgtggatgggtcgccactccagggcagcgacatccaggttcagtacgtgcagctggcgccagtgagtgaccacacggccggggcacagacggccgaagccctgcagcccacgctacagccggagatgcagctcgagcacggggccatccagattcagtgagcggtgcccatggcaccaggagcccctcgccggctccgcctacggcccggcccccacgcgccctgctctcacggcctcggcacaggcagcggctgcacgtgttctgctgaagtgcgtctgaaggccgctgcctccgcggggaacagcatcctatcaactgaaagagcagccgccgccgcccccagccggagacccctttcgtttgagtcctgctgttggtgtcggagcacgaggggaggcacggtgcggagagcgtcgcatatgcgcgggaaatcaagaactatgatatttttctgtttaaacagctttttttaatttgctatggtgtttataacaaaaaagaaaatttgaaaaaaaaaatcccaggggagtagcaggagccctttgctgtgtgctctgtccagtgtcatgagacgggagccctttgctgtgtgctctgtccagtgtcatgagacgggagccctttgctgtgtgctctgtccagtgtcatgagacgggagccctttgctgtgtgctctgtccagtgtcatgagacgggagccctttgctgtgtgctctgtccagtgtcatgagtacgggagccctttgctgtgtgctctgtcccagtgtcatgaggngcaggtgtttgcaaagccagctctcggttccgatggggtattgctgacctacttttctaggggaaatgctcttaaacactgtaattatgcatttctaatgaaataaaatgtatttatgaccacagcagccttacgcttttcctcctgcgagacggttcgccagagagtgcctgtccctggggggttgggctcgctggccttcaggccacgctgctgccctct

SEQ ID NO: 579677 - DNA, 1828 bp, Homo sapiens
gggcaggtcccacggaggggatgctgcggccaggctccgtggggtggggcaccctgcgacgggctgctcctcttcccagggccaccggtgagactctcagtgcacagagtgcggttctgtgtggaggtgtgggatgcatctcctggccctcccgtagtggggtgcaaccccaagtgaagaccccgtggctcatgtcaagtgccctcagggctggggctgcccacccgcctgcctgggccgtcttgacaccggagctgcctgcctggatgttggagcgcccagtggattgagtgggaagtgggcctgggtgcttacaggcgatggggtcaccagagcccacccaggggcctcgcctgtcccccattctcattccaaactctgggaggcggtacaaggtcgggagggccagcggggctctctgccaccaggactcacttccgcccatcttggaactgggcctcactttcctgcgagcttctgctgggttctcagtgcccaccagcagctcctttgctctccctgagcccttgaggtcactctgccttgggaatggggagggtttgggtctcagcctcacgctcacggtcctggcttggattttaggcctcagtggcactctgggagcgcttgtgctcttcatggttgccactgggattttccaggaggctctgtggcatttgctgttgctctctttttctgtggaagctctgccttgcttttttttttttcccttttttctgctctgtaggtgcttgagggcggagttgcagatccagcagagactcgatggcactctctcactggatctgatgcgacttgagagcgatggggagacaggatgtgccgcagagtcctcggtgctgcagggtgcacagctgatcgccgtggcctcctcggaccccgcggcggcgggcgtggatgggtcgccactccagggcagcgacatccaggttcagtacgtgcagctggcgccagtgagtgaccacacggccggggcacagacggccgaagccctgcagcccacgctacagccggagatgcagctcgagcacggggccatccagattcagtgagcggtgcccatggcaccaggagcccctcgccggctccgcctacggcccggcccccacgcgccctgctctcacggcctcggcacaggcagcggctgcacgtgttctgctgaagtgcgtctgaaggccgctgcctccgcggggaacagcatcctatcaactgaaagagcagccgccgccgcccccagccggagacccctttcgtttgagtcctgctgttggtgtcggagcacgaggggaggcacggtgcggagagcgtcgcatatgcgcgggaaatcaagaactatgatatttttctgtttaaacagctttttttaatttgctatggtgtttataacaaaaaagaaaatttgaaaaaaaaaatcccaggggagtagcaggagccctttgctgtgtgctctgtccagtgtcatgagacgggagccctttgctgtgtgctctgtccagtgtcatgagacgggagccctttgctgtgtgctctgtccagtgtcatgagacgggagccctttgctgtgtgctctgtccagtgtcatgaggcaggtgtttgcaaagccagctctcggttccgatggggtattgctgacctacttttctaggggaaatgctcttaaacactgtaattatgcatttctaatgaaataaaatgtatttatgaccacagcagccttacgcttttcctcctgcgagacggttcgccagagagtgcctgtccctggggggttgggctcgctggccttcaggccacgctgctgccctct

SEQ ID NO: 579678 - DNA, 126 bp, Homo sapiens
acagggatagtcatttagttgtttgggctcttctggttttgttacagtgcatttacgtgaagatgcagtacgcgttttgttacaacaacaagtgttcgctctccctcattcgttcccagcagtcac

SEQ ID NO: 579679 - DNA, 539 bp, Homo sapiens
cccagagacatgagggtactagaggccacatttctgattctgcagatatcagatgacacaatgtcaccagcataatacatgctttcagtagcctatataataacaggttaactgcctaacagcagtcttaatatctggaccttatacatcaggatggtgctgtgagtatgggcaggaaatagtttagagcctgagagacacgacaactgaaataaaaatgtaggccaggtgcagtggctcatgcctgataatcaccagtacatataggaagagccaacgcaggaaaaattgctataagcccaggagagtcaagaccaacctgaacaacataacaaggaccctgtctctacaaaaaaaatagtttaataagtcaggcgtgatggcatgcaccctatagtcccagctacttggaaggctaaggtgagagaatagcttgaacccagaagatacaggctgaagtgagccataattgccccaatgcactccagactgtgtgacagagcaacaacctgtctcaaaaaaacaaacaacaaaaacac

SEQ ID NO: 579680 - DNA, 163 bp, Homo sapiens
cattccattttcaccaccaaacaccaagcattcaccatgtgcccaaaacaagcaaagcacccaacacagcaaacaaaggagcgaacaaccctcaatgctgcacactgcatggtcagtcaccctgcaacagtggcccaaaggccactgcatcaaacaataaaca

SEQ ID NO: 579681 - DNA, 1230 bp, Homo sapiens
  misc_feature (444)..(444): n is a, c, g, or t
  misc_feature (465)..(465): n is a, c, g, or t
  misc_feature (781)..(781): n is a, c, g, or t
  misc_feature (858)..(858): n is a, c, g, or t
  misc_feature (860)..(860): n is a, c, g, or t
  misc_feature (880)..(880): n is a, c, g, or t
  misc_feature (981)..(981): n is a, c, g, or t
  misc_feature (994)..(994): n is a, c, g, or t
  misc_feature (1225)..(1225): n is a, c, g, or t
  misc_feature (1227)..(1227): n is a, c, g, or t
ctcagggaaaaaggcaaagtacaaatctgtaaacataatagaagacttgcgaggagtcacacaaatacatgaaaaagaggctttgcagaagctttggccacagatgttcattgagcttgttagggatgcagccatggaaattgggaataaaaattcctatatgaagctctgcctacagcagataacagaccaaaaaccacaaatctgcgcccgctggcctcaggggcggagccctcgcgccgtttttctttagcgaggggcgcggccggacgcccgctccgcgcctccggccccccccggcccgtcgcgcacccgcgccctgccatagtactcaccctacgcccgcaatccacatcaaccctacacatatttgcgggccgttcgggcccactagtgactatcctatcattatagttccccgcgcggccgcgcgccggccggcgncgcgcacaccacccctacacnacccccaccgcacacgagccaccacagcggcgcgcgcctcgccgtcggggcccggcgcgccatgaacggcgcggaaccatcgaagcacagcccaccctaccatccgtactcccagatgcgtcacacccgaccaccctactcgcccccaccttcgcccgcccatctctgggctgtaacacaagataccccacatcccatcatcacccgatatgcgccgccgcacccggcaaggcatcgatatcgcgcgcggtgcctcgcccggccgcgccccgccgtgcgcgaccgcgcgaggcacgccgccccgccactcccatancgtccatgcgtcaccatccccgccgtactgatcctcccgtcgacgcgtggctcgatgccgcggagaccgatacaccnancgccatcgcgttacgttccnagcgcgcatcggcctcacaagacgacgcgctacagtgatacgacgccggagaaggcacgccgagttcgcccgttatcgccgcgcgtaccccccgattatantccgcgcgccccngatgtctacgcacacacctcaaacacgcgcgggcggggggcgggacccgaagccggacgcgcctcactccgccaccgaaccgtcgctctcacggtccgcgcgttgtaccgcatgagtccaagagacgttccgacccaccaccgcctcgctgatagcccgtcgctcctcacgcttcttatagccctatgacaccaccccgacgcagcacgctctccgtcgaccctccgcgtncntat

SEQ ID NO: 579682 - DNA, 351 bp, Homo sapiens
ctaaatgtgttctgaagataacatagatgaaacttccatcaaccctgccaatcgaaaaaaaaaaagcacatgccaacataatacaatttttcctcagaaggattttggtaatttgagaaacctgaattccaagttcctttctccttttcaagttacaaaatgcttcccaaccaacatgcacagcactgcaaacatatattaaagcttcacaaaacaaaaactgtaattaaaattgaaactctgtgactcatgttcattatgtcaaatatacagatggctggtgttgaacatagctcaaatcgttttctaaccataatcatgtataataaaagattaataaagagtgaaaaa

SEQ ID NO: 579683 - DNA, 910 bp, Homo sapiens
ggagagagagaactagtctcggtttatgtatgattttttccctattggatggtttaatgactttaaaaaagtgagcatgaaaataaatcttaatttcagttataacccaccaataagaaaaagttaggtcacagtttaagctctgtgacacaaagtgaactaggaggcaaattatatccatcagatacaattaatgccccaacttttacaagtacaggctatctggaaagctggcaacatacccagatatggctatgtggtctctcacgacagcaagggatgacatctgaaaagtggtcgttaggagtagcaggggtaactaaagtatgtggctcggaaatcaagaggttcataacacttgctacatgtgcggacactgagtacatactgcacacaagttgaaccccaacatgagactcaaccacaccgccgacacgacagcgcgtacccacgcacccccggccgtccacagcgccaaaatgagcataacgcaaacaagaccggggacgcccgctcccgagcgcaacacacaataaacccaatatacaccaaccatcaacccagcgccacaaccaaccacccccagcccaacacacccacaccacaccgacaccacgaccacacacgtccataacacgagacaaattccgcccgaagccataaacagggtacgaaaacaacgaggaaatcgcgagcacacacacgacgccgtacgccaacaagaggaccacagtaagcaccaccacaacggcccgccagacaagctatcgcgtgacaaccgagaggacaacagacaacgggtacagaaggacacagcccaaccgcgcagaccaccggcccatccacacaaaagaaaaaaccgacacagcgcacgacaacaccctcaccccacaaacccacgcgaacaaac

SEQ ID NO: 579684 - DNA, 588 bp, Homo sapiens
  misc_feature (18)..(18): n is a, c, g, or t
  misc_feature (25)..(25): n is a, c, g, or t
  misc_feature (28)..(28): n is a, c, g, or t
  misc_feature (31)..(31): n is a, c, g, or t
  misc_feature (34)..(34): n is a, c, g, or t
  misc_feature (36)..(36): n is a, c, g, or t
  misc_feature (38)..(38): n is a, c, g, or t
  misc_feature (41)..(41): n is a, c, g, or t
  misc_feature (46)..(46): n is a, c, g, or t
  misc_feature (61)..(61): n is a, c, g, or t
  misc_feature (63)..(63): n is a, c, g, or t
  misc_feature (66)..(66): n is a, c, g, or t
  misc_feature (69)..(69): n is a, c, g, or t
  misc_feature (84)..(84): n is a, c, g, or t
  misc_feature (87)..(87): n is a, c, g, or t
  misc_feature (92)..(92): n is a, c, g, or t
  misc_feature (545)..(545): n is a, c, g, or t
  misc_feature (554)..(554): n is a, c, g, or t
  misc_feature (580)..(581): n is a, c, g, or t
gaaccagttggtgaagtngagaagntcntgntcntngnggntgagngggtcgtaagagccntngtngangagtaggatgagacnggngagcnggcatggagttcaagtcgttggagtagttgggggagatggtgggcgacaggacgcctgcctggaaggcggcgctcaccgcgtcatgctcgtccagcagctgctgcagcgcgcggatgtactcgaccgccgagcgcagtgtctccaccttactcatcttcttgttggccgcgccgttggggacgtgctcccgaagggtggcaaagcccaggttgaccaacttgacgcggttgcgctcgcgctcgttgcggcgcgccacggcggccggctgctgctgcggcagctgtagccaaagccgctgaagttgagccggcgtttgcagcgcatcagttcgggcgaagacgaggtgtcgcttgacttgcttgggcgctgacttgtgaccgccccctgagggctgcgtcggccgccggtctcagctgcggcgcctgctgctgctgctgctgctgctgctgctnctgctgcgngccatctgcgctcgtctgcggcggcnncggccgc

SEQ ID NO: 579685 - DNA, 815 bp, Homo sapiens
tcagttttccccaccctttttcgtttccttttattatttgttcgtcaaactcacacacattcattacttacttttttattttctttttatttctatcttctttgtttatctcttattttatcttatctccattctttaatttcttttctattcactttatatttttcttttatctctacccttttctttttccttattctctttttctttttcctctctttttttttcttttatatcatttttcttactttttctttatctcttctccttattttttctctctttcttcttttttttctttatctattttctctctttcttcattcctccatttttttcttttctctttttattatttcttctttcctctccttttctctttctactctatttttattcttcttcttctcttattttttctacttttatatctctctcttccttctcttttttattctattattcttctacatttttctcttctctattcttctatatcttatttttcctctcttttatatcttctttttttctactttcttttctctttcttttatattacttactatctactccttctttatctcatgattctatcatatctcatcttactctcttacttctcttctcttttttctcctattctacctaatttcatctgtttcattttctctcttatattccctttatctctatcttcttatctccatctctctctcctctttcatttcattattattcttccttctatttcaatattactctctctctatcttatcacctcatctccatctaatctacttccttcatctccc

SEQ ID NO: 579686 - DNA, 446 bp, Homo sapiens
  misc_feature (403)..(403): n is a, c, g, or t
  misc_feature (412)..(412): n is a, c, g, or t
  misc_feature (438)..(439): n is a, c, g, or t
tgggaatgtggcacaggacctgctgaaggggctcacgctcatgtcgtccacagtgtcagcgcgcgatgtactcgaccccgagcgcagtgtctccaccttactcatcttcttgttggccgcgccgttggggacgtgctcccgaagggtggcaaagcccaggttgaccaacttgacgcggttgcgctcgcgctcgttgcggcgcgccacggcggccggctgctgctgcggcagctgtagccaaagccgctgaagttgagccggcgtttgcagcgcatcagttcgggcgaagacgaggtgtcgcttgacttgcttgggcgctgacttgtgaccgccccctgagggctgcgtcggccgccggtctcagctgcggcgcctgctgctgctgctgctgctgctgctgctnctgctgcgngccatctgcgctcgtctgcggcggcnncggccgc

SEQ ID NO: 579687 - DNA, 1171 bp, Homo sapiens
ggctcctaaaggcagctccaaacagcaagtcgtgaggatggacctggctcctggcaggattatcaggccgcaagtctctcggccaagatcctccgaggctcttcttcgagaaacagtcgttcatcgtgtctgccatccccatctggtttatactggacgaatataggcgatatggatacttgattcagtactggctgtcttgtatagtgtgatgaccctagtaagcacatattgtggtatgcgctttgaagtacaacgaatgtgaaattttgttctgcgaagcagcagagaggtatgcacagaaggaagggatggaatgcatgtgtcctaaaggaatgtgacatcgaatagaggtttcgatgaaggcctcgagtaatagtacacagagtgtgtctcggcgacaagggcaggagaaggatggaagagcagatcattggtgggacagcacagaaatggaagctggcggtgattaatggaagtcgtacaaagcatttggcccatcattgctaataacgaacaactcgtggttccgtagggtacagtggatcagttgtagcttcacttcttcatattgaagaactttcaaacccacaggtgaactacatactggtccataagatgccttcatcaggactcaatcgcccgtccaggtactactagctccatacatagaccgatgtcgagcttcaccccctggacttagtgtctatgggtggactgtggtatatggaaaagtagcagggtggtcagcgcgggagacacaagcaagttccgatagactagaggctgaaaaaagaccaggagaatgtattcagtaatggatatagggtggttttgacaggatgttgcacttaatgattgaagggaactcgcagtctaggaagttatacgggaaaaagtctgggaagtgctggattccagagggggaaataactgtgccctgagacgcaaaggagcgaggaacggggccagggggccagttactatataaagagcaaggacggaaaaagggtcttgtgtttcacacaagaataagcagttgtgcggcatattaaaagactccggggagaaacaagtacgcatagtagccggcaaccacggaaccctctgtgtgtaaaaaagggcgactgagaggcataagcgacataagcagggagagatgaggttacat

SEQ ID NO: 579688 - DNA, 708 bp, Homo sapiens
  misc_feature (31)..(31): n is a, c, g, or t
  misc_feature (417)..(417): n is a, c, g, or t
atctgacctctccagaaaggttgaaacagantgggaaatattttacacagaggaactggtcgcatctgacagaagccctgtcgctctatgagaacacctggggccgctgtattgtcctctggaattttccaaggagatcgctctgtgtcccctcaaacttggaattgtgggtattttaccccgtttggaagaaagcttaacccctgagatccgtagcccctatcaccactgtgctgccaatagccctcctgacctccaactatgctgtacactgacaactccaaatgagtcagggccattgattgtgaattccctaaagttttcccttttttaataattatttttaaatttataaaaagcccaatgggaaatgtatattttgatgagcttagggtgtttttttttgaaagtcaacgnctgaaggatggttagacacgcaccacgcgaagacctgctaaatgcacctgacccccccccttagaatgtgatttttgttcccttttatttctctgtgggcttttgtttttgtttttgttttggtagatcttccatttggatatttggaggagtgaacatcgcttgttttgctggagggaagatcttgatggtgtttctttcccccaaaattgacttagatattaaaatttggtgcttataagagagagttaaaaaaaaataggattgcttccattaaattaccaaagagta

SEQ ID NO: 579689 - DNA, 327 bp, Homo sapiens
cgagttatcaggcgaagccaccagacaatgatcggttttaatcacatcacgaacaatcaaattcgaatcttcattcggttcaaaattggttcgaatcgcaaggtcgatgtcatcatgcaagatatctactcgacggatcgttagctcaagagatatttcaactttagggtaggtttttaaaaactgatttaaaatttttctaatttgaaaatgcatcattaaaggtgggcagcttacttttaccaaaccttgtggctcacttttttgctttaataacacgttctctgcacattcaacttgagcaatgattttgcagcattcctcgtt

SEQ ID NO: 579690 - DNA, 600 bp, Homo sapiens
  misc_feature (18)..(18): n is a, c, g, or t
  misc_feature (25)..(25): n is a, c, g, or t
  misc_feature (28)..(28): n is a, c, g, or t
  misc_feature (31)..(31): n is a, c, g, or t
  misc_feature (34)..(34): n is a, c, g, or t
  misc_feature (36)..(36): n is a, c, g, or t
  misc_feature (38)..(38): n is a, c, g, or t
  misc_feature (41)..(41): n is a, c, g, or t
  misc_feature (46)..(46): n is a, c, g, or t
  misc_feature (61)..(61): n is a, c, g, or t
  misc_feature (63)..(63): n is a, c, g, or t
  misc_feature (66)..(66): n is a, c, g, or t
  misc_feature (69)..(69): n is a, c, g, or t
  misc_feature (84)..(84): n is a, c, g, or t
  misc_feature (87)..(87): n is a, c, g, or t
  misc_feature (92)..(92): n is a, c, g, or t
gaaccagttggtgaagtngagaagntcntgntcntngnggntgagngggtcgtaagagccntngtngangagtaggatgagacnggngagcnggcatggagttcaagtcgttggagtagttgggggagatggtgggcgacaggacgcctgcctggaaggcggcgctcaccgcgtcatgctcgtccagcagctgctgcagcgcgcggatgtactcgaccgccgagcgcagtgtctccaccttactcatcttcttgttggccgcgccgttggggacgtgctcccgaagggtggcaaagcccaggttgaccaacttgacgcggttgcgctcgcgctcgttgcggcgcgccacggcggccggctgctgctgcggcagctgtagccaaagccgctgaagttgagccggcgtttgcagcgcatcagttcgggcgaagacgagctgctgttcgctttgatctctgctatgtggctgctgtacattagtgccactgcctccactgatgggtctgagccagtctggcctgccggttctcatgctgcgagcgtcctgctgcctgcttgctggctgcttgcgtgctgcttgctaacaacatgcgtcgctgt

SEQ ID NO: 579691 - DNA, 560 bp, Homo sapiens
  misc_feature (18)..(18): n is a, c, g, or t
  misc_feature (25)..(25): n is a, c, g, or t
  misc_feature (28)..(28): n is a, c, g, or t
  misc_feature (31)..(31): n is a, c, g, or t
  misc_feature (34)..(34): n is a, c, g, or t
  misc_feature (36)..(36): n is a, c, g, or t
  misc_feature (38)..(38): n is a, c, g, or t
  misc_feature (41)..(41): n is a, c, g, or t
  misc_feature (46)..(46): n is a, c, g, or t
  misc_feature (61)..(61): n is a, c, g, or t
  misc_feature (63)..(63): n is a, c, g, or t
  misc_feature (66)..(66): n is a, c, g, or t
  misc_feature (69)..(69): n is a, c, g, or t
  misc_feature (84)..(84): n is a, c, g, or t
  misc_feature (87)..(87): n is a, c, g, or t
  misc_feature (92)..(92): n is a, c, g, or t
gaaccagttggtgaagtngagaagntcntgntcntngnggntgagngggtcgtaagagccntngtngangagtaggatgagacnggngagcnggcatggagttcaagtcgttggagtagttgggggagatggtgggcgacaggacgcctgcctggaaggcggcgctcaccgcgtcatgctcgtccagcagctgctgcagcgcgcggatgtactcgaccgccgagcgcagtgtctccaccttactcatcttcttgttggccgcgccgttggggacgtgctcccgaagggtggcaaagcccaggttgaccaacttgacgcggttgcgctcgcgctcgttgcggcgcgccacggcggccggctgctgctgcggcagctgtagccaaagccgctgaagttgagccggcgtttgcagcgcatcagttcgggcgaagacgagtgccatcgatagagcagtttgggctggtgaccttgtagagcgtccagtgaagattggccgtcgccctgcgttttcagctatggcgccttgtgatcgtgccgctgaataaagtggtgctgcgcac

SEQ ID NO: 579692 - DNA, 499 bp, Homo sapiens
  misc_feature (456)..(456): n is a, c, g, or t
  misc_feature (465)..(465): n is a, c, g, or t
  misc_feature (491)..(492): n is a, c, g, or t
tgggaatgtggcacaggacctgctgaaggggctcacgctcatgtcgtccacagtgtcagcgcgcgatgtactcgaccccgagcgcagtgtctccaccttactcatcttcttgttggccgcgccgttggggacgtgctcccgaagggtggcaaagcccaggttgaccaacttgacgcggttgcgctcgcgctcgttgcggcgcgccacggcggccggctgctgctgcggcagctgtagccaaagccgctgaagttgagccggcgtttgcagcgcatcagttcgggcgaagacgagcgctgaagttgagccggcgtttgcagcgcatcagttcgggcgaagacgagcgcgtgtcgcttgacttgcttgggcgctgacttgtgaccgccccctgagggctgcgtcggccgccggtctcagctgcggcgcctgctgctgctgctgctgctgctgctgctnctgctgcgngccatctgcgctcgtctgcggcggcnncggccgc

SEQ ID NO: 579693 - DNA, 501 bp, Homo sapiens
  misc_feature (5)..(5): n is a, c, g, or t
  misc_feature (61)..(61): n is a, c, g, or t
  misc_feature (101)..(101): n is a, c, g, or t
  misc_feature (104)..(104): n is a, c, g, or t
  misc_feature (107)..(107): n is a, c, g, or t
gccanggaaccgacaaaccgaaaggaagaatttttttaacaacaccccaaacgggcaacgngcaagcccttttaataaccaaaaaccgcccgaccccaccnggnggngcaaacactcctgaacaaatcaagaaaaattcaaaccagtctgaccaaacatgggagaatgaagaatgagtagccccattgaagatctggaaaaaaaaatcgcggacctcatgacacaagcttggctcgaagaaccgcaaaatgaaaacaaaataccccccacgcaaaagaagtgaaggttgctaaaaaataaaccggaaactcccaattttccaagccaaaaaaaaaaccaatgcgctttttcaacaaacaactatgtgaagacaggttctacaatataaaagaaagcatccttatcacccaacaaaaaagtaagcttgcaaaagcgaattccccccaatttctttaacaagtaatcctcaaaacttggcaccctggaaacgtggcccaactc

SEQ ID NO: 579694 - DNA, 941 bp, Homo sapiens
gttccgctgtagagctcagcttccgggctggcgctcttcgttgcccagtgtccgctctgtggtcgcgtctccgacccccagccaccagtacccgctgcattctcggacgggctctaggtcgccatgggctctcccgtcgagggatggcaacgccgtaagtgctgatcgcctggggatgtgtctgccgcttggccgaccaagcagtaacgagaccgctggcgtacatcgtgcttccgcggagggaagtggagtgagtgcaggcactcgtctccgttgtcagagcattgcatcgttagctgacgtcggtcgtatgggcgcaacgctcggcggatcctgagccaagagcgcgtgcgccatgtgaggctcgcctagcagtcttcgcacgttatgaggtgaaatcctgacgagagcccccaggaggaggggccaaggcattcagaagcgtgacagcatgctgccgcccggaatcggccacgcagtgcgggagtctctggactgggtaattaatgaaggggctccgcatcgccaaaactccacgatttccctgtagtcttcaaacgaagggtaggttggacatgaagttcgcaatgtaaaagtgaccattgcttcagtgaggggagaagatttcaggcggctaagtagagggcctcgtcaatggcttcggaagcgtgtcggtgttacccccttgcgattgaatcgttcgggccagcattgtacactgcattggacaccagttggtcgaagagcatttcgaggtcccaattgaatctcttgaaaggcccaatgcgtattacattaccccctagctcagaaaggttgcacctgcgttccacgtttatgtgatggcaaacacttcttagtaaagggcctttgtaaacacgtttacttgcaatttgagttaacactaacacacagacaacagaagacaaacataacaaatg

SEQ ID NO: 579695 - DNA, 194 bp, Homo sapiens
cagggcaaggagttgaagtaggagtccagaggcagaggcccgcagaaccagaccaaggtaacagagaatagatgagggaaggagccacatgagaagccgtacccatttgagtcaagcagcatatttgtgaatttgttgcaactgtagtctcatatagctacccacgtgtatttatgttatgtgcagacaagaag

SEQ ID NO: 579696 - DNA, 121 bp, Homo sapiens
ttctcgaaagagtacggggtcgaggacagagcgtgaatgttacagagtcgtgtgtggtcaacgcagaacttccaacgattcaatgggatcacgatcggctcacgagtgggagacaatgaga

SEQ ID NO: 579697 - DNA, 136 bp, Homo sapiens
cgctggagctactggaggccatgtcaggtcccgcttgggatggcttatcagcccttctgttacttcaaggggctttggagcacaccatattcaccatcaccatcaccatcatacacaccacacacccaccaccacc

SEQ ID NO: 579698 - DNA, 309 bp, Homo sapiens
  misc_feature (49)..(49): n is a, c, g, or t
  misc_feature (78)..(78): n is a, c, g, or t
  misc_feature (80)..(80): n is a, c, g, or t
  misc_feature (173)..(173): n is a, c, g, or t
  misc_feature (223)..(223): n is a, c, g, or t
  misc_feature (236)..(236): n is a, c, g, or t
  misc_feature (266)..(266): n is a, c, g, or t
  misc_feature (295)..(295): n is a, c, g, or t
ggtctcattcgggtgtttttggaagagagtcgtgtgggcccaggtatcntagcgacgacacgagagagacgggcggtntnacagccttccactacctgcacgagtgtattggtaacgttggggtctgtctgctatcagctatgccgctgcccattacgctgcagacccgcttngccaagagaggcatcctcaaacatctggagcctggaaccagaggaggagntcattgccgaggnctatgacgatgatcctgtagactacgaggncaccaggttgggagggcctaccaccaaanctggtacaaggtgt

SEQ ID NO: 579699 - DNA, 900 bp, Homo sapiens
  misc_feature (445)..(445): n is a, c, g, or t
  misc_feature (762)..(762): n is a, c, g, or t
tccggggggtggcttggaccttttttggaaaaaaaaaaaaaataattttttcaaaaaaccccccggggggggggggaggcccccccggggggggcccggggggggcctccccgggtcaagggtttaattggggggggaaggccctcaactcgaatatttggccagccttttcgcggcccccaaaagccgggcgcccggcgaacctcgaagagggtacacgggggaagtggtgtaaactcctcgttggagacggggcgtgtggcatacctgggggactgtgggggggcccctccaggcgtctcgaggtggtgcccctcgagcggggaacgagggagagcgcagcacaacactggcggtgtgggcgctcaccaaacgcgggggggggaaaggcggtgcttatttctcgcggggtgtgaaagagccccacgcgcggaagatagttgtnaacccgagtggtcacgcgttacgcgggcgagccatctcctgcgagtgtctgtgcccgcggagtgatattctccacacccaagcgcccacaatcctcgtggggtctctgatgaacaccgcggcgacgagacctcgtcacacgcgggcgaggcgcgaaagacgcgttggtctggcgcacaatcacgcggaggggagaacacagcgggcgccccacaagcgggtggtctcacggagagtggtgtggtgccgcggagatatttctcctcgggaaagacaaccccgcggtgtgggatgagagaaatgtgctggaccgcgcgnatgagaaagaccgcccgcgcgagtctgatgtatgagagcgcgaggagccggcgggacccaaccgtgggtgggggggccctacctcaaaaagggcacggcagagggggcacccagggggggccacagagttaagccggg

SEQ ID NO: 579700 - DNA, 681 bp, Homo sapiens
tagtaaagacagtggtttcaccggtgttagccatggatggtctcgtcctgacttgtgtgaccctgccctgcctcggcctcccaaagggctgggattactgtgcgtgagccaccacacctgggccccggcacgttatctttttaaggaagtgacaccagtctccgtggcttctgaccaaagaaaaaagtgtccacaggagacatttgaagaggcagacaggagggtgggtggcagcaacactgcagctgcttctggatgcagcgtggggtgcctcctccggagcggggtgtgaacagcgcacttcaacagtgagcaggcgccgtggcctccgggtggtgtccctcactctcaggtgggtgccccgtggatgggtggaagccagacctttgggggcaggaaaccagctcagaagaaggctacccagcctcagcttgctgggcaaggaggccaggttatttacatgccataatggtgtggtacaatgaaaacaacactgttctgcaagaaaactctcctacccgcatcgggagactgggggctccttgcttgggagatgagcttacactcaacgtgggagatggcggtggactaggtccctgaaaagctgggccttgcagggccaagtgaggtcctcaggtcctaacccagtggccctctgaaagggggtgtgacagcaaaggg

SEQ ID NO: 579701 - DNA, 198 bp, Homo sapiens
ccggtatgtgcctgacatggttaatttataacaccccgatttcctcttggggtcccctcaatgcagacggtggctcaaggtggtgttacattataataaaatggaagacaatggcagggcacatccctgtgaggcacctgccagactggacgctgtgcctcctccaagtccactcccaaagtctcctgggtaccgagc

SEQ ID NO: 579702 - DNA, 111 bp, Homo sapiens
gataccacttcgagctcggcaccccccatgatatatattgtctttagccctccagaggctggctaagttgataccacggcccaaaacccataccataaattatatagttag

SEQ ID NO: 579703 - DNA, 1271 bp, Homo sapiens
  misc_feature (323)..(323): n is a, c, g, or t
  misc_feature (440)..(440): n is a, c, g, or t
ggcatcttggtggataaggctcaggatgagaatcccatgcatatgtaccgtagtcccggaccccagacacggacctgtccttcctgggctcctggagtccatggatagcaccatgagaggcacctagttactatggtcgctatctacaagcaagctagctacgcgaagtagctaggagttacctgttaggttgcaaggagagacactacatcaacaagattgattccacatacattgaacctgcatgacaaggaattatcttgccatggccctaggaggtagcgtgactcggacctcaccacatgtcactcacccgtcctggnttccatgcggggagcgacagttgtacgtggcacggacctgttgggaatcgagaagataacaggacgcaatcgtctggtggactgctaatcccagcagtgtcgtgcgcaacgctattntgatgctgtcgtgcaattccctgagtcagccatgtcgtagttcgcgggagccgtggctgcaaagttgccccatacggcctcatggtcggccctgccatcagaaggcaatccaccgtcgagattgaccagcattgggtcgcgtaccagttgacttgcgcccgccgacatgactcggacctaaggctatggcaatcaattgactggctcagccatcagaacccaggaatggtcctagatgtgtatgtacaggcggggacattcgggggaggcgattgtggaccagtccaatgaaagccatgcgtaggttgctgcgagaaggcttgttgagaagcgtcccctgtttcactgcgatttttctgagagctctaaccaaaagccaaggatctgggcaatctggattgccgcccaccccctgaagggtccagattctcttcaaattgcttatattgcgcccgccaaccttggggacctagctggggggaagaggaacccattggtttcgggccccacaacaaggtggccgcgcttgtggaccaaaccaatttctaatcaaacgataaacaaggactttggctagtatccatccccgggggaatcggtgcgggacatcccagaaggtttctggtaaccacagaagagttaatgcgttggaggtaggaaagcggggccccccccggacaattggtgttccacgggggacatgggttggttcacccggccctggggcccaaaggggaggcacaatgggcaccctttgccaattcaattcgtttccagttaggaaccgaagggatttggattgcccgatctggccccacccaagggaagaat

SEQ ID NO: 579704 - DNA, 112 bp, Homo sapiens
cacattgtccgagagcaattagaaataactaaatttacttccctttttctgtcaccttatgtcctctaccattttctcctttctccacttcctaatttctctcggaccaatg

SEQ ID NO: 579705 - DNA, 187 bp, Homo sapiens
aattagtctttatgacagtactatattattctgattttaaagatagaaaaaacaaacacacacaagtaaactgtacagatgaactggtggcacaatcatgcggggcagcagccagagtcaaacgctcagcagctagtgttggaacacgtcagtgacgtgattaaaccttgggcaaggtaacattgac

SEQ ID NO: 579706 - DNA, 379 bp, Homo sapiens
cgaccgatctcagcgggtgtgactgggatgcactgagagtccctggggtggtcaggagatgacagaatcctggggagcagtggcatggaggggttgaagttgacacccaccacagactggctgagtaggaactgccagggtagtcagaggcaaaacccggaccaggcaggggaggcccagatgggacgagggtgggttaggagccatcgactcaaccctgaagagcgtctgagctcactggagactaagaggggccccagggtcagaagcaggattgggaggctaggaggtatagacaggaatgaggatctggctgagaaggggaagagggagagaggctgtgggggagaagtggggtcaggggagcccgtgtttcctt

SEQ ID NO: 579707 - DNA, 384 bp, Homo sapiens
aggacagcgccagagtgctacaagggtagaagaataacccagtgaaggccaggaatggtggctcacgcctgcaatcccagacacttggggaggccgaggcaggtagatcaccgtgaggtcaggagttcgagagcagccgaccaatatgatgaaaccctgtctctactaaaaatacaaaaattggccgggcgcagtggctcacacctgtaatctcagcactttgggaggccgaggtgggcggatcatgaggtcaagagatcaagaccatcctggccaacatgcgtgaaaccctgtctctacaaaaaaaatacaacaattagctgggcgtggcagcacgcgcctgtagtcccagctactccggaggctgaggcaggagaatcactt

SEQ ID NO: 579708 - DNA, 940 bp, Homo sapiens
cgcatccgacggctgggaggccctaaggcccgaatcctcccggagagtctcacctcagttttcgcggacgagacgggcccttgtggagttcgagtcgagcccggaagaaccgagggagcccgggtctcctctgaatgtgtgcatgcgtgcgtgcgcttggggtcccccgaaaaggccgccgaaggacaagcccaggatcaccccgtactgcagcagggtgcaggcttggagtcaccccaaggcagccagagccaggcgcagtcggtcccccccagggtcagcaagacctacacctggagtcgcgctcaaagagcagccaggagtacagtcctgaagtccccacgatgtcagccgaagccaaagtgaggaggcaccaaaggtgttctcaggaccagggagtacttgcctcggaagtttgggcccagatataagggaggagctgaaccccgggggcccccccagcgatcaaggtacctgccggtcgcaggatcaccaagagttctataccccggtcagccaagctcccgggtccgggacccctctcagcactaactggaaggctgacacccagggccagctgtgctcccccccggggctcagtattgggccgagttaagccacctccagcctggccgcagaactgtgaacaggcggcttcgggggccaaacgacagacgaaaaggttagaacagtccgaggccccaggctgtacaagaacgttgacttaagggagggaggctccctggtacatccccgagaggggaaatgccccaattcgggcgcctcgtggttgcaaggggccgccccaagaaaaaagatttctcgcggaatgctagaagggaaagcccctgtggcaaattgggggagcgtgaagatcaagagactcgtgagaggcactggacaaggattgccctcctgggcgggaacacacggcccgcga

SEQ ID NO: 579709 - DNA, 590 bp, Homo sapiens
ctgctgaaatgaattatgtatcttttctgtctttacttctattattttcaaagatctaaagctttcacttgaaaattagtcttttggaaaaaaagacattgaaactagtgttaaattatatttcattgaggtaatgaatatgaagattcatttgctgtaatctccttgggatcttctaaagtagtttcttgtgcttttaaaaataacactataatggtctatatgtgtatcagtttttacagtaatttgtttaaactttagcttataccagtgtgcatgaagaaccaagtgcagtctgaattagcccaatgcaaatagaaagccggccttttattttcctcccaaattaatattctaatataacccttatgtaaaataaagaatttttaagtgcttgtaaattaataacaaaatcatacataatgtcagtggaagagaaaagttaagggttttatatcgcagtaaaatgcatttttaaattgacgtagtattgttataaaacatattcttgaatatggtatcagagtttatcaaaactactgaagtcccactaaagatggatctataaaggtgttcattttataaaaaaa

SEQ ID NO: 579710 - DNA, 850 bp, Homo sapiens
  misc_feature (136)..(136): n is a, c, g, or t
  misc_feature (140)..(140): n is a, c, g, or t
  misc_feature (157)..(157): n is a, c, g, or t
  misc_feature (164)..(164): n is a, c, g, or t
  misc_feature (167)..(167): n is a, c, g, or t
  misc_feature (171)..(171): n is a, c, g, or t
aatgtaactgctgtgggaagagttgctatatgtgtgtttaggaaataacaagaaaaaaaaaaagcacaaccacccatgtttggttttttcaaatatttaacatccttgcttggttgaatccacggatgcggaaccnatanatcctgagggccgactntaccccnttntganaacatcccccacagatggctgccctgggtgccctctgttagctcagcccgactaccaggtggacctcaggttgagggctgggaccaggagacatgggcttctttcttgggaaggggcatgttgggcagtcctcgacgtggcccagacagggccctttcccagcggggtctcagccaggttcccctttcaccaaggctgggctgggtggagtctggatagttagaccccagcacctgtgagtcacgcagacccagaagcaggaagcagacagtaagtgacagccgctaagacgcagggaggctgggccagggctggggcacgagggtaccttcacctgggcgtcagaagcacttgagaggacaggggctgctggctctgatgtctgccccctaggctggcatgaactgccagagacgtcagacgtggtacatgccggcctctgtggcctggaggggcttgcaacaaggaggcagcgccctgtccccaagctggtctagcctattgtccaggactggcggaccggtgccgcacccccggggcaggggtggggcccgtccctccccagcacactttggagtcgtgcagcggggtgccctactccttgtgccttcttccatttgcgggcggtcccacccttttgctgccgaggtccccctggccctgtgtccccggccgttgc

SEQ ID NO: 579711 - DNA, 171 bp, Homo sapiens
  misc_feature (50)..(50): n is a, c, g, or t
ccgctaaaagtacacagcatcgtatggcttgcatgaaaagcctggccaanagcggcgaccaggagacgacttcaaggagtactcggtgttcctgaccatgctgtgcatggcctacaacgacttctttctagaggacaacaagtgaccagggctgccctccaccctcaccct

SEQ ID NO: 579712 - DNA, 673 bp, Homo sapiens
  misc_feature (136)..(136): n is a, c, g, or t
  misc_feature (140)..(140): n is a, c, g, or t
  misc_feature (157)..(157): n is a, c, g, or t
  misc_feature (164)..(164): n is a, c, g, or t
  misc_feature (167)..(167): n is a, c, g, or t
  misc_feature (171)..(171): n is a, c, g, or t
aatgtaactgctgtgggaagagttgctatatgtgtgtttaggaaataacaagaaaaaaaaaaagcacaaccacccatgtttggttttttcaaatatttaacatccttgcttggttgaatccacggatgcggaaccnatanatcctgagggccgactntaccccnttntganaacatcccccacagatggctgggctgggtggagtctggatagttagaccccagcacctgtgagtcacgcagacccagaagcaggaagcagacagtaagtgacagccgctaagacgcagggaggctgggccagggctggggcacgagggtaccttcacctgggcgtcagaagcacttgagaggacaggggctgctggctctgatgtctgccccctaggctggcatgaactgccagagacgtcagacgtggtacatgccggcctctgtggcctggaggggcttgcaacaaggaggcagcgccctgtccccaagctggtctagcctattgtccaggactggcggaccggtgccgcacccccggggcaggggtggggcccgtccctccccagcacactttggagtcgtgcagcggggtgccctactccttgtgccttcttccatttgcgggcggtcccacccttttgctgccgaggtccccctggccctgtgtccccggccgttgc

SEQ ID NO: 579713 - DNA, 284 bp, Homo sapiens
agaagaaggaaggcttcgaacgtttacatatgtcttccttggaattctaacaagggccacagaatctaaaggctctctcttcattccttccttccttcctttttttcttttttctttctttcttttctcatcccctctctccttccgtcccgttcttccgtcccgtccgttctgcctgtccgttccttgcctttctttcttgcgtctttctgttctgttctttttgcgttgtctttctcgtctctctccgtgctttccccgtcctacgcttccgttctttctcg

SEQ ID NO: 579714 - DNA, 337 bp, Homo sapiens
  misc_feature (20)..(20): n is a, c, g, or t
  misc_feature (49)..(49): n is a, c, g, or t
  misc_feature (78)..(78): n is a, c, g, or t
  misc_feature (303)..(303): n is a, c, g, or t
gctgctgctcaggaaaaaanattcctttcaaaatagttttgttctatgncaatgcacctggtcgtccaagggttctgntggagatgtacaaggagattaatgttttcatgcctgctaacataatatccatactgaaactctttattatttaaggaatacattttataaggctatagctgccatagatagtgattcttctgatgaaccggggacaagtaaattaaaaacctttagaaaaccttctccatcaggatttgttggcttttgaaatctgggtcaagtaaattaaaaaccttctagatngccattgggaacatttgtggtttcatgggaagag

SEQ ID NO: 579715 - DNA, 334 bp, Homo sapiens
ttagagatcccccaggagacaactttaatgcaccctctagctgggttttccttcagccctctgaacatactgaggatagccattttaaagctttttcctgtaaaccccaacatccggacctctccaggcaatttcggtggcctgctttcttcctgtgtatggcccagggttcctggcatgtctaatcatcttttgttaagaatcagacaccgcaggtgatacattgtagcaccaggggaaagcagttttcctttctctgggatccttgctgctgtcagctggttaataactcaggtacggagctggactatcttactgagcctgttctcctggg

SEQ ID NO: 579716 - DNA, 161 bp, Homo sapiens
tcatcgagctcggaccggccccgcggcatgggtaagcatgaatagtacatataaactgtattagaagattttgtcaaggtgtgtggcacatggtatgtgctcgggtcatagtagccttcgtgtcgtaggtaacggcctcgtggatagctaaattatctgct

SEQ ID NO: 579717 - DNA, 480 bp, Homo sapiens
actcgtcggacgtggtgatcacctggcgtataatttaattttacatagctggtaatatatactctcaagtaatgagaattctaattatagccatctgaaacataaagatattttaccgtcgtatctgcttcatatggtaaagatctttgtttcactgattgtgttcgtactatttatcaaggacatgtttcttttttttgtcagaaattttttaaaaattttattcgattttactttaagttctgggatacatgtgcggaatgtgcaggttggttacataggtatacatgtgccatagtgatttgctgcacctatcaacccgtcatctaggtttttcctgcttacttgcttttgagacagagtctcgcactgtcacccaggctggagtgcagtggcatgatctcggctcactgcaatctccacctcccgggttcaaacgattctcctgcctcagcctcctgattacgctgaatggaattg

SEQ ID NO: 579718 - DNA, 330 bp, Homo sapiens
  misc_feature (65)..(65): n is a, c, g, or t
tctgatggagaagatctttagaccatgttataaaaaactgctacagaaaatgaactctaggccanggcgtgtgacccacacctgtaatcccaacaccttgggaggctgaggagggaggatcgcttcagaccagcctgggcagcatagcaagaccccatctctacaaaaataaaaaatagttggatatgatagcaggctcctgtagtcccagatacttgggaggctgaggcagggtgattgcctgagtccaggagttggaggctgtggtgaactatgattagccattgccccccaacctgggtgacagtgagatcctgccgcacctctcaa

SEQ ID NO: 579719 - DNA, 631 bp, Homo sapiens
ctagcatcgagctatctataaacctagccaagtacatacagttaactgagctcgccaggcagataggccaaccctctacgagcagggaagacgtaatctagttgtactatgatgcgcagctacctatgccatgagaagactctgtatgatcgaggcagtcatgctactgataggaccaatacgcatgggcagacgcctaaacatttgcacaattgaccgccaccgacttatgcaccctaatagaagtgcccagctagcagtatgaatcatcagccgtccatgtacagttagcatttcacaaggctaaacctactgactattctagaaatatggtgtgccttaagacaagcctacactttaagacttctagtgatcgtgctacctgcgcgacgcgcataaagaaaaagaagagaaagtggagggggaccccggtacccaagcgacctatagtgagatgaataacaataaactgggcaggggttacgacgacgagactgagataaccgtggagttcctcacttaaacgagttgaaaaaaaacacctttgtgagctgagatacagcgaaaagtgccgtgcggacgcggttacatttgagcctgctgatggctggagggtcgtggcgttttttgt

SEQ ID NO: 579720 - DNA, 194 bp, Homo sapiens
tgagccggtccgttactgggcgtatgtaggagttgaagattagtccgcgcgtatcgtggtgtactcgtacgttccgtaccattggtggccattttgatttgatggtctgggagggatcgtttgacctcgtcctgttatcgtccggatgcgtagggattgcgcgggcgatgaaggactaggatgtatggcgggca

SEQ ID NO: 579721 - DNA, 385 bp, Homo sapiens
gcgatgctgatcatcgtcgagacgcttgtatatcgtctacgacaccagagatgaatcacgtaacgtctagctccgaaatgttctggatctctgtacactctctcttccggtgcaatcagaagaaacaaagaatttcctccctgccactttgggaattgtatagcgtctcatgtatattataggttcacagactgaaaagcaactcaagattgcctcagtcaggttcccttctatgttccacagagcaccaaggaaattctgggcacttgatagtgtccctgagagtaaaacatcagtattcaccaaattaccctctttgctgccaaagaacgatggggctttgataattttctccttttaaagccaaaaagataaggcatgactt

SEQ ID NO: 579722 - DNA, 131 bp, Homo sapiens
tgataggctgggggacagcacaggccaggcagaaacgaggacacagagaaatcaccgaggggtgagtacgctatgtcttccctagaatcaagttttgttctggactggctcgtgcctgagtggctagactg

SEQ ID NO: 579723 - DNA, 350 bp, Homo sapiens
cccgcagctaacaggcatgacatgaaggtaaagaagggagcagcatatgaagcaggcagataagctaggaagcttttctcagcaaatctagatatgaagtgcaggttgattgaatgaaccagtgggacatagtaagggcagcagcagcatggacgtatctcaggaaggacaaagacagagaggtggttacagagtctagggaaacacaccattcttcctggccttctctgatgctccccacgaggctcatttcagtaacaaagctcagagaaacaaccaacgaaagatctttgagacttccatgggcaaagatcaataaggtacaaatgcaaggcaatgttggcgtccat

SEQ ID NO: 579724 - DNA, 966 bp, Homo sapiens
cggaagacttggatcgggcctatgttcccatcgcacaatgtgaaagatgtgtacgtggttaaccagatcagattcgctgttgatttgtgactaatgttccatgaagaacgagtcgaaagtgcatctcgagcgaaaccgttactcaagagatctccacctattagagtctgatagtcactgattcatgagtcctagctcagttacctcagaattatatctaccatctacagctacatagtgggaggtcttcgggggcatacatactaggcctgttaggttgtccaccaatttcatgactgtgaagtcacacgatatgttgctcaagtgggacacctatacagtgcttgaagccatacactgttgaacagtctgtcaagacaccaggatcttttgtccagccatcactggtcacacatggcacccaggagcttcttaggagcgcgatcccggttctttgaagagtcctgctggatgacaaaccgcctggggctgttgtaggatacctgattgaagaactggtcagagttaacctattatggagcgactttcaagccaccatatacagtggtagtagggcactcgttacgcaggttaacatcatccagatgacagagtcctgatgccggtgccatggtctgaaaggctccctaaatagagtttgtcgtggaacctggccaaggggaagcatttcccaacgggaggggtcctgtaggcaatcgacttgcttgaaccccgaccttgcggagattgaccccagaacacgagtcttgcaggccctgtgtgatgttggctgagaaagtgtctgcgggactgcgagtactgaaaacttacatggggtctaggggccgtcttgtgtgaaacccccctggggaggaaaatacatcttggtatcacagaggacccaaattttgtcactaaaaaaccaaactacgcttaggtggcacaggccgcttccaagatgggcaa

SEQ ID NO: 579725 - DNA, 460 bp, Homo sapiens
  misc_feature (416)..(416): n is a, c, g, or t
gttcctgcccaacaagctctgccagaccatttaccctattaaaggatactcgatagtaaatgtaacctgtcgcactaacatttgctcctcttgggaacgatgtattatcatgaccatgcacaatctatgacgtactacatccctgtaccttatgcataaggactctactggtattaactcatcttggcaagtcaaagctaatacccccgaaaccagtctagctacctaagaacagcttatggagcacactgcgctatgtcacgaactcatgtgaagatttataggtagtggctacaaacctaccgtgcatggttatagcgtgatagacaagatagcatcttagctcaaactttgtgtgcacaattccctctatatcccctttgagatttaactggtaggccatagaggcacaggtntctagacactatgcatagaccttagtttgagagtaatacattcc

SEQ ID NO: 579726 - DNA, 1006 bp, Homo sapiens
ccatttaaatgagatgctgtatgtaagccagggtcagcaaagttcagcctgtgacctggtgtgtgtgtgtgtgtgtgtgtgtgtgtgtgtgtgtgtgtgtgtgtgtgtgtgcgtgtccctgagtaaagagtgcgttgggcatgtaggtaagccgataaaaaagaaaaaaaggatgccagatgaaaaagtgtgtcgcacggaccaggccaagaacgagtagcgcctggtacacgaagaagggggggcgtgccccgggagatcgtgtcgacgtcgtcggggtaacaagaaggtgggctttctcgaaaaaaggtgtggcgtctgacacccggggggggaggagcaggggaagtgaccctcagggtcgaggggaacgccctccaccgtccgggggaacagagacatagttgcgtgggctacaggcactcgctgaagattagcgcgtgggaaataagcggggtgtgcaccaaccagcagaacagcggtagtgggtacgggtgtaccccaccacacccaagaaactcgtgttgaaacccgggggagggggggcgtcgaaagaggagggcgggaatccatgggcgctgggtactacgcaagctgcggggtgaccaccgctgtgctgaaaaaataaaaaggttgacgctgtgagggcacaccaagtgggtggtctacccgagcagggagggtgtgaacatgcagcaagtcactttgagagcaagttctcggaaccgcttgtattataatcaaagcggccgggcgaagacaacgcgtgtgggcggcaacacggtgtggcatacgttcgcaaaagggggcgcccggcaccaagagaatattgcgggagagggaccaccgggggaaaccgtgtggacaacatccgggtgggggctacccaacttggggaacacaaacccgtggtggcaacccgttgggtgtgcacgagctgtcattaaggagagaagaagccccaatatgtaatcaaggcggcggggcaccaacggcgccgcgaaat

SEQ ID NO: 579727 - DNA, 436 bp, Homo sapiens
  misc_feature (97)..(97): n is a, c, g, or t
  misc_feature (198)..(198): n is a, c, g, or t
  misc_feature (328)..(328): n is a, c, g, or t
  misc_feature (353)..(353): n is a, c, g, or t
tgcaaagcttaatggctgcagaggataagtcctcgcagaaggaagacagatttgaggaagagatcaaggtcctttccgacaagctgaaggaggctgngactcgggctgagtttgcggagaggtcagtttctaaattggagaaaagcattgttgacttagaagagaaagtggctcttgccaaagaagaaaaccttagtntgcatcagatgctggatcagactttactggagttcaacaacatgtgaaaacctccttagctgcgaccacattctttcattttgttttgttttgttttgtttttaaccacctgcttgccccttaaatgcantttatttacttttgaccctgtctcngaaacatgcccaagatgcccgcttggtcagggggtggggtatacactttcctattggctagcccgtgtcagggcgatcctggt

SEQ ID NO: 579728 - DNA, 107 bp, Homo sapiens
tccggccacgttaggtgatctgtggggcattacgcccatgttcttttaagtaattccctgaggttggctcagggcaccacttctgattcgattccacagatcaccct

SEQ ID NO: 579729 - DNA, 463 bp, Homo sapiens
tctggcgaggcagtctcaaatgctggagatgcaagtggagctcttatgtatgaaagacagggcaacggaactgcgggggcagttgagttctgagaaaatggcccctgctgaactgaagagtgagcttgcacaaactaaattggaactagaaacaacactcaaggcacagcataaacacctaaaagaattggaggctttcaggttggaagttaaagataagacagatgaagtacatttgcttaatgacacattagcaagtgaacagaaaaaatcaagagagctccagtgggctttggagaaagagaaagccaagttgggacgcagtgaagaacgggataaagaagaacttgaggatctgaagttttcacttgagagtcagaaacaaaggaatcttcagctaaatctacttttggaacaacagaaacaactactgaacgaatcccagcaaaaaatagaatcacag

SEQ ID NO: 579730 - DNA, 112 bp, Homo sapiens
  misc_feature (11)..(11): n is a, c, g, or t
gctggtcctanagctcaggagtcgacactagctgggaacatggtgaaacctatatcattaaaatacgacaagttagacgggcgtagcggcagtgctgtagtcccagctactc

SEQ ID NO: 579731 - DNA, 241 bp, Homo sapiens
caggcacgcaccaccacacctggctaattaaaaacttttattatagagacagggtctcattctgtggcttaggctggaaatgcagtggtgcaatcatagctcactgtaacctcaaactcctgggctcaaaggatcctcccacttcaaccttccaagtagctgtgcaccacatccatctagttttgggttttttttgtagagatggggtcttgctatgctgcccaggctgatctggaatgcc

SEQ ID NO: 579732 - DNA, 188 bp, Homo sapiens
  misc_feature (27)..(27): n is a, c, g, or t
  misc_feature (188)..(188): n is a, c, g, or t
cccgctacacccaccaggcacacaganccaaccccgacacccatctccaccaccactacggtgaccccaaccccaacacccaccggcacacagaccccaaccatgacacccatcaccaccaccaccacggtgaccccaaccccaacacccactgcacacagctcccaaccccacaccattaccactan

SEQ ID NO: 579733 - DNA, 171 bp, Homo sapiens
  misc_feature (14)..(14): n is a, c, g, or t
gtgctgagacacgncacgagatggcactacttctgggcatgggcagtgctgtgtggcagcgcactggcgcctgaaaatcctcaaagagatgtcgcacctgagacggacggcgaggtggccgagccacgcgcgagggaaaatacgagcatgtggccctcgacctcttctccg

SEQ ID NO: 579734 - DNA, 118 bp, Homo sapiens
atgacctcacgtttccgattgccttctgcagaacctacaatgtacgagcatcagagtcggcccgagacagacagcatactgagtggttgcacatcctactctcgataagcactgtaca

SEQ ID NO: 579735 - DNA, 453 bp, Homo sapiens
actaatactgatttcagtttgctacagtttcccccacagtccagacatgcaatataggtaaattggataaataaaattggccatagtaaatgagtgtatgtgtgaatgatagagtgtgttcattctgctgtggtgatccctgttaaataagggactaaactgaagtaaaatgaatgatttcagggttttttttttgtaacttctaccagaactgttcccccatctaataacatttaaacgaaaattagtttccttcacttgtatagcaatctgaagtcagaatgcattgtgggtttgatgtgttgccaaatatttgcagttttttgcaaaacaaaacactgaaaaaaaacacaaatttgcttttacacacctacattatatccgcaacattgtactgtaagtgtcagtaacttttgtttaactatgtggaataaagctgtaattataatgata

SEQ ID NO: 579736 - DNA, 263 bp, Homo sapiens
acagatcgatggaacaaccaaatcttctggctccatcagctccccgtcgtctcttggcacctctcctgtacctcaccctggttatgtaagtcaacccaagcaatgtactatatctctagggatccactctgcccataaggatcctagtaatctatacacacataacaatatacagtcacacattctaacaaccagttactgaaaccatttactcagtggtactgcaatgattcgcacaacaatagaaaacagttcactttgac

SEQ ID NO: 579737 - DNA, 128 bp, Homo sapiens
atcccccacactactgcctgcttgataggtccgattgtgggatttcactgctgactgctggctgcctgttgaatgaaatacatatccccaggtcgctagcctggtgttgatggaactttccactttgt

SEQ ID NO: 579738 - DNA, 382 bp, Homo sapiens
tgcagcagacacagcatcataattcaggagctagttgaacgtatgcctcacttctctccactcgaggccgatatctagtgatgttgaccgggccacattcaatgtcagtagagcttcttcacagcctgtttgatctggtgcctgtaggatttaacatctactatgaacacaagtgtcttgtagtcctcgctcttcttcatggcacactctgtggtcggcggcaacttgatgataatatggtgttcaagcttgcttctcctgggggcgctcttctgaggatatttgggctgcccctggagtcgcagtgtattgggccgctggaaggtgggtgatgtgtggatcttttttcttcaccggctgtggacccctttcaacgctgtta

SEQ ID NO: 579739 - DNA, 1499 bp, Homo sapiens
  misc_feature (163)..(163): n is a, c, g, or t
  misc_feature (518)..(518): n is a, c, g, or t
  misc_feature (827)..(827): n is a, c, g, or t
tggccaaaaaaatccgatttttttttttaaaatagggggaaggaaaagggggaaaagggccccggtatgaagaaagggcctataagaagcaaagaagctaagaggtatcatcaggaaagaggcccgtccggggctatgggggaaagcgcgggaggcacggtcnactggggagtctcgccggacagcacgttagggtatattatcagaacgcggcaccggcagtgcctgaaagcgtctctcgggaaaactcttcgggtggcctcaccgaggtccccgcggtctccgaggtctctctcgcggagggtctccgacacgaggggcgccgaaagtctcacgcaggtgtggtccctataagagctgagaccgcgggtgctaccacgagactctcttggaagaaaaacacccagctgggagggccgccctgcaacctcggaacatacagtgtctgaggcgtccctatctgaggggaccgaggagcatatacaccccagagcgggagtgtgagagcgactatcacncactcccaaagagagaaggggagaccgaggccgagatattacaaccactactatcaccccaggtgaggagcctctcctacgagaacaggagtcacccgaggactgaggggagactataaaaagcgggggagaactccacttatatcctgggagggggggagacaactgagaaccagtctggtcccccacaagagggtgctaacaactgtctccactgacaagactgtagaaagaggacctccgcaacatacccggtggtgatacaccaacttccaccgcgaggagaagaagaaccccccctccctactnagaagaggaagcagaacgaacgagcagaggggtggtgggagccaccctctgcgcgagggacaagaacagttgggcgcccacctacacaaacacgaccgcacgtgaagagaggactaccacccccaggagcgtggaccgtggggggagaacaaaacggataattcatccttccccccagggagttagagagcagcaccaccaacgcgggaggaaacagcggccgactatgacacaagctagcaagccgccagatgagagaagcttttccacaacagttggtggggctcatccccctacgacggagaaagcaagggcgcgcgtcgatgggagcgggaggggaggaatacaccaccacaagacgcccctgcgatgatcaagaacacgacggatcatcacttgagaaacaagacgtgcggcccaacactcagggaggggtccacactaacgaggacggcaagtgctgtgtgcgcacccccaaaggaatagcacgcacgctacgacaaggcagcggcccctcacagcagacccctctacgagcacaaacctcggcggtacacaagcaccgaggactaccacccacaaggagagggggcggaactactacccccccacgcagaaagaagacatacaccagagcagaagagttgcgtgccgacacgaaactagacagcg

SEQ ID NO: 579740 - DNA, 846 bp, Homo sapiens
ttccgaggcctgtgcccaggcgcccctgacctcgtgggaggctctgcccttgtgcgcttggtaagggctcgtttcccgacccccgtggggaatctttggggggggccacgcggatctgtccattagggaagtccccgtgtccgtggaccttgtttaccccaatggtcatgttttgggtgttccacctccttggtttgtttgccccggggtcccccaagagtttgctcggggcccgccccccccagcactggtattgagtttctgtgtgccctcccgtgtgtctatccatgcagtgtaccccagtccgctgtatatggagtacccccgggatgtagctcttttccctctttggggcccccatttttaaagagggtgcctccgaagaggagattccacgactgtttccagatggtgatgcaattttgggcccaacgtttgctccgccatgggaacccccctggggaagggctgcccccctgtgcccagagtaccacccgaagagggagggtatctgccgattgggccccacaccccggcggctcccgtaatcggttaggaccaagaagtagctttttggacacacctctttgcccagaaggccgtggagaaccccccccgtccgtccacctagagcttgtggatgcagagtctccccggccccttgggagcctggaggaaccaaagaactggggttttttcgcaaaagggttcaggttcaaaaggccattttaccctggctggggaatttttttctggtgggggcccagggaccgaggccctgaaggacccaattttgtaattgtgacccccactttgggaattaaggattttttgcaggccccaata

SEQ ID NO: 579741 - DNA, 183 bp, Homo sapiens
ctctggttcactacgataccaccgctgatgagatctgcagcagtgtgatgggaagctggacatgctggtggcttcagtgggcacgggctggcaccatcacggtgcattgccaggaagctgaaggagaagtgtcctggatgcaggatcattggggtggatcccgaagggtccatcctcgcagag

SEQ ID NO: 579742 - DNA, 922 bp, Homo sapiens
  misc_feature (600)..(600): n is a, c, g, or t
  misc_feature (827)..(827): n is a, c, g, or t
acacgcgtgctgggcgcttacgcgtgctgggacagtgtgggctctgaacacgttgtattgcctggccgcgtctgttctttcctgtgcagggtagcgagacaggagtagggtgtggtcccgtgtagccgtgctcttttcaaggaaacgagtgctcctctccctgagaatggcatcacaagaagcatggtcaccaatacatctgtgcatgtataggtcattcgggatgtacatcccctgttagtcgtcgaggggcggtcattggcatccagcaatctacagaagaccttcatttacctcattaagataagcccgacatgcacttgaatgcacggagaagcaagtgtcctctgcttcgcacgtattgcgtctcttaatcatctacgtctcttcatagactctacctactatatgtctcttcgacctatgaaccgctataacttagctgagaatatctactaataggctatgtatatacatagaccctgtaaactctctctcattatacccgcatatctatctaacaccgctgttacgtagggagaagaagatgcacacttcatcgaagtgaccggaaacgactcgaaattcgtggagctaggntcgagtcccatacgcgatgaccagtatgactttgtatcatttaatctcttaaaaaagagctatagaagatataattgatccgcatggataagtacaccttagcatatgatcctggaagatatgagatcgatattccagtagagtagtgacagtaagagaagttgtgtcatagatcgacatacttgaggtagtcaaaatatcgaggcgttcctctatagattagatcncagctcagggtgatagatcacacttccaagtcattggttgtaacaacgttgcgggaagtggaaacgatgagatggcaccacgagtcattcaccgg

SEQ ID NO: 579743 - DNA, 357 bp, Homo sapiens
gcaggacggtgaaatatgctggccccaaaacctccaatggggcaatcttctacttaccctcaattcttcttgcaaaatgggagacgagtgaaatcataagagggagggagcctaggtacctaacagaccacataaagggatacacactagacgggagggctaacatgggtctttttctgagcaaaaaataaacttacaatcggtgtaaagccagtaatactcgggagttaatctgctacagtaagtatgggggtgtggactattacatacctgcacttgacactgaaccctttctccctatcaggactcccctccctgtggttagcctactcggtgcctgcttctgagacagcatac

SEQ ID NO: 579744 - DNA, 724 bp, Homo sapiens
agcgggaagagaacgagagggcgagcgagcgcggcgttcccgggccggcccggccccctcccttcaccatcgccggccctccggccgcttcctccgttccactcctctccccccccccaatgagcccctccggggcgggggaggcccgggaacgggacccgctacacgaattctacctaactcccatcgacctctcctctcgcccggccgagctgtgaggagaagggcccggcccggaactgcgctcgcagtgtgagcgaggaccaccgggcgggccccaccggggccgcagctgagggcctggctccgggcccgccggcgctgctgctgaccgacccgcgcgggcccacggctgcctggcccgggcccggcgacggcgccgacaccagacagcggggacggcggcccccgcgctcccgggcccccgcgcccgagtcggccgtagtacgcgaccctgcccgcgcccccgcggccccagggcccgacccagacccgagccccggccaagccacccgccccgaccaaacacacaactcggccccaagcccaccccacacaactgcaacccacccattcgcaacacagaccgcgcccttgactgcctcggcaggcctacaacaactccccttggtagcgacacgaaacccggctggcgaacgacttccgcggactccaccccttgctggaacgagccccagcccctctcaccccccgcgagcgtgca

SEQ ID NO: 579745 - DNA, 143 bp, Homo sapiens
gttatgaacagagcaagtatagagcccggtatgatttctagtaatgtgggggataaagagcttttgtgctgatagctgaaactgtcccagttaagttgtccacaaatactctgccggtgggttagattccgtgaagcaggacg

SEQ ID NO: 579746 - DNA, 391 bp, Homo sapiens
aatacacaggatcccacattctctactcagaggaaagctactcaaggaagccaaattatatataaatgtaagaaatttttcctaaaaattgtgatctcagggattaagttgtaataatgggtgttgtttacataacctgctggtatcgtcacactcctcacttaaaatgctaatgggtgaattctccccttcccattctgtgcctatgactccatcacacatttttagaaggtataagtcccttattctaatccattgagccattctcaattccctttcacaaacatgtggcatgacccatatcccatctcaccacagcctttccacactccacactgtgatataatatttataatgaaccctgttttcagtgctacagcctctcgtgccg

SEQ ID NO: 579747 - DNA, 132 bp, Homo sapiens
ttaaaagctaccgcaaaaaagcaacaacaaagtggtcccaaaacaccattctcctttcctatctgaaggtatcacgatgcattgtacatcataaaccagtcttttactcactaaactgggtcacggagctcg

SEQ ID NO: 579748 - DNA, 99 bp, Homo sapiens
atttttttttttggggggggaaaaaaagaaaggggacctttttttttggggccccgggttgggccgggggttcctttttccaagggatttttttgccca

SEQ ID NO: 579749 - DNA, 1471 bp, Homo sapiens
ggttcctcgttgccaacgctgtcttgtaaggtgcggctacgaagactggtggacatgggcagcgcctggcccagcgcatcatgcctcttcgacgttggatgggaccctcaccgccccgcggcagaaatattaccaaaggaaatgtgattgacgttcctagcaaaaattgagtgcagaagatcaaaagtcgtgagtggtcggcggatcggacgtttgagaaagatgcagtgagcaacctgggaaagtgactgtggtatgcataaagtacgaattactgtgatatccaggaaaaatggcgttgtgtacgcatacagaagatgggaaactcgttgtgtacgacagacatattcagaagtacatctggggtgaaggaccctcaatccaaagatattaatcgaaactacgtgtactgacgacttgcatttggccaaagattcaagagctcccgacaccaagaggggtaacgttcctagttgccaattcctgaacattgggcatggttcacgacggctgttccacacgtagattgcgaaaggtaaagcctgacaagaacccaggacagcaaacgcacattcggaggattcttacccgtagacatccgaactcaagtacaacggacacaaccgtcattgacggcaaccaaacaacacgctttctgctaaggcaacagaattcttcaccgcagaaaaaccgacgattgaagacatgaagcagcagacaggccccaccaaacgcttgaatgaccacgttaaggaacagcggccaaagacttccacaggacatatcgcaaatagatccactgtatccaatgcagtcggccattggagggaccaacagagcaggaataaccgtggcacactcggcagcacaccacctggcatggcaaacacaaactgcaaccgggacagaatcaaagggaacacgaacacatgcaagcagagccacctgacagaggcatgaacacgacaacacacgaaaacagacgcacagcaagcgacacaagtgacaccccatcgaagcacccactgacgacacaacacccgagaaaacacgcaagtgagacacgcaacacaacaggaggaaaaaaggccaccctaggacgggaaaccaacgcagcacaagacgaaccttgggagaacaagaggacagaccacaaaccataacaccgcgaggaccaccagagtcaagacggcccagggacacacacatcggcaagagaaagagcgcaagcgaaacagaggggaacgaacgcgacgcatgcgccaccacaaacaggataggaaaaacagagccgcaactggaggaggtacagacacacacaagacacaagacagtcattgacattgcgacctatgcaacgagatgagaagcgcaagggacgagagacaagactatggaaaggaaacaagacagacaagacgaccgacaaacaatacagataggatcagagaccactcaacctgaggcagca

SEQ ID NO: 579750 - DNA, 242 bp, Homo sapiens
tcagtaatatgccggaacggaaacagcccaaatgcatagtaacagaatgagtattaatacaattcaatactgtatacaacagatatgaatgaacgaactacaagcacgcaacaatacagatgagttgtatagacatactgttgagtcaaagaagccagacacaagagtgcatattatttcatttatttgaagttgaaaaacaggcaaaataaatctatgctattgaaacttctaaaactagg

SEQ ID NO: 579751 - DNA, 1189 bp, Homo sapiens
  misc_feature (523)..(523): n is a, c, g, or t
taaaacccacatcgggtcctttaatttcaagggaacttccccgtgtttagccccagggttgatatctaaccccgaaaaaagccccagaagaaaatttctcgtggcagaattaacccaggtaaaaaaaagcgcgccagttattcctttattgtgtgctcaacgagaaactcactctcagtggagaagggaaggcgggaaggaaaaagaggagaggagaatgtaaccagaggggctctcaacaccccttacaccacgtgcaaacacatttcagaacatttggggaatttaaacacaaacacttaaagaggaagccttctccgaggaagagggaggaggcaccaagtgtggaaactcgtggagagcagcctcgagggtgcactcagaggagacccacgaggaaaagaacacctccgagagcgtggcgagtgggaacccccgagagggagagcctcgagggcgtgcgccaccccagtgtggcgtgggaagagaactccgccaggagacgggatgtggagaatctccncagaaaatcctgtgggagagattagaacctatatcccttctgagacaaactctcttaccagagaaactctcccctgtgtgaccacagggggttgcgcaagaagatttaaaaaaaaccccaaggtctttaaaacaacactattattggggggggtggggcttatgggagactcttggagaaacacccaaaaaccagttttgggacttggatatgggccaaagcctttggcccaaaaaccactttggtgtcccctctctactctgggtaaagggaagaggaaaactcgtggacacacaaacggcgcaaggagaaatcctaaaatttggggcgcagaaaaaacgcggggaagagcgaatcctccttgggaagcggagttctgaaacaaacggtgcgacacgcgatattacacgacacgtttaccaggggggagacacaggtaaccaccatctcttattcaaaccatttttcgcgcactaatggtgcgcccagcgtgtgtccccaaatacccgatccacaaaaaaataaacctcagggacgggtgttatggcagaaaacccaatccgtgtttcccccgagagggctgtacatcaaaagtgttaatgcccttggagagagtgttcccccaggggtcggcgggaaaaatccccacactcaagagacacgaga

SEQ ID NO: 579752 - DNA, 232 bp, Homo sapiens
acacgaaacacatataacattagccccgtaacacaacagcgagccagttctttcaaggctatgcaagcctaggcattgactatctgccctccacgctatacacagttcctagatgcatcttcttctactagaaggctgttttacctacactgcaaatctgttgtttagtgtagccatcttcctcaatgatctttgctatgtctaatggatgtcttgctccagcctcttcatc

SEQ ID NO: 579753 - DNA, 643 bp, Homo sapiens
agacgacagtaatggtcacatcagaagtgacgcgactgttgggcgagctgcctgcctctgtgcgtgaccctcacaggcgtggccctgtctagagatacccctggtcaatgaaggccactggtgtgcagagccgtgtcgaggctcctacacgtgcccactctcttcagcgggccacccggtcctccctccacgtacccgttctagtcccacagagaggcacgggaatgttagctgactctggtgccttatctcgaagggaccagaagtgctgcagtgtcaaggccatgctctgtgctgtcttccggtgtctcttcgcgtgtctagtcctactcgtccgtcctcttcctctcctttaccccactttcagtgccactttcatcaggtttcgtgtctcatctccctgcgtgtcttcttcctttgtctgtctgtttctttccccgatgcagagtcatgtagattgccgctgacgagtgttcagttacagatcactctctgtgcggggagtggccctgcttgctcctcagactcctggtggccttgaagttctctgttgcatctagtccatcctgccctatggccctggtccgggctccagcttgtgcggggttctgggtacgagggtcactgtcctttggtcctggag

SEQ ID NO: 579754 - DNA, 745 bp, Homo sapiens
  misc_feature (262)..(262): n is a, c, g, or t
  misc_feature (680)..(680): n is a, c, g, or t
ccacttccacaggaggactacacgccgtcggttgtgctgcagccatgtctcgtatctgatccctgaaaagttccagtcatatttatggcagactactcacacacacaagaatcgactgggcggcgataaaatatggctatgccatgcactgccatgtataggggtgtcgggccagaatgatactgcgtcatggttggatgttgaaggcaaagcaatgagcattgcacctacacacagagcaggggcgaggatgcaacttcancgtgtaggaggagtggaggctgggtgatcggctgctggaattcaccactaatataatgccaagcaaggtcccacgtcccagatactcaccgatcacctaggatctgtgtgttccttggaaccaggacgaggataagtgatggtactaaggcgactgcgtacacagatacccaggcccccgtggtccctagtcgcatactgggtcctggaccaactaacgctcacgcaggaatgaccgtggacgtcggactgagagtaacgagttcgcgggcccaattacgatgcgcttagcgttcatcggttcgtggggggcctgttcctgttcccgaaggaccaggcaacaaacaaggatgcaactggggcgccgggggccgcaaccgttgggttgtgtccagacacctgaagataaggctctgctnaggccctggttcctgcttaataagcactaggttatatatacccaagaacacaacaacgcacaagg

SEQ ID NO: 579755 - DNA, 89 bp, Homo sapiens
  misc_feature (35)..(35): n is a, c, g, or t
gaaagccctgctggtggcgctcaaggagcggggcntgttccgcgccattgcgcacacccccatggtggtgccactctgcaaccggttca

SEQ ID NO: 579756 - DNA, 327 bp, Homo sapiens
  misc_feature (14)..(14): n is a, c, g, or t
  misc_feature (16)..(16): n is a, c, g, or t
  misc_feature (29)..(29): n is a, c, g, or t
  misc_feature (56)..(56): n is a, c, g, or t
  misc_feature (58)..(58): n is a, c, g, or t
  misc_feature (63)..(63): n is a, c, g, or t
  misc_feature (69)..(69): n is a, c, g, or t
  misc_feature (73)..(73): n is a, c, g, or t
  misc_feature (85)..(85): n is a, c, g, or t
  misc_feature (88)..(88): n is a, c, g, or t
  misc_feature (94)..(94): n is a, c, g, or t
  misc_feature (97)..(97): n is a, c, g, or t
  misc_feature (120)..(120): n is a, c, g, or t
  misc_feature (123)..(123): n is a, c, g, or t
  misc_feature (141)..(141): n is a, c, g, or t
  misc_feature (143)..(143): n is a, c, g, or t
  misc_feature (145)..(145): n is a, c, g, or t
  misc_feature (164)..(164): n is a, c, g, or t
  misc_feature (244)..(244): n is a, c, g, or t
  misc_feature (250)..(250): n is a, c, g, or t
aaggtctcactatncncccaggttgcccnccgaagtgttgggatacaagtgtgagncnccgtncctggncccntgtacttgaagncancactancgnaatgtatagatattgtataatgncancggttgttatactgtacntncnatttgtatttttatttttncttccgtcaaatattcagccgcatctagttgaatctgaagatgtggacctgctgatgaagagggctgattgtatctaacntagggncttgcatgcagctggcacttaatgcattttattgactgttttagctaacattcaatggacaattcctaataaaaact

SEQ ID NO: 579757 - DNA, 155 bp, Homo sapiens
tacgtcattctatgtgcggtgatcatctagagctcgagctgcggcagtcatgcttggaactggctatcgtcttacatctaacagttatgaccatgcactggcctatcgtcttacatctaacagctatgaccatgcactggccgtcgttttacact

SEQ ID NO: 579758 - DNA, 156 bp, Homo sapiens
atggggtctccctatgttgccctgggatgatcttgaacccctggccataagcaatcctcctgtaaacctcccaaagcactgaaattccaggtgtgaaccaccatgaaaaccaaaaaaacaaaaacacacaacacccaccacaaaaaaaaaaaacac

SEQ ID NO: 579759 - DNA, 475 bp, Homo sapiens
gcccgaggaaaaatccgaatcggaaggtgaggaaaattaaatggctcaacaagcccaatacttaggtttccccccccccctttttgattgggaatgttgaaccatttgaaaaaaaaaacttggtttttgtttttgcaaaggaaaaaaaaaataggataggcttcccttgtgcaaagggaaaaaaggttttgtttttgttttgtttttaaaaggagccctgaggcatcagctattatacttgggactttacctttcactccctatatggtaacttaaagccattcaacaaggagtcaagtagatttgaaattaaatactcaacagactcctccttttttagctgtatttttcaggtactgtgtggtgaccccccccctggtgtttattacaggcccctttggtagttgtgtatttgctcatgtatgtgatttgacaaaccagttttttaaaatacccccctttttaaaaatttgga

SEQ ID NO: 579760 - DNA, 353 bp, Homo sapiens
tctgcaggatcccccgttactggcatttagtgactagaaattctttatccttcagctgcatacacatttactacacacactgtgttatcaagtgcactgtgcttatagggttcaaggactcactataatcaagaatctttcttcagttgtctcattcagcaattttaaggcttctgtatcatattattttggatgcttagattcctgttgtctcatacatattaatgtattttctgatatacaagacactgtatcatcccatgtgagacaaccacctattattcaccactgtgaacgattatttttctgtctgcttcatcttttctcaaatgccaggcaatgccccgtgacgc

SEQ ID NO: 579761 - DNA, 199 bp, Homo sapiens
cgttgggctgagtctgtgggcctgacggccgcggttgattctgatgtacctagtactacaggcatgactgggattccgtgtaccagagtacatgacccatggtatgtacgcacgtaggcacccttggacgcacccactggggcctgggggtcggagggagtgttggtagcctcctccccacccgaagggctgaccggcg

SEQ ID NO: 579762 - DNA, 935 bp, Homo sapiens
aggtctacaagagcgctacttccccatatcatagaagagcttatcacctttcgtgatcacgccctcgataatcatgttaccttatcgtggctcccgtagtcctgatagtgcccttattcctaacagcttcacaagcaaagactaacctaagtactaacatctcagacgctcaaggacaatagaaaccggtcttgaactatcctggccacgccaatcatccctagtccctcaatcggccccttccccaatcccataacggccattcctattttaccacttaaccagaactgaaggatctacacacgcgaagtccccgttcccccgttgatcccatttcacaaactccacaatggggcccaacccaaaagtgggataacatggaagaccccgtaaacgaaaggttatcaacccgggaaacttataacgtgggccggtgactcattaacgttcttatccaagtcttacactttaccagtataccgtatacaccccccaaatacaaaatatacccatataggaaaacacccaaggggtgcgccagaaactccgtagtgggtaaacttttcaccaatttttgacaccgagctacgtgaacacacaaaaaatctcgtggaaggataacgtatacacatatcacccacgcaactttgcgacacgagactcccccacccgccaaaattgtacccgcgatacagctttaacttataaatctatatcacgacgcgtttttcacacataatatgaaaacggcagcttaaatatggggcccacagttatctctagtgtttagaacactgcccctcggagtgcctccccaccacccacaagacaaaagtttctatcaagggggcgcccgaattatataatccatcaactgtcatcaacagcggaaaagtgtgcacccgcaagctatattaacccccccctggcggagc

SEQ ID NO: 579763 - DNA, 556 bp, Homo sapiens
gtttcatgcgtctgtgcgatacctgtagcctgcagaagtgtaactactagcagtctgtctgcatgatagttcatttttattagtgtagaacattatcaaacccatagaaaaatcgagagtagagtgaatacccatatgcccctatccttggtgcaccagcgtattaacaccttgtcatttctcttctccctctttccctctcttactctttcctttctctctctctttcttctcctgtctctgctcttttgtcagaccatgtgacactgcaccaacatataacacttcactcctagacccttggggggatactagtgctccttacaaggaaggtgtacttcccacaggtagagtacccataccctttcataaaatgatcatgcattaatgccatgacatcccatcctcccagaaaagtctaggatactctgtcttccacacctgatttaattgtggcatgcattattcttagtctagaacagtcttgcccttcctctcttcttgaagacattcagtacttcgcgatgtacagatcagttgttcacagagtggtcac

SEQ ID NO: 579764 - DNA, 1096 bp, Homo sapiens
  misc_feature (705)..(705): n is a, c, g, or t
caaacggcttcagaactggacagaggagtgtgacaatctctggtggcgatgcattcactgactgagttctttgaggatgatgccatgttgaccattctactttctgcctgtgaggatggaccaaagagatataccattggtcgcggaccctgatcccacgctacttccgcagtcatctttgaggggggtgctacggaggctgtactatgttcttaagtcaccccaaggaggcattccacagcaatctttgtatccctcgactgtgaccagggcagtcatggtgacccagcgatggcaagcccatgttcacccaggtgtgtgtggacgggccggttgatacctggtagttcagtgttgtgacgacatgatgcggataaagacgtggcacttcagtcatccggcatcaccgagagctcttccctcgcgtagcatccttgccatgcgtgcccaagatccccagatgttggatcgagctctccagataaacatcgactcggatgtgggctgtccgaattccactctcaactacctccgactctgtgtgatactcgagcccatgcaagagctcatgtcacgccatcaagagcctacagcctcagcccccgcgactggctcgagacctggcttttcccgaagtggcagcgcatggtagcaccctgcggagccaacgtcagcagccagcaaaggcggaaacggacgattccnggggcagaccatgagctctggtggggcaactcaacaaaggaccagtcagaaaagagcccgtaaacatttggcccttcagcccgattttgatgtggggaaacccctgtatggcggggagaccgtgagcaacgacaaagggcgttcacccggtgggagaacacccaagttggttgacaacagcgctgtgaaagagaggagcattaaaaacccctcatgtggggcaaccctgagaagaaagcggctacgaatagaacagggcgacctaggtcccaagcgggggggaaagcgatagccaaacatcacgaggagaggaacatagatctcaccgcaggacgaacagatccgggacacctcgacgagagaacgcactgggtcacacggtaagatgagc

SEQ ID NO: 579765 - DNA, 149 bp, Homo sapiens
  misc_feature (58)..(58): n is a, c, g, or t
  misc_feature (68)..(68): n is a, c, g, or t
  misc_feature (85)..(85): n is a, c, g, or t
  misc_feature (118)..(118): n is a, c, g, or t
  misc_feature (136)..(136): n is a, c, g, or t
  misc_feature (139)..(139): n is a, c, g, or t
atttgtcgaggcagccactaactcgttgcaagtcgtggaggccgcctcaacaagttcntctcccaaanctgcttggcgaccagcntttgttaggccaccgacatgcctggttgacaantacagttggttcctgagngcnggggcgatct

SEQ ID NO: 579766 - DNA, 177 bp, Homo sapiens
  misc_feature (60)..(60): n is a, c, g, or t
  misc_feature (63)..(63): n is a, c, g, or t
  misc_feature (103)..(103): n is a, c, g, or t
  misc_feature (151)..(151): n is a, c, g, or t
tatgaattctgccggctctgaactacagggttctgtcgttcaatgccttgccccagggancanccgtgggtggggtcaggaatcatcccttgggcagccctcnacccaagggtctggctcactgcttgcacgatggggtctcttcacacanctcttgaatgtttcccgataggggct

SEQ ID NO: 579767 - DNA, 248 bp, Homo sapiens
atctgagtaacacatatacactacacatgatattcatataaaaagggtattcaatcatgtacagtaaagctaaaaaccttccgtctacgttcgaatgggaatgcaaccagagaacaaatggaaaagttttccaggtacagaagatgagcacgcagtaacgccctcttgtgggatctctacccaccctaggaacactgtggctcttcccctacacatggtgattgctaaccttgctacaagacgttgag

SEQ ID NO: 579768 - DNA, 185 bp, Homo sapiens
agtcgctgttcggtattagctaagtctcttgtagattttctggtaaaccattatgcaaaaggtagaaggggtaatctttgcttttttttgcttttattttattctttcatctttcccttacggtactatctctatagcgtcaggataaaaatttctatctcctatactttaatgttaggtgaatg

SEQ ID NO: 579769 - DNA, 169 bp, Homo sapiens
  misc_feature (2)..(2): n is a, c, g, or t
  misc_feature (72)..(72): n is a, c, g, or t
anttcggcacagcgagtttctgaacctcagctctagcccttccatggctgtccggatcgccgcactgcagtnatcgcatgctctcactcgcctgcccacccctgtgctgctgccgtacaaaccacaggtgattcgggccttagcaaacccctggatgacaagaagagac

SEQ ID NO: 579770 - DNA, 109 bp, Homo sapiens
tgttgcgctccgcccgtgtgttgcgctccgtgtgcttcctggcgcccccgcccaaccaggaggccaggaggccgtcaccaggctgaggcccagcaccagtgccctggtc

SEQ ID NO: 579771 - DNA, 663 bp, Homo sapiens
  misc_feature (19)..(19): n is a, c, g, or t
  misc_feature (31)..(31): n is a, c, g, or t
  misc_feature (41)..(41): n is a, c, g, or t
  misc_feature (223)..(223): n is a, c, g, or t
aagacttggtaaaagaacntccactaatagngggcgctagnctcggtaagtagcctgaaacgacgagaatcatacagacgcgtatcgtatacatatacagtatcatcgacgtacgacaattgccggatcgcatacgcgggagtgatgctccgagcgggggtgcagctgactcggcatgcggctttgggggcttcgtggggagagaccgttgacctgactcggncctgtgacgtcagacttctgaccccgtgccgatgattatgggaccccatctctggccgtgtctgtgggtcatgaaccgacatgctgagtctggacccgggtccccgggcacactgactgcggtgaccccagataccaggacccgggaggcctcagagaactctggaacccgttcgcgcgcgtggctggcggtggcgctgggcgctgggggggcagtgctgttgttgttgtggggcggggtcggggtcctccggccgtcctcgccgcgtccctagcccgcgccgcttctccccggagtcgtcaacttcatcgcgatgtggtggaaagacgcctgccgtggtctatatcgagatcctggaccggccctttcttgggccggaggtccctatctcgaacggctcggattcgtggtggtgcgatgggtcattgtcccacgccctg

SEQ ID NO: 579772 - DNA, 269 bp, Homo sapiens
ccctcttctcctacaggacttggacactgcaataaagaaattttattttaacaaaaaaaaaaaaaaaaaaaaaaaaaaaaaaaaaaaaaaaaaaaaaaaaaaaaaaaaaccccctttgggggggggtgtttgtggggccccaaaaaaaaaaggggccccttttgggggggccggaaaaagggggggcggaaaggccccctcttttaaggggggggtcccccccgccgtcggtgaaacacagtgagggggccccgggataacacccccaa

SEQ ID NO: 579773 - DNA, 1181 bp, Homo sapiens
gctgctgagaggcaagatggttcaccagtgaggtgtactggaggcacccgggaccaattcggccaggttctcaggttcttgttcgtgtctgttcaagaccggccacggtcgtgatccggcaaatatggcctctaatatgtgccgctcagtgtttccgtccagtacgcgaatggatagtctggtctgcaatgtaaagttggactaatatgctcaatccttcagaaggacttatccggggcactctactcagattgagaaagcactgataagtactccgtatatccaaataaacaaatttgcataaggaatagcaaaaggaatgaacttgcgggacggcaattcccaatgactcggggggcgcgggaacaaggagaggctacgatgcacaagtggcgccccagtggcgccagatcagcgcgtggttctccatgaacgccggaggttgttcctgtggtccgtagagtgggttgagaaaactccggagcacgggctcactcgatatattggggtccaggtcgtatgactcccaagtttcctgacgtacgcgccgatggagttatccgtccgcggctatataatacggaattttggggggaaaagcaaggtatcccgtaagggaggccatcggcttaacgtgaagggggcaacctccgtttgacgtttgtgccaagagaagtctccgacagagaaaatggcgaaaacatctggtgcgttaactctccgtggaaaaggaaagagcatttgcagcggggatgtacacgcgttagacccttgtccaattataagagtccactgccaggtggaccacgggcgtttgccctgtcagagcatcacttggggggtgccggcagtctgttgagggcccccttgattacacgtcgtgttgaagaagcccaactgggagtcggctctggagggtacacgaaatggggagtaaccacgcttcgaaggaagacacaaggtcggtttggaaagcccaaggtgggaaaaaaaaatattaaaacggcctttcggagttctattcccattcgattaccgtggaggccaagaccggcattcagaataatatggggaagcgtaaattcggaggtaaccgcaatccgctctaggaagtcattagagagatgacgataggtacagtttcccacagaaaagcaatggcaggaatcggaagttaaccc

SEQ ID NO: 579774 - DNA, 122 bp, Homo sapiens
ttcctaggttccgtttgaaatgccaatttcaaatccatggggttttttgtatccactaccactgattccaaaccaagattatttcccccagacctaggaaagagccttcctaccactccccc

SEQ ID NO: 579775 - DNA, 341 bp, Homo sapiens
  misc_feature (35)..(35): n is a, c, g, or t
  misc_feature (39)..(39): n is a, c, g, or t
  misc_feature (41)..(41): n is a, c, g, or t
  misc_feature (77)..(77): n is a, c, g, or t
acccaccaaggaggagctggacgccatcatcgagnaggngnatgaggacggcagcggcaccatcgacttcgaggagntcttggtcatgatggtgcgccagatgaaagaggacgcgaaaggtaagagcgagtaggagctggccgagtgcttccgcatcttcgacaggaatgcagacggctacatcgacccggaggagctggctgagattttcagggcctccggggagcacgtgacttacgaggagatcgaatctctgatgaaagacgcgacagaacacacgccgcttgacttcgacgagtctgagatgagaggcgtcagaaggagggacagcgctctaccaa

SEQ ID NO: 579776 - DNA, 979 bp, Homo sapiens
  misc_feature (250)..(250): n is a, c, g, or t
ggtcacagtctcgtactccgcttctcagacactggtctccctctcgcttctgtctgcgcgaatcgcatgagaagagagatcatcgcgccaaggtgaatcagtcttaccatagggtctgaccctgtcaagaccgtgtctatctctagaggattactgtcatcagaacggtggtatgattcatatcgtgcgcgcacctcaaaccaccgcggtatcactgatgtgcaatgagcaccagaggagagtgcgtgcntgaccgtgtggcccaatgagtgaccagaacaaccaagccgatggctagtcctgtagccctataagtgacgcctatttgggcatcgcgccatccggttacgaaccttacacgtgagcattcacaattactagacaatatccttgcaaccaaatccattctaacgaatgcaagacatgaggcgtgtcctcactgaaagaggtacgaccctaatgtctgcatgaacgcaaaaggctcttctcactgaaaatcaacctgaaagagcaaactgggagaaggatgatgattcgagataatgctattgtagacgcattcgaataccaccgagccaattgatacagatgtgcctgtccaaggtccaagttcgtgttcccttctcacgaccatcctggatgcaccatgtgttccatcggtcgatgggactcatgggacacggcgttggtactagcgacaactcccgaggtggtccacactgctacgacgcgtgttagcgccgactacaccctcagagctagtgtcctcgcggtaatagggactcttgaggctggcacggtgacccttgtagccgaccatagtcgtctatggaacgaattcctcagattgaatccgaaggctactcgctttcatgcaacccaggggccagaaggcttgcaaatcggttcgccgaaattcctaggaacaaccctgtagattaccgtccccccttggacttccagaaaggatagttgcagg

SEQ ID NO: 579777 - DNA, 162 bp, Homo sapiens
tacaatgttgttcttgtttttcaatgatggggtctcattctgtcacctgggttcagcctccagggttaagcaatcctcctacctccacctcctgagcagctgggactacagccatgcgccaccacacctggctaattttttttttttttttttttggaaatg

SEQ ID NO: 579778 - DNA, 335 bp, Homo sapiens
  misc_feature (44)..(44): n is a, c, g, or t
  misc_feature (48)..(48): n is a, c, g, or t
  misc_feature (64)..(64): n is a, c, g, or t
gggtcctccaatgctatattgaatttgtccattcttccaaacgnccanaattctatgatgtccngtgtctgctattaccaatctatcagtaacttggtctactgttactttgccaggaaatagcaatggtgaaggtggcaaagaatctttatagagttttattccaattttattatctctgatctgccccctgtctttgtaatactttaaagcaattgaagtatataaaaataatttatctttgtgtccctctccaatcaaagaaaacaacatgtttccacgaggtccaagtatgactagagttggccagcaggaaacttctagttcttgccaaa

SEQ ID NO: 579779 - DNA, 235 bp, Homo sapiens
agtaggcaggtatgaaagtggcttatttatgtaaataggttgctgttatattctgaagtttcagttgtcttgcttcagctcacagggctttatgaaggcacaacatagttttcagccactctaaataagacaaaaaaaatgagaaaaaagaaggaaaagatatttaaaacattatttttaaggcttgtagccaagaaaaattagagtcaggcgccacacagtagtacatattaaa

SEQ ID NO: 579780 - DNA, 138 bp, Homo sapiens
ctagagtttcctggtcggagtagcctgatcttttttggccctttcacagttggagcaacagtccctagccttgtgacactgggcccaatcagcatttagcccaccaggtccacccagcacccgcgctcccagctgtca

SEQ ID NO: 579781 - DNA, 639 bp, Homo sapiens
  misc_feature (146)..(146): n is a, c, g, or t
gcggaagcttccccaggattgtgaatttaaagtctccagcttatttggggttttcttctgggaaattagttcaccagaaaaggggccactaacattttgccgcaagagctttctagaaaaatccacgggcccacttgcgacggacntcggcatctggacccttggcggaccacacatagctctctctggccctgcggtaggcttctcacctttagagttatacccacccgttcacaggccgggggcccacatccctggagcttggaccagatggatcgaccaagttccacccagcccagcgtctcccaccacatctacggcctttctatcctggcccttgacacgacgctgtgcctcccacgtgtccgcccagtgccctccacggtcctcagccggtccctcccagccctgcctactctggagcacgcgtgtcccctctgggaggcacagattcacgcttcggcgctgcacattttctgcgcgggccgctgtgccgcccgggccgcagagacgtgtggtgcctcttgtcccgatgggagagaccgatcgaacgtggcccagatttttataaccagactccgtgactatcttttcacgctagcccagatatgccagccctgaaggaggggaatccagaga

SEQ ID NO: 579782 - DNA, 122 bp, Homo sapiens
  misc_feature (76)..(76): n is a, c, g, or t
ctctccatttagggttgccccattctgataaatgtccatcaaccaacactcaatgtttcctttctagctctcccanttcaataggctgatagtgttaaagaaatagcttcctatctactatt

SEQ ID NO: 579783 - DNA, 147 bp, Homo sapiens
ccttccgtctggccaatggagaagcactcatatgtggacacaaacacaatccctccgtctaccttggtgaccacactccctactccaaatgctcgttatgactacgtctgagaccacctactctaattctccgactggtcctgttac

SEQ ID NO: 579784 - DNA, 571 bp, Homo sapiens
  misc_feature (90)..(90): n is a, c, g, or t
  misc_feature (170)..(170): n is a, c, g, or t
  misc_feature (320)..(320): n is a, c, g, or t
ggtgttgtcttgggcacccggaccagccccgttttttgggccccccacttctgcccacagggccttttaagtgcccccttaagtgcccgngcccttccaggggggcccatccccccctgtgtatatacgttttccggtatatctctgccccccgaaccctttttactttngggggtgggtttttgtttgacactttcctgtccccttttcagggcgaacctcccatgtaggtggcgtgtataaatgaaaccggccctggttttttggaattgaagggcgggggtccttttccccctggggtcccagggtgtttttcttgntaaaccaggccttttttgggaacccctcccccaaaaattaagtttggccaccttggggggttgtgtccccccagcccgcccgtcctttggggtgcacaactcccctttttcccccctgccccggtttaaaaaccaagtttgtgggccctttttccctttaggcccctgtcctttttaacatgtccccttcaccggtaatcccccccccctgcccccgtctttttataaaaaaggaccccccgcccttttta

SEQ ID NO: 579785 - DNA, 877 bp, Homo sapiens
ccgcccttttttggtggttttcctttccaattttctgtttcaaaggcagcagcagttgagctgcaatggcgccagccttttccccagccccactcccttttatgaactcctagcttttttggcagacggcctagcattctggcttaaggggcacctttggttagcaaacacaattttctatgaacggatttacccatgtggacgtgaaccgtgttgttgccagcggcttggaaggacgggggacctccagacaatgagtgtcccagtgagttgatgcagattggtggagtggtggaggctcctcaggatgagggtcgctgcagacccccgtgggtaaccagaccgagtgtgacaacagtagggacataacctctatagcagactcttggcacacctttaactattagccccgaggttccgttgttgacaaggctccggttatgcacgtgcgggggaaaattgcctccccaggcagaagcgggccctctccaggcgtggcactccgtgggggcacctgccagggattgcctcacagcccctctcgtccacaaaaaccatgtgtctcccccctgggggcttccgtgaaagaagcgcctgagtgtagactcgcacggccacgtttggtcttcgcgagcgagagacacacggtgggaaaagcgctggcaacaggggtcccgcgaagtgggggctatctgcgtagagccgggtccttccaggcatcccagagaagggcgttgatgttgtacccccaaggggccggattgtgctacccagggactaagggttagccttgtccacacggcgccgagggggtctctccccggggcggggttgtccctttaccccgggtgctcgggcttcccggtcattttcccgc

SEQ ID NO: 579786 - DNA, 340 bp, Homo sapiens
acgtatatattgtaccggtcgctcgataaggcaacatgcgtgctcgtgcatgagtagtgaatctatccgttttaaagctaatctatgcaagcagtcccggtggtctccttagactgcgtacttgccacatctacatattgatcgttttaagactttccctgtttgaattcttatctccccaaatcataagcattgtaccgatttgcactcgtgccggccagcgcagctagtaaagagtatgcccgtttcccctgcatagtctcctggtcactgtaattgatcgtgtgtgtgcgtgcgtgtgtgtgtgtgtgtgtctgatactgtcttggcccttatcgag

SEQ ID NO: 579787 - DNA, 347 bp, Homo sapiens
cctcccatgttgacgactcgttgggacaattcattttattattacactagaatagctagcagttgcccattcggtccccagatacaacatgtgagcaaatggtgagaagttagtggtatctatgtttacatgtaggaggcagctgtgtctaagcggtaccgggagtttgctatcctacacctattaaccgttaagtatagaagtttgcctaactttacatttcctcgactcccaggtaagtggccattttcattatcagaacaacaattagattcccgacgtcgggaattggaagaatatctggcaacaagtgtgttcaatacgagtaatttgtgaggaggttacat

SEQ ID NO: 579788 - DNA, 738 bp, Homo sapiens
attactttactcaacctctttgatgacacagcaaacaacagacgtgactatgtctcttgtatatagcagacaatctagcctgttttccataccagacacgaggaagagccgtgtttataatgcatcatatagacattacactctacagtttctggtagtaacctacttgcagttcattcaaggagttctatggtaaaggacacacaaggaaagagagaaatatcatcacctagtaacggaatcatgatgtcaagcgcaacagtgaagaagaaggtttccaggcctcggaaggtcagcggagagaacggtgtaggagttcagattcagagttcatgagttcagaagtacgactagtaaattcagtgagtgaaatgtcttgccaggagaaattcagcctcctttaatgcgaatttgcaaatgtgctcccagggatattttattacttctgcatgcttcaagagacaaccatttgaaggaactgctttgtggcattgttcctggatagtaaaacttcagaagtactctccatctgaaatctgcaaaagtatatgataaagcgataaaccgaaaaacaggagttcattttccatccaaaacgaaacacgtggacttcctgcggagtgacatggctaattccaaaatcacagaagaggtgaaacaggagtatagtaaaacaggatctagatttcaagacttctcagtggaacatcctggaccctgatgaagaagaagaagaag

SEQ ID NO: 579789 - DNA, 485 bp, Homo sapiens
  misc_feature (105)..(105): n is a, c, g, or t
aggcgcttacagctcaatgcgaatcaggccttcttcctgtgggtgagcggacacagcatggtcggcgtctccgcgccaatggcagaggtgtgggagatgagaaanggggaagatggattcctgtacatggtctaggcctcccaggggacgttcgggatgaaattggcggtgtgaaagcggaaggaagtgcatctctgtgagaattgtttaaacgcgttaccaaggaaggaaaaggcgtgtggggaactgagatcgaggaggtgatccgatcagagagcaggaaacagtagtgttccgacctaggagtgtgaggaaggggtgttggggtttcaggcggaggggactggggtcggggtgagcacattcagctttggaaactatattatttaatgtggggtagcttgtgttcagattttaagagtttaacaataaaatactttgcgttctgagttgcgaataaaatagaccttcaagttaaaaaaaaa

SEQ ID NO: 579790 - DNA, 144 bp, Homo sapiens
aactgatgaagcacatatcattctctatgattaactgttgcagtaccgcttaatgtgagttcttttaattatgtggcacgtgatagaagttatgtactttcaggtgggagaaatggcctgcttagctagaatatcctaaaatat

SEQ ID NO: 579791 - DNA, 1167 bp, Homo sapiens
tggggggggtgcgccccccaaatttttttattatacaaataaaaaaaaaactccccgcggggggggggcgcccccgcgcgcgtgcggcggggggggggagcccccggggggggggggcgccccctctcacgcgcggggggggggaggcaaaacacagcgagagagagaggggggcgtcggcgcgcgccccccgacaaaaatcggagaggggagagcagcgcgcgggagagcgaggagagaaaaaaacacagcgcgggaggagggaggtcctcgcgggcgggacgggggggggcgccccgggtggcctcttgtgtgccacacaaggaggtgttatcttcctgttgggagcaaaacaaagagaaaagaggcgcgccgcgccataaataccacaaatatatttttcttccggcgcccggtgggggagggagtcattctacacccgcgaggggaaccgtgcggcccgacagagagagagcccgccgcaggggaagaaggagggagcgctgcgggagggagcacaaaatctctctcgcacggggggaccggggaaaaaaccccggaaagaagcgcggagtgaatctcgccggagggcacccagagaacacaaccgtgtgacagaatcagtgagacgggggacgggagggggggaccacacaggaggagagaaagtgggaccaagcaggagagtggcggggagaggagagcagccccccaacggagaggtacaggaaaaaggaaggcaagggaagggaaaacacataagagaggggagagagaagaggggataaaatatcgagcgccccccccggccgcctgcggacaaaaacaaagagggagacacaagagagataaacaaacaagagaggaggcaccacaaaagaggaaacacgaccccaccaggagggacagaaaagatgaggactccacagcaccaaaaacaatgagagcagcccacagagaagaagtgtaaacaacaagaggtagcaagcagcgagaaggggagataaattagggataaaccccccaaaacagcgtgggagacagaggaaaagagcgcaccgcagggtgaaacagccaccagagagcagagtataaaacgaccaccggagaagagatgcacacaaaaaaggggggtagggaggcgaacaatagataagagagaatacc

SEQ ID NO: 579792 - DNA, 719 bp, Homo sapiens
aggggatcttgctcctggaggctgagcggagcctgcggagagcgacggcacccgcttccaggtcctcggagccgcgcttgtgtggggctggtgggtcccctgctgcccattgatctatcctccaccccgagcgtccgtgcgttctggtggcagcgagacggctaggcgggtatccgcggtagcaggaaggcgacaggaacttcctatgtccttgcgtggggtcatgggtcggagtgcgtgtctgttcgtggacgtttcgttcgctccgttgttgtcctaacccaggacctggaatgccccgttctactgatcacgcagccgttcttaccagacttagtaatgcggcagggcccaggcggggcggggacgcctcatgcatcctcctgggacctaaatcacaggagtccttggccacgttcagccataagacattattcacttgggctgcgaaactcctggcaactattaggcgtgggtgaggtcccagcccctgtctgggacagagacgtagtaggtcatgtgtcacccgtaaggctttcacaacggtcggtgggttgcatgtccacggagagatcagggtggcgatatgtgcctaggtctatatctatgatatgatcgccatgagtgacaatagtccgcagtgacccttcctggacggctcatcgggtccctggcctccacgactcccgggggccggttcgccggaatgtcccgggttg

SEQ ID NO: 579793 - DNA, 672 bp, Homo sapiens
  misc_feature (156)..(156): n is a, c, g, or t
  misc_feature (212)..(212): n is a, c, g, or t
  misc_feature (254)..(254): n is a, c, g, or t
  misc_feature (330)..(330): n is a, c, g, or t
  misc_feature (610)..(610): n is a, c, g, or t
  misc_feature (648)..(648): n is a, c, g, or t
agcttatccaccatgatcaagtgggcttcatgcctgggatgcaaggctggttcaacatacgcaaatcaataaatgcaatccagcatataaacagaaccaaagacaaaaaccacatgattatctcaacagatgcagaaaatgcctttgacaaaattnaacaacacttcatgctaaaaactttcaataaattaggtattgatgggacatatctnaaaacaataagtgctatgtatgacaaacccacagccaatatnatgctgaatgggcaaaaactggaaacattccttttgaaaactggcagagggatgccctctctcaccactcctattnaacatagtgttggaagttctggccagggcaattaggcaggagaaggaaataaagggtattcaattaggaaaagaggaagtcaaattgccctgtttgcagatggcatgattgatatttagaaaaccccatcgtctcagcccaaaatcttcttaagctgataagcaacttcagcaaagtctcaggatacaaaatcaatgtcaaaaatcacaagcattttatacaccaataacagacaaacagagagccaaatcatgagtgaacttccattcacaattgcttnaaagagaattgctaggaatcaacttaccaagggatgtngactttttcaaggagactccccct

SEQ ID NO: 579794 - DNA, 525 bp, Homo sapiens
cttcagtgcttctgccaggtattctacagcggtgagtcctgtgttcctacggccaaattccaccacacacggggaggagtcttttaacaatttcaaatatatgagcttatcagtttctgtattcagtggtaaaaaggatgagggaaaatgttatagccaatgaatacctaaaatagacttaattggattatactgcatttcagaaatacttgattacacacacacacacacacacacacacacacacacacatacaatataaggggaaaagtcaggagttagattgggacgtggtggctactctgtatgtcaactgatatttatagggtgcctgccatttgcccactgcactaggtgctgggagacagctatgaacaagccagattatggctgcatgcaccaataagggtgaattctcaaaatataagtagtggagaaaaagcaattaatagggaatatacaaatagtgtatattcaaactaaataggttgtttcagatttatatatagtggtataaccctaaag

SEQ ID NO: 579795 - DNA, 1712 bp, Homo sapiens
tggttaatgtcattaaggaaaaaaggaagaaaagttatgccgagggcgttcttggactgggtgtagtagggggtggaagggtgatttatatcggaagtgggagggtgattccatagggggtgtgttgtgatcccgttttcggtgcaagaaattaggagggtggaggtgcgcgcatagggcgtgcaactacagtgaaagggacaagaagtgaaggtgaacagaggtaaagaaactcggtggtgaggggtgggcacgtgcgcctcacgtggagatagccttccctcaagaaatctcactgtgaacaccaaggggctcgtggtcccacaaagtgtctcagtgcgcgcacgtgggcgcgcgaatatagcacaaaacgctctgggacacaccatcaacagggggggcggcacacacacatcgagaacacagtggcacctacatcaggtgtcggcaccctcaaagcgggggaaaccccactcagatatctacgcggccacaacgggacccggactggatgacacaccgaccccaaagcgtgggaaaccacatgcggggaggcataaccactccgcggaaaacacaacagggggggggccaagcctacaaaatcccggggcacaaaaaaagacagggctcaccaaattcaggcccgatgccagagccaaatctacaagaggggcctacccaacacacgacaaaaccacaagcaacaagtgggggagaaaaccctatgtggaacacaaacaaacccaacactatgtggacgcccccaacaaacccaacccaagaacaaaggcccccaaaagagacagtgcaaccagaggcgaagcctatcaacccaggagcgaccactaccaagaaacactaaccggcgcaggaaagcaacttagggggagacgaaaccagtggcacaacaccaccacagggtgaagacatacacaaattgcccccaaggaacgtcagccaggcaaccgcaagggcaagtggaaacacatcccacccagcgcactctagtgaccccacgcgggggatggccactatagtgggagacaaaacaccagtggtgacacccgaagcgcacagacgcccgagaaacggctttgtagcagcaccaaacaacacaacaaaacccgcgggagcgcccagattagccgcacacaatcagaacagacgggcgtaacaccacgacaacgccacaacaaaaaccgcaataacgcacccacacgcgagatccatgatgccacccacgaggtagcatcaagcgcactcaagcccacaccagcacacccaacaacgaggtggacacacgcgatcacacaaccagggagacacacacccacatatccagcagaaacagcgtacccgacaacaccccctcgcgccaagcgtgccagccacatcaggcgcaagcgggccaaccagacagcccacccagacaagctcgtcacgcgccccatcagacacaactccaacaagccctcaccaagcttacaccacacagcacgcatcgtccctacaccgcaccaagaccaaccgccagacgcaatcagacaacacagcgacgccaccaacgacagagccccatacacacaaacagggcaaagtagaccaaagaccaccaagaacacggagaaacatccatacacgaccaaccacagcccacggagacaacaagcagcgcgaagcaacactaacgcgcaggccccccgccatgt

SEQ ID NO: 579796 - DNA, 440 bp, Homo sapiens
atgatggcgggcgcctgagcgtctgttccgtctgctccggaggccgtgacggtcagactcgttgctgtcctgtggttcgtctcacgcactacaggaccctggggggctcgagccacctccagacggcgcgaggagtcgcttaagtgcgaggacctcagagtgggacattatattcgtggagagccaactctacatgacgctacgccagagccagctaactgtacagactacacagctcatgttacctgcattccagcacgcgacatagcttgtcaggattccagtgtcaatgacacacattttactgggaacgaagttgcttttttcaagcccatatcttgccgtgtctatggatattcctacagagtggctcggattgcctctatatcttggcatggtgggagcagatcgattctaccttggatccctgctttgggttt

SEQ ID NO: 579797 - DNA, 378 bp, Homo sapiens
  misc_feature (101)..(101): n is a, c, g, or t
  misc_feature (132)..(132): n is a, c, g, or t
  misc_feature (182)..(182): n is a, c, g, or t
cccaggaacccccacggcacagaaaaaaggccaaaattgtacgaaaacaacaagtagaattcgaaggccccagggcccaaaatgaagctgctcacagctgnagtgaaagaaaggtgccgtccggggccaaanccagcagtgtctaaacccccggagccatctcgctgccgaaaccctgcttncccctcgccctagggctcccttgccgccctcctgcagtatttatggcctcatcctccccacctaggccacgtgtgagctgctcctgtctctgtcttattgcagccccaggcctgacgttttacggttttgttttttactggtttgtgtttatattttcggggatacttaataaatctattgctgtcagataccctt

SEQ ID NO: 579798 - DNA, 328 bp, Homo sapiens
tccagctggcccccaagtcagccacacacggcgtgtgactcccagaatggctccgcctggagattccccatcctctccaatattccccacggtccattcagtctgccccaccgcaccttcaacttcccatccttcagtttccctctagcacatcatcctcttcgcaacttcgtcctccacccggcccagaccccagggcccgtactttgccctctccggtcccagcacagccccaggtcctcatcacttccaccacacccttacgcccttgggggccacgcgggacggggtacccgagctcgacatgcgtaactcactggtcactacg

SEQ ID NO: 579799 - DNA, 1834 bp, Homo sapiens
caccgcctgccggcaccgacgcgccacgacctcaaagccagaagcgtgacgaacacgcgacaccacaacagccgcgcacaatgactgccacacatgccctccggcccgagccacagcagaacgcatggcgagccgaacacaggcaggacaacacacaccacgcgcccaccggcagcagccaccgaggccccccagcacgaacgcacaggcaccacacccaagagcacacccgtcaccccacgctcagccacccccgcgaagagaagcagacagcacgcgcgcaggcgcacccccgcgccaccagaacggagcgacgacgcacgcagagagcgagcgagacggcacgcgccacccagccacaagcccaccggccacgcgcgcagaaacgacacaacgcgcaaccgaacacccgggcgccgccggccgcccgccccgactccaccagaccaagcacacaggacaggcagccccgcgccaccgccaccccaggagagcgagcgacagacaagagcagccacagcagccgacgacacccagcccacggagcggccgaacgagtagcgctgtacagaacgaagagaaccgaggacacgagggacgacagcagcgccacgcgccaccaagccgacaaaggaacgcaaaaaagatggccaacgataaagaggacgagacggagtacgactaggacggcgagagcggagagaagcgggcacacagagcgcccacgcgcccaagcgcggggccgctgcgagccgccagggcggcactcgcgcccgcaccacgacgccagaccagcacccgacacgcgcgcgacccagccacgcgacgaggaacggacatcgcacgcgactcccggccgcacctcaccctaccagcacgccgcccctgacacgcgcagcgcccgcccacgaccccggcgcccgaacacagacgacacgacccagcgaacggccgacgagcaccgcgacagaaacgacagcacgggacagcacaccggagaacgaccaccgagcaacgcgcgcccgcgacccccgccgcaccccaacacagtccaacaccccgaaagcctgcgaacacacacacgctcacgacgcctacgaccaacgaccagcacacacgaccaccaaccgagcagctaccgagacgcagcagcccaaatcagcgagagcacaaccatcaagacgacaacccgcgttcccgctcccacagccgcgcacggcgcgcgacgacgcgccgccaccacgcacacaccaccgcgcgcccccagacacagcgtcaacgctgagagactcgccaccgcgcgacgacgcagtctgcacccgcagctcgaacgccgacgcgcacggacggcacgcgcagaagaccaggaccgaggagacgccggaaggcgcaaacgagagtgcgggaacgaggccgactgacacgacgcgcacggacgcagaccagaacgaggagacgcgagcacccaggagaaccacgcagcagcagcggagcggcacgcgcgggaacgcgcgccgaccgatacaaccacacgccagcacagagacgccgacgacagaggcgaggcacgcagagacgagcgccagacgcaacaggacccgaacacgacacacaagagcaggcgccgccagaggatcgagcgaacgaccaatcaggaccgacagcacgcacgctccgagccagggcgcgatgcagccgcgtcgtaaagccacgccagacagagtccagcacaagagatgccaggcgagcacgacaagaagaagcgagaagagacaggcgaggaagagacagtacaaagacagcagagcgagacacacacactccgtgaggcaca

SEQ ID NO: 579800 - DNA, 114 bp, Homo sapiens
cgcgttgggagctgaagctggccgactttggactggccagggccaatgtcagtgcccacaaagacttactccaatgaggtctgtgacctctgtagatacctgccccccgaagag

SEQ ID NO: 579801 - DNA, 281 bp, Homo sapiens
gtggatcatctgaggtcgcgacgtttgagaccatgcctgaccaagtcgggtgaaacctcactctctgcatataccatacataaattctcttggcgtgtgcctgtagtcccagcttttggggaggccgcgccaggcgcattgcctgaacccgggaggtggaggtagtagtgaactgagatcttgccagcgcactccagcctgggccccagcacgagactctgtctcttcacagaccacacaaaataagcaaatacagtaaaacataaaaaatttaaaatggg

SEQ ID NO: 579802 - DNA, 270 bp, Homo sapiens
ggtaatatgtaacacagactaacacgtgatatatgggattcccataaacaatagtaaaaacactttaacattatttactttcaatattatcttggaattattccaatgtattccaagtaatagttaactggtgtgttacaatggattccagacccaattggatagcgcttagatatattagaggtgtctgcttgttctttcacttgaatcccggatgaaactccctttatggaaagaaaatccagggccacctggttacctatttacggt

SEQ ID NO: 579803 - DNA, 398 bp, Homo sapiens
  misc_feature (24)..(24): n is a, c, g, or t
  misc_feature (69)..(69): n is a, c, g, or t
  misc_feature (75)..(75): n is a, c, g, or t
  misc_feature (232)..(232): n is a, c, g, or t
  misc_feature (236)..(236): n is a, c, g, or t
cctagaggatacgtccggcatttncgcccgtgtactaccagagcaatctttggtaaaactaagatccangattcntgggactgtacagacctgccaaaggatggcctattagaggttcaatacttcttcaagatcttggataattagtggtgtggaaagtaaagaagtcacaggttgggacatttagacaagagtgaatcacacacgaggaatgtgttcattctttttgtgntcgntgctttaacctgactgaatacaagatcaacaattttttttttctcctggcaatcattacatatgtcagaacatggattttgcactgcagacaacatttaacaccagcctatggggtactgcattgctttttataaagttcaaaatacagatttattttcaaa

SEQ ID NO: 579804 - DNA, 174 bp, Homo sapiens
ctaattggttcttcgatgacgaaaactagacatctaaaggtcaaagaatgaaattagaacactctctaacatcgcatgcaaaaatacactcaaatgcattaaatacctaaataaaagactgactactataaaactcttagaggaaaacataggcgtcatcgaagaaccaattag

SEQ ID NO: 579805 - DNA, 596 bp, Homo sapiens
  misc_feature (26)..(26): n is a, c, g, or t
  misc_feature (68)..(68): n is a, c, g, or t
  misc_feature (141)..(141): n is a, c, g, or t
  misc_feature (170)..(170): n is a, c, g, or t
  misc_feature (172)..(172): n is a, c, g, or t
  misc_feature (182)..(182): n is a, c, g, or t
  misc_feature (194)..(194): n is a, c, g, or t
  misc_feature (197)..(197): n is a, c, g, or t
  misc_feature (202)..(202): n is a, c, g, or t
  misc_feature (204)..(204): n is a, c, g, or t
  misc_feature (209)..(209): n is a, c, g, or t
  misc_feature (212)..(212): n is a, c, g, or t
  misc_feature (215)..(216): n is a, c, g, or t
  misc_feature (221)..(221): n is a, c, g, or t
  misc_feature (228)..(228): n is a, c, g, or t
  misc_feature (251)..(251): n is a, c, g, or t
  misc_feature (313)..(313): n is a, c, g, or t
  misc_feature (322)..(322): n is a, c, g, or t
  misc_feature (403)..(403): n is a, c, g, or t
  misc_feature (422)..(422): n is a, c, g, or t
  misc_feature (426)..(426): n is a, c, g, or t
  misc_feature (428)..(428): n is a, c, g, or t
  misc_feature (471)..(471): n is a, c, g, or t
  misc_feature (490)..(490): n is a, c, g, or t
  misc_feature (496)..(496): n is a, c, g, or t
  misc_feature (529)..(529): n is a, c, g, or t
  misc_feature (593)..(593): n is a, c, g, or t
attattgttttaggtttggttaattntgtttatttattatttatgtgtttggaattatatttagttgnggataatttgattttatatttaagtgatgttatatttgttagaatatttaggatttgggagtaggagtttatntttattttagggttttagttgtggtgttnangattttttgngttttgagtttnttnttttnanttttntgnttnntgttnttgatgntgttttgggttgtgttggagttnaattatagaagttggagagagttttttggatggagtaaaattgtttgatttttttgatttgntgatgggtntttgagattgtggtgaggttgattgtgtttgtttttatgaataatgagagattaatttattattttaatgttgattaatangagttgtggtgttgggatnattngnggatattgatttagtttaagagatattgttgattgtttgttgnggttggttttgtgggttgnattatntgtatttttatgtaatttatataattgggatgngttattatttatttgttatattttatgggagtgtgtgatagtgatgaatgttgatatttatganaga

SEQ ID NO: 579806 - DNA, 609 bp, Homo sapiens
gtgggctgagcctgcgccgaggattcagctgcctcccctcttgatgccccctcgtttcccgactgtccgttccccgcctgccctgctactgccgcggccacccggtctggcggactgcgcttccggtagtgccggtatatgccaccggaggtgcagagagggcatcggtagtcagtatggtccggttgatcccaagaacctcgcagttcgttttcggaccccttttttgcttgattgcaagggtaagacggcgtgaatgacccgttgcttttccgtgctgggcaaactgtgaccgcgatattatatatctcgcgatattacacggaaattttcagacctagaagaacacgcgggcaggggaaatgaccccctttttacctaactgtggttcccaaaacggcgaattccgggcttggagttgactttaacaggaagttacaaaaaaaggaaaaaaagttaagtgttggaaagcgggcaggtttaacacggaacaaaaacaggtttgtggcgcattggcaaaattggtgataaacgttggtaagattttagagggcaattccggagaaactaatgggaaggaagggtacatttcagagcaacaatggggta

SEQ ID NO: 579807 - DNA, 214 bp, Homo sapiens
  misc_feature (132)..(132): n is a, c, g, or t
  misc_feature (136)..(136): n is a, c, g, or t
  misc_feature (166)..(166): n is a, c, g, or t
  misc_feature (172)..(172): n is a, c, g, or t
gctgcatagttgcgacctctggttaaggaattgtcattgggcgctcgcctggcagatgtgtaggtcctgagtggcgactagatcgagcgtgtctcagtgaggaaactgctggcgtctcccaggaccaggatnagtnaactgattgtgtctcaacatagggaagtgngttctnttggcatattcacccccgaatattgctgtcgggctagtcggg

SEQ ID NO: 579808 - DNA, 149 bp, Homo sapiens
taatcgagctcggtccggcattatggctttaaagtttaataagtcctggcccaggtcagtggctcaagcctgtaatcccagcactttggaagggcaatgtgagcagatcacttgagctcaggtgtttgagcccagcctgggcaacatgg

SEQ ID NO: 579809 - DNA, 269 bp, Homo sapiens
  misc_feature (121)..(121): n is a, c, g, or t
  misc_feature (191)..(191): n is a, c, g, or t
  misc_feature (238)..(238): n is a, c, g, or t
  misc_feature (257)..(257): n is a, c, g, or t
gtccggggatcaccatccggagatgttttccaaggctaaattcaactagcccctgttttttcctccctgaactcttggggctgagctgcaaccacccaactttctttcccactcttctctngggacgttgtgggcctccacgggcttggggcacggcattgggacgtggcccacggcacacgaggtcccgngggcatcaggagacaaggctgggtctggggaccgttgtcctccccangttgatccccgtgacccgnggtaccggagct

SEQ ID NO: 579810 - DNA, 441 bp, Homo sapiens
  misc_feature (212)..(212): n is a, c, g, or t
cccccgcctgaagatgctgcccgagtcccgctccctacagcaggcgcttggtcaactggagttaagccattgactggtattgctgtcggacgcggtatgccccttgcaaccccagcagcagcaattgccccagctccacctgctggtttaggtggtccagtttggggagttggagcaccagcaccgggtctgatgcaaccacgagcacttcntggcatgccacctccacctcctcccccgacaggtgcaccaactgcggcgttcggtcgtgggatgccacctgttaccgctgtacgagggtatcctcctcctccacctccaccgcctcctggatatcgttgagatgcaatctgattcatggtatctatcctagataaccacttatcatctctgagaagttttgtaaaagcatttacttgtttcaatatactttcctaagca

SEQ ID NO: 579811 - DNA, 794 bp, Homo sapiens
  misc_feature (670)..(670): n is a, c, g, or t
cagtgtacctgggctggttacagcagctctacccctcactgactgcaaacatggcagcgcagaaggaccagcagaaagatgcctgagtgctgtgaagtgtgctgagctggcacgaccctgctgcctgaagctgattccctcctggtgcagtgcctggtgagtggctggagctggctgcctgcgcgaccatcctggccctggagcaccttctgtggaccagcatgctgcttctcactggccccgcaacctgggagagcattgtgccagcgcctcgtacgcaacgtggatgtactaccagagcaactatgtgtacgttgttcctgggcctcatcctgtactgtgtggtgacgtcccctatgttgctggtggctcctggctgtcttcttcggcgcctgttacattctctatctgcgcaccttggagtccacgcttgtgctctttggccgacaggtgagcccagcgcatcagtatgctctggctggaggcatctccttccccttcttctggctggctggtgcgggctcggccgttttttgggtgctgggaaccaccctggtggttattgggttccaaggttcctttcaccaaaattaaggttttgaacgggaagaagttcaaaatgaaaccggtttaaggttttttttggaacctgcggccctcccgggcaagntgccccacccctgcccatgcctgtcctgcacggctttgctgctcgggcccacagcgccgtcccatcacaagcccggggagggatcccgcctttgaaaataaagctgttatgggtgtcattcaaa

SEQ ID NO: 579812 - DNA, 129 bp, Homo sapiens
cgccgtggatgttttcagaagtggccatcgagaggtctggatggtatcatcgcaacgttgctctgataccgtttgtatctgtaaatatgtcttctgcaggtcagacacatataaattttatccacgtca

SEQ ID NO: 579813 - DNA, 113 bp, Homo sapiens
gctggagctgctcttctatctgctgctgttctgagcaagctacagtgtctgtgtgagtatgggtcttatctctggcactagagcagctcgcaaggtattctggccagccatgc

SEQ ID NO: 579814 - DNA, 277 bp, Homo sapiens
taaaattttggtagtgaaaattgtatcactatgtttaccaatattactagtatgaataatacacatagggtgtgacttggaggctgctcaatactttgttgctatacacaatgcattattttgttgtaagcatcttaactacacatataggtttgctgaccttgaatacatcccggtatggcaaacttcattttattctgggtgttcattttattctggtctcagggccatacatttattttagttaattacttattattttgacaccattacttgg

SEQ ID NO: 579815 - DNA, 380 bp, Homo sapiens
ttaatactcatcacgactattataacggatcttcacgtcaaaacaaaccaaaaatccacattacttcatatatcctctgttctcttatccggtctgcttaccattcaggataaaacgtctgactttaaaaggcggtgctaccctcctcgagctccttgatcttcttatctctattctcgtgtgtaaaaaccctggaagatatgctttaaaacattgagtccaaaattttaaattgctttccagcatagcaatatctctcgcccctctggattcagttttctgtgagatggaccgaacgtctcgcctaatggacttgtggtgactcttagcagtggttgtgttggaagttcctctattaataattacattaaaattgcttt

SEQ ID NO: 579816 - DNA, 873 bp, Homo sapiens
tgctcggaggggtcgctgcggcgcgtccacgtgttgtagggtggggagggcggtcagggggggagagaatgggggcggtagggcgagtcgatgcaagtggacgggataggcggcgcggtaggggcagccgcgcccgtgtgggcgagggccgcggcggaggtgagtgaaaggcgcgcgcgcggtgggttgtgtgtacgcagctgtgggtgtggagtggggggaggtgcttgcgggcagtgattgcctgccgtatccgcaggcgcttgggtcttctgttgatgttgtgcgggggcgagaggagcgcggtgttgatgtgagcgggaggcggcgcggggtggaggtgcaggactcggggcagaggagcgagcccgcgattgtgtggggacgaaaaaggcagcgaccgcgtagagagcggaagagagccgtgtatgaggggcaataggcgcgagccaaggagatccgccgtgggatggtacacaagacaatgttgtgagggctgacgattgaccgtagaagagtcaatccttctcccatatagaccacaggcgagaggagatagcacaaacgactgtaaggagacacatgttgggccgctactgcgtggtccatgttctgtgatgcggcgtctggggcgcggttgtgtagatgtgggccccgcgtcctcaccgatgagtgtgttcccccgcatgggggtgctattcttattacgcgtgggccccctcaggtttgtttgcccccagtggctgaagaccgtttgggggtctgtttcttgaggcgtgttctcgttgcccgcacacgccccacatcgctgttttcctcccaggcccctggccgaaaaagagtaaaaaatggccccccccccccccacgaaga

SEQ ID NO: 579817 - DNA, 2464 bp, Homo sapiens
gagcacagttgagtctccagccttgactcttctcaagagcctgtgactttcctccctggacaaaggcatcatgagttgtcagatctcttgcaaatctcgaggaagaggaggaggtggaggaggattccggggcttcagcagcggctcagctgtggtgtctggtggaagccggagatcaacttccagcttctcctgcttgagccgccatggtggtggtggcgggggcttcggtggaggcggctttggcagtcggagtcttgttggccttggagggaccaagagcatctccattagtgtggctggaggaggtggtggctttggcgccgctggtggatttggtggcagaggaggtggttttggaggcggcagcggctttggaggcggcagcggctttggaggtggcagcggcttcagtggtggtggtttcggtggaggcggctttggtggaggccgctttggaggttttgggggccctggtggtgttggaggtttagggggtcctggtggctttgggcctggaggataccctggtggcatccacgaagtctctgtcaaccagagcctcctgcagcctctcaacgtgaaagttgacccagagatccagaatgtgaaggcccaagagcgtgagcagatcaaaactctcaacaacaaatttgcctccttcattgacaaggtgcggttcttggagcagcagaaccaggtgttacagaccaaatgggagctgctacaacaaatgaatgttggcacccgccccatcaacctggagcccatcttccaggggtatatcgacagcctcaagagatatctggatgggctcactgcagaaagaacatcacagaattcagagctgaataacatgcaggatcttgtggaggattataagaagaagtatgaggatgaaatcaataagcgcacagctgctgagaatgattttgtgacgcttaaaaaggacgtggacaatgcctacatgataaaggtggagttgcagtccaaggtggacctgctgaaccaggaaattgagtttctgaaagttctctatgatgcggagatatcccagatacatcagagtgtcactgacaccaacgtcatcctctccatggacaacagccgcaacctggacttggatagcatcatcgccgaggtcaaggcccagtatgaggagatcgcccagaggagcaaggaagaagcggaggccctgtaccacagcaagtatgaggagctccaggtgactgtcgggagacatggagacagcctgaaagagatcaagatagagatcagcgagctgaaccgcgtgatccagaggctgcagggggagatcgcacatgtgaagaagcagtgtaagaatgtgcaagatgccatcgcagatgccgagcagcgtggggagcatgccctcaaggatgccaggaacaagttgaatgacctggaggaggccctgcagcaggccaaggaggacttggcgcggctgctgcgtgactaccaggagctgatgaacgtgaagctggccctagatgtggagatcgccacctaccgcaaactgctggagggcgaggagtgcaggatgtctggagacctcagcagcaatgtgactgtgtctgtgacaagcagcaccatttcatcaaatgtggcatccaaggctgcctttggaggttctggaggtagagggtccagttccggaggaggatacagctctggaagcagcagttatggctctggaggccgacagtctggctccagaggcggtagtggaggaggaggttctatctctggaggaggatatggctctggcggtggttctggaggaagatacggatctggtggtggctctaagggagggtccatctctggaggaggatatggctctggaggtggaaaacacagctctggaggtggctctagaggaggctccagctctggaggaggatatggctctggaggtgggggttctagctctgtaaagggtagctcaggtgaagcttttggttccagcgtgaccttctcttttagataaagatgagcccccaccaccaccgactctcccaacccagactctcccactccagaatgtagaagcctgtctctgtacctctaactggcagcaagttaaatttttgtcatttatctctgatggcactttgagggaaaagaatgtccacatacagtttttgaaagatcttctctccaaaccagttagttagagccagtgacgcctctgtgttctggggcggaatctgtgctgtctaggtttgtgcttctagccatgcccattcccgcccccaccatgcctctttgcattgcccattttccagatgtgtattctgttgaggacccaggcccatccagggatttcatctctaagcctggcagtgctggggggaaatgtgtttctgtgtatatagctcctcttgtccactctgctttcggaagtgctgtggtctgggggtcttcataataaacctcatttgca

SEQ ID NO: 579818 - DNA, 881 bp, Homo sapiens
  misc_feature (117)..(117): n is a, c, g, or t
  misc_feature (521)..(521): n is a, c, g, or t
tgtctctttctttattttgatgatagagtctgggctctgtctggccaggctggagtggcgtgtggcacatctcagtctcactgcaccctccgtccatctgtggtttcaagctattcntcctgtcctcttgcctccacaagtaagctgggaattacagtgtgcacaccactcatgccccagttaattttatgtattctttaggtagagacgaagttcgtcaccattgtgaggcaccaggctagctcgtcgataactcttgcaccatcgaagtgagtccactttgcgcgttggccgtcctcaagaatgcatggggattgacaggccatgagccaacctacagcctggctctcaatcacatgacatctgaacagcttttcacgtgtggtgcaactcgtcatgtgtcatgtcgacacacgtatcctccaaccaacagcctcattcttcaccacgatttcatgaagacgcaagtccaagaatgtaggcaagtgtgatcgcctacgtctcacataacgccgtcatcntcacatctttggtgggcccgtatcgcatcgtatctctagtcgtcacatatctacataactacacagcaacgcaaggcattagcaaggagcagcttataacttgctctgtagcatacgtctagttacactggcgttgtctggcctggactgcttgaacactttacatgttgccatgtcctctgcaggttgtgacgagtttctctgactctatcttgcttgctacctgtcttgtgataatcgtggctatgctcatggctagaactgttatctgcctatgcggtcccttctggcacttggcggcactcgcgtccgtgatcaaggtaacactggttcttgtttttcattcctcgtggccctccg

SEQ ID NO: 579819 - DNA, 321 bp, Homo sapiens
cagtttactgccgctctacacctcagtcttgttggagactcgacgcctcacccatcagttcaggccaatgtaaacacagcgttacccggcagtgcacaaaacaggcctcagtgagaaatctaccactttctacagtagccccagatcaccagacacaacacacttacctgcccgcatgacaaagctcaggcgtcagtgaagaatccaccacctcccacagccgaccaggctcaacacacacaacagcattccctggcagtaccaccatgccaggcctcagtcaggaatctacagcttcccacagcagccattgcactccgg

SEQ ID NO: 579820 - DNA, 223 bp, Homo sapiens
ctgatagagacgcaagagaaaaatccattgccttccaaagaagatgaacacggacgaacgcaagcacggcgacatcgtacatgacggcgtgcgccgccacatatgcactgatacattccacatagcattgccatcttattgtcacttcattttaggctgtactacactttgtacagatgcaacagagagtgggatcagagtttaaatagactgtgctgcccca

SEQ ID NO: 579821 - DNA, 212 bp, Homo sapiens
agatgttgcacagaacccagtatgtatgcagagtatgtacaaatacttgtgccacaatgactgcctcccctctagtctccacggcgatgatacatacaaccagatttgtatacacataggcctgctgtaggtcattttaaatctatgagggacttctagctttagtaagactaaatgctggcatgggtgcgcggggtgcacgtggggcatgc

SEQ ID NO: 579822 - DNA, 248 bp, Homo sapiens
gaaggcttccgaggattctggaaattccctaaggattttggcctgtcctctcaaactaaccaagggccctggctggtggccttttccaagagccggaaattggaaaaaagaggcattaaggcaggaattggaacccctttatggagacccccccccaccttaatcggacccccatttttaaactcttttcctcctcaaggccaaggaagtttgtatctgcctttagataagctcttattctttctaaa

SEQ ID NO: 579823 - DNA, 108 bp, Homo sapiens
ctgatctctgcactgatcatcccgttagcagggcgtctcttccattttctgcctcttccacaacttccttcttctcctttaagtcctggaggtgatcttctgcacgat

SEQ ID NO: 579824 - DNA, 404 bp, Homo sapiens
caggtggattacttgaggtcaggagttcgagaccagcctggccaacatggtgaaaccctgtctctactaaaatacaaaaattagctgggcatggtggtgtgcacctgtaatcccagctacttgggaggctgaggcaggagaatcgcttgaaccagggaagcggaggttgcactgagccgagttcgcgccactgcactccagcctgggcgacgagcaaaactccatctcaaaaaacaaaaaaacaaaacaaaacagatggcaaagtagatggtggatgagggatttgcagagacagtgcatgaagatgctgagaaaggagcagggggagaaaagcaactagagaaatttagagaaaaactgggtttctagagagataaagttcagcaagacaaggtagagccgag

SEQ ID NO: 579825 - DNA, 289 bp, Homo sapiens
tatacgcccgagatgttgctgggggggtgcgcacacctttaaacagccaggtctcgggggaactcgctgtcatgaggacagcaccgaggcgatagcagtaaacccttcctgagagtccaccccatgatccagtcaccattccgcgctggatgcatgcggtggggagcagggtgaggactgcaagtgtgttcagcttatttttcttttcttttctttttttttttttttttggaaaacagggtttctggctcggccgcccgggatggggggactcctcataaagtcaacc

SEQ ID NO: 579826 - DNA, 1538 bp, Homo sapiens
ggttagtattgcgggatactcatgctcgggcagatcccattctcccatgcatggtgccctaccattcatctccatggcactctctgggcacccattctgtacagggagtgaggaggcctggtctgcatcatcagtaatccaggatcctcccggtataccatcgcttgctatgtcggaggatcgtgacagaccacggcggatgagatgcgtggtggatgggtgagggatgcatcgaactgatggtgtgcggaggttctgtccctccctatgcctggcccttaatagtctcttgactacacctccacgtctctgctcaatcttggtcctttgcacactaatccccatgcgtacttgtcaccagtgcgtacttcgaccacaagtgcgcgaagcgtttaatctcgagtgtcccaaacatctcaaccactactatgagtgtgcaccttgtggctccttcggggagtaaaaagcccagatggtcctctgcaagcttagtagttttacaaagtcccgttgggactctttgcctctcgcactcgaggcgtgtatcgcttcaggcccccaatgggtgcgtgtcttagcatcctccaggaataggataagaccgcttatggtggaccaacgttgggtcgcgtgagggaagcttcgctgggctcacacaagttgtttcatagtgccctagtggatggcttcccacaatcgcctttgtcgcttcgcatgcattgcgtggcacgaagagacacgcggggcacaattccttgtcgccaacaaaccccataccaattgggcataggcccatggttgtccctcatccggtgcagttaagagggcgcactaagtcgcgcccgtggaagcgttaggctgttcttagacagtccctggtccgggggcttatagggttctctccacgagactttacgttgccacggcttcgagggtccttgtacttaccgaaccaccaaggaattggcctacagaccgtcttgtgggtggaaccctcttgggactcgtcgcggcgaggctcccttggctacatctagcgctggttcataggtgcccctgtgttgttgccatccccagatcgccctttttccccttcccttcgcttgacttcgcctgaaatatgcccctgggtctctagtcctttttactgagatgccaccagcatttcttctcttggtcgccgtggtgaccttctggcccgccacacaccttgtgggctgggccagttcaaggtaccccattccctggggaaagccaatcgttagtgcctctttgcgtgcaaactttaaacatctcagaaagcccattgtgcagtatgggcagcttttccacagaactgggtatatctggtgcaccacccgcaggtatcagaaatctctggcggctctattgagggttccccaacaggggccagttggcccacgggaataggcgctatggggcaagcgtctcaattatcgccaagcagtccattattacagagccgctccccacagcatggtttccacataacagtgttgtgtgagttattaacacca

SEQ ID NO: 579827 - DNA, 130 bp, Homo sapiens
gtggttgcggagacatgagggtacacatgagtagtactcctgtctgactgacggagacatgagggtgacacctgagccgggagcaggtcaacccaaggattgctgagggcaacagaggccacggccatgg

SEQ ID NO: 579828 - DNA, 1924 bp, Homo sapiens
  misc_feature (1922)..(1922): n is a, c, g, or t
  misc_feature (1924)..(1924): n is a, c, g, or t
gcgtgattcggtgctccggtcctttgatctctttggtcctgtcctacttggtgttggtgctagagtcatgtctagaagcttgatgtaccaatgcttgatcgtgacggctgactgcccatgtaggggcgcaggagatcgtagttgattccacatcaagatctagaacaacaatgccgagtcatgttgccctggtgtggcacgctggcacaggcgtaggagcagagtccgtcagcgaatccgtgtcgcaggtctacggaatgaagccgtcaggggtctctgagtccgggacaggctcatttgcgcgcaaggagtgtgtagtagcgcaaccacagttcctgcaatcgctacatgtgcacgtaatccattctcttgggaatagagtcgggtcgcccagttgagcaagcgtgaggggcgaaatgagtcgctggcctcccgctgggacacggacagggcatggtgtggaccgcctggcacggcactgacggagcaccgggggcttgcgtgggtgactgcgatgggaggcacttccataggtctgcccggggcccgcattttgccctgcctttggcaaggcacgctcccacaaattccttgggcccgtgcggcggggtgtcaccgtgccccgaggaggaggacagaagcacacggggcggttgagcggtcaccagcacagcaaagaggaccggttgcccctccgcgagccaccgtttcgtcacgttgaaccaaattaccgaagccctgcaaggatgttgtgaaccggagacgccgtttgtcgctgtctgttatgtgcgaaacgggaccttggacggagctctgtggagacgggctaaatgtccagcggagccattgaggatacagggacccagcccaagtgcgggagcaggttgggttcacagcaagagcatgtggtgtaccggggggtcgggcacccttcggtatcgcgtttggttccccatgggcttcagtttcattagagtccgttccacccgtttgacagaaaatggaccaggaaacctgcaggagaaaagttttcgccttcggggacaggtcaacgcggacgcataagtgtggtggctagtatatacgcaataggaaccctattggactgacccccaaatataaattgggcgcccaggtatggccaccatcacaaatattgtggcaactaaccacagtaatgtacggcggatagtacggcatgacggatacacattgggcgtaggtaatagccgggtgtcccatttgtgtggccctcagagtgcttggccctgtgtttgtgtacatggacagaacaaacgaccttgttatagcagtgggtgtcaacactctcaaaccaattgtgatgagagttaatgatcatcgttgtgcatatgaacacatgatctacagtggttatgaggtggtcaccacactagcgtgacaacaaactctcagaaagtgaccctggaccccacagcggtcgtctaccgtggcttatacccactggtagagaaaagaacctgcctttaaacaatgggggacagtcgcaatagaaacaaggcaatatctattatcagaaataaggcacaatagtcaccactgcccagcgtaacatacccctaagcgaaggcacacaagaactatttctattgctaacatccatactagaataacaaccacttatacgaggaagaagcacacaatcacgctatcaagcaaacactaacagtaacataattcccctaactaacataccgactcaaacttcctgcaacatacattaccaaatgccgacacaatgacccacacactaacgcaacaaccaaactgtatttgatagcaactcactctagaataacgatagatataactaactacgcagatgtaagaaccatcactgtgaataacactatttctactactgctgctttttactttccatngn

SEQ ID NO: 579829 - DNA, 100 bp, Homo sapiens
cgcgtccggcgggctgcggcggagcgagcggggcagcgctgcagaaggcggcggctggctctccgggacggtcacatgccgctgcagggtgcgggcggag

SEQ ID NO: 579830 - DNA, 1005 bp, Homo sapiens
  misc_feature (26)..(26): n is a, c, g, or t
  misc_feature (510)..(510): n is a, c, g, or t
  misc_feature (512)..(512): n is a, c, g, or t
  misc_feature (520)..(521): n is a, c, g, or t
  misc_feature (523)..(523): n is a, c, g, or t
  misc_feature (528)..(529): n is a, c, g, or t
  misc_feature (542)..(542): n is a, c, g, or t
  misc_feature (545)..(545): n is a, c, g, or t
  misc_feature (551)..(552): n is a, c, g, or t
  misc_feature (561)..(561): n is a, c, g, or t
  misc_feature (563)..(563): n is a, c, g, or t
  misc_feature (565)..(565): n is a, c, g, or t
  misc_feature (567)..(568): n is a, c, g, or t
  misc_feature (570)..(571): n is a, c, g, or t
  misc_feature (579)..(579): n is a, c, g, or t
  misc_feature (586)..(586): n is a, c, g, or t
  misc_feature (597)..(597): n is a, c, g, or t
  misc_feature (599)..(599): n is a, c, g, or t
  misc_feature (601)..(601): n is a, c, g, or t
  misc_feature (608)..(608): n is a, c, g, or t
  misc_feature (612)..(612): n is a, c, g, or t
  misc_feature (617)..(617): n is a, c, g, or t
  misc_feature (819)..(819): n is a, c, g, or t
  misc_feature (883)..(883): n is a, c, g, or t
  misc_feature (936)..(936): n is a, c, g, or t
  misc_feature (1003)..(1003): n is a, c, g, or t
tctggcgctgattatctgctgctgcngccaccgtgctgctgctctgcaaaattcagctgctgcctctgtcttgaggaccccagcgcctttcccccggggccatgctgcctgcagccacagcctccctcctggggcccctcctcactgcctgcgccctgctgccttttgcccagggccagacccccaactacaccagacccgtgttcctgtgcggaggggatgtgaagggggaatcaggttacgtggcaagtgaggggttccccaacctctacccccctaataaggagtgcatcttggaccataacggtccccgagggccagactgtgtccctctcattccgagtcttcgacctggagctgcaccccgcctgccgctacgatgctctggaggtcttcgctgggtctgggacttccggccagcggctcggacgcttttgtgggaccttccggcctgcgcccctagtcgcccccggcaaccaggtgaccctgaggatgacgacggatgagggnanaggaagannangcttnntgctctggtacancgngcgggnnacctcgggnantnannannaattttgnggggggnggctggagaangncnaggaaancctnaccangcccaactggcccgagtccgattaccccccgggcatcagctgttcctggcacatcatcgcgcccccggaccaggtcatcgcgctgaccttcgagaagtttgacctggagccggacacctactgccgctatgactcggtcagcgtgttcaacggagccgtgagcgacgactcccggaggctggggaagttctgcggcgacgantcccggggctccatctcctccgaaggaaatgaactcctcgtccagttcgtctcagatctcagtntcaccgctgatggtttctcagcctcctacaagaccctgccgcggggcactgcnaaagaagggcaaggggccggccccaaacggggaactgagcctaaagtcagctgcccccaagtcccanct

SEQ ID NO: 579831 - DNA, 717 bp, Homo sapiens
  misc_feature (26)..(26): n is a, c, g, or t
  misc_feature (573)..(574): n is a, c, g, or t
  misc_feature (580)..(580): n is a, c, g, or t
  misc_feature (585)..(585): n is a, c, g, or t
  misc_feature (592)..(592): n is a, c, g, or t
  misc_feature (594)..(594): n is a, c, g, or t
  misc_feature (598)..(598): n is a, c, g, or t
tctggcgctgattatctgctgctgcngccaccgtgctgctgctctgcaaaattcagctgctgcctctgtcttgaggaccccagcgcctttcccccggggccatgctgcctgcagccacagcctccctcctggggcccctcctcactgcctgcgccctgctgccttttgcccagggccagacccccaactacaccagacccgtgttcctgtgcggaggggatgtgaagggggaatcaggttacgtggcaagtgaggggttccccaacctctacccccctaataaggagtgcatcttggaccataacggtccccgagggccagactgtgtccctctcattccgagtcttcgacctggagctgcaccccgcctgccgctacgatgctctggaggtcttcgctgggtctgggacttccggccagcggctcggacgcttttgtgggaccttccggcctgcgcccctagtcgcccccggcaaccaggtgaccctgaggatgacgacggatgaggggcacaggaggaccgagggcttcctgctcttggtacagcgggcgggcccacctccgggcactganncaccanagtcnttgcggngnggcnggcttggatccaagtgccccattggtaactcctgatcactggccccatagctgacccgaggtccttattacccccccggcgcaatcagcctgttcctttgctaccatcatctgtcgccc

SEQ ID NO: 579832 - DNA, 154 bp, Homo sapiens
  misc_feature (132)..(132): n is a, c, g, or t
ccaccctgacctcccaaagtgctgggattacaggcgtgagccaccgcgcccggcaatatgtaaccctttcaaaatgaaaacaccagtcttagctcatgggctgtgaaaaatagcaacaaaacaggcgccggntcatacttggctggttccgctg

SEQ ID NO: 579833 - DNA, 132 bp, Homo sapiens
ctactgtaccattaattacagacacacacacacacacaatcacacacacaccccccgcacagagacacaccgttacatacacatgacatacacacattccactggctatacactgtttgtggaggtagcact

SEQ ID NO: 579834 - DNA, 228 bp, Homo sapiens
ggccggtaccaacatgcgaacggactgatccagtcccgggttggtgaactccttgcccgcgccgttcatgtagtcggtcagcggcaggatcttgccgtagcggtagtgcgtgccgatcaggtcggagtcgctgatccagccgtcgtagatggacttgcccgactgcatcgaggtctgcagcttctcgaccacgtcgccttcctggatcagtccgttcgccatttggtg

SEQ ID NO: 579835 - DNA, 1009 bp, Homo sapiens
ttgtctttttctttctgttttctctggctcgtttctgtggtctgtgtggctctctttttgttgatgtctccattttcgtgggttctttttgcctgtctctgtactatttcccttgctttctgcttttttctcgggaccgggcgttttggtgcgtctccctttttgtctctcctatctcggtgatgccttttgttggtgtgctttttcgagtttgtctgttttgttgcagccctatcctgtcctgtggtgtcttgctagttctcctctccgtctgtccctccagattagcgttggacttatatggcatagttgccaccacgctctgatcgtattttttatattttcttggtaggaggagtggggtctcgcattctttgccaagtcttgccttgaacttcttttgggcgtttttatcaatgctttctcacgttctgcctcaccatagtttcaaaggattatcatggtgtgagccattgcccccagtacaatgtataacagttttgtgtgttgtgtgttgtgtttttgtgttgtgttttgttgtctgacactgggtgtctcattctgtttgcccaggcagtattgtagtggtgcgaccatggctcatctgtagtcttgacttctcaggctcaagttgatcctctcacctcagcctcctgagtagcagcggttacaggcatgcatcaccacacctggcttattttttaaaactttgtttgtggagacagggtcttactatgttgccatggctggtctagaacttctgggctcgagtaatcctcctgccttggcctctcaaaatgttgggattacaggtgtgagccactgtgtcataacaattattctttaaaattctcttatttatttatttttaataattatacaagatggagtctcagtatgttgcccaggactggtcttgaatgcctgggctcaaatgatcttcatgccttgacccccctaagtgctgggattacaggcgtgagccaatgcgcctggcctataacaattc

SEQ ID NO: 579836 - DNA, 363 bp, Homo sapiens
gattgagagtgcacagactatggtcctgtatatcctaagaaatcaccccaagctattagaactaataaagcttagtaaggtggcaggatattagatgaatgtataaaaacaaattgtacgctgggcctggtggctcacacctgtaatcccagcactctgggaggccgaggtgggtgcatcacaaggtcaggagatcgaaagaccatcctggctaacacggtgaaaccctgtctctactagaaatagaacagaaaaattagccaggcttggtggcaggcatctgtagtcccagctactcgggaggctgaggcaggagaatcacttgaaccccgcaggcagagcttgcagtgagttgagattgcg

SEQ ID NO: 579837 - DNA, 1441 bp, Homo sapiens
tggggggggggaaaaaaagggggggagaggggagagagagagaggggagagagcggggattgttccaccaccccccgcgcgcggcggagccaccccgcgggggaggggaaaaaaccccgagggggggggagacggggggaaggggaactgtgggacactgggggggaagaggtgtgcagagtggtggggtgggagggggggagaaagagaggagagaggggtggggaggagacacgcgcagagtgggagggtggggtgggtggcagagcgagtggtggtggcctatatatattcttgtgtagaatgtgttatattagtttttcttaaaagaggaggggacctctccaaagagagggggagcaggaggggagagagggggtgcgcgcgggagggagaaaggtgggggtgtatatatactcccgcgcgcagaacacatagaagagggcccacagagcgggggacaacacgggggagaccgcggggaacacgcgcggtggttggtgcatgccgacccctctccacaaagatatatctcatcccgccgtggcgagagggaggagggtgtgtggagaaaaaaaaggtgggtggtgagacagagacacccaagagagggagagacgcacacagagagagatgaaaagaaagaggggggggggggaacacatgggcacaggagcgcgagaagagagagagacgcggaagcgaagggtgagggtacaacgagtgcagaccactaggggaggagagagacaatcacttgcagaaaacgccccgtagaaaagaagtgtgtcacccccaagatatgacgcaaaaatcaagttgtctggaacacaaaccgaggagggcggaggcaaaacgagcggtggtggtggaggaggccaccaccacagagaagacagagtcgtccagagagagccacagaacaaatgtgagttcccaacggcatcactgcggggaggaacacaacaccaacgggcgggcgatgagatgaagagttgggaacagagacgaagaagaagcatgggtaaaacacgaggggtgatcgccccgtcggcaccccaccgttgtcgagaaagagcaagagagacacacaccaccacagagaaatactcgaccagtcaaagaaggagggcggagcacaaaccgcgaggagacacaaatgtaaaagagagagcagtgtcctgggaaaacaaagcaacgcaagcggggggaaacacacggggacacagaagaacgagtctcacaagaaggagaacaagtgtgtgcgccacaacactgttgaggagaacagtactgcacccgcgagggagaacacacataaagtgcggcggagacaacccataccgtcgagcaacaagacgaggtcgcacacaacggcgcctgatgaggggaagaagcaacacaagagcaagtgaggcgaatcacaagagaaaacaagcac

SEQ ID NO: 579838 - DNA, 110 bp, Homo sapiens
tagctggccctcattgtgtgctgaggtgtggcctcgccgcagtgccgatacgggggcagagggtttggcacgcacagacagctcggtgcctgctccagacttaaactcca

SEQ ID NO: 579839 - DNA, 702 bp, Homo sapiens
aaaggggttagcgacgccattaccaaatcccggcaaaaaaaacccgccaattccaaatacgggattagggcatccactggccggcaatttgaatgttgaaaaattgggtcacatatttcccgggctgttccaaatcgggctcaaagaatccacccgctggcctccaaaaggctgggataccagcttaggccaacatgctggccttaagcacattattaattaattccttatttattaatttttttggagatgggttcaactcttggttcccaggctggagtgcatggttcaatctcggcttactgcaacctctgcttcctgggttcaagcgattctcctgcctcagcctcccaagtagctgggattataggcacctgctaccacacctggctaaattttttaatttttagtagagacgtgtttcaccatgttggccaggctggtctcgaacttctgacctcggtgattcaccctccttggcctcccaaagtgctgggattacaggtgtgagccaccacacccggccatgtatgcacattaatgtttgagaagcactattctagaaaacccagtctggctgggcgcggtgctcatgcctgtggtcccagcgctttgggaggccaaggtgggtggatcacttgagcccaggagttcaggatgagcctgggcagtatggcaaaaccccatatctatttaaaaaac

SEQ ID NO: 579840 - DNA, 390 bp, Homo sapiens
aggatccccccgctagaccttaacccttgtaaaagaattttaatttcttagatactacggaacactcaacgggagggagttgagggatctctggatggcagcctccagcttctaccccagcatccccacgcgcaggctcagcggctgcagcaggggctcctgggcccactcttccaggacacttacgagcagctgatacaacagattgactgccaaacatgccatccaggttgatttcaggcagcctctgttctaggaagacggtggctctctccagcgcagacaggatcaggtctgcaatggtggctttactttcagcagtgtccagcccaggcagtgaggaggaccacagcggtggcagtgctgtcagtagcggtaagggctcccggc

SEQ ID NO: 579841 - DNA, 374 bp, Homo sapiens
tcacgctccttgatctgccggctcaaggctgattgcgccacgaacgggcgctcggcggcagcactgaagctaccgctgtcggcgatttcgacgagataacgcagttgccgggtggagatcaagagtcatgcctttttgagatgagtagcgagcctggaagatattagtcgcaacccttgccgatggctaaagtgaacggcatctcaatagaaggaataagtcatgagcccggttgagctgatgagccagtggactttcggcggtattgattggctggtgatcggcctgggcgtgacggtggcttatatcgtgttcggcattgccgggttcggcacggcgctggaggcggggccgatcctgattttattcatgcc

SEQ ID NO: 579842 - DNA, 259 bp, Homo sapiens
ggacttgagctttgtctacgtggcgcccaccgccggagggcgccgtcatctctaggctgtgggtcctgctccctattgtggtaggagtggcgacgccagcacctgggtaattggacatcttgctcctgtgcttgcaacatcctgtggcttgaattggccatgaatgccatgcatgcccaatgaatgtggtgcctgttgtgcattttgcttgcattgtggactgattgattgatgcccattggtgtgccccattgtgacc

SEQ ID NO: 579843 - DNA, 184 bp, Homo sapiens
cactgcttcggatgctgggccttgtagatggcttctcaggcgtcacactcctgtatccaggaacgattggtagtgtgtgcactcaaagcagctgtcccgcgcacgtgtgctaggaagtctggcgcactggacagatcacgttgtcagccagttagcactgtccccaatccgaagcagtatgcgg

SEQ ID NO: 579844 - DNA, 688 bp, Homo sapiens
taacaatagacatttatttaaaggtaaaacatcttcagaccaaataattcttaaaatggttggtttcaaggtttaaccatcttcataacagcggcatccacagacttcaactacatgattacttcttggcccattcttctctttcttttctttcccgaataacctctttcagatacgggttcaagggtagaaattttcctcttcatattggggtccacgggtctttagagcaagatctggatgcttcaagtccaggtccagtgccctcttaaggcgaaacatccggtgcattataagggttctcaggaagtcttctttatgggctctctttatacatcttcatcccctcgatatatggtatcatctcgcatttaaccccagtttatggaactccgggagcatggtaatcaccatttcggaataccattccagccacttggcctgtgagtgctgaaacgggccgtgctttaccgagccctgtgtaccgagcaaccagtggcggggtgggcaaagaaccaagcggcctatacagaagggcgggcaaacaagggagccaagaaagaagggggtggactccattttctaagaaagcatgggcatgatgtgaaagcaccggctaggtccaatataagaacatatggaaagacgctcgtcaccaggacccagggaaccaaaatggcatctgagg

SEQ ID NO: 579845 - DNA, 317 bp, Homo sapiens
ggccttacctcggacttacctcggagcttacctcggagccttacctccggagccttaacctccggagccttacctccggagccttaccctccggagccttacctccggagccttacctccggagccttaccctccggagccttacccttgtgaggtagagaggaggctcctcgagggaatgatcacggcagcctgatgtgaagaaaagcaaagccctgagagaggttggggcccagatatgaaatgtgggggagatcaaaggctttgagtgggagtggccacatggattgggaacaccttgcaggccaggaaccagg

SEQ ID NO: 579846 - DNA, 256 bp, Homo sapiens
  misc_feature (166)..(166): n is a, c, g, or t
  misc_feature (182)..(182): n is a, c, g, or t
  misc_feature (242)..(242): n is a, c, g, or t
tacgttcataagcaccgctacagtggcaggacagctttgcaaatgagccgagatctttctattcagcttccccggcctgatcagaatgtgacaagaagtcgaagcaagacttaccctaagcgaatagcacaaacacagccagctgaatcaaacagcatcagtaggntaactgcaaacatggnaaatggagaaaatgatgggacaattaaaattattgcaccttcaccagtaaaaagcttttngaaagcaaagggat

SEQ ID NO: 579847 - DNA, 104 bp, Homo sapiens
  misc_feature (30)..(30): n is a, c, g, or t
  misc_feature (55)..(55): n is a, c, g, or t
aaaggggtctcagctgcccgaccggactgnacgtctccggggaaccaagcatgtncaggagaaagagaactagtgctgagggcctcaataaaggtgtttatgac

SEQ ID NO: 579848 - DNA, 862 bp, Homo sapiens
  misc_feature (550)..(550): n is a, c, g, or t
ggaccccgtgccaacaccagggggcacagacgcactttgtagccgagaatgtgggagaacttggggccccccccccaccagaaagtggacagacgtgttcccgggacgccgtggaccgcgtctgagacctcctccccagcccttccaaggaactgggatgataatggagactgtcaagaagggggcaaatacacacaagggcagagatagccctgtgagccagtctcagctcacagactgccgcccccatttcctgttgaacccctcctggcccccccttgattcccccttatagggtaccgacccgtaccctgcccccggagctgcgttgctaatgttcctaagcctgccacggcacgaagacctgtaaggggcactctttggctctcgcgggcactctctggatttatgaaccactgggctaccacccccactacccgctggtataaaccttttattctcacgtttgaaaatcacgctttgttgttccagcaagaaagatgtgcctataaaggtataaatgggagaatgtttgtgccactcgcttggnttgttgcacgcttcagcacacacatgtgacaccaccaccaccaccactacaccaccaccaccaccaccaccaccacgagacaccacttcttaaaggggaacccacaccaagtattgccccttaacccagacttccaagttttctgctgtataagaaagctgtaatatatagtaaaactaaatgttgcgtgggtggcctgagttgaagaaggccaaggcttgtaaatttaccccatgccgtttggctttttaaattattttgtgcctatttatggataaatattaccaattctaaaagataagtgtgtttcca

SEQ ID NO: 579849 - DNA, 334 bp, Homo sapiens
  misc_feature (54)..(54): n is a, c, g, or t
  misc_feature (62)..(62): n is a, c, g, or t
cccagatttggttaggaaagaccactaatggcctctttcttgctcattagcccntcattctncacatcagttgggatctcctcactttggggaagccagctggcatgttaaggagccctatggagaggcccacatggcaaggaactaaggcctcctgccaacagccacgtgagtgaatgtggaagtggatcctctgccccagtagggccttcggatgagatcacagcccagtagacatcttatgtgcagccccatgaaagtccctaagccagaaccaccagctaagtgactcctggattcctgacccccagaaactgtgtgagataataaatgt

SEQ ID NO: 579850 - DNA, 503 bp, Homo sapiens
tttttttaatttgagacagcattttgcttttgttgcccacgctggagtgcaatgggatgatctcgactcactgcaacctctgcctcccaggcccaagtgattctcccgcctcagcctcccgattagctggaaccacaggcgccaaccaccacacctggctaatttttgtatttctagaagagactaaaatataatctacaaaatcaatttctccaaaactaattagaagagacagggttttgccatgttggccaggctggtcctgaactcccgacctcaggtgactggcctgcctcggcctctcaaagtgctaggattacaggtgtgagccaccatgcccggccctaagtgagattttttttttttttttttggagacagcgtcctgcacgggttgcccaggctggagtggcatgggcacgatcttggctttactgcaaactctgtctcccaggagttcaagcatttctccctgcttcggactccccaattaggctaggatta

SEQ ID NO: 579851 - DNA, 622 bp, Homo sapiens
aaaacgaaaaattaaggctagtagaggccggtgttcatcggccgagatgtgcaagtctgtatggtgatcctcaggatctagaattagaaataccatctgaccgagaccatcccattactgggtatatacccaaaggattataaatcatgctgcgataaagacacaagcacacgtatgtttattgcagcgctatttacaatagcgaagacttggaaccaacccaaatatccaagaatgatagactggattaagaaaatgtggcacatatacatacgtggaatactatgcagccataaaaaatgaagagttcatagaccttatgtagggacatggatgaagctggaaaccatcattctcagcaaactatcacaaggataaaaaaccaaacaccgcatgttctccctcagaggtgggaattgaacaatgagaacacttggacacaggaaggggaacatacacacactggggactgttgtcgggtggggggacgtgagagggatagcataaggagatatacctaatgctaaatgacgagtataatgggtagcagcacaccaacattgcacatgtatacatgtgtaacaaacctgcacgttgtgcacatgtaccctcaaacttaaag

SEQ ID NO: 579852 - DNA, 803 bp, Homo sapiens
  misc_feature (671)..(671): n is a, c, g, or t
gaaaccttaggctgcggctgcatgtgtgcttggagagcccccttcttccgccggggcgggcaagcagtctgtaggactgtggcacaacgggctggtggcgcaaggagaggaactcgtagagcagcctccatggcgtcacacaggtagggctggtgcctgctgctctgcctggcgtctagtctggagtcagcagcaaaccaatgccctcaccgcagcagatggggcagtggcgggtcagtggacgtggtccctagactgcttcctgtgcgaacgacgtgtgcgcaccgtggatgctctcgccagcgtgtgtaggacaagggcacagggcctccctatgtgctgagagcaggtgccagtgctggacgatggctccctggtaggacattcagcgcgatttccaagggggcacagctggcccaatgatgacaccaactattatctcttgaggcctcagtggacctggtccagattccccagtgcgcgagggcttgctccatgctgactgcagtgggaaggaggtgaccttgtgagatctcccgctactttctccagatgactgagaccacgtgttcagacagcagcgttggttcactggccaacgtgcaggtctctggagggggacctagcttctccttgtgtgatgaacgactcccagggtctgccaacgagtngaggcgctctggccacccgaggctcgaaggttgccactgagcccccaggggactgtgcgaactgcagtggagtcccaggtgatgacgcagacccaatccctgagcttcctgctggggtcctctagctccttg

SEQ ID NO: 579853 - DNA, 91 bp, Homo sapiens
ggatttgctggtgcagtacaacaggcttaatagggacatgctcagagaacaaacttgacatccaggaaaagaagttgataaatcaaaaaaa

SEQ ID NO: 579854 - DNA, 905 bp, Homo sapiens
ggcataaggagaaggtcgaggttgtagaagctggggtggccggaagtgtacgcctcatcggtgtgtcgtgggctttgtgcggctcgcgatgtcctctgctcatctccactgcgtaaagggagggaggctgcgaccgtcgtaagcagggagcctcggcatgtccgctgttaggtgtccaggatgacttgcaaggccacattagagagcgttgcttcgtcaaaactatgctggatggctggagcgagcacatcaagtatgttagtgcctcgatgcttcctagagcttggcaacggctcgccagatctggtcactatgtatagcgttcttgctgttagtagacatgaggagggggatcatgttcgagaatagagcaaacagcgtgttgctttatcctttgaggactttgtgccaatgcctaaacggtacacgaaggagagcacgcgataggatgcggatggttccctggcaagggtactgaaagataaggcagggatcattgaaaggaggggtagtatcaaacaggaaacgcgtagatggagtgggggatgggctgtgacggacgagggttgagtacaacaatgtccccatcaccgcatcaaatatcttagaaaagatggtaatggtaatgaacacaataaccaagttttagcaatgaggaaggaagaaacctaaaggggaagcaacgaagtatcgctcaggaagtgaagggaattgttgggatgaaggaaaaaaagagaaatgtagggagcatggtttattaggctacatcatggaggctgagcctggctaggtcgcctgtgataaattggcgcagggcaaagtaaattaatggttttttcccaaaaattatattccaacaggttggggaacttttctaggtcgttaattcaggggttcccaaaggt

SEQ ID NO: 579855 - DNA, 1306 bp, Homo sapiens
  misc_feature (769)..(769): n is a, c, g, or t
taaaaaaacctcgggtcctaggggggggggggggtataatcctaagtggaaatgatttcatttacggggaaaggcccttggtgagaatgtaggccttaatttctcttggttcctttccgtgtacaggggaggagaatttggaatgtaagatagagaaccaccggaccttggagattacctcccgggtcttgagaactcaagatccacttgtagagcacttaaactctgttggacacaaacacgagacacctctatatatacgcggtgctgcgcacccatccggggaaatgtgtcctctgggtatccgaaactatccaggaggtccctgtaaaacacctctatatgtgtgtgtggtatatatgcggcatctccctaagaatataaggaatttggcgcgctgggttataccccctctagagggtgtacacacttgtgtcccccggttggggtcccaagatgttaaatgggcggatcccaaatgggggatgtatataagagacactgtacgccgcgccttataagagatcgtgggggagaagaaaaggtctcctaacaacggccgatgtgcaacccgtggggcctccgaggaccacagcgtatcggggtgtacaccccccggggagtggtgcgcccaagccaggcgggcaacacaaaccgggacgaacaacgggcgcgcctattaacaaccgcttgtgtagaaagaacgccccggcccactcaggagaggcggggggcccccaaaaaacgctcttatggggaagatcacccnccagaggtgtgagcacccccgggagccacacaaagacgccttgcagcaccagacaggagggcgccactcgggagaaccaccttgcggcatcgagggctccccccggaggaccaccgcgtcgggacagaacacagcacccggccgcccgagaggagttaagaggcgccacaaggacatgacgtctagcggccacacacaccaccaatgtctgttagggaaacacccccccacagaaaggagggtccaccaggacgaacacacacccaaaaaattgtaacagcagcgcaatagttggagcgccaatgaggcagcccgccacacaacgccgcctataaaagcaccaagatggggcggcctcccagcttgcgcccccacgaacaagaggcgctatagtctgacgctaggagcgcaccacagacgtggtgccccccccccatggtggaggtgtacacaaaagcgcgcgagagaactaccacatccccagcggagaccacagaaaccccccccaggggggggctcgcactctcaacactcgcc

SEQ ID NO: 579856 - DNA, 164 bp, Homo sapiens
gatgagctggtaccgcaaagtgggatttactggaggtggtagcaagggttccaagaaaaaagtaaaacttgctgctgatgaagatgatgacgatgatgatgaagaggatgatgatgaagatgatgatgatgatgattttgatgatgaggaagctgaagaaaaag

SEQ ID NO: 579857 - DNA, 301 bp, Homo sapiens
ggcagtcatcacacatctcatgttgatgaacagactcaggataccagtttaaaatagaatcttctctcttggcaaaatttggaaggtatttttcagttgcattttgttgggttttagtattttggtaatgactattagttatagtttccttacattctggcatccttctttgtagccagttgtcttttcagtttacctttatttttttttaagacctgatgatatatgttcattaacactgccatagctcctggagttggattttcagtgacttcattgaaaattaaaacgtttctatggc

SEQ ID NO: 579858 - DNA, 910 bp, Homo sapiens
gagagtataccgcagacatcatttctactacagtggcggagccgtacaggacctgtttccactgcaggggatccaaaacaagcccgtgaagcagaagccagagcaacagtagccgaagatattgttctctccctctggcgcccacttgcccacgcaagcccagagtcccatttacatctttacagagcatcgtgcatcaagtcaccagggtgtatccatatcaagctgaagattagtttgtacatccttgttacagggatctcctccttccagtgccactacagggaaagtgcatccactatgtcagggctcaccgagaacgagaaagtgctggtgggacaatctcttcttgcccctaagatctcacggatggaagtccccgtaaattgggtccttggccgttcaaaggtgtctaatgaacctcgccaaggaggcataatggtggtcaccaatagtaaattactgggccaccctaaaaggatgaatccacgttacaagagacctcctcttgaaacgacaatcccttgaaaactcaatgtttaaggctgtcccatagtctggggtctgtatccgacacgctttaggagctgccgcaggcttagtcataactggccaggaccgatgctcaatgtcctgcctgatgattggagataaacacttgtgcattggacgacgcagaactaccttattgagtctgagagtcttaacaattcactgaaaaggacacatcatgttccattgataatcaagatacccggatactgaaaaggggggtacccttgacaaatcgacgaataactgttccacaatagtaacaagaggcgaaaggaaggataatacgagatgaacgaacaatcgtaaagataaggctggacaagacttacacctttccactctacacattaattta

SEQ ID NO: 579859 - DNA, 531 bp, Homo sapiens
ggctgtgtgtgaaaaatcaaggtagagtctgtctttcactaggcccacaggtgacgtcagaatggcatggaggccagatacaatgccgcgtcactctacagtgcagtttggagaatacacatagacccggatttacgcatctctggtctgggaggccacaagctcagaacacaaatctgacaacaaggaagcatgtgttcccaaacctgtcatgaccatgggcgaaaatgaccagcatgcgacaaggcaagaatatgtatgtcggcatgggatcctcagaacttcgcgagagaatatgtatctgggatcctcagaacttagcgagacgaatatgtatatgggatcctcagaacttagcgagagaatatgtatatgggatcctcagaacttacagagagtatatgtatatgggatcctcagaacttacagagacccctgcacatcaatgggccaggcatgatgccggcactaggagaggagcgcgtgacgaccgttcctggcaaacgagccaaaaacggccagaacaggaac

SEQ ID NO: 579860 - DNA, 1285 bp, Homo sapiens
  misc_feature (258)..(258): n is a, c, g, or t
tttctaggaccatctcggtttggtcgcgcgggccctaggctaggtaaggtgaacagtgagtcagtagtctgttttcctatgcgcagatcgctgttctaatgactagctgacttggagtttgctcgaccaatagaatagaacgcaccgcggcagtggaacctagacgttcatgaacaaagtccgagcatggaagattcttgtcagtgttccagttactgtggcagtctaatcaagcccaggcagtccaatgtcgtagcntctgatgagtcgaaatttactgcactcgcgaacctttgaagacaccaaggttatccttttaaaggaaaacggctcaggttaccaggggggcctgagatgaccaaacaagtcgacgtgccacgtcttgccacccacttctgacttggcacaacgccaagcaaggcgccgacacttgcacacttttcacctgcactaccgtccaggcttccccacagcgtctcacacacgctcaagacaacgttggtgccacaagctgattgccaccacacacattggttcctagttaacgacgcgcccccaactccggggcattttctccaccccatattggacagtcgcagtccaatctctgcaaaccaacctcaccaagctagcgccgaattcccaacgtctgcagccatcccttccagacggggcctttgcaacaacggccctgggctgcggactgtccaagggggatccccaagggtagtggccccgtttagttataagcagttgggggaaccgaaggcccaaccttcctaagctcatataggtgccatgcgctggcgcaccgggggacagaccggccagttggcccgctcctcaaacgccttcccaacgcactcagtcaactttgaacccgcgtcaacaggcacacgagcaccgcgccacattggcttggaaccacaacaccttcccgttctgtacaccggctcactttacctttccattgtgagccacaacacggtcccgctgtcctccatatgggccgcccccccattgcgctcacgacgagctcgggcactgaacctaccacaagggggctatcttacccccagagcaacacggaagaaatgagaactcggttctcctaatcacagcctcaagtgggccgtctgtgcgcttatcgcgacgtcttcgccgactcatactctcgtgacacttggcgcaccgagatacagtcactcacgctgcgcacgcttggcaacaactcgacgtttcgcacactctggtcacacgctgacaatctgctcacatccagtaa

SEQ ID NO: 579861 - DNA, 270 bp, Homo sapiens
  misc_feature (225)..(225): n is a, c, g, or t
tagatgctgatggcaatgacacaattgacttccctgaattcctgacaatgatggtaagaaaaatgaaagacacagacaatgaagaagaaattagagaagcattccgtgcgttcgataaggatgacaatgactatattaacgctgcagaacttaaccatacaatgacaaaccccgaagagaagttaataaatgaagaagttgatgaaatgatcaaaaacgtagatnattgatgacgatggtaaggtaaactatccagcgttagcacaaatg

SEQ ID NO: 579862 - DNA, 115 bp, Homo sapiens
  misc_feature (57)..(57): n is a, c, g, or t
gctctctccaccacctggtgacgttcttgacacgccagacggtgttttcatctctgncttcctccacagaccagcagcaaagtagatggcacagagaggacactgcaaatagtct

SEQ ID NO: 579863 - DNA, 118 bp, Homo sapiens
tgatgaactggcacaccgccaatcttatctacttcatccagaaagacaattccttgttgtgctttttccacattataattggaatctgggaggcacgagaggtgtaccgagactcgaa

SEQ ID NO: 579864 - DNA, 894 bp, Homo sapiens
  misc_feature (48)..(50): n is a, c, g, or t
  misc_feature (55)..(55): n is a, c, g, or t
  misc_feature (57)..(57): n is a, c, g, or t
  misc_feature (60)..(60): n is a, c, g, or t
  misc_feature (62)..(63): n is a, c, g, or t
  misc_feature (66)..(66): n is a, c, g, or t
  misc_feature (70)..(70): n is a, c, g, or t
gtcatgacggagggtgtgaagacgctagtctggacgacgcagaaaggnnngtgtnantgngnnctnctgngggtgctggggagtcggaagagcaccatcgtcaagcagataagatcatccacgaggatgctactccgaggaggaatgccggcagtaccgggcggttgtctacagcaacaccatccagtccatcatggccattgtcaaagccatgggacaagcctgcagatcgactttgcgcgacccctcctagatgcggacagactgccagtgcagactatttgcactgtcctgcaccgccgacgtgagcaacggcgtgctccctgatgacctgtccggcgtcatccggaggctctgggctgaccatggtgtgcaggcctgcgtttggccgcgtcaacgggaagtaccagctctaacgagctcaggcttgcctactacctgaactgacctggtagcgtattgcatcagagtgactacatccccacgatcagcaagatgtgctacggacccgtcgtatgagaccacggggatctgtggagacacagcttcacccttcaaggacctacacttcaagatgttggatgtgggtggctcagcggtctgagcggaccgaagtggatccactgctttgacgggcgtcacaggcagtcatcttctgcgtagtccttgatgcgcctaatgacttggctgctagctgcaggacgaggacgatgaaccgtatgcgtgagagcgtgaagctattccgatagcattcttgtacagaacaaaggtggttcacaagacagcgtccatcatccttcgtcctcgacaagaaggacctgtttgaggagaagatcagacacagtcccttgaccatcttgttcctgagtacacagggggcaaaatttatgagga

SEQ ID NO: 579865 - DNA, 241 bp, Homo sapiens
gttaggacctgaccctgtagcttccactgtttgctagtggtatgtctatgtctgagtttgcaaactgcaagttcttgtccagttatctttttttaaaacttggatactttcccaatccaatcgctggtttggggagccactctcagtgcttgtgagtcctcctctgccccagggcaacttagggacctcggcaggcatcggtctaggcagagagagaggcagcttccgatgacctccactc

SEQ ID NO: 579866 - DNA, 199 bp, Homo sapiens
gttatgtgtggtgtatgccaaagctagaggtgcattacattgccttaagagtgctttggaaaggttcttcgttatggcaaaatcgtctcgcagtaccttcttgaatgagatggaatcatcgaagggtttaagccttaagatggaaggggacttgatcatcattatagcgcgaaagtcctcggcataacaccacacaatt

SEQ ID NO: 579867 - DNA, 301 bp, Homo sapiens
cagaggcacacgagcgaaactttactccaaaaacataaaaaagagaataggttaaaatgggaacccttgttaagagggagggtcgtgtgtgtggggaatgtcactttgcttccggagaggtactagggtgctcaagcagtctctgcaataggatggggtcccctgtctttcctatcccttgtctgatcagccctaaaatttactggtacagagacgggagaaaggaggggtgggtgcacaggacattgtcggagtggggaaaactccgtgcaattatgttggcctcgtgggggtaccccct

SEQ ID NO: 579868 - DNA, 851 bp, Homo sapiens
tggctgagagttggtaggctgggggttatcacaaggacacatgcaacatacaaatgcttaaaatacactgttgtacaccagatgctcacagtttacgtagatgatgatcctactttacatggcaatgacaaatagagatactttgactggtgtgcaaagatgtgtagtaacacagaatgaggaagctagcaagcctcccctagccctactaggactatagacaggcctttcaagggtgacgtgagagtctactagcgtagagaagaaagggaagaggcaacagtattcaggatagatgggggagcgcggaagacactgcaagatgaggaaaccagattagcaagcctatgaattctctgaactgacatgctgacactataagaatgtacaggtgatggactttccagcatagcgtctctagcacaagaacgttgcggcatgggttcggtggaggaaaagggacgtgcacatcgatagaaccacacttgcattggtattcctcatgcgtaaagggcccaattgctgatacctaatcgacggctgtgccgtaccctagtgtgcgcgtgaacggttgctacggacctcgaggggcttgagctgggaagccacattgaccaaatatgccaatccaacatggattcgaacggcggtcgccactttaacctttagtcccaagggaccaattctcacgagggttaagaacgagagacaaacctctctcaaagcccccttggtaaacgcctccaagcagggtaggatatggccacgggtgcaggaattatggcaagaatcatatacaccacttggcactacttccaagacttcaatagagaattgtaacaggtccacaa

SEQ ID NO: 579869 - DNA, 285 bp, Homo sapiens
tgtggtcaggtgatataatggatagaggcgtctaaagaactcaagagaatcactggattgcggaatcttagcattgtggagtaaggacatgctatactagcaggaagctgttggtctttcaacatcagttcctgatatagagcagtgaaaaagaccatcatctccactcctatcaacaaaaataggtcatataagctactataccgttctagtctctcagaaactcttcacagagctgacattgtacaggaatccaagctcgctaaattccaaaaaggaatcagc

SEQ ID NO: 579870 - DNA, 752 bp, Homo sapiens
aagcaccatcacaattcagatgatgtaaccacgttggtcgacagcgaagatgggcctaaaagtaccacacaatagcgttcttatcagcggtgaagctacagtctgctctgtgagtgccgtgaactactgtcttgtcgttgacgcggtgtgatgtgggtatcttggcccggaagctgaagttcgatctattactactcgggcgctgctgtctacacacgttcagatgtgtattagcgttacatgcctggtcaatctcagagagcgaaggggcttactatagttaaattgtgctaatatcagttaggaaaatgcttgtcatgttgtggtgaaatcttgagtttgtgtagcaatgcctgggacatgaacgggccatacaaacagaggaaagctctggggcttccaggcaatggccttgtgtcgagtcatcttacaagtgtccatcttgaacatcattaaagtggatttaaaaagaagtagcagtgccacagtttatcaccaagaacttattttaatgggacatgggtctaatgtcccttcatgcaacaagacagatgaacaaaaaacaatggtcctaaatagctatgagtgatcttgtatccagggtggaacacaacagggcatgtgtactgtcatatatctcttagatgaaatcacacatgttgtgaaggtagaacaccgaagcccaagcaggcttaggtctgccacggacgtttacgccttagcttgtgggctatccgtcccctgatgtgcag

SEQ ID NO: 579871 - DNA, 1119 bp, Homo sapiens
  misc_feature (343)..(343): n is a, c, g, or t
ggcagagggactctgcaagcgatgtctgcatcgtgcctgtgccagagcgtcacctgtctgactgacgtgtgagccgcgctacacgctgctggtggcactgccgtgctctctgccctgagcgtgagtgctggcgcctactctaccctgttctgtgtgcatcacgttcacagcggctggcactagcacatgagaattgcattggaacggcctaccatggctcgcacgtgtagtaaggacgtcagtcgacatgcgtaccctactgatcttaatacccagatcgtgcgaggtgctgatcgacgcggtaccagcttggtgtacccgagctggttatcggtgttatcantctttatataggcggcttgtctacctatgcctagcgcaagtccgaggcgtgcttgaggatccagtatgggccacaacagtctttgcatgtggcatctatcctaggactaactcttgccatgcgtttgatcctatcttgcagtctagtcagccaggaactgacaacgggtacctcttacccttgcgactgttttcacttcattgttgccttgtcggccgttctttagctcgtagtgcagctccgatgcttggctgctgcggctcttcaatgacccagtggtcatggtgctgctgcttcctcagtatcaatctcgctgctggcgccagtcgctggggctggggttgctgcttctcttccagccgtggcacgtcgtctgttgaagatgaatgtgctgctcttcggccctgggttacgtgatcttctcctcgacacgagttaggcttccggtggcggcccttcccaagctgcggaactctgtgctggccttcacgtgggtgcgtgggggtttccttctggtcgggaaaccctggggtactgtccgccctttgaccttgtgcgcgcattctgcccctgtggcgaacgtgggccttccaaggggctcgtgtcaacgttcccgggcgtctgtgggcccaaaccggccgcggttgcccctcaggtgcgtcacaggagcaatttccggggagccaccgagaggacgccctttccaaggtacctatcccaagtgtatcctccaactgttaaccctggatagacaactcgtgttgtatcaccatatg

SEQ ID NO: 579872 - DNA, 562 bp, Homo sapiens
ctggtctttttcagttggttcacgtgtgtccagctttcttcttcgggtttatttcggttcctcataagtatggccaattgtctaccctgttgcttcagcccgtttcatcgaattcccatctcatttccaggctcttcctatgacaatccgtgatccattcctcctgggacattcggggtgcccaaccaggactacgaattccaggccaagcaagcttgctcacactggacaccacctctatccccctgcgcctctgccctgtcgcctcctgcaccggaacgcccgcctgcgtggccggctgacgagggcgactgctgctgctggtacgctgcggctggaccagcctcataagaggatggtctgtgaagtcggaattcgtcttctctgagggctctgacggcatctcggacggagagctgcgatgggctggcatttgtgaactgaggacatcgtggcctccaaggggatccggccttgggcaccaatctgcctgtggagcttggaggcagacgtgagggggccggggcagcctagatccacggatggcagtggtggtcctggc

SEQ ID NO: 579873 - DNA, 894 bp, Homo sapiens
cacggtggctcacacctgtaatctcagcactttgggaagccaaggcaagaggatcctctgaacccaggagttcaaaaccagcctgaccaacatagtaaaaccccgtccctacaaaaatcaaaaaagtaacaaaaaataagccaggtgtggtggtgggcacctgtgatctcagctacgtgggaggctgaggcaggagaatctcttgaacctaggaggcagaggttgcatgtgagccaagattgtgccagcctgggcgacagggtgaggctcttgtctcaaaaaaaaaaagtccacatcttcatgaaccctcagactctggagtagggtgtcggcattgtttagccagctattgtgggaatggccttggacctattaaaggacggaaagtgggtaatggatgtcccaggcagtcaagagactgggatatcccccgagaatggcttgggttacccagctatggacccttggaagatgaatctaatccttctcactgggtggagtctgtgcaaagtcatttgcttacatttatgctaatagcagataaactctatattccatgtgctcacagggcccctgggtagacaggacccagtcttgatttccagagcagacaataggcgaccgaaacacagtgggcattgatctgtgcttgagtcccagacaaacgtgtccattacatttaccagcatttccaaaacttgtgaaggcaagaacaaacggtagttgccataaagaggtttaccaaaccaactgtggcagttcagactattaacaggcagaatcaagtgacacagagaaacaaacagcacaaagacatgctggacgcgagtcgcacgcccaccataaagccaacgtcacgaacaaccactgccagtagcgcgccggcgagcccca

SEQ ID NO: 579874 - DNA, 107 bp, Homo sapiens
tcaagctcgacgatcgccgctacgcctcgtctacgacgccgacttccaggtgctggccagcggcaatcccgacatgatctgaccgcgacctgtcgtcgctgtccgga

SEQ ID NO: 579875 - DNA, 678 bp, Homo sapiens
  misc_feature (188)..(188): n is a, c, g, or t
tcatctgtggccacgttatctcccgagatgcactccataagctcattaatgggaggaaaactgaagtgtccctactgtcccactggagcacgaactccggcagattgggacacgcactcatattctgattcctacctcggagaggaaatcttgttgaaaaggggttcttcacactgtgagcgcttggntctgtctccggtaagggtgtgtcaaacttccacgtggagctgtgtgttggtttccacgaacgcctcggctgtaggagcttccacctgaaggggagcacactggaggcagccctttggcacgaaggctgaggaagggagatggtacccagcccacgcctggcacctcggcatccactggcataaggaaagggagatgctggcctctgtgctcctgctgtcttttcctgtttctgtttgcgtttgacttagtagccaccgacagagctggcaagggagtttggtcttcagccgtagagcatccttccacccctgccctcagcccagtctcttgctgccatgcccatgctatgtccacccttgcccctcggcccacagagtgtccaacggtggcccacctcttcctcccactacagcctcacacagtatgtaccatctccccctgtaaatagtccccgttagaacggatgccgttgttttataacctttgaga

SEQ ID NO: 579876 - DNA, 233 bp, Homo sapiens
tccccgcgcgtttgcgtgtcacttagtgggcgtttgcgtgtcacttctaggggatttagcggggtgatgcctgttggagggccagtgccctcctaattgtgggggtaagggctacgctggagtgctaaaaggctcacaaaaatcctgcgaagaacaaaacttctgaagtaataaatatgattatcccgtatcgaacgcctttttggacaggtggtgtgtggtggcctcggtat

SEQ ID NO: 579877 - DNA, 438 bp, Homo sapiens
  misc_feature (310)..(311): n is a, c, g, or t
ggcacgagggggactaggttttgctatgttgcccaggctggccttaaactcctggcctcaaggtgatccttctgtcttggcctcccgagtagctgggaccagaggcgtgcaccgtcacacccagcttcaagtctcttattataaagttctggccacgcacagtggctcgcaactgtaatctcagcactttcggaggccaaggcggtcagatcacctgaggtcaggagttcgagaccagtctggccaacatggagaaactccgtctctactaaaaatacaagaattagctgggcatggtggcacacgcctnnagtcccagctactcgggaggctgaggcaagagaattgcttgaacctgggaggcagaggttgcagtgaaccaagatcaagccatttgcactccagcctgggcaacacagtgagactctgcctcaaaaa

SEQ ID NO: 579878 - DNA, 474 bp, Homo sapiens
gaggtgacttaatcagaaacacacaatttactggcacccccctttgtccccagtccctgctcctcgaacctgctcttcctctttccccctttccctccctttcactttcctcccctccacacaccctcctcccacctctgactcccaagagaagacccgggacaggccagaaactggagtgaggaagaaagaaccacagaatattaatgtaatgaataactttcaagtcctatctggtccgtgtcctggcaaagtcccttggggtctctcccctgctttccgttcatcaggatgactgagctcagtaattgtaacaaagggagtgtagtaggcaaggggacaaaacccatagtatcccacccctgattgacttattaactcaatgaacacttattgaatacctacgatatgccagaagcagttccgggtactggaaatacatcagtgaataaaacagccactcatcctagtaaa

SEQ ID NO: 579879 - DNA, 230 bp, Homo sapiens
cctctatacgggtgagtggtcacgctgtatcccaggcactttgtgatctgaggcaggtggagcacttgaggtcatggagttcgagaccagactggacaacgtggtgaaacccctatctctactaatagaatacaaaaattatgccggtgcaatgtggcacatgccctgtagtccccggctgatttgggaatgttgatggcaggtagaatcacattgaaccccatgtggct

SEQ ID NO: 579880 - DNA, 655 bp, Homo sapiens
tctcaaaaaaaaaaaaaaaaaaaagaggaaaaaagaaaccttaagtttccgccaggcttgtgaagtaagaactctgctaaagaggaaaggggggttcatcatcatcctcctcagctgggtgggggtcagtgggaagtgctggtcacggggatcgggtcccagtgtctcagacttggcccaccagggaaggccttttacacctacccaaaagggagcgggagatgatgtcagacggaggcgtctgaggagatcctcgtgcgatctggttttaagctatcaagttggattccacgcttaacaggtgaacaatgatcagcaagtggctcggttggaaacacctaggtgggttgggtaaaaaaagcgggaggctgacaaggtggggggtataaagacacagtcgaagccagctggcgggattccaacccccctctcacaggatggaaccgcgcgtggatgggctcaccctctggtgcgggcagcaatgtgcaacgccagggggggaacactatcctcacaggtttaaacttagcactccaaaaagatccagagtacacctcacttgagttgggtaaggaccatttcggacctggggatccccgtgatcactacccaggacagaaatactatcagtgtggaccccaccggcacggtgtgt

SEQ ID NO: 579881 - DNA, 190 bp, Homo sapiens
ttggggggtttgccccttttttttttatttcctttttggtaagagccctttataaaaaaaaaaagaaaaaaaagaggggggggggggccaaaagccacccctttttccccccccccaagggttttggggggttctccccccccggttggtgggttttttttcccccgtttataaagcctttgacccggta

SEQ ID NO: 579882 - DNA, 257 bp, Homo sapiens
gatctttctgtaccctgacggaaggatctgacatacacttgatttggcttacaatgtctgatcactgatcaataagatatctctagattgccccttgcgagcaggactgtatgaatccataacatctatgctcatgatcagtacatgcaaaatcagcaagacaatcatccagtggtgcataacctctcctgcctcatttagtgcagcccgggttccccacgcgggtgttaaacctctgtctctggtcctaccagcat

SEQ ID NO: 579883 - DNA, 795 bp, Homo sapiens
agtgagactctgtctcaaaaaaaaaaaaaaataaaaggaatcagttggggtctgtggcagaattcaacataaggaatatgacaagaccccagttaggtaaccctgatttgctcaggtccgagctgtggtctcttttacggcttcatgaaaggaccgtgccctcacggaggggaccacggtttggcctgggggggtctaaggtaatggcatgccattcctttcttcgatcaccaacaacccaagccttcttttgctgggacacttaggggaacgagagcagcaaatgagaaatttacctttttatcttcccaagcgagcgagaatgtttcccgtgttcagagaggaaagtaacattcacttattgcttgactgggggtgtccttagggaggggtggtacacggcttgttctcctcttcaattgggaacttctggtatttcaacaggactgtttatgtcaggcttgacacattgggacactcctgaagaggtgattggccccccacccttgttttggcggtgagttccggaccacgcggcgctcagaatgtgtcccatcttggcttcgatcctctggtacgctgtgcttggtaaatacttgggtcccaagctgagacaatggctgtgtaaacaccgtgaagagtcactcccaagggtgttattgggtccaaaagaacttgccgtgtgcttcacccgaaggcagcaagtctgcagtgggattttctcacgttggtgaatgacaagaaacagggataattttggcccttgcggaagaaattacgggagtgggctacaag

SEQ ID NO: 579884 - DNA, 240 bp, Homo sapiens
gtcgtctctagagctatccccctttgctgcctgggggttcttgatctcagtgctcattgaaacttctaatactaggggctgttattcgcccatcagttcgtcactcagtactgtctggtgttatcagattgttgcagtatcacagcctgcctgtgctgtacaaagggatgattcaagggtgagatagagtggatcgcacgattattacatcatgctgctattgaaacttctaaaactagg

SEQ ID NO: 579885 - DNA, 341 bp, Homo sapiens
tgtgcatctctaaggaacctctgttaaacaattgttgatttttttttttaaagactgagcttgggccaggtgagatggctcacgcctcccagcactttgggaggctgaggcaggcggatgacttgagatcaggagttccagaccagcctggccatcacggcgaaaccccgtctctactaaaaacacaaaaaaagttagccaggcatggtggcgtgtacctgtaatcctagctactcgggaggctgaggcaggagaatcgctttaacctgggaaggcggaggttgcagtgagccgaaatcgcgccactgcactccagccagggcgacagagtgagacctgtc

SEQ ID NO: 579886 - DNA, 325 bp, Homo sapiens
ggtacctgtgggtagcacaactagggtcagttttgcaggtggtaaagccatttaccaagatagttgtaggtaaagaagggcagatttattagagaaatgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 579887 - DNA, 374 bp, Homo sapiens
ttgttcctcgttggtttcaggctcgagttagaacttctcactggccgtccaccacgtgctgaagcgccgtcatcacagacccgctttccacccctctggatccagcagggtgtctgctgcgtttctgatccagtgaggcacccattgccactcccgtttgggttagatgctcaccattgttcctgcgtggctgagtgcctgggtttgtcctaattgagctgaacactagttgctgggttccaaggttctcttccttgacccacggcttctaatagagctataacactcaccgcatggcccaaggttccattccttggaatccgtgaggccaagaaccccaggtcagagaacaaaaagcttgctgccatcttggg

SEQ ID NO: 579888 - DNA, 146 bp, Homo sapiens
agcggaacagtccagttagtagtgtgctcatgttcatgtgtgaacacaattcaggccccatggaatgcatgctaagaaaaaggacatggaccgtatactaggttcagacacagtcacctgtgcggcgcggggatcccctctcctgt

SEQ ID NO: 579889 - DNA, 1281 bp, Homo sapiens
atgagaattcaggttctaaggactataggtctccttacaaatgaagacttatcagggccctagaaagtgctaggaggaagaggttaacaaataaaaatttgtccgcgtgcaaactattatagaaatgacttgccacattgcgaagctattatttgtctcccaccatattttttagttaaaaaaaagtctggggccgggttgcggtggctcacgcctgtgatcccatgactactttgtggcaggccgagggtaggcggatcacctgaggtcggaagttcgagaccagcctgagcaacgatggagaaaccgccatctctactaaaatatatcaaaattagctgggcatgggggcacatgcctgtaatctcagctagtcaggaggctgaggtagtagaattggcttgaaccagggaggcagaggttgtaggtgagccgagatcgtgccattgcactctaagtcctgggcagacaagacgtgaaagctccgtttcgagaagaagaacaagggctggttgtagagggctcatggccgtgtaattctccagatatttggggagcttgaggcaggccgattgcttgagcccaggagtgttcaatgaccacgtacctgtggggcaacaatgggcgaaaacccatctctaaagaatgatactctgaaaatttatcccaggctgtggtaacactatgccttgtggtgccttagttacttggggacggctgaaggtgtgaacgggcatcaatattacgggccgtggaaaggttagaacgggatggtaaattaacgctggtggatgtgttgccccattggcgtttccaagcctctgggcaaaatacacgtcaagaacccttattgtttcacgaaccatctgggtgtccctgggttttaacaacacacagggttataaagggacaacccttaaaatcaggcaaatagccggagcactgtatcacaggaatttgccccgcgtaaaaggcaaaggccactgattggcaaaatatgacgagggtaccccccggggaaatgggggcacaccgcgggacacggggattaacaacggagattgtccccccatttgaaaagaaagggtcgcaacaaccacacgcatcccgtctttgaaggacgggaggagccagaagatgagtgcacaacagcacaggcgcaagcagtacgctaagccaagcagcaacagtacaactagacggagacacaatgcaagagagaaagcacgacaacgaacaagcgacgagcaacgacggtaagccaagtacaaagcaaaagat

SEQ ID NO: 579890 - DNA, 466 bp, Homo sapiens
gtatggagccagcgcacgtgtcaggaccgtacggacctccaccacgagtttcctctggcttcgccctctgcaaggaacccacgcgcgtgggttccttgcacacttggggatgtatgggactccttcaggtttcactgttgactggccttgaagagctttgtggctgggcccccacttgctctcctctcgggcaaggggttgtggttcccttcccactcttgcgccttcatgtgggccccactctgccctggttgtgctgggaggtcatcttccctcccttcatgagccatttacagcctcattttgggggcatatcgtctcttcatttgcaagaaaaaatacaaagtagtctctgtgagtgtgatgatcctgagtcattgcatactgtcatcattctagaacaacaagatgtcaaaaggtgagtggattgatttcatctgcaaggaacccacgcgggtaccgagct

SEQ ID NO: 579891 - DNA, 129 bp, Homo sapiens
cccgactatcgacagctgggcgtgggccaggctcaggctccacaggcgcaggtaggaggcggtgttggagacagcagtcccaggcagtaactctgataggtgtgagatggtactgggtgctatgagcac

SEQ ID NO: 579892 - DNA, 375 bp, Homo sapiens
tcacatgtggtcccacgtttgtgtgggaggcccactagttcaacaaggactccacttgctctactgttggctaagaggcagtctgcttttcatccagggagaagcagaagtgcaaatggttatagactatgtacaggaccaagttacctcggcaattctaaacgactgcaactacctgatctttctacaagtagataaagggggtctggatacaccggaattgctatactttctctcggcctggggatccctcgtagtagaggggtgcaacctacagctgaaacagctccactgctcgctcgaaggagcccccgtatctggcgagtctggtggcgccctagatgacaccatgagcctagtcctcccaccacaaac

SEQ ID NO: 579893 - DNA, 477 bp, Homo sapiens
agcttttccttgagaaaaatatctaacaggtgacagcctaatgagtccagacatctgtcataccatagaacaggaatgactccacatcataatataatgtcttgtggtccagaaaaagttatgcgccaacaggcacaggtatgcagtaatctgtttcttgccatccactgaaacacagagatgaaccttgcaatatatctcatcaccaggtggtgtttccacacacatttggccatgtgccgagcggaaatatcgataggctcttcatatattttaaacagaatacacacatatagagacgtcccagccgtgcatattcttcaggatatggagaatgataccaggtatcaagctcatagcggccaaaagcaattgataaatcatgttgcttccctctgtgattggccttgcagccttaacttctccaaatcctctgaagcccgggcttgtgctcttcggaacagatccacgtcatac

SEQ ID NO: 579894 - DNA, 637 bp, Homo sapiens
agaggacttcacactaagtcaagatatattagaactaataaaagcacttgttgatagatctattggcctttctttattcatagagacacaaacagatcgcagatcagggttctcaactggagcatctgttaattttccccataaaaatcagtcttattctatattatttggagatgacgtctgccacccaggctggagttcaggtggcacaatcatgggttcactggaagcctggatctccccggactcagggtgatccatcccacctcaagcctcttgattagcggggaacacaggcgcacgccaccacgctggctgatttcttgcactgtaagtaggagatgagggttcaccatgttgtcccaaaactcctgggctcaagccatctgctcacctcggcctcccaaagttgctggggacccacaggctcccagccaccacaccaggccttcaagccttatatatccacttctgggagttttattccaaaaaataatcagggattgtgaaagaagatttaagatgcccagaaattcagcatcttaaaatcatcatttacgtccatgcaaaaataaactgcggttacagaccatgaattttatatcattataactaggctcaaacacatctttattaa

SEQ ID NO: 579895 - DNA, 206 bp, Homo sapiens
cacgagggcgatggaaattcggccgtctcggcgacgcgcgcgatctcgggcgctaacaattggtcacggcagacagtgaacaacccgccttttccttttatggaattattttcggattgaatctgccgacaggtgtgctggacgtgcataatgccgatgaagatcgggcggatcgcacgttccaaccgggaaccggtacaatcgac

SEQ ID NO: 579896 - DNA, 479 bp, Homo sapiens
agagctttccgctgcttctggtgaggtggcccactgctgcccaagtccttcgtctgtcgtcaagtgtctcagccggcccctgttttgagcgcctgttgcccggcgtgtcctgaacagagcgcaggacatcaccctgccccacctgtgcatgcgtacttctggcttttgcgcgtctgaacttccatccagatcaagaggatcagttcttcagcctggtacatgagaagctggggtcatagctgtcacgtctgtagacagccctgcaggtggacctggtgtgggccctgtgtgtgctgcagcaggcacgggaagcagagctgcaagccgtcctccaccctgaatttcacatccaatttctagggggcaagtctcagaaggatcagaacaccttccagaagctgctccacatcaacgccaatgccctgctggagtacccagagtactcgggtcccccttctggctgcctcggctggtggccc

SEQ ID NO: 579897 - DNA, 922 bp, Homo sapiens
gatgttgaagctctgtgctgcgtctgctgctgtcctggcacagctgccgaggttccaattcactcgaccgaacgaaagagactgagatgaccactgatccccaagtccagactgaacaagatctagcctcatcagagtggcgggaggctgagggccatttaagacccgctggtgtgttaccacaggtgcgaaggtgtccgcgcgtgctgcggctgcgcgaattatatactgcattgtaatgagaacaagactatgcttagtcatgtacataccctcttgcatgaggtgagatggcactggtataaataaagcttgggtagaaacgactgacgtggagtctcttcatgcagaagaaggtgagagattctgtatggctcactgggccagggccatgtacctattcatggaagctccttaaagtcatccgggctttaaatctcagatgctgtgtctatgtaccaaagcttcccgaactcgacagatcagatattatcaccgcgagaccatgtagctcaaggggtggtagtagtgcatccatccgtgcttggccgaagatctcgcaatgtgattatgggtcgcacacgcatgtcttgttacgatcatggagagaagagtaacaatgtcttatcatggtctaaaacatatgaacacctttgaactgagaaagtagtgcagagcacctatgtcttgggaacgttgttcgcgtccaacaacaagagggccgctcagagaccacgaggttgtacatagagctccctgacaactggataatcccctcccgaaggcccttccttgtgtaacgaatgggttaccttccaggctccgtccagggaaccttttccttaagaagacacccggcccttggggtgccagggcggggctttggcttgggggggaggaattgcctcgaaggcgcttccag

SEQ ID NO: 579898 - DNA, 1740 bp, Homo sapiens
ggggcacagcgacaagtctccaccagtccaggaaggtcctgcaacagtcaccatctcgtatctatacaagtgagtacaattcaataggtgggtcgtggtctcctcctcatgaacctgtcgtggttaggactctatgagagcgtgggcaggtgacatctgagagctcaagcatgactcctctgcgagtgcgcatcaggagaccattgtcacgctagcaaaccactccagggtcttccacacgggcgtggagcattcctatgcgcatacatcattggagacggtgtttagaattcgatggctctttcacctaggagtaatcaatctgcaatcatgcaaggccctaagagacactcgtagagaactcctgcacgcacttcaagacatcatctactaagcgtagccttgtactattgcccgtgggcgcaaggaaaggtgattaaggagtccattgcagctccttatcgccacatttaagtaacgtataagtacgtacgtatgtgcttcgcgacacgggagggctcccacaaatatatgtatagcgttcgcttaggacatattccggttgcgggtgctccataattcgaagaaggagggattgcgagcgcggaggatccaacataatcggcaccttaggtggacagcttttaatctacctcttgtgttctatctcaatctccttagtgggaaggagacatgaagaaggaatttcacactcgctgtggcgacgacatcgcgggtgagcctgtgagtatagtctgccaaccggaggcgggtttgggagaaccttccctcgagttgccggttaccgcctttggtggatttaggctctcttctaccatcttcgcttcccctgcggggcgcgtttgcctagagtcgcgggtaacatctactattggggcgcgtggggggtgtccccccctttttaattccgattaggcgattatttcgaccttcgtagacgcgggtcgtaacaccacaagggccacacagcgaagcgtccgcgcggcgactcatggtgtccctagtgggtgccccctacccaacctgtcgctcggggcaaccttctttgtgccaggcgcaatccattagagtgccgggcgcggtgtttctttcatccccacccgaggttgtgtttagtcgcgtcccgcagagaggggaagtgcggcactcgcgccggagcttttttgtgtgtgtcggtaccccgctcctggaggtggggagaactcgccctaccttccaggggggatattggggagctcttttcccccaccatgggagtcgcggcgcgtggggccggagcttgaccggaggtcgcgcggcgcaggtgcccccccttgtggtggtgccgcgcgagggccttgtatcccccggcgggcttttcttatagagggccccgggcgcagggcgttcgggtgtagtggtgcgcccaactgtgacgttctgggtgaacccccgtctcacaggggggcggatcaccctcgtagctcctctttggtcctctcctacggaaactgtgggggcttggtgccccacggtgttttcgctctgggaggggacgcctggttgctctgttgttacatgttcccacgcatcagaaagatcgtcaacagaccacgatctttatcgcttttgtggccgactgacgagcgggatgccgacacactatgcgtgtggtgtcctccacgacaatatgtagttgtgtcggccgtggtcgcatgacgtacgttcactgagcagccc

SEQ ID NO: 579899 - DNA, 942 bp, Homo sapiens
cacgcgtcggtagcctgtgtgtggccagtggctactgtatgagatagcacataatagaacattgccaacttcatagaaaatgctgggacagagctgaggaaaggttgtggtgccttccaaggagcatcatagcacacactcgaggcttcctgattcctccccatccactggtacctttgctgtagatgcactgaccccaggtagtgaattgtgagattttcagtggtcaagaataattactgagtaaagttgaaaggctgactcgttttgagatcctggcagtggaaaatagcattagaggatgatgagagcctgggcaggccgggaatctactgccctctagcttgacaccttttcccgagacttttccacacatcagtggatgctgagttgcatactcattgacagtcagtactgaaagtcaaggcatggcgtctcctggaggcctcttagatatttcgtggcaggagtaagcaaataataaaagttcttccctgctagaatttctttcctttaatgcagaatcaaggacaaaccaattacaaagataaaaatgaaatgtgtcagtacctggcacagaataataagtgttgctgaaacaaatgctatttgaaaaatacctgggttccatctatggaagtgatagaaaccatagcaacacttatatgtcttcaaagtgcaggcattagtctaaacctgtcagtatttcatcattctcacaaaacctatgtggattgcaggcagctcagggggacacgcaagcggcatgacacccgggtggaaggcccggccaaaaaccccgggcggaacaccacctcaaaggtaacaccacacaggagatcaacgcgcccaagcggggccaccacgcacccgcgcggagccacaacgaggggccacaggggccccccacagcagagcgcccggaagaacataaaaaaacaa

SEQ ID NO: 579900 - DNA, 1660 bp, Homo sapiens
  misc_feature (37)..(37): n is a, c, g, or t
  misc_feature (1219)..(1219): n is a, c, g, or t
  misc_feature (1256)..(1256): n is a, c, g, or t
  misc_feature (1258)..(1258): n is a, c, g, or t
catctatgtatagtatcaacagcatgtagatgccgcngatacatgcctggtagtataaagcacagtagctgtggtgggcgtcctatattagacgtttcagaggggtcacccagcagggttggcaccaagaacaccggtggttttttatctccgcgtggtcctttgttcttttctgccttttcttaaagtgtataccgctaggcccctttgcgtcgtccgaagtcttccggccccccaatgatataaatttccaccgaaagtgtgaataaattaatgccctctactaggggaaatatataaagggttgttgtcttcccgggtcagcccccgccgttgttcgtgtgaaatggatatctccacaggagtagtcctaataagaaaataatgttgggggatatcccaccccgtgttgtaaagagagtaaaaaggggccccctataaagagaaattttttttggcgcaacattgggacaacacaggaacacatagttcccacggctgcccccctataatgggaggtgtcccttcctcacccccccgcctgtgttgtgtggttgaaagaaatgtgggggcgccgcccccccgcgttaagatattatccaacggggtttgttcaaaagccgcgggcaacaaatggatgcccctacttctctcgttctttatttataatccccgggctctggtagaaagtggttgcgccccccctcgccggagtgtgtaaaccccagcgggtgtcaacacccgcacaggccctccttgggaaacacctcccacgaaatcaaagccgtatacttgcacgctgtgcgttttaataaacgtgtgggcgccacaccacaaaaggtgatcaacgagcccacggaggaccccaaggccacacagagagaaaggaaacctcacaggagagatctcgttttgggcccccgcgggcccgcagagagaagagaagggcttgcctcgtgccacaaaaggggggaaccgtgtccccacactcgagaagagagagtcgcacccctgcgggccttcttcgcagaccacagcggagagtgtaaacacaccgccgctggtcaacagcacacccctcttgggtttgcgagagaaacacacacagagatatagtctctcacagtctctggttgggtgtgatttcggcacacacacgagaccttgggggagattccccacttcagagagtctctggtgtgtgttctgtttctttggncgctcgcccctctgtgtgtgtctgtgataatatttgngngcggtgcccctctaactgccacttattcacacaagggataaaggcacaagaactgtggagacgcttctaagtccaccacggataagacctcgcacaccacctcgttcgcctcttcacacacacacaggtgaaactccggagaagacaccaaaggcgctctttggctaagactggtggaagactatccaggacccaattaccaatgaccagatacgatgagatccccccgtccactggggtgcgccaaagtcctgggtcctaaatctgtggctctgtatcccccagctctcgaaaaggccaagggctaaagaacttgcccctataactggcgttaaaagtaccctgttgagttttcctgtaccaataaaaataattgaaataataccaattttcccttccaca

SEQ ID NO: 579901 - DNA, 715 bp, Homo sapiens
gtctaagccggcgcttgaagcacttcccccggggcgcggccgtagctacgacctgtcgagacatcacccaggctgatcctgtcccggaaccggtttcccgaggtgcccgaggcggcgtgcgcagctggtgtccctggcagggccgtgagcctctaccacaattgcctgagatgcctgaacccagccttggggaatctcatcgaggcacctgcacctactctgccaagcctcagtccgaagaccaggctgtcagctgctgtccaccctacatcttgccagactgcccctgagggtcctcatcgtcagcaagcaaacaagctgggagccctgtcccctgacatcgggcaccctgggaagcctgcgacagcttgaggttgagcagcaacgagctccagtccctgccctcggagacgtgtgtggcctctcttccctgcgggagctcaaatgtccggaggaagccagtctcagtacgctgcccgaagagctgggggagctccctactgagtccggctggatttctccgttgtaacgcgcggtctcccgaagtcccaggtctccttctgacgcctgaggtcacctgcaggtcagttctgctggaggagacaaccctctgtcagagtccagcctgcccaggtctgcctgaaggggaaacttcatatcttcaagtatttgtccacagaggccgggcagcgtggggtcggaccctggggggact

SEQ ID NO: 579902 - DNA, 82 bp, Homo sapiens
gggggaaggggtttggggggccccccctttttcagttttttttttcaaattccaggggccttttcttggccccttttttgga

SEQ ID NO: 579903 - DNA, 293 bp, Homo sapiens
acagaatcagaagctaaatcccatttagtcggtgatatgcagactcctctgtcacttaactgtgtatcaaagagctactacacagcttaagagattcatcagacgtgttccttccatttacttaatagataggcactggtgtccaaccttggtatgtccaaaggccagtaggcaccacgaagcaggcaagaaggcacctgcagaaatctccccaaataacatagtgcatcacaccattcattcagctcagaccatctcccagcagtcatgtctgcacaagcacacacagcatg

SEQ ID NO: 579904 - DNA, 276 bp, Homo sapiens
  misc_feature (98)..(98): n is a, c, g, or t
  misc_feature (141)..(141): n is a, c, g, or t
  misc_feature (178)..(178): n is a, c, g, or t
  misc_feature (214)..(214): n is a, c, g, or t
ttgccccacactattggaggtcaagggggtcttctaaatagcacacatcttgtcatccaagttctgagtacattaaaaataagacaaaaacaaaagtntaaggcatatgggaacccaaatgtgatatttgttaccgacagngctgatacttgaaaaattgcctactggtggacaagtnggctttctaataccagtccccagatttagataactntacaaaccacatcacaggcagttctggatgatagcaaaagccccctggacagtgggtgggca

SEQ ID NO: 579905 - DNA, 290 bp, Homo sapiens
gtgatacagagatgaggcctcagtgagccgttgatacagccactgcactccatcccaggcaacagagtgagaccctgtctcaaaaaaaaaaaaaaaaaaaaattcccgaagacggggtctttttttttgccccaggtgggtttgaacccctggggctcaggtaatcgcccggtttgggccccccaaggggcgggatttcggggtttgcccaccaccctgtggcccagtgtgtgctccccttggctttgatttatttctcaggggatccctcaagagttcaccctgtgggt

SEQ ID NO: 579906 - DNA, 805 bp, Homo sapiens
ggccaggccaagcaccagccaagcagccatcattgccaaggaccttcaagggccgagggatcacggtgggtagaagataaggagatcttggctatgggaagcccctgccccagaaaacatggctgagcagatcatccaggagatcttgacagccaggatccaggagcaaaaagaagatcctggcaagccctccgacaggaggacgcaccctcagtggacgatgccaacattcgcgcattgcccaggcctgaccaggctgacaaagtaggggacaagatagccagccgcagaggcctacgggcaggcagctggccaagctgggccaatggccaggtgagccgcgagtcagtcgtccctggatggggacgaccaaagaaaattgccaccgtatctcggagatcttcaaagaaggagcacccggaccggttcagtcgagtgctacatggctgagcagaacatggtgagcatcgcggtgggctgtgccacccgcaagacaggacggtgtcccttctgccagccactttttgcaagccgtatctttcacgacgggcctaagagcagattcgacttgtgacgacactcttccgagagcaacatcagccctctgcggcatcccacgtgcggcgttatccgaatcggaggaatgacgggggcctcccaggaatggcgcctagaaaagatctggcatatgtgtacggtccggtccccacatcaaactgtctttgtacccaagtgataggcgttgctacagagaagtgcacgtggaaactatccgacaatacaaagggtatctgattcatcggaa

SEQ ID NO: 579907 - DNA, 135 bp, Homo sapiens
ttgatgtggtcctggatgggaagagggacatgagatggagtttaaggaacagcgagcgatggagtgagggaggtgctggcctctcccctctgaattaactcccccagtgagctcagctctgtgcctcatgtttgt

SEQ ID NO: 579908 - DNA, 213 bp, Homo sapiens
gttcgtctagctgttccagaggatccttgtagccacatatgtaagtgctaacatagcgtcagtggtggagtctggatttgaactcaggtgtgtctgacttgaaggctagggccccgaaccctgtcatccaccctacatgtgacctcaggcgtggaacgtagggtgcttgtcctgagagtgtctcctcccacattagagtggttacatggggta

SEQ ID NO: 579909 - DNA, 146 bp, Homo sapiens
tagcgttcagaggatcacccttcgagcggtgtactggagataaaaaaaatacgagtgatacgaagtagcaagacacaagcctctgtcaaaaaagaagagaaaagatcgtctgagaaatctgaaaaaaaagaaacgcaaggatacta

SEQ ID NO: 579910 - DNA, 524 bp, Homo sapiens
  misc_feature (444)..(444): n is a, c, g, or t
aaattaatgaaagtagctacactggtcaggcatggttgctcacgcctgtaagttcagcactttgggaggctgaggcgggtggatcacctgaggtcaggagttcgagaacagcctggctaacatggtgaaacccaatctctactaaaaatacaaaattagctgggtgtggtggcgcaggcctgtaatcccagctattcaggaggctgaggcaggagaatggcttaccaaggagacagaagttgcagtgaacggggattgtgccattgcactccagcctgtgcaacaagagtgaaactccatctcaaaaaaataaaaataagaaaaaagaaagcagccaaaccaaacaacagattttcaataaagacaacatagacttctattgtaagaagatataatctaggactttcatagctatagagaagtcagtcaatgcctggcttcaanagcttaaaggacaggctgattctcttggtagggactaatgcagacaatgattttaagagaaagcccaatgtctttacatt

SEQ ID NO: 579911 - DNA, 148 bp, Homo sapiens
ttgggaaaaaaactttcccctgagcttcccctgaggtcagactgcagtttcaaaaagggggaattttaaaaagtcattgtttatttcatggaaactgaagttttgttgaggggtgaccagccctggcattgaaaaatataataatcat

SEQ ID NO: 579912 - DNA, 269 bp, Homo sapiens
agtcagggcgattgctcccacctcccttcttccatcaacgcaaactatttggagagatgtttgaaagtgatgttgtggaactgtgatactgcgtacatggtcatgtaatggaccctcagatgggacacagtattggacaacttgcttggtgcatgacgtggactttcctttttgtgtggtgtcttgcctggcatacctcagtaggacaaacccagatgaactgtttgcacacagcccatctggagagagtacactgtgtggactcccta

SEQ ID NO: 579913 - DNA, 150 bp, Homo sapiens
gtaggcagccaccatatgctacaagaaccgcaaactgcccacagtttccctgaagtagacagtgaggataataacaaagtcgccaggcaggaaaaaaaatccaggaaaaaagcttgtccgctatttgagaatcccctatattccccaagg

SEQ ID NO: 579914 - DNA, 244 bp, Homo sapiens
tccaggatcctctaggcgctcacacaggagaagctgctagttcctttgctctcttgcctttgttatatctgccctgccgggtagggatgtggggcttggggcatctcctgtggtgtgctgggtgtgcagccctgattgtcgtgtggtgccatcagacctggacagagagggaggactcagtccaggcaatagggaggcccctaggacgctatctgtgacatttcagaaggccaatcagcagcac

SEQ ID NO: 579915 - DNA, 149 bp, Homo sapiens
  misc_feature (16)..(16): n is a, c, g, or t
ctgtactgctgcctangtctgaccctgctgggtgcccagcccacaggagaaggaggggatgtcgagcatgttcagcagcgtggcttcgctggctcccactttgtctccacgtcttgatccgctgtcatcactccggatttcactggtgc

SEQ ID NO: 579916 - DNA, 400 bp, Homo sapiens
tggaaggcgggcgggaagagggtggggcgagctaagaagctagaagcgttttgccgtgagccaaggaccaaggacgggaatgcacgatgtacgagcgaggagtcagggacggggactccgatggccgatgactcagacctgctttgcctggctgggggaactgggccatgggaagaacacaggactggccccggcccaggcccaacccccgcttggccacggcggagagcctgccccaggcccacctggccgaagcaccagcatcattccaggggcctcaccctgcctaactcccaagtccatgtccaacaccttttcctgtgtccacaattctcatgtggttcaaagacgtagatccattactgtttccagatgatcaaagcagctacaaaattaaaaa

SEQ ID NO: 579917 - DNA, 296 bp, Homo sapiens
ctgaggtatagacacagaattatagacaggatctttgaatcttaaattcagctgattaaaaaaaaaaacaatgaacaaataaaccatacaaaaaaaaaaagggatcttgaaatattggccccctctgttcctttgcagctttttccacaatacccaaaatttaaaaccaccctgattgcccttcaccagtttaaggggttaaacaaagtgtgggatatgcagacaatggagaatttatttcagcctaaaaaaggaatttctgtcatatgctacacttggtataacctcttgaggac

SEQ ID NO: 579918 - DNA, 355 bp, Homo sapiens
ctcgctgtgttggactgacctgcggtgttcctcggggctgtccgagccaggccacaggcggtcatgctgctggaggcctggggaggttccgagtgctctgcggactccaacacctgtggccatgaactgggaggttggacttccctgaaaaagaagctggcccaccaatgacccgggtcagccttggggagacctggggggtggggaatggcttccccgtgggcactcggtactgctgcagtgagctgttgctggaagtggaacccaggcggtgccggtagtagtcgtgggtggccacgagcgagccgctggagggggatggcctgcattgctttagcttgctggctggtgggat

SEQ ID NO: 579919 - DNA, 1251 bp, Homo sapiens
attgtgcagcaactgggcgggccgacggaagtgcgcgttgaggtcaacaagaagtttcgcctgtctgtctggcatgaaaacctggctgtcgtccaagtatctgggtactgctggtgccgcttgagcagaaattcagtcagtggctgactttctcatccgattgttcctgctagtacgctggcgagttatgctattggcggagtaggcgggtcgatggactgttgtattcgttatccatcaagcagaaccgttcgtgctcggatctcgaacactgcagccttgacacgtgtgttggtgaaagggacttattccgtccgacgactggggtgagatatggccgagcgttcggaaggttggcgtttcccgttcacaccgtgccgttataatacgataattgggccgggatggcgtggtccacatgcaaagcatagggcagggactgatcgcggacgacgactgactatgatgggctgggggcgttaaagtcgactgaacttctggccgcgagctgcacgtggtgagctgctgtattttcccgcccattggcggacctcgacgaatcgcctagacgctgaatgccagcggcacttgggcctactccattggggcacgaaaaatccgaagtcccactatagagagggaatcattccgaagacggaaggtcggaacgaggcgggccacaatggcatctgggaacgcgacggttgtcactccccggaactttatcccttgtcagggcatccgcggggggcaacgggaaggaattggtccctgaattgggggagagcctttgggggcgcggaatttccttctaaacacttgggcccaccgtcttagcgttccgaggatggccacggcggtggaaatttcggccgttgggcccaccgcacaccatagtgcattggcgcccgttaaattggtaaggccccgcgggcacaaaacacctttgggaacgcaaacaccaggtcgacgctattataaaaacccacccccgtgagaccaacccccaactatacgcaacacacagtcggaaaaccaacaacttcgggcccaagacaccaccaagggacaatcaggcgaccccggagagtacaaaaaccaacgaccggcgccaggccagggcgtagcccgcgcgaaacaacttagctacgggacatagagtccacaaccacggccacgtggcaccccagagagatcagaaaatcgcgcggcaccaaagaccgcaggcgacatggagcgaaaactcaccaa

SEQ ID NO: 579920 - DNA, 131 bp, Homo sapiens
tccttatccagggagcggcacttcttaatagtttgtggctttctatccagcctctcttaggaggggtaatggtgtagtttgcatcttgtaactctcctttctcctttcttcccctttctgaaccctgcact

SEQ ID NO: 579921 - DNA, 276 bp, Homo sapiens
tgctggtgcaatctatccagagcataaatctctctatatcagcataagtgaacttatgtctgttctatcttcaggtgtcactggagtagcactttgaatttccttcaagaactttccctatggattcacaacctggctatttggtgcaagaggccgagctttccgcctgcctccgcttttgacattccttcttcactaagcttaatcatttctaggtgtagatttaaagtgacagatgtgcggccgggcacggtagctcacgtctataatcccagc

SEQ ID NO: 579922 - DNA, 838 bp, Homo sapiens
gagggacccgaagctcagttacagtacagatcaggaccatgaagcttctcacggtgcctggtgttctgctccttggtcctggcgtgtcagcagccgaagcttgcttttcgttccttgtgctgaggcttcttgaatgggggccgcgggactatgtggatgagcctcacctcttgacatgagagagcgccacaattcacatctggcctcagacgagaaatacgttccaatgcctcggaggtggaacgtaatgatgctgccaaagaggggaccatgggggatgtcctggcgcgtgcaagaacgcggagtcacgccgagtgccggtagagaactatccagagaatatcttatggcctatgggatgcggaaggactcgactaggtttgcattccagggctggctcgaatgatatggggggccagtggacgtggtgccagagggacccccgatatcgagtttccgtagcctgttggtgcctggcctgaatggaagatcactgggagtcgttcctctttcagcttctgctcctcctggagattcgtgggctggtgacggccctccagggggcagtggattatcaacatgccgtgaggtagaagggtacacccatgtgagtatgctaaggtgaaaattacctataaaagagggtggaaagtttctgcaatgggaccacaaggcacttcggtgaaacacttaagacaactttgtgtagaggcccagcttagtggtccccggcaaaaagaactgtgtgcaagaccctttccggtctggggcactgagctgaccctatgcgtgaagacgtggctccagggccaaagcgggtccccaggggaaactcgcg

SEQ ID NO: 579923 - DNA, 621 bp, Homo sapiens
taaaaggatcaaagcggtgaatagttctaaaaaagggtttgtgctcttaagtttggactaattgtctttggcagcgagaaagggaacaatacttgacggaaaataaataaactacattccaattagaataaactaccggggttcttgaataatacttttttaaagaaaggccctttttaattatacacgggttcaagatttttttttaataggaacaaacacttatacaacactgctgggagaaagggacttggtctaggtaatttcaaaccatgaaatcaagcaatcctcaccaggatacttaggagggagagaatattttattcccattttaccaattaggataaatgaggcccagaggggttaaggtaacttgcttaaaattcacacaggtagaacaatgggggtgctgagaataaaaacccagtcaagtttgcttggaaggaggtattaattgtttgattttttcagaaggttaacaatgcgggtaatgaatatttgtttaacctaatgccggaattaaaagaagggaagggtgaataagagattgcaaccagtggcaattaaagcatttaataagaaagggatgacccccataatcctttggaatttcctaatatt

SEQ ID NO: 579924 - DNA, 1391 bp, Homo sapiens
gacatgctcagcccagagtgaatgtctgtgagcattccagtgtgcacatgtgctggttgcctgctcacagatcaggcttggcaggtggtggtaggtggttaaggttcccagtttcagccatcaagtgtgcagttcgttcactgctccagcagtctcagtttactctccatcatgtcacacacatggtgcacagcattcctcagctctcaacacatttcatcaaggcatcccactaggcctgtagtgttacaacatgtaggccataacagtgggcatcactgttgagctagattaaactcataataccgacacagagcaccagagactggatatactgacatctagggaatacaaaccattacaaccccaacacactcaacttgtcatgtcgaccaccacagaaacacactaagactactactatgatgacactgctacatatgagcacaaacatatgaaacgaacaaacgacaacgagagatatacctacatagacctacaagagtcacacccattaacagctatacagagcagcatggcagaggcgacaggagacaagaaaagtccccacacgacaaacacggtaacaaaggccaccaatacaaaataactgacatagattgacgacacagaggcagaacaacagagggagacacaaagtgggagcgataaaatcaccaggcaccatcctgagggacactctgaccaagtcgaaccgtgcagcacacccagcaaaacgacaaaacacagcataacaaaataaacaggccataaagtacgaacgggtacacacaataagaggggccacacacgccagcaaggatcagccacacagaacacacaaataaccacaacacgccaaaaagacagaaatatgacaaccacaacgcaacatcaggacaatcgctaaaaggggcaacacagaaagcagacaagagccactagaagacatccctgagaaacaacacaaaaggccacgaagaacaggggctgcaccacagactaacgcaccacagcacacagaagtagcgcacaaagagtcctatggagacccggcggaagcagcaaaaacaacacagggacacagggccaaccacacgaaaaccaaatgaccacccaagcacgccgagcagcaagcacagcagaaaacctagaagaaataaaacacgagggagaagcagcacgaacagaccagaggacaccgaacacgcacaacacaccaaaaaacagccataaaaaacacaacaaccaacaagaacacaaccaaacaacgcctagaggaaaagcgacaaaagcaaggacacaaacaacacccagaaacacatcacagaggggtaccaagaaggcccgcacaccaacggagaagacacacacagacacaagacgaacga

SEQ ID NO: 579925 - DNA, 1304 bp, Homo sapiens
  misc_feature (335)..(335): n is a, c, g, or t
tcaggctggtcctggtcctgggatttttgggcattgtgaccacccggctctgcggcgctgtagaggctgctcccaagccgcgctcgagtagactcgggtgggggtccctggcggtggtagcggtggcggtggtgcgagcatgtcgtggctcttcggcattaacaatgtgccccaagggtgaagacgctggggcctgtcgcctgcctttgcctgtcctgtgctagcccgtgtgccgagtggcggcggggacctgtggcttgggagacctggcctggcgccctaagtgacaaattggaggcaacttcgaacccacctggcctggtatgcgcgcctgnctaagggtcggccgcgcgaagccttggagcacttcgccgttatgcccaagggaacgccccttgaattcttgggcacaggattccagtgatgcaagaacgcttgcaaggtttgcgagtcaaacagttccaatgtctcacaaagaaggtagatgagggccggcccgttaggaaggccaggcgtttccaaaggaacgtcggaaggtcgtgtaattcgcagtgggccgccagtggccttagaggtgagtaagtggacgggaaggaacccctttgaagccgaagggtagaaccccccgggtctatggctattccaggggcacatggggccccccaagttcattcaactgaaccaaaggggcctttgtggccccctgggcctatgagcgccctttaacggaaactggcacctccaaatactttgaatagcccagtgatagtggcacaccctttccttcccacattggaacgggaagcgaaaattttttaaagcgggggacaaagcgcccaatgggaaaggggaaggcttcctggtgtgtccaatgaaaaagcgcagtgggaaaatgccccaattgcccagtgctggaatgtccccaaccccgggtttgccaacctcgggggcgtgagcaatcggcgaccgccttgctgtggttgctaccatggtcgaactcttgtagaacatttgccttggtccggcacaggtttggtgcacgggtgctcggaatgtgtccccgccgtgtgtctcgtacgtccatgccctcataaggtgtgccctgtatttccggggctgctactaacatctttgcggctgagcacttttcattttcccgggctgtacagggtcgtaaattttcgtcggcccctttgtaaataggggcggtggttcctgtagtcacaccggcttccaatgagactcgggtcatttgggcatcgctttccagattccgagggacctggggctttggcagaaccatt

SEQ ID NO: 579926 - DNA, 360 bp, Homo sapiens
ggacccctaaaccctgtgggtggagggcaggggtcgggggggtttacctttttgggttttcacatggcctaggccagtcctccggtcagactggtgtcaggcaccctggtgcaaaattccttttttggcccctccagtacccaaaaaaactgggtgggccctttacttctgcagcccccagggtggtagaaaaaactgttaaaagccccccaaccagtaccaggacccctgggttttcctgtgacctggggcccagtttttgccctttaggcctttatttccccccctgcaagtggggatgccagccctggctttgcctccttcattaggctttggaagactggcccaggttgtggagga

SEQ ID NO: 579927 - DNA, 266 bp, Homo sapiens
ttggtgagaccctgtgtttaccgaaatacgaaagattatgctgggcggttgtgactggtgcactgtcgtccggctactagggaggccgaggcaggagaatcgcttgaacccaggaggcggaggttgcggtgagccgagatggcaccactgcactccagcctgggtgacaagagcgaaactccatctcaaacaaacaaacaacaaactgtgtgaagaggctgggcacggtggctcacgcctgtaatgccagcacttcgggaggccca

SEQ ID NO: 579928 - DNA, 1333 bp, Homo sapiens
  misc_feature (250)..(250): n is a, c, g, or t
gggctctcgtgggtgtggctttcttggttctatccgcgtccgcgacttctttttgtgagggcccgctcgtcgcccgttcggtgtgggggcccctatctctgctcgtgctcgggggtttttttgtgtggggacacctactgggtggcatgttcagctccatggtgcccctgcggggcgtattttttttgttacccccgcgtttcgtgtgctgggttcggtggtcccagcacggccgactctacaatgctgngtgcccccctttccgtttgattcctgggggggcccgcactgtgttttctcgccgacgaggggcacaccccatttcgtgggctcttcccgcggtgttttcaaagaatactcatgcccccccctccgggggtgctctctctcccacaccgcgtgcccttgtggggggagactctcacaaggggcccttctagccccccaagagagcccctgtctttggggggcacaagaacaaccggggtggggccaaaacttgcccggcgcccctcttgggggaagctggggcccactatgttttctacaattgcccggcgcccgccgcatcttctcgcccccaacccttccacccgacctatgttaatttgaggcccccctgtttgtgggtgtccacggggcataataaagggccccctgggggtgtatttgggtgtggagattagatcccacacaccacgggttcccggggcgccctggcccccggggctggaaagttgccacacacagcctcgtggctccctgggtgcgctacaccactcggagaggggggccacagcacaggctgaccggtcgccaccacaacacacagtgggcctctctgccgcccacagcacccggtggctcccccgacacacagtgggttgttctgagaacccctctggggaacgaaggggccctcgggccccccggttgaaaggccacccacagagaggcacaggaagtgggcccctctggggggttcccggggcaactgtctgcgcgcgttgctgcacaggccggcccacaccccgtgtaatttaatttttcacaccctagttctcccttctcctgtcaaaggcacaggcccgggctccacagggcgtcccccttgcgtggggcaatgtaaggtgggggaaggcgtcttgcaaggtcaacctggggggcccacagccctttctccaagccttgcctggcgtgagagcatgtgttccacaggggaagccctggaagcaaagcccctcaataaggacagggagggggtttccgaggccaggcatccgccgccccgtgtcgcatcctggaataaaaagtggctctggcatggttccca

SEQ ID NO: 579929 - DNA, 195 bp, Homo sapiens
gatagctgactcttgagtatcaacagcgagcaggataccagcatgcagaaaccctctctctactaaaaagacaaaaaaattagctgggcatggtggcacatgcgctgtggagcccagctactggggaggctgaggtcggagaattgcttgtacccgggaggcgggggttgcagtgagccgagatcatgccattgc

SEQ ID NO: 579930 - DNA, 127 bp, Homo sapiens
  misc_feature (121)..(121): n is a, c, g, or t
ccactcctagcatcactccccgtcaaagcatcactccccgcttcaagcataactccccggaggcctgaaggcccagctggaagaggagaggaagcgggtagcccgggtgcatgcatgagcntgcagg

SEQ ID NO: 579931 - DNA, 219 bp, Homo sapiens
cctctttactggactccacttatgattccctaaaggccactgtcgaagcccccatcgcttgggtcacatagtcactatgccgtcatgtatctctatcacaactaaggcgggctatggtataatacgcctcacagtcattctcaaacccctgacaaaacacatagcctacccccttcctttgtactatccctaatgaggcataattataacaatgctcgt

SEQ ID NO: 579932 - DNA, 849 bp, Homo sapiens
agcggaggggctgctgggaagatggcggactcgtgtggctagccgatgaggaggccgcgtgtcggaacccgtgccccctgggcccctgacgaccgatctgaccggagcgacctgcgcagggcccggggagtcatgtaggggtggcgcctgcggggagggctgcgggagggcagtgggagctggtgttagcggctgcggcgctcggtctccgtggcgtccctgggtccggggtgggtgtcggggccctccgacattctgccgtactcctgcaagcctatcgacgagagagctggtgcgactcgtggtctccacagcgtcgtccgcatgcgtactgatggagcagctagtcggtttctcatattcagccgtggtgaaggagatcttagatgagactgaagaccaccttgtcctaaggtcactgccgcatgcgtggtgtgggatgcagccctggcactgtgagacccacgcacctgtccatctcgcggtgtgccctgctttccactcgctcttgtgcttgccggcgtcctcctgtgggagagggacggtggtcgcggaagtagtgcacggcctgtgttctcgactgggagctctagactgcggcagcgatcagtagcccggtgaatcgacctcagggcttaccttaagccccgttcgctagctctgggtcttgcgtttctccacctggttgcatgtgagaggtctccatcgatccaacttccatgcttcgagtccttggtctctgctctagacctcccctgtctctggctgtcttggcctgctgctgatcctccagtacagcacttgtggttggggcccagccctggcgggacggctgttggagggagccca

SEQ ID NO: 579933 - DNA, 435 bp, Homo sapiens
caaagtcaaacagtgcccgggcaacacgttatctcttatccctggcctgtcacataagatgagttgtgatgtgtttaattaaactgtttgatgtgaatgttgaaacaaaacgcagggccgggccccatcacttggtgcactgctgttgctttcactgaaatcgtcttcatcatcatcatcatcccataaatggcagttgtgtctaccaggccatagaactgtcctgtaccatgggctgttatccgagccctgagggagttccccgagtcccgagttctgtgtgtggttcacatttcaaatcggtctgctcaggacaacgacggactggtaaaatcagttgagtattggctgttggtcaatgaaactatgtttcactgtcagtttcacaactatctgtgagccaatcccagcaaaaactttccatgcactgtcact

SEQ ID NO: 579934 - DNA, 143 bp, Homo sapiens
ctagctacactacagacatgatggtacggtttattcaccgagtcagtgggtttcaaaaagcgggaaaggaattgaatcagaaaaataggaagacacatgtaatataacacaccagtccacatttcataccagagttgtcgtcc

SEQ ID NO: 579935 - DNA, 370 bp, Homo sapiens
tggtagagaggggggtctccatggttgcccagggtgccctggggtgaacgtgggtttacaggcatgctgaatcttgtaaagcctgcccacagttcaaaggggaaggaagcaatccaggggccactgattgggatctgccgagctgttgaagaactcgagcgttggacgccgcgcctaaaggtagcagccgcctagcaacacaacattccctacatgaacgtgaaaggacacaataacctcgtaacagaccccgccacagaacataaatgaacgtggcgacaagtcccgcaatataacgagcgctttccatcccccacgcctcgctgccagcggaaataatgaacggcgaaatagggagatataccaccaa

SEQ ID NO: 579936 - DNA, 561 bp, Homo sapiens
tcttcaataactccagctataccaagatatattggtatctcttcacaatacgtgggaatgtataccattgtctggagatattctgattcatatgtctatactagtattaggaagttggatcccgtaaaagtcatcgacgtctactccatcttaccaggctagtgctataaatactggatcttcagatgcttccgcctctgcatacagatgcaaaaccttattagaaaggtataatgcacgtgatccgtttctagtccaaatgaaatatcgtagtccaagattaacagaatggttctatattctctgtcattgtctgacattatgaccaagatgtacatcccctcatcctcatatctccatccaatgatgatgtaggcacaagaggacgatcagatatggtcctgagaactttgtttcttcatacccttagcagaattctacttttgagctttaatcctttactttatcaccacctagcacaatatagcatcctaaggctagttttgcatgctgtgggtctttggtttcttttgttactaaaacaaagcattttcctgttcc

SEQ ID NO: 579937 - DNA, 211 bp, Homo sapiens
ccaagctggaggatcggatccatactccagcagagcgatagaagatcggggagcaagaaggaagagggaagcagatcacgaaggaggatgtgagcaggttaagtggccaaggaaggggagcacattctggagaaggcctggtgctatggcacttagttttcagcggggactgggctcaggaacacataaggaggttagccctgagagctcc

SEQ ID NO: 579938 - DNA, 269 bp, Homo sapiens
  misc_feature (249)..(249): n is a, c, g, or t
aataagaattagaaatgagtacccatgtaggccaggctagagacaggttcttgaactcctgacctcaggtgatccgcccgcctcggcctcccaaagtgctgggatcacggcggatgagccatcgcacctggccaacgaggaagtatttttttttatctatcctgactctttcttgaaaagctatgaacttttttcttgtactttcctttttcttttttggagacagggtctatgctgctgtcagccacncaatgtacgcacatgcggtt

SEQ ID NO: 579939 - DNA, 281 bp, Homo sapiens
ccttcttcaggatcagaggtagggtgcagaagcatttagggcagcaaacaagtgacatgaagggagggtcctgtgtgtgtgtgtgctgatgtatcctgggtgcctggctccttgcagcagggctgggcctgcgagaaccaaggctcactgcagcgcgctcctgacccctccctgcaggggctacgttggcagcccagcacataggttgcctaatggctttcactttctcttttgttttaaatgactcataggtccctgacatttagttgattattttctgc

SEQ ID NO: 579940 - DNA, 1804 bp, Homo sapiens
ggaggccgaggaggcccccggggcccggccgcagctccaggacgcctggcgcggcccgcgggagccagggccagccgggcgaggggacggcgactcggggcgctcccagcgagagggccagggggagggcgagacccaggaggccgccgccgccgcccgccgccaggagcagaccctgcgtgatgccaccatggaggtgcagcgcgggcagttccaggggcggccggtctccgtgtgggacgtcctcttctcctcgtacctgagcgaggcccaccgagacgagctcctggcccagcacgcggccggcgccctgggcctgcccgacctcgtcgccgtcctcacccgggtcatcgaggagacggaggagcggctcagcaaggtgtccttccgcggcctgaggcgccaggtgtccgcctccgagctgcacacgtccgggatcctgggccccgagaccctgcgggacctggcccagggcactaagacgctgcaggaggtgacggagatggactcggtcaagcgctacctggagggcaccagctgcatcgcgggcgtcctggtgcccgccaaggaccagcccggccgccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggaggccgtggccgcgggcgtggtgggcggcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccggcgcggctacttcgacgaggagatgaaccgcgtcctggccgaccccagcgacgacaccaagggcttcttcgaccccaacacgcacgagaacctcacgtacctgcagcttctgcagagggccaccctggaccctgagacggggctcctatttctttctctctctctacagtgactgggcttcctccgtgcagttttctgcaactctggagaagtggaggcatacttgtgtgtctgggttgtttttttttttgtttttttttttttttgttttgtcattctttaattttgttgttttacccattcgttatctgtggaaaacgttttaagttgtcatgtgacagaaacttttcctttgtccatcgaggtgtttcataagttttttggtgtgttttctgggtcgtctatgtgtcatatggttttacttttctctcctttttcgttttcagaacatttttctgtctgttttggattcactgcttccattttacagaatgtcactctttagactctcagtccatcatgccatcgggtactcttgttgcagtgtaatttttattacatgcggttatttccctaacgatgtgctattcacgttcatcttcaaactcattttccatcagccagtgtctactatttagtgccctggctctatttcggtcctcctccccgggctttccctggctgctgtgctggccaaaagcatgggctttattctctccattggctgctgctccaccttagaggtgtgacctcactagcgttgactgagcgagtctgttgtggagaagaactttttgtagtaatttactaggaaaaattctgaacaagtaaaatatgaaggaaaaaa

SEQ ID NO: 579941 - DNA, 252 bp, Homo sapiens
ttccctctctcacgatccttcccatccttcccatctctgtacgtgatcttcaacttcattttctccaagagcttctacctcagctaataaatcagcttcattagctgctgtgatgttaatgcctgtatagcagccatcgaagagttctgcgcttcactaagggcttccttaagtcctcctttctggaagaatctgcgagatagttcctgcagtcccggaacaagaattcccggccgtgctctagggcagggt

SEQ ID NO: 579942 - DNA, 385 bp, Homo sapiens
ggcacgaggtgtattagatgtgatgcagacaatccaaacggcagatactactgtggtggacagtgcacctgtgacatgtcaaagcatggcacagatgatggtgtagtatggatgaattggaaggggtcatgtgactcaatggagaagatgagtatgaagatcaaggccttctttccacagaaatagtgcccaatacgtagaattttgcgtcttctgtgtgtgacaacatttttgtacattatggtattggaattttctttcatacattatattcctctaaaactcttaagcagacatgagtgtgactttttgaaaaaagtgttggatttacatttagcacatgaatttcttttggtttcttcatatttcttgcttaccaaggttc

SEQ ID NO: 579943 - DNA, 139 bp, Homo sapiens
ggcctattgaagtcagtagcacatgctgcctggggtgatgatagtgttctatctggcagggttgagtcgcacaaatgtatgcattgtgaaaactcagcaaatatcacgcgatttctgctatgaaacttctaaaactagg

SEQ ID NO: 579944 - DNA, 759 bp, Homo sapiens
tccgtgttcttttctgcttcttttgtcttttgtatttcgttttttttttctgtttttcttgtttattttgtgcccttttcacttttttttcttctcttcttagtttcttctgttttgtttgtttagttctatttcggtattctgttctctttcatatgtcttgtatcgcgattctgtgattagtcctagtttttgttggtttctcgtttgtgttgtatctgtcaagctatgtatttctacatgatatgttgtttgtcatgttgtgattggtatctagaaggctatttgtctctctgtgcttgctatatcttttttttgtctttgtttatatacggatcttactgtgtatatgttattatcttgtattctatctctgcttttatcctttggagtcctgggagatctcctccatattaatggtataatgctatcaagagtagaattttgtagctgtagattagttatgtttttaacgcctacttgcaagtcttgcttctttgggatatcataaatgtattttgtgatgtactaaggatactggtcgtgaagtcgtactcaaatattatagtgcattttagcctaattcattatctgtatgaagttataaaagtagctgtagatggctaggaattatgtcatttgtattatacccagatctatcttctgagtagtgtggctgtcatgctgtcctgcgaaactgttagacctgttatctttgtcagtttgtgatgagaggatcttccttttacccacaaagta

SEQ ID NO: 579945 - DNA, 345 bp, Homo sapiens
ctgatcctgccgtttcctcagagcactgcaggaaagaatgtcactgaggtctaacttcccacacttttagcagagcctctctgtctacttttcttcatcttccatcacccaacaccggcctcccgttctccatggagacatggcgggagcttgagcttcacccacccctttcccgtccgcagtcagaacagcagagttctgtcacgtggttttgctagttggaggcagcagacaaaattctgaccagggatattttttgtttgccctgtatagtgttgtaaaaattagaatgtttcacccaaaccatctggattttcatcttctcctttttaccaaggagctgaa

SEQ ID NO: 579946 - DNA, 493 bp, Homo sapiens
tccggaagcaactgcacacctattaagcgcttcctggcataatcatctcggtgattggctttctctgtggcaaccagcaggaatcccagatctctgaattgtggcaaaggagtctcctgataaaggtgggatggattctactgaccaacatcaaaacgatcagacatttgaaagccttaatctcagggtcggggtttgggccgcccttgggccttttccttgggcctaaccattaaaatcagcctagccaggtctgtcttccaggcacaggggtagggccagatactcctgatgctttttgacgcttctcccactgggtgggcaacaaccctccccttccctgtgacctgcagagaagcttcagggggcgtttattcaatttgctaggagcctacaaagcacaggtacacggtgactctgtggttcccactgctcctgccactctccttggtcccctcactgtctctggcaggcagtaatgttctgggtgagc

SEQ ID NO: 579947 - DNA, 163 bp, Homo sapiens
tataatgctccctccatgtgctcctgggtgaagatggttccctaaaggaggtttattggttcatccctgatagaactcagggggattcttttccctcccaccagctcttgtaaatgatggcctttcaatatataccaactcctgccagggacacgaatgttca

SEQ ID NO: 579948 - DNA, 457 bp, Homo sapiens
  misc_feature (173)..(173): n is a, c, g, or t
  misc_feature (299)..(299): n is a, c, g, or t
cacagtgagtaggcaaaagcactcatgtgagctggtcctgtcacccctgctgaagagcaataagccagcgttgtggcttgagagaaaaccagagcttgtgtacctgcaagtgacactgagcggcctctcctgggacatggttgagtctggggacatggaatatcttattgtgnagcgacttcctctgccaggcctgaagggcaagctcatggaccactcccctttgctcagcctcctggcatcttggcctttggggccagcagagcaggaagctcagctttctttttctctttctttcnttctttttttttttttgagatggagtctctcactctgtcacccagactggagtgtagtggcacaatcttggctcactgcaacctccatctcccgggttcaggtgattctcctgtctcagcctcccgcgtagctgggactacaagcgcctgccagtacg

SEQ ID NO: 579949 - DNA, 385 bp, Homo sapiens
atgttgctgaggctggtcttgaactagcctcaaataatcctcctgcctcagtctcccaagtacctggggttacagacacaaaccatttgtatttggtgtttatttttaagtttttgaggaactgccgaactgttttctgtggtggctgcatcatttttcttgcctaccagcaatgtattagggttccaatatctcagcattcacacgaacacctttatttttcctttaaacaatttacgtaggtgtgagtggcatctccctgtggttcggatttgcattccactaatcacttatcatgttgaacatgttttcatgtgatttggggccatttggcccattcgataccttctttggagaaatgcctactcaagtccttcgtcgacgc

SEQ ID NO: 579950 - DNA, 878 bp, Homo sapiens
cgacaccgcggtcatgtgcggggcaagccccagacccgtgccggccaggctgcagtgcagggagtaaggctcgtgttgcgatgtgctgcgcctggccctcccccttgagccgtctccgcagcggcgcggggagtgcgggagctgcgggtgcctggacgggctgtgggtgctaacaaataccctggcatgcgtgctgtgctgtgcgtgcgctggctactgctgtggtgctgcatggcgcttgctgtgtggcctgcgtggtgctgctggtgtcgcggggaggcctggtgcctgggcccgggcctgggcccccggttgacctgccaatgcttgacacttcttccctccgtgctccaggcgggcatcccatcatggcctattctcggctacgacgtttgtcctactcactatctgggagaaagcatgcaggaacacagcgaggatccctgcagggactacttgcggacattgcccttgaagcctacggttgactatggcggcaccacgtttcatcccgagccaaggcccttcatcaggccaaccaacacacttcggaaacacgctgggcagagcggcaacgcgggcgcaatcctggtcgatatcggggcgtcctgggcccctcaagctatacattaccccaactaacctaatgatcgatgccccggggaccaattgttacacaggggtggatccagcgcgttgggctcttagcaattctcaaggggcaatagggcgcccgtgactctatgggcctaccaagtggagagcccttaaaggccaaggcctttaaccaaggttggcattgttccgtacacaagggaagggttggcccgacaagggggcttgaaattctccttggggcgatccgggaactttgtccg

SEQ ID NO: 579951 - DNA, 148 bp, Homo sapiens
tttgccatggctctctaccttactcgaagggacatgcatctgacaaccacaggcactgtcctcacgagagcccaccaggcctggcctgtcagccatggctctggagggagggaaatgtgtgccttgccttctagagcccagttgttgc

SEQ ID NO: 579952 - DNA, 1197 bp, Homo sapiens
tgggcaagggtttttttcccataaatattaaagttttccgaggttaaaatatttttcttcggggaagcaacaagtttcttttcagtgggtcccggatcaatttaaaacaggtgggagaacaccggggggcactggtgaaacgtggcgtttcgtggggcagcctcttaagctgggggggctggtagtacagctacaggcttcatcaaccttaaaagggaggtggacttcgggaaatctcgagcattatgagaaaaatgtcctggaattatacaatctctcccaacaaacttggccaggtggattttacccacgcaaaaatgtggggtggctatgggcttgagacataagagaggagaaaccaggccggtaacaccacaaacatgtgggctttgggctctctgaggagagagagggggcgcaagatgcgccaactagggagaagcgcacgtccaaaagggttcccagagacctcttggttgcccatgagaacccaggcagggctggtggcgctatgtggctaccctgggcggcgctcgggcgctactaaacagagatggtgcgcgcctgagagcgagattcgggcgaaacacttcccctggacaagctatatatttcatattcctcgtgtgtggagaaccggggtgcgcggcagaaccacgccacgagatagtaaacgctgcgcacagcgggcattgaggcaaagctgagacaagcgcacccgggggagcaccccctactgtggtctctcgtgtctgtccgcagaatgtgcgtggttacaacccacacaacgccgggtgggttcgcgacctatagggaccctcctggtggggaacccccctcggggcggaacaacaaaggcggggggtctcccaaaagaagcaccaacacggggggggcggctcccatacgaagacgaccaagctgtgtggggccgagaaaatacgaccaacgcgggggcggcacaaacacctgcgggcggacacggggtcttacaagcgctctgagtagccccccccagtgataagcaaggcccccaacgcaggacgaggcaccctcggggcctcctcacaatcaactggacgacacaacactgatgcggcagcacagcgaagagaataataacattatcgccacgaccggcgggcttcccagagaaactcaccggagggggcagcaacaaacacagcgcgccccgaa

SEQ ID NO: 579953 - DNA, 179 bp, Homo sapiens
tagactggtacttatcttaaaagcgttatggcagtgagacagtgtaagtaaatataaaccaacttaattaaactagctatcactaaaaagcttttaaaatcaaagacaagggagttcccgtcgtggcgcagtggttaacgaatctctgactaggaaccatgaggttgcgggtttggtcc

SEQ ID NO: 579954 - DNA, 601 bp, Homo sapiens
aggtgtgaggaggcggacaagcaggggtgctggaggctctgcaggatgccaagctcatgggtgacctggtcgcgcttcatcaagcttcttattcacaaacgttatgtggccacatgctcgcttggttcctgttctgatcacatttcttaacgacagaaaatctgctcctgccatgctcagccacttcactgtataatgagtcatagttgtctctcgaggtcaccatgatcccatccatccctggacctaggaccctcaggctggccgacgatgaggctgaacccatgtcattgacagcgatgcacgtgtagatgccgtcatcttccgtggtcacgcccacaatcttcagcgtggcctctcccaggtcactgtaggagatgctgtagtgaccatcgttgttcaaggtgttgtgttcagggcccttccaggtaattgaggctttggggcggccacagactcgacatctaggaacaacggtctcccctgtctcacacgtgacctcactcaatggaatgacgaattctgggggaacgtcataaatgtagttgggattgagaagcttgttgctgagtccttcccgtgacttccgataaccgttctc

SEQ ID NO: 579955 - DNA, 865 bp, Homo sapiens
tggtcaagatggggctttgtcatgtgacccagccgttggtctgaaactccgttgggctcccgcaatttctcccaccttgtgcctcccaaatggctgggggattacagggctgtgaggtcacccatgcccagctctaggatgactgtttatgtaaagattgggtatatgtcttgggagaagatggagaaaaccccaggtataaggggacacgacagtgtatgagacgtgaaccggggtctagtgagggtgtagagatggattacgccatgggaggagaccaagatacacgagacgcacatcctgacagagaacaagaggctctggggcaacccacccagagggacgagaacacacgagacgacgcgcaaagggagaaactcaactgcgttggaaacatgggccccatgcaagcgccaacgggacaggtgcgacctccaagaaactcgaccccacagggaacagacaaaccaagaagggcgagctcacaccaaggagaatagcgaagagagagcaagcgcacgccaggcgcaaagaaaatacagcccaaagagaagcgccatcaagaagcgccaaaccaacagaacacagtgcacgcgcgccccagggaaaagcacccccggcaacaaacggagagagacgcaaccaagctccccgcggaatgagccgccaaacgaaatacaaccacaaaaagcctggagagaaagactaggagacagagtaacacagcacccccggtcaagccaaaaggggcagtacgaaaagtagagccatacaataaaatacaaagagacacacagcaacgagagaaatacgcccaaaaacacaaacagtggaaaaaaaggacatgacaaataggcgacccaca

SEQ ID NO: 579956 - DNA, 1061 bp, Homo sapiens
ggttggacggggcactctcagaggaaccgcggggccccgagttgggctctctggaacttgtggaggacgacacagtggattcagatgccacaaatggccttatacgattatgcttgaaccagcgaggaactggtcagaccgtcagaagagaagctgccaggtattctaacgagcgcacgatgacgcgacaggctgccgggccggactcagagaactgaacgtgtctcttgctttcacggccatcaccaggtgggcaagctccgaatcaccacattcccccaccgatgagtcaggctgacgcgacgagcgagctcacggacacgactgcacggactgggaatgcagacggcctcgatctgctctcaataccgtgcacagcagagactgcacaacgggttcctggccaacagcgaggatcacgcaacggtccacgactcattccagtgcaacaagtaccatgacctgaacggctagcaccccgcgctggaatctcagcgagcctaccgacgacaggtcctgtgtgctctgctacgcgctgaccaccacgctgcgacagaaacagccccgaggcctgaagaagctcctcaggcccgcacaagggcgacccgagaggccagacaacgggtcccagacacaacgcacggctgccagcggacggcccaacgtaacaaccctccaccccacacgctgagctgccacccggcgacactgacgctcttcacgcaaactactccccaccctgccacccaccgctcgaccccgcacccgccccccgcaccccacccgggactcacaccacgcggcccacacactccgccccccacccaaccgcacccgaccccgccacgagccggcccacgcccccactctgacactcggcattcacgtctcctcactttacccgtatctccatgtcactcccccaatcacgcttgccacctcattccctacgcgcaccccctgcccggcatccccaatgtacacctggcaagctctcacccttgcacttccctccttcacaccctccctcacgcgattactatgccttcaccacccaaacc

SEQ ID NO: 579957 - DNA, 1013 bp, Homo sapiens
  misc_feature (358)..(358): n is a, c, g, or t
  misc_feature (476)..(476): n is a, c, g, or t
agcggaatcgtggcgacggcggtggcagggacagcaggagcagcggtgcggtgtcagcgcggcgcgtcggagtacactgggagcacccgtggggtcgagagtataattatgcaagtctgtccctcctaagcgtggcccatgaggcagtctgagtcaacaagcggagtgaaaatgaatcgacgacaattcagattatgtcgggtgaaggaccattacgactctgttgtctctggaaatactattgtagtctggtcaagtagttagatgattgaagagcctagtgcacctccttactactgtgatgagaatatgtcaatacgtacaagaccaactattgtgcattcatcagaagggatcntcacagcttgcttctatacctcgtggacctcgagtcatacgccccggccaatgcttggatggtggcagaagaccaggccagccatagaagatgcagacagagagtagagccaattcangagtaaacaacacttgcgttgtgcaagacaatgcttcagtggtcttactagacgaaggtgggaagtcctattcggaggtgactcttctgattacagaatgctaggctagagtacctgctgtgttggacctagtggcgtagatagaactgcctaggggactctaatagacaaggcaccacatctaagtatgttgtgaagcaaaaaaagcagttccaattcccgacagaagggaatggcccaacacagctgcgcgttgtcctgagggatacaccccaatgtataatggtccttgagttaatgcatgcgtgtaaaacatacgaggaggatctctggacagacaatcgggggcaccctttacttcgtttagggaacagtttttgaacacaggggttcggaatcccactcctgcgcatgttggaattcgcaacactaagatttacgacttaacaattggggaaccttttcctatcaggctcccctctggccttgttgtaggaagggttgctcaacggaaagtttgggttacctggaaaacca

SEQ ID NO: 579958 - DNA, 946 bp, Homo sapiens
gcagtccgtggagctgccaaagggagacctgggcccggcctccccgagccaggagctctggagtcccatgcctggtgcctgcgatggggattgtgtgctgcctgcacctcgcgtgaatgatcccccgtgcgagtgtctgacgtgtcgtcatgtggggcatgtcggaggcaggggggtggcctggttcccagtggactatggctaccgggccttctggcgtggaccggggggcgtactttcggggtgggccaggcagtgcccgggtctcgtcaagccggggccacccccgttttccgtgtgtcatgtggtcgtgtgccgtttccgggacgacggacacgtgcctggtagggcgccattgtgcctggtacggtggtcgccctcctaggtgtggcgcattcaccctgtgggggactactagtgaggcgccacaaagtcaaaagattgtacagagcccacggggagggaacaactcacaattggtatggcaatgctggcccctcgggatgggggccgcagtcgggcagcttatggagttacaaagacgcagtatttccacacttctccggcaacttatgggaacacaggagttcaaaagagaacaccctttcacacagcgagaaaagcaggttggaaactgttggggcaccaacccaccacagtccgaataaataggagccgaagcatagacgccccactgaacgagcatagtcgaattttagtcgagacaccccggtttaataaaactgcaagttttttactacccacgtgacctgataacaaccctagccccgattttagtggtcaccccacacagtaagtgggtgtaccccgatttctccgtttgtggtcgtaatcaacacacggtcacgccatttgtgttgctccaccccacacatgtaggtggagtcgccacccacttcgtagtgcagttagcctcattgttgca

SEQ ID NO: 579959 - DNA, 358 bp, Homo sapiens
attccaaccattgtcaaaatacaagactatacaatatagcacctatccatggtcatgataattaaaggctttcaggtcacctatcttagtgactattgctctcttctgaccctaaactcttgacatcctagtttatgaactgtgccgcctccttacacaccaaagactgataaaaaggagactgacttatgagccacggagtttacacagagattctctatataacggcataaaggtgagggtgagacgacagagagagagagagaaagagagcagaagaagacgtgaaggagaggagagaaaagaaaacagacaaaatataaaaaaagacagaagggtatacagtctggtgctcaat

SEQ ID NO: 579960 - DNA, 250 bp, Homo sapiens
cctgggccaagcacaatgaagatcatgatcattgctccatcctgagcgcaagtactcctgtgtggatctggctggctccatacctgggctcgcatgtccagattccagcagatgtggatcagcaagcaggagtatgacgagtccggaccctccatcgtccaccgcatatgcttctaggcggactatgacttagttgcgtacaccctttcttgacaaaacctaacttgcgcagaaaacaagatgagattgg

SEQ ID NO: 579961 - DNA, 200 bp, Homo sapiens
gacggcattgcatccagtcgaacagttggtcatggtctatacgatgcggtggaaattgcatcgtgtttgtaagcctaatgtggggacagctcatgagtgcaagacgtctttgtgatgtaattattatacaaatgggggcttcaatcaggtgagtactactcgagttgtcaaacgtcaaggtagtcgcatggtcggcctgg

SEQ ID NO: 579962 - DNA, 875 bp, Homo sapiens
acatatgatgataacctgctattattaaactttttctaaaaagtgaaaaaaaaaaaaaaagatttaaaaactcagggctcccatactctgtttcgggacccattctgagaatgcattgctaggcctattgtgttatgttttaaattttggcactgctcttcccgtggcaatttggtttacaagtggtttattgcagcaattattaagggtacattgtctctctgtttaagttaattatttgccctttattaaaaaaagttttgattaaggcaaactatttttataaagtgccctgtttaaagcatttggcactgttatttttgtgccatttttattttccattttcctactttcaaatttgtgtcctctcgacaattttccttctttccttactttttgtttttgcaccacgtgttagaaattgggggcatttgttgtgttgttcatgtgttagctcggccactttattgcccccatttgttgaggaaacccttaaaggggcaatttaaccttagaccccttgtgctccactattttgttaccccgtgtgttggtccttacagctggaggaaatttccctcccctgtagtccaatatttttttgtgccttacatatttcagaaatccataccctaataacttgtttgggaacatattctcctgttcaactttttaaattcccaggaaggctatttttattaactttttgcagaagcctttttattgctcccaaaggtcctgattcctcacagaaaacagtctctgtgtgttcaaccctttcctctaaagattcgttgctctcatatacattagtggtcccttcgacaaaaaaaaaaaagcgtgttcggctgggttattcttaacccactggatgg

SEQ ID NO: 579963 - DNA, 452 bp, Homo sapiens
gaatgctgtagaacatgaaacgacaagctctcatacagaaattatgacgaactacacagaaactctcgggataaaaatacagtaactcaaagtggaagaaactcaagtagatggcgttcataatcagaattcattatgtaaattaaaaactagtgaagaggggtcgagcaaagtggctcacacctgttatcccaggactctgggaggccggggtgggtggatcacttgaagtcgagttcagagaacagtctggcccatatggtgaaaccttgtctctactaaaaatacaatgattagctgggtgtggtggctggctcctgtagtcccaggttctctggaggctgagtcaagataatcacttgaacatggaaggcagatgttgcagtgagccggattggcccagtgtactccagcctgggtgacagagcaagactgtctcctctaaccatgag

SEQ ID NO: 579964 - DNA, 212 bp, Homo sapiens
  misc_feature (177)..(177): n is a, c, g, or t
  misc_feature (186)..(187): n is a, c, g, or t
atggccggcggatctccctttatatttttattgtgtctgtttgatccttctctcttttcttctttattagtctggctagcggtctatctactttgttaatcttttcaaaaaaacagctcctgaattcactgattttttttttgaagagtttttcatgtcctctaaatctccttcagnttcgtgctnnctgaacttagttattctcttatctg

SEQ ID NO: 579965 - DNA, 1206 bp, Homo sapiens
ggctttatcccgcgcgttgcggtcaagatggcgctggtggcttctgtgcgagtcccgtgctgcgcgttctgctccgctgcgggggccctggctcccgtgtgcgcggccctcgggcggacgtgagctgtggctggcctggcggctggagacggtgctgcgctggctgcttcagggagccagctgggtgctggtgggagccggactgctgtgtgccgcacgggtgtcgctgtgatgaacattcaagaaccccccagtgaaccagcctgagcctggcaggctctctgaacggagctggtcatcagcctggagaaggctggcacgaatgacaagagctttccgggggtgtccatttcctgaccctcggaaccggacccggcgatggttctatcctcggaccgggccttggaccctgactcggaagaattgtcgtcgcgcacggcagcgccactgcaccatcttacagactcgcgcggtaagctcgggaacacggccccgctaacacagggcacgctatagtgcaccttcgcaatggtatggtacccaatgacacagcaaaacacctgagctagcctagagaccttcccgggcatcaaattcaaaacccggcggaaagggcacattaggcaccagcacctgagtctatcgtaactgagggctttgggcccattgtagttgggagcccctagaaacccccattggttagaagcgtaaaccacgggaaatatcccttatgggcctacggtagaccaaaaccccgccaaagtggttaccgctttggaccatttacaggacctttcacaaaaattggagaagtaaacctgcgataatgactagtggtgggcaaactcttcatattacggagcacacccatattagcaaccagtgggatcttgagaaaacacgtaaacaaacgccacctttgctgtatattaaaaacacaaagcggccaaaactctcaggggcgggacaaaacacaacgagcagacaaaggaggccgcagcgacacaacaccagagcagagaaaccccaccatgatgacacagccgcctggaggggcgagccagtgcgaacacccgctaacaaccaccagtaggactcagtagtgcagcgagcaaggaggggaccctcctgtcggaacagaggtaatgcgcgagacaacaaatatacgactgggagcaacccccaacgagatcgagaatacccagg

SEQ ID NO: 579966 - DNA, 534 bp, Homo sapiens
aactacccaaatctcacttgactgtaatccccacatgccagggcgggatgtggtgtgaggtgactgggtcatgcaggcggttttccccatgccgttctcgtgatggtgagggagttcttaggagatctgatagtttaaaagtggcagtttcccctgagctctctctctcctaccacctttgtgaggaagatgcctgcttccccttctgccataattctaagtttcctgaggcttccccagccatgtagaactgtgagtcaactaaaactcctttctttataaattacccagtctcaggtagtatctttatagcagtgtgaacatggactaatacagagaactggtaccagcagagtggggtactgctgcaaagataatctgaaaatgtggaagccactttggaaatgagtaacaggcagaggttggaacagtttggagggctcagaaggcaggaagatgaggaaaagtttggaacttccaagagactagttgaatgcttttgaccaaaatgctgatacggatatggacaatgta

SEQ ID NO: 579967 - DNA, 667 bp, Homo sapiens
  misc_feature (348)..(348): n is a, c, g, or t
agcagtgtctcacacctctaatcccagcactttgggaggccgaggtggacagataacctgaggtcaggagttcaagaccagcatggccaacatggtgaaaccccgtctctactaaaaatataaaaattagctacgcatgggccgggtgcggtggctcatgcctgtaatcccagcactttgggaggctgaggcgggcagatcatgaggtcaggagatcgagaccatcctggttaacatggtgaaaccccatctctactaaaaatataaaaaattagccaggcatggtggtgggcgcctgtagtcccagctactcgggaggctgaggtaggagaatggcatgaacccggnaggtagagcttgcagtgagctgagatagcaccactgcactccagcctgggtgacagagcgaaactccgtctcaaaaaaaaaaaaattaacttggcgtggtggtggccgcctgtaatcccagctactcaggaggctgaggcaggagaatcactagaagctgcgaggcagaggttgcagtgagctgagattgtgccagtgccctcctgggcaacaagagtgaaactctgtctccaacaacataatataaattacgggttcctttgttcgctgatggaattttgttcagtcccccaatatatttactgattaacgtgggttt

SEQ ID NO: 579968 - DNA, 833 bp, Homo sapiens
  misc_feature (743)..(743): n is a, c, g, or t
gggggcaccgcgagtgccgaaccttcggctggacaccaagatgcctggcgaacagcaggcagaggaagaggaggaggaagagatgcaggaggagatggtgctgctggtgaagggtgaggaggatgagggtgaggagaagtatgaggtggtgaaactcaagatccccatggacaacaaggagagacacgatctcgctttgtcacccaggctggagtgcagtggcacgtgattgtagctcactgcagccttgaactcttgggctcaagtgatcctccttcctcggcctaccaagttgttgggactacaagtgcaccccacacacctggctaatttttcactttttgtagagacgaggtctaactgtgttgcccaggctggtgtccaactcctggcctcaagtaatcctccttccttggcctcccgaagtgctaagattacaggtgtgagtcactgcacctggcctcatactgggaatttgatctcacttagcctacctggcctttctcgggacactggggcagaggaggatcttaatgagctggattcagctcctcttaccaagatttttcctcgggcatccaaggccccttctcctgggcttggagacatcaacagtgcttgtatggagaatttctttttcagaagtcagtgaactcagcatgaggaaagcctcaggctgtccaaagtcactgaaagagggtggcaggaaaaacgggccagaaaaatgtagatcttgatgagancagtctctccaagtggtgatgtttgaattaacaatgattcaaaatcaaaaaaaaataacaaaacataaataattataaaaaaaaagaata

SEQ ID NO: 579969 - DNA, 196 bp, Homo sapiens
tcagtgatggacaggaagcactggggaaatcaccctctttgagacctcacttttagtcttcctaaatgggaattaataatatctgcatctgtgtgatgccttcagcattaataggaggcactgttgtgtgttacacagtcctcactagggtgcggagcagtggcaaagtgttgcgcttgcctatgggcgtgcactg

SEQ ID NO: 579970 - DNA, 413 bp, Homo sapiens
agagcctgctctagtaattagggtcggatccagaaagctttacggcccattttctgaaagtgtgcttcctgcataaagcatttaatattgatttgtgttgcggtaaatgacattctcaaaacattttgctaattctacaattaaatctgaaatcctattattcggaattcctttgtttctggagaaaggtatacatactcacttgacctatataacatggtattaaagtttggtaattaagtctaaattccctgttgtacaagtatcttgattatctcagaaggggacatcttctaaaaatggcacgtgactagatgcaaattttaggtaagcagagttcggaacaggcagccctttttttttctctcccttatgtatctgttggtagcatggtagtaatgttgaatcattta

SEQ ID NO: 579971 - DNA, 1519 bp, Homo sapiens
  misc_feature (1519)..(1519): n is a, c, g, or t
ggatgacgatgacggagaacgctaggtgggcctggtggtggagtacgcgttgggtacgtgagaagcgtcgaggactattagggatgcaggatgatggtgatggtgtactgtgccagggggcgtaccctggtatgtgttaatgccgatggtccggagacttcaaggttgggcctattatgaagcataacagctgggcccatgaggaggtaggtagcacaggtagtggcaatggttgacccgggagacatcgtggtcgaggtgagaacttcgacgtctttaaacccagctaacaggataatcccatttcgtgaacagacgtcgtagttgctcttggtatcaccctatgcagttgggcaacgaagtacaagactcgtggagtgcactgagtggagataggcgctcgcttggtgacatcagtcctcgtgaggttcccgcgttgtacagcattactcgcactgcatactctacttcattgcactgctaacgactggagaggagtctacatgatcttattgttccaatacgttgcacccttaacttaatagaaatagcggtagctagttaattatgtattgcaggccttggggtgtatccacgattgtacaaaggttcgacctttaaaatagtgccctactatagccaccgaagcgaacatgtttaccaaaagggaattcggtttggaggaagaccaggttttcccatattggggcaaggaaaagggtaatttcatctacttaagagggtccatgggtgctacttcacttacattgctagttatgtggggacacctccttgggaatagacgagcgtgtaaggggtcaattacctgcggctatggcctattacccttcacggttggcacaaggttaaaccaaaataggggaaaagcttgataataacacccttcaaaaatataattagccagattgccgggaaatttgggagttgtacagctcttcatacattgtggaaaggcacctcgcctggtacggaagatactgtggggagcgatacccattgcgtggacttgtggggcaagagagacttggcggttcttttggtggaaagccgaagttgcatcgaaaaaatggcactcgagtccattggagaggacccaccttaacacggttaaactacagggggggtgtcccaacaaattttttggggccagttccccattgtgcatttataggaggggtccccaaggatggtgttggcgcttcaagggagacataagcttgcagtctaagaggcctcaaaatccacccgggcatggggtttaggggacagggacacgctcacaaatcggaggttacctttgcgactacccactagagttgggggaggttggacacacagggtgccgccacagacattagcgaggcgacatgtgtgttgcccacactttgtaacgggagagagaagagggctaatcagatatgaggacacttttcacaattaaaaggcacaatgggggcttgggcagagtagactgtctgagacacgggcggtcatatgn

SEQ ID NO: 579972 - DNA, 727 bp, Homo sapiens
  misc_feature (108)..(108): n is a, c, g, or t
  misc_feature (113)..(113): n is a, c, g, or t
  misc_feature (115)..(116): n is a, c, g, or t
  misc_feature (118)..(118): n is a, c, g, or t
  misc_feature (124)..(124): n is a, c, g, or t
  misc_feature (128)..(128): n is a, c, g, or t
  misc_feature (132)..(133): n is a, c, g, or t
  misc_feature (147)..(147): n is a, c, g, or t
gaaaacctcttccttctttcccactgtgtgctttacgaagtgaaagtgaagattcgcagagacacggtctgatacacctctatagtatgactatcatcatttaaattnttttntnntntaaggngagnagannacagaaatgtgtgnctattccagatgattaaatttcttgggtctagacatgttctgagctcatagttaactcaggtggccagccctttgcactgacacagacctgcagtttaattccccataaaatatggattcgattgcagcagtgacacttcgttagcacctacgctgacgctctccagctatctcccatcgtcgagatctacggtacctcatgacagagatatctagcttacggaagaagtaatctcagttcttgcaactgtcttgctgtccatcgaactattgcagcgtcccttttaattacaattctgggattaacgcattgggggctccaattttccagcatctggtaaccgaaatccatgctgcactcctaaccattctccgaatcagtccggggaaggctttatcccccagatttgagcctgtgccagtccgtggaggagcacgagctgaactgggccttccatatgcacttttccctgtgacagtgtgctccatttacggagtccaatgttggactttccttgcaccctaagcattgctgtcctagatgagccggcaggcgttgcccgtgaagtgcaagctaaaa

SEQ ID NO: 579973 - DNA, 119 bp, Homo sapiens
ccccgtgtcttatgttggtttgtccaacattggcttcaccatcagaaagtaatagcactcggctaactccataactgctcacaatatgggagcaatttgctgagcacccgactaaccag

SEQ ID NO: 579974 - DNA, 395 bp, Homo sapiens
tgaggacccttctctatgctcactggaagcgcattgtttaggggcgatctgctgcctcaaagctgtggatgaccaggctgtatgaatgtggattactgcagatctgaaagacatcacgggtggaggacataacgagctaagcgacagtttctttgaatttgctgcagttcaacatcaatgttccttccagtgtctatgccaagtattacttttggatctttcggttctctgggcagaacgccgaaaaaacctgaagcttttcgctatggtagcccccgtgaagcaggggaggagggcctcaccaatgctatgagtgactatcctcgaagggcaagatagttgttgaaacccttacgcaacggcacagcatagtgagggtacgaatcattgggttt

SEQ ID NO: 579975 - DNA, 690 bp, Homo sapiens
gataattagcatattcataatctcaaacatttatcatttccttgtgttgggggcattccatatcctctcttctagctatttgaaactatatatatgcatacatatatatatatttttttcttttctctgaaatagcctgggcaacaagagtaaatctccgtctcaccaaaaaaaacaaaaaataaataaataaaataaaataaaataaaatggctattatcaaaaagacagaaaataacagatggtgatgagaatgtaaattagtacagccactatggataacagtttggaggttcctcaaaaaactacaaatagaactaccatatgatccagcaatcccattgctaggtacatattcaaaagacaggaaatcagtgtatcaaaaagatctctgcacttccatgtttattgcagcactattcacaatagccaagatacagatcaacctacatgttcatgaatggatgaatgaataaggaaaatgtagtgtatatacattagtgtacataatgggatattattcagccatagaaaaggaactaaatcctatgatttgcaacaatatagatggaactggaagatattatattaagtgaaataagcctagtacagaaatacaaatatcacatattctcactcatatatgggagctaaaagagttagtcatatggaggtattgaatagaaggag

SEQ ID NO: 579976 - DNA, 1453 bp, Homo sapiens
ggggaattatttttacagctgacacattgttaccccgtggctcttttgggggaaacctataaaacacggtttgtaaacaaagacgcggtgggtgtaccccctgcgtgattttccccgggatttttgtggcaccacccggcttgttcgggccacgcaccagacctcttggggggactcccacgtgccccccgctcactatcctttgtcctgttggaagaaggaggtgaatttaataatattcggttgaaaaatgcttctttgtgttgtgataatagtcatgctcctcactgatgggccagacttttgttggccgaccctcgtgtaccatcagtgggggcaccttgatatttacccccctgtgggggtgttttcgggggagcaaccaaacgccttttgtctctttggagtggtccaaagcccacaatcataaataccccacggggggggattatacaaccaccaggaggttatttctatgggtgtgcacacacagctgcgggtgccatgtacaaattcacgccacaacatgtggggtattatctttcccactcatccatccactctgcggggggcactctatttttttgggtgcttcttttccagggggggcccctcccaacaagggggggagagactcacttgttgctctttatagagaatcacaccctgtttggcacactactttctgtctcgcgtgcgttcttgagaacacacattttgtgtgtgagagagagtgtgcgcccaccacagccccacactttctcgggactatatatgtgttttaagagagaaaaaaggtgggaatctcccacagagagtgttataaacaccacacatttttccgcgccacaccaagagtgggagagaactttatccccccctggataactccaccccacacaccgggggttctcggagtctctctcgggcacacgggagtttctcacggccacaagatgtttataggtggctcttgtgtggggtgcgcaaaaaacacacacagagatgttggagagagaaaatctcccttccacattgttgagaagaaacccgaggtctccccgagacactctcttgttgcgcacacaaaagtgttatctctctgtggggggcgcttgtgggagataaattttctacccagagaaaggccgagaccacataaaggagagggcctgttgttggagagaaaaattgggggcgcgtgccgaggggagaaaataggtgcctggtgtgtaagctccacagcacgcccttggaaattgcttttgttcgaaggttttgggaaattgtttttgcctgctgccttctgaaagagataatcacagaaaggggctatagagaggggagatgatataggggttgttggtttcctcacaccccctcactttgggggggggggaaaggatccccccgggttttctcaattaaacgggtttttttttccagacccgga

SEQ ID NO: 579977 - DNA, 1581 bp, Homo sapiens
  misc_feature (105)..(105): n is a, c, g, or t
  misc_feature (115)..(115): n is a, c, g, or t
  misc_feature (289)..(289): n is a, c, g, or t
  misc_feature (304)..(304): n is a, c, g, or t
  misc_feature (347)..(347): n is a, c, g, or t
  misc_feature (446)..(446): n is a, c, g, or t
  misc_feature (701)..(701): n is a, c, g, or t
gatcaccggcgtaatcaaatccttcacgcgattggacgaaagtagctttccgtcagactctggagtgagaatcatagcgtggagcccaggctcagatacttgatngtcgcgatcnagactttcaactgcttagcagggtgcactaatccattagccgaagcacacatattagtcatttacacagcgaacaagtaccgtggctcgtggatggaccgcacaagatgtagtcggagttgaagcagtacgcgcctttcatggtgatgtattggtgaaatgcaatgcggcgttnctgatgcgtactcantgtctaaagtccggacatgtagcgtcgtactgagcgcagcganacacaatgtctaagaggcgcccgttaccgtgccagagagtgagaatgcctaagagcgcatggagtgcagtagagctgaattatcgcactcctaagctgntcatgcggagacccaatcaactgtgtgatggtccctcgcaatcggggagttgcttgagtcgactgaatgaaccatgacccatggacacatgcgaatgtatgcggcctgaattgtgggagctagacgtcgtatgtgcagaaatcacttggggcggctgttatcgacatggtctgctgcttggcacgatctacggattctaatggtgcgttcgcaggaggagccgagagtggatcataccgtaatgttgaatcgtcnagggcgcttgcggtgggcatagctcgattggcattcggcaattttcgcagagatccccagaacgttctccatccccgagaagtagaagggaaacacgagattgccatgcacgccttggcctgatgttccttggtagctcttgggaagacgtgggggatcgaaagagggccgacatgaggccagggcctggttgcctttcctggcgttagatatttcaatgggtcgtagattagcacgtcctggttaagcttgtggtaaagctggacaaggtttctagccttggagcagtttccacaggggactttcgcggggggaacccgtggtttaccgttgcacattacctgccttagtgactcgcaaagtggctcgcaacgggaaagaaagtagggggtcgccccataggagttgccagccctgttttggtgaggacctcagggactatgggcgtcccacgcacatctcgggagtccctcgttgggacacccacgtgtgcaagtatcgggatcaaacatggagcttcgtcagatacacagcatgagaaagggtaaaacaaagagtgggcaccattgcggtttggaacagcccttgtgtgggcggtgcaaagggttgactgtggggcacaagcagtcgtggtgggacagccttgtgctaaactaaagcgttgtgtgcccaaaaagacaacaaccagcagcggtactgttaggtgggtagacaaagacaaaatcgagacgtgtagaaggtccagcagttaacaggatgaggaccataggtgctaatgccgcacgcagcatacaggtgagaacgaaccagtgacaaccatgagacgagagacagctaagcacactcctttgtctcaagttcgtcttacgcagctgagcgg

SEQ ID NO: 579978 - DNA, 135 bp, Homo sapiens
cccccccctttggggggggggggggggggcccccccccctcctccccctttttggggggggggggggggggctccccccggggggggggttttttccccccccggccccccggggggccctttttttttttttta

SEQ ID NO: 579979 - DNA, 455 bp, Homo sapiens
  misc_feature (185)..(185): n is a, c, g, or t
  misc_feature (187)..(187): n is a, c, g, or t
  misc_feature (189)..(189): n is a, c, g, or t
  misc_feature (202)..(202): n is a, c, g, or t
  misc_feature (207)..(207): n is a, c, g, or t
  misc_feature (248)..(248): n is a, c, g, or t
  misc_feature (376)..(376): n is a, c, g, or t
  misc_feature (429)..(429): n is a, c, g, or t
taatattaaaaattggtatctctcttccgctcacgaagccatcaagtgccatccatacataaacctacatctttttcctccatctccaattatttttatattttcccatactatcttctttgaactcttatggtggatgtattaatacaacagtatagtgaataaaaataacattgagagcaagnanancccctaaggtccntccanggtgtggttgagccgcatttaagaatggggtgggctttaangacattacaggggtataagaaaatgttattaaaaaggtttaagtgaagggtggctgtgagaatggagggtagacctgatttaagttaaataatattttcctaggttgcgattgtaaatacctggcacnttggaaatacttaaaacaacaccagagatgtcagattatacatgcccctatanctggggaaagtattttattaaatagg

SEQ ID NO: 579980 - DNA, 4663 bp, Homo sapiens
cgggacgctcctcacttcctagatgggatggcggccgggaagaggcgctcctcatttcctagatgggatggcggccgggcagagatgctcctcactttcctccagccgcgagaccccctccccttccgcctcgcggcgcttcctcgctccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacagcggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccaggtgcctgccatggggggtgctgagtggtcctggtgcaggaatgggtggccagaagaagggatagagctaggggtcatttctgagtggcgaggactgggggccagcgagttgctggcctgtgtggcactcaaccttcccctccccagcagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcgtgagttctcattagctgggggaatttggcatggaagagctgaggggctgcaggtggggcaggatgcacgggttctgggtggggagtgaggggtcttggaggcagggctgtcccacagggcgcccgccgacctgcacctgtctgtgaagtatgtagggtgggcagaagccacagtcgccgccgccaggggcttgctcctggctctgtcctttgcttccctccgtcctcgctcagttgtgatccagcagcccccctccccactgcctccccagctctcagtgaccccgactgtctcctgacttagccgaggtaaggtcagtgcagcagacagggccagactggggtgtggggggctgagctgggcacatgagtgagggctctggcttactgggaaacagcgattgacctgtgcttctgacagcccccgagacaccttgaggaggccgctccttcccagacacacccccacgcccccactggacggcattggaggaagggacagctgcttgggttctaatgctcctgctctcttctctttcccctccaaccagttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaactta

SEQ ID NO: 579981 - DNA, 4514 bp, Homo sapiens
cgggacgctcctcacttcctagatgggatggcggccgggaagaggcgctcctcatttcctagatgggatggcggccgggcagagatgctcctcactttcctccagccgcgagaccccctccccttccgcctcgcggcgcttcctcgctccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacagcggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcgtgagttctcattagctgggggaatttggcatggaagagctgaggggctgcaggtggggcaggatgcacgggttctgggtggggagtgaggggtcttggaggcagggctgtcccacagggcgcccgccgacctgcacctgtctgtgaagtatgtagggtgggcagaagccacagtcgccgccgccaggggcttgctcctggctctgtcctttgcttccctccgtcctcgctcagttgtgatccagcagcccccctccccactgcctccccagctctcagtgaccccgactgtctcctgacttagccgaggtaaggtcagtgcagcagacagggccagactggggtgtggggggctgagctgggcacatgagtgagggctctggcttactgggaaacagcgattgacctgtgcttctgacagcccccgagacaccttgaggaggccgctccttcccagacacacccccacgcccccactggacggcattggaggaagggacagctgcttgggttctaatgctcctgctctcttctctttcccctccaaccagttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaactta

SEQ ID NO: 579982 - DNA, 3909 bp, Homo sapiens
cgggacgctcctcacttcctagatgggatggcggccgggaagaggcgctcctcatttcctagatgggatggcggccgggcagagatgctcctcactttcctccagccgcgagaccccctccccttccgcctcgcggcgcttcctcgctccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacagcggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaagttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaactta

SEQ ID NO: 579983 - DNA, 3941 bp, Homo sapiens
cgggacgctcctcacttcctagatgggatggcggccgggaagaggcgctcctcatttcctagatgggatggcggccgggcagagatgctcctcactttcctccagccgcgagaccccctccccttccgcctcgcggcgcttcctcgctccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacagcggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcgctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaactta

SEQ ID NO: 579984 - DNA, 1042 bp, Homo sapiens
gcttgggccgagctggaaaggcgggccacctcggtcttcgctcctttgtggagctctggcagtaactcccctccctctctgtttctctgcaggcagcgcaccgagttcccgcgaggatccatgacctgactgtgggcccctgtgagcctgcgctgcctctcgtgtgtgtcctgggtctggtgtggtgagcccagtgctcgcagtgcctggctgggctgggcctggagggctgcagtctccctcgcggtgagaggaaggcggaggagcgggaaccgcggcgtgcgctcgcgcggacgcctgcggtgggcgaagggcagttcctgggcctgggccgcgcctcacgcagggcggcggctacccagcgcagtactcagggcccaggggtggccggcggctgacctgggagaaatacaaagttagtgcggtcaggtggatgcccgaagtgagcgaggtgtgtgcctgggcctcctgacccttaagaaggcaactcccactgcaggcctgagaaaggtgcgcatcatcgacaggaccgagaggctttcaggtagacgggatttactgcgggactggatgtactgtgcggtttgcactgggcctgcacgggggcgacccctgtgagaacacgcctggaaattggcccccggggacccgcgggaagatccgctccacgaagggcgaatgcgggaaacgggtgcctagaacaagaaaatgcatatcgagggagacacaagggacaaagtgccgagaagtcgcctcaaatgatctggcggccacgtgggaaccggcaggggacctgggcaaacgaggagccaagccaaagtccccttgggagcgagcgaggatttgggaaacggacgtggggggcccaaggaccgaagttggcaacccgacccgattggcacccgaccctcgctcgaggagctcgcagaacgcgctggagaggaaccgggctgagcttaacgcaaacgagacagtcggtcacaggcacgcagcaggggcacgatcgcgcaagggtggggacagaggccgcaggagcgacacg

SEQ ID NO: 579985 - DNA, 3885 bp, Homo sapiens
cgggacgctcctcacttcctagatgggatggcggccgggaagaggcgctcctcatttcctagatgggatggcggccgggcagagatgctcctcactttcctccagccgcgagaccccctccccttccgcctcgcggcgcttcctcgctccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacagcggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaactta

SEQ ID NO: 579986 - DNA, 249 bp, Homo sapiens
  misc_feature (53)..(53): n is a, c, g, or t
  misc_feature (70)..(70): n is a, c, g, or t
  misc_feature (77)..(77): n is a, c, g, or t
  misc_feature (80)..(81): n is a, c, g, or t
  misc_feature (84)..(84): n is a, c, g, or t
  misc_feature (109)..(109): n is a, c, g, or t
agaggacccggaatgtgtggtgttatggaggagcactttctcataaatttagntctgatatctgaaactnttttaantanntanttgaaaatgaagttaggaaggctanatataattatgtccagtagaatattcttttcctaaaattagtggaaccggccatctgaaagcatgttgagaagaaacaccctcgtgatcaaccacaacaaaacaaaataaccacttacggtggcataacaccacacaatt

SEQ ID NO: 579987 - DNA, 800 bp, Homo sapiens
gtatatcgctcacacctcatatcctccctactatgcctagaaagggataatactatcgcctgtgcattatagctactctcataaccctcaagacccacgccctcttagccaatattgtgccgatggccagactagtcttggcgcctgcgaagagagcggtgggccgtagcccgtatatagtctcaatctccaacacgtatggcctagactacgtacataacctaaactactccaatgctaaaactaatcgtcccaacaattatattactaccactgaatgactttccaaaaaacacataattgtgaatcaacacaacacccacagcctaattattagcatcatccctctgctatgtttataaacaaatcaacgaacaacctatttagctgttccccaactttttcctccgacccctaaaaacaccccttctaatactaactactgatcctaaccctcacaatcaatggcaagccacgcaattatccagtgaaccacttattcacgaaaaaactctaactctctatataatctcccctacgattctcctttaattatacattcacagcaacagacagtaatcatatgaatatctcttcgaaaaccaacattttcccacacgtggtatacatcaaccggggagggaaccagccagaagctggagaaggcccatattctattacacctagaagggccttccctaatcattgagaattaattcaaaacctggccataaattaaatcacacggccagaataaagcgggcaaataatagacgcacaggttaggaaacataggactg

SEQ ID NO: 579988 - DNA, 1677 bp, Homo sapiens
cgggacgctcctcacttcctagatgggatggcggccgggaagaggcgctcctcatttcctagatgggatggcggccgggcagagatgctcctcactttcctccagccgcgagaccccctccccttccgcctcgcggcgcttcctcgctccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaactta

SEQ ID NO: 579989 - DNA, 713 bp, Homo sapiens
gactgtactgcttgcggtgtttgcgtgtggcaggagccagtgactggcgagcggggtgtgtcgcgactgcggagctggcagtgcagaaggtggtggtccaccccctggtgctgctcagtgtggtggatcatttcacccgaatcggcaaggttggaaaccagaagcgtgtagtaggtgtgctatatggggtcatgggaaaagaaagtacttgatgtatcgaacagatttatgcagtaccttttgatgacgcatgaaaagcacgattctgtatggttaatagaccatgatatattgtggaaaacatgtatggaatgtttaccgaaagtcaatgccagggaaagaatagttggctggtaccacacaggccctaaactacaccaagaatgacattgccatcaacgcacctcatgaaaagatactgtacctaattccgtcttggtcatcattgatgtgacagccgaacgtgcctagggcttgcctacagaagcgtacatttccagatggaagacagtccatgtgatgatgagaaatccaagccatccgaaaaccattatggaaccacggtgacacaggtgcaacttgggagccagcggaagctgcacagcaagattggacgaaagacacacgttgtatacggacgaatatcaaacgcaaagacaggtgaggcactctgctctagcgtgctaagaaacaggtacatgttagcagggctg

SEQ ID NO: 579990 - DNA, 489 bp, Homo sapiens
gcctgaactggtgattggacttgttgaaatgtttttccttttttcctcttttgtcccctggcactgggatggtggtggtctgtgggtgctgtctcagggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccaggtgactgttgcaaacagccaggactacttggggcttctgggaatatcctggggcctgggcccagagttgatgagtgctgtggtttaagccttgtgaccatgtaaaatgtcatacacaggtttaggaggttgaggtaaagcgagattatgtaatttgcctaaagtaacaaagctggagcttgtagatctaaa

SEQ ID NO: 579991 - DNA, 4126 bp, Homo sapiens
cgggacgctcctcacttcctagatgggatggcggccgggaagaggcgctcctcatttcctagatgggatggcggccgggcagagatgctcctcactttcctccagccgcgagaccccctccccttccgcctcgcggcgcttcctcgctccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacagcggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcaagtatgtagggtgggcagaagccacagtcgccgccgccaggggcttgctcctggctctgtcctttgcttccctccgtcctcgctcagttgtgatccagcagcccccctccccactgcctccccagctctcagtgaccccgactgtctcctgacttagccgagttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaactta

SEQ ID NO: 579992 - DNA, 4272 bp, Homo sapiens
cgggacgctcctcacttcctagatgggatggcggccgggaagaggcgctcctcatttcctagatgggatggcggccgggcagagatgctcctcactttcctccagccgcgagaccccctccccttccgcctcgcggcgcttcctcgctccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacagcggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcgtgagttctcattagctgggggaatttggcatggaagagctgaggggctgcaggtggggcaggatgcacgggttctgggtggggagtgaggggtcttggaggcagggctgtcccacagggcgcccgccgacctgcacctgtctgtgaagtatgtagggtgggcagaagccacagtcgccgccgccaggggcttgctcctggctctgtcctttgcttccctccgtcctcgctcagttgtgatccagcagcccccctccccactgcctccccagctctcagtgaccccgactgtctcctgacttagccgagttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaactta

SEQ ID NO: 579993 - DNA, 145 bp, Homo sapiens
agctaatatgtggtgttacgttatcgtggtgtacgtccttcaaggcactgacacggctccttcctcctttgtagtcctgcccccacccccacagacctcaagatggttctccttcacctcttttcccctctcacggtaacaccaa

SEQ ID NO: 579994 - DNA, 413 bp, Homo sapiens
ccgacgtggtcagtgtcttcactggggtgtgacgggtagttacaacgggcaagtttggtgatacccatcagactgcacacatacattttattgtatgtaaatcctgcctaaaatgtgattgtgtatacaatttcattctaaataaaataaaccaacatgggcaaaagaactttacaaattttaaagtactgtggaaagacaaggccactgtcattagtccagccacacagtgtgagtgtagaattctgtggagtttctcagatatgggggcttatcctagaccccaggatgagtctaatgaagacttgccagtacggggcttaaccttaaggtgcaacgtatgagaaccggactcaggagccagaggacaagagtctagagataacgcatgaagagaccggaggacaaaaagg

SEQ ID NO: 579995 - DNA, 4472 bp, Homo sapiens
cgggacgctcctcacttcctagatgggatggcggccgggaagaggcgctcctcatttcctagatgggatggcggccgggcagagatgctcctcactttcctccagccgcgagaccccctccccttccgcctcgcggcgcttcctcgctccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacagcggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcaagtatgtagggtgggcagaagccacagtcgccgccgccaggggcttgctcctggctctgtcctttgcttccctccgtcctcgctcagttgtgatccagcagcccccctccccactgcctccccagctctcagtgaccccgactgtctcctgacttagccgagttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaacttaaaaaaaaacaaaaacaaaaacaaaaaaaacaaaaaagaaaaaaaaagaagaagaaaaaaaaacaaagaaagaaagaagaggaggggcgcggcgcccgaccaaaaagacctccccaccggggcggcccaccactatcagcggccgcccccgcgtttttatcaaacaagggggccccccaaatagggggcggccgttattaaacaaaccacagcgcgggcgcgcggcggtataaaaacaaccgtgcctggggagcggacaacagcgcagtccgcggggcccactgctggaagaggacacaccacacacgcggggagggcacacatcggggcaaaacacccaccagagt

SEQ ID NO: 579996 - DNA, 407 bp, Homo sapiens
  misc_feature (12)..(12): n is a, c, g, or t
  misc_feature (26)..(26): n is a, c, g, or t
  misc_feature (65)..(65): n is a, c, g, or t
  misc_feature (302)..(302): n is a, c, g, or t
  misc_feature (344)..(344): n is a, c, g, or t
aatttgggtccncattcaccaaatgnccatgaagcccatcctacaaatcctgggctgcttacacnaccaattaatatggtttccaatttgtgccctgaccaaatctcatgttgaactgtaatccccaatgttggggtaggggtctggtggaaggttattggatcatgggggcagacattccccttgctgttctcatgatggtgaatgagttctcatgagatgtggttgtttaaaagtatgtaacacctctcctcctctctctgtttctcctgctctagccatgtaaaacgtgcctcctcccnctttgccttctgccatgattgtaagtttcctgaggcctcccnaccatgcttcctgtacagcctgtggaactgtaagctgattaaacctcttttctttataaatta

SEQ ID NO: 579997 - DNA, 197 bp, Homo sapiens
acctagacgtaacacaggttcggtgacttaaacaatagaaagttattttctcacagtcctggaggctagaagtccaagatcgaggttccagcaggatggattggtttattctaagacttctctccttggcctgtagatgaccatcttcttccggtttcttcacatgatcgttcttctgtgctgtgttacgtctaggt

SEQ ID NO: 579998 - DNA, 427 bp, Homo sapiens
ctgtaaaggagtccaggctagagccacagagactgttgtggaggtgagttcggctgtagttagagtgattggacccttcctattggtctgtcttgggccaactggtgggtgatctctgctgcatccaacatgggagcagagactggcagcaggaggggggaacatggtgacaagtggtgctcacttttcccattcctcatagcatagtttgcaaaagctagagagtggcatccagcgggcctcacgctagagcccagtcaagcagtgcagtttaagccgcgtaccgcactccagcaggcccttgaaccaggcagcgaagccgcgatcacatgttaaacttggcatttaagactgtgccaatcggccgattagcctacaggtcctagcttaaattcctgtcaataaatggaaatgggtttggttttaa

SEQ ID NO: 579999 - DNA, 234 bp, Homo sapiens
aaagtgtctcatcacacagatgccatgacgtcgccttgcgtaggtaatccttcttgggcagctgagccacttgtctctcatttggtcgaaacagcctgccacaggtatcaccactggctcatatagcttctgcttccagagacactccatcgccttgtcgatttatggaatgtctgggctcagacttcatgctcgtggcccagtgctaactgtatcttcagcttttttcaattc

SEQ ID NO: 580000 - DNA, 127 bp, Homo sapiens
atccccttctgttaccttgtcatttgccattcctctcacagctatatcaggttctccttggcagctgtatactggagtctggatatatgctctctaaagaccttaaataaaattttgtacaaagacg

SEQ ID NO: 580001 - DNA, 304 bp, Homo sapiens
tgactctcgaggatacacaacccgcaaccccctttggaatgggggttttaggatctacagtcaaacaaggtaggtcagggaatttctttatggctagtttttacacagaaaggcagagggaaagttaaagtcctatttttaggttttatggctggctttggagagaagggttctggtttctaggaccagccaagggaaggagggcttctagtttctctgaggcctctgggaaggatgggactgagagacaggagggcaggagaaggtcacagagagaagttcgcttccaaggccactgctgaga

SEQ ID NO: 580002 - DNA, 344 bp, Homo sapiens
  misc_feature (51)..(51): n is a, c, g, or t
  misc_feature (58)..(58): n is a, c, g, or t
  misc_feature (279)..(279): n is a, c, g, or t
  misc_feature (284)..(284): n is a, c, g, or t
agctgggattacaggcacatgccagcacaccaggctaatttttgtattttnagtaganacagggttttcccatgttgcccaggctggtgtgaactcctgagctcaagtgatctgcctgccttggctcccaaagtgctgggattacaggtgtaagcgtccacgccttgcctacatttttttaacaactaaaaataattcacaatatgcccagtgtttttgtttctcctaaaagttttactgtggttttctgttacaaattcatggctaaaatcatgttgntcttnagaactggaaagaagttactgactttaaaccattaaatgtatctacttcgtgtaatacag

SEQ ID NO: 580003 - DNA, 535 bp, Homo sapiens
  misc_feature (112)..(112): n is a, c, g, or t
  misc_feature (121)..(121): n is a, c, g, or t
  misc_feature (178)..(178): n is a, c, g, or t
agctctacacaggcagctggtgctgttctgccacacgtcacattttaaaagtcactgtattcacaggtaaaaatagaagttgctctgagaaattcttcctccattacaaatnaagtcacangtcttccgtatgtccactctagagtgctatcttccaatctaaaacagaggaactgtnttcaaacatcattagtttagcggtctccactaacaaagacatacggataaagtaacatgtaagtcagattaagaatctcaactttttaagaaaaaccaaatgactaaaggcatatttttattctatactttttgtcctataggtactctaggtccttgtgtaattattgaggacaaaacgtcagttaaaggtgagagggaaaactaggttgcagactagcagctgttttgcatctcacaagaacaaaggccttaacaaaccgtatactttatgcaaacaaagtgatgcctcactgacttaggagacaagtcacatgccatcagtgtgtcagaaaatttctttcttcactgatagtta

SEQ ID NO: 580004 - DNA, 169 bp, Homo sapiens
  misc_feature (2)..(2): n is a, c, g, or t
  misc_feature (16)..(16): n is a, c, g, or t
  misc_feature (27)..(27): n is a, c, g, or t
  misc_feature (44)..(44): n is a, c, g, or t
  misc_feature (97)..(97): n is a, c, g, or t
  misc_feature (99)..(99): n is a, c, g, or t
  misc_feature (111)..(111): n is a, c, g, or t
  misc_feature (117)..(117): n is a, c, g, or t
  misc_feature (134)..(134): n is a, c, g, or t
  misc_feature (141)..(141): n is a, c, g, or t
  misc_feature (143)..(143): n is a, c, g, or t
  misc_feature (167)..(167): n is a, c, g, or t
  misc_feature (169)..(169): n is a, c, g, or t
anccctggtgttgagngaacgtccttntgtccatcgtgggtaanagccttggggagggtgcagagctctgcagagccatgggccaggtggggctgcntnagtcctgtcccnttgggnactgaggagaggggccnattcacntntctcctagaatgctgtgtaaatanan

SEQ ID NO: 580005 - DNA, 400 bp, Homo sapiens
tctgtctgtgtagaacctcctactgtctgcgacggtctgctgtctctactgctacatggtcacctgcatctaggtcttctttatgccattgttgggcattggcctccgatggcatgcgattcgatggcatcatggtcagagtgacccatttcctaatggttcctactacctgataagtagctggagtgggcgacagagacaagtcatctatcaatagggtcattgccaaggagggaaagactgggcttggagagctgtgtgctggttcctgggaacaggcatccttggcttgagatcacaaatgggacagccccatcatgacgatacacgatcacattaacataactcagtgctctgggaagtcctgccattaagaaccccagttaacccaaaatatctt

SEQ ID NO: 580006 - DNA, 883 bp, Homo sapiens
gctggacctcttaatgatattgtgatagggaaatacaaatcgttgaggtcatagaatattcttcttcctctcaggagaagacggaagctggagtggacatggttcataaaagccagaagacgcaagatcccgtgttggactccggggagggtgactcatggtcctcctgtccatgtcttgtagtcactggagtctcactcccagagggtgtgaacaaatagcccgaaccctgatttctgcacgctctatctatggcactgcacggttgtagtaacgcttccttgttacaatgccagcagccatctatgatatttatgtggacccagaataactgagaaagagttgattttgtatcctcgcgattagatcccgagaagggtcaagagatatgcggcgaacgggccaatcggtgggccttaggtggagcaagggtgcatgtaaataccagattctcgctaggggcgtccatatcacccacgtgacaggacgtggcgtggtatgtcacgacttcaaccaacaagaaagtcaatcgcaacatcgagattaccctcatcaggacttcctcatgcttggactacgatcaagtggtaatgctacggtctcctttagcgattcatgtggctggggcgtagtccatgactgggaaataatatgaaggctttgcactcaagtttgaatcttcactgcgtaaatagttgatccccaaacgcatgggattcttgatgggggacccctttcagaaaatggggtgcaacggagggcgcccgggactctgggagcgagggaatgcatggtcttataacaatgacccgtgattaccccctggttggcttcacaagggtccaaataaacgcggatttaatctataagtggtctcgttaag

SEQ ID NO: 580007 - DNA, 574 bp, Homo sapiens
gctgcgcgcacgcggtcccggtgtgcagctggagagcgatgcggcaccgggagcccccggggggagtcctgcgcccgccccccaggagcccgcgaagatgccccggcgcagcctgcacgcggcggcgtgctcctgctggtgatcttaaatggaacaggccttccagcccgtgccccaggtgaacgggttccaagtggaacttattttggtctgggtggggggagaatagcgtccagaagtaccgtcgtgtgggggctgctgcagtccccatagactgcacaggacatctcagtatgagcgctcagcctcgagtcagctacatcgtctgcaacaagcagtttctcctgaccaacaaggccattcagtgaagctgaacctgcctcggacatgcacatccagggcctccagtctcgctacagtgccagcagtgactgatggggaacgaatgaccgagtctacaacgtcgggacgattgcgcggctgcctgtcctatctcaacttatcgagcagatgagaatcgagctcgtgcgtgttctggatgtctaacggcagagttcgccctattagtcagcga

SEQ ID NO: 580008 - DNA, 929 bp, Homo sapiens
gctcgcacgtctgttgttccgccgcgttccgccggtcgcgttctctgccggtcgcaattggaagaagagatcgccgcgctggtcatgacaatgggtccggcatgtgcaaggctggtgtgctggggacgacgctccccgagccggttccttccatcgtcgggcgccccagacaccaggcgtcttggtgggcatgggccagaaggacctcctacgtggtggacgaggaccagagcaagctgtggcattctgaccctgaagtaccccattgagcatggcatcgtcaacatgtgggacgacatggatgaagatctggcaccatagcttctacaacgagctgcgcgtggcccggaggagcaccagtgctgctagacgaggccccctgaaccccaatggcaaccagagagaagatgactcagattatcgtttgagaccttcaagaccgccggtcatgtacgtggcatccaggctcgttgctgtccctctacgcctctgggcgcagcagggcattgtcatggactctggagacggggtcacccacgacggtgcccatctacgagggtacgctctcccccacgccatctgcgtctggacctggtgggcgggactgaacgatagctcatgaaagatcctcactgagcgatgcttacatgctttcaccaccaaggccgagcgggaaatcgtgcgcgacatccacggagaagctgtggctacgtcgcccgggacttccgagcaggagatggcaaccgcgatctccttttctctggagaaggagcttagaggttggccgatggccacgtctcaccatggccacgcaccgcccgggtcaagggcgccagcctcctcctggatgacttccggtcccgaacaccttactccctcaagtggcggggtccacaccttccaatggttgtggccaccccgctttcgca

SEQ ID NO: 580009 - DNA, 548 bp, Homo sapiens
  misc_feature (140)..(140): n is a, c, g, or t
ggctctcctgtgctcgccatggtccagagtatatcttatgagaagctgaaccttccagtgccaaggccttcgtgtgtgcggagcgagtacagccccctgagtgtgttgaccattgaacccgtcggctccatcgcttacanagagtacgaagacatgatagctacgaggtgcacctgtcgttagcatgggggccacttcaacaagcctgcctggcagagcaatgctgtgggccttagagtgcctgggcagagagcttcctgtgaccagtctctccgtgctgctcagtgcacactgtgtgagcgggggaagtgtgtgtgtggatgagcacatcgagtgcagtgtccgtaggtgtaaagggcacactctctggtcgttgccataaaccaagtgaaatgtaactcatttggagagctctttctccccacgagtgtagttttcagtggacagatttgttagcataagtctcgagtagaatgtagctgtgaacatgtcagagtgctgtggttttatgtgtcggaagaataaactgttgatggcataaaaaaaaa

SEQ ID NO: 580010 - DNA, 1581 bp, Homo sapiens
  misc_feature (354)..(354): n is a, c, g, or t
  misc_feature (1093)..(1093): n is a, c, g, or t
  misc_feature (1298)..(1298): n is a, c, g, or t
gatttgattggcgtgatgtctcactagaaagttctccggcgtccctagtacatgggtccctcgagcttcctgatctcggtaagcgcaacagcaaggcagtctgtgggaaggtgactagcttcccctaaggactgatccacagtcgcgaagccggttcttagcactctaccaggcactttgccatgagggaatactcctggtctggacgagtgaacttctagcattgcgtgtcgtgagtaatgtctgaaaccatggtccagggaatgcacacatggctgagaacaaacgtatacgtgacgtgtgcgtgcgacggcgtgatgaccaatgtgctatgagaacaaccaccgcatgagntgcgtcttgtgggtgacaattgctgcgcgacgtgaacggttgcgtgaccaccatcgaggtgctgtcttggaagcctttgccatgacctgtgctccttgtgacgtgacagcatccatcatgtgtgatgtgacacgtgcttcagatcgcgtgtgtatctcctttcgaaatattgcccagatatccatcgtcagaccgtatccggcctatgtcacaccaagggttatcttgtgatagcgatactatgggggaacgcgccctaggggggcattgggcccaaccaaaggcccatgcttcggcagggaaagggcactcttttattgattcaatcgcataacaaatttcactagttcgacgctcgatgctcagacgattcaagtatgtcctccactcttgccagcattagtcggtcgcgtagccattttggctccatgccgcccactagcaaagcaaaggaccgcgagccgtgctactgcgtacgagttcgcgagggttggaactcgcttgaggtggcgacttgtcgtgggcccttcagcgaagaacttgtgtcctctggggggccctgcggccggaggaagaggcctattgttatggccgcacggtagaggattcacccctcggattgggagacccgaatgctgagtttcccgtggggactcggggattggcatttacttggacctccgggaagcggtttcccttgccgaggggggaggtagtatcgccaaaagggcgcacaagnagggcagtagctcttgaggtggggttcaagccaaaggcgatttggagccacaacgccaaggaaattcttgacgcgcggtgaaagtgagccccatgccgaagcgcggccttgccgtccaagtgtttgagggccgggttaacttgagggggcaattggggtatttcccttgaccttcggctgtttagaccctggctgtctctgagtnggtcagccggcgccttggggggcattgaaaaagggttaaagccaatcccctcccggcagcttgagtaattgtcaagcgcgcacaggatccttggctcacaggattagggacctcaggggtctgaccgttttatcccactgtggcctcgcggagcggctgagttcaatggagagtcagtggcggctcccacttggattattggacctcttaattttggggaaagaaggcattaaagccctttaggggtgggttttgggcccctcgtttggtggaggtcgaacca

SEQ ID NO: 580011 - DNA, 97 bp, Homo sapiens
gccagcaccaaccagacatctatgtacctctgtgccagcaccgacagggggaacattcagccccagcattttggtgatgggactcgactctccatcc

SEQ ID NO: 580012 - DNA, 960 bp, Homo sapiens
agcggaggttcgcgccggcggtagactgaggactgccaacagcagcggagaaacgtttctctttcctctcagtttgcgcacaccatggcggcccctgcccatgcagactactcatgcctgtgctgtgcgtgtgaagcgcaaatgtgcaaggctcatgtattgttgcctaggccaagctgctgctcgtgctgcattgctgaactgcattggctgtgtgcccctgtcatgctatgacgccctggtgctatcagtggtcactccttcatcacctggcacatatgacacgagcgcaaggtgcgatggcaggacggccatacagacctacctcaagcgaatacgggcgaacgtacgatgctatgcggcccacgcaaacaagctttaccaggaacagagtgccatccaccgacaacggccccacatcctgcgcacacgctgcaccgcgcgaccgaccgcgacctagcacttgaaactggcacggcaccgcgccattgcgcccattggagaagagcacgacgacaccgttcagggctccgcacccacttctaacatgtgggcgaattcattacaaggcacggaccgtccggaatgatgctctgcaccagcaacacccgaaagttttccacccacaggattaccgcacttgctttcggcggacacaacacacggatagggaagcaaaggcctagacaaaaatgttcgcaaccagtgtttccgcggccttcaccatagtcccgaaacttctaacgcgcggaaagccaaaatcaagtatcagacctcctgaatcaactatactcggaaccgacgctccgcttgcgcaccgcaacaacactactgtaggtgcattgcagcagcacttcctagctcaagtttctactctctccacaaaaacgcgggacatacttacactcttcgtgttcaaccgaacatacaagacggcgcgcaatcagctggccaactaca

SEQ ID NO: 580013 - DNA, 685 bp, Homo sapiens
  misc_feature (282)..(282): n is a, c, g, or t
ttttttttttcacaggtggaaggtttaattttataaatttaccataaagatggtttaaattcggcggtaatttacccagtattgccaagttaagtgccaattcccgtgtaaaattcatcggttcaaaccccaagtaacccaggaaacttccaatcaatatgtaacatccgttgggtctaagaaaccgggttaagtgagggatcggtttccagccagatcagtgtaattaataggtgggacttgatgagttttgatcaagtaattagtggtcacagaatctgnacataaaacataagagagcttctatagtctgaaattcccaaataaagttagtcaagttacttaactgggagcttgaggatgctttcttacacacaatgctgtttagagtagaccccaactgatttagcgtcatctgtagacacgtttcccccaccccacgtgtacgtgagtggacacacacaggcaccaggctaaatcagcagggatggcagaaccacctgcatggaaccaccatgaagtctccttaaagctcccataagctttcacatcttgacacccagtccagtggggccccaacctcccctgaaggagatggagtatcagaaggagggcatcgacctgaagaagcaggctgaccaaatgcagtgaccgtatgggtggggcgtggggagctcgtgccgaa

SEQ ID NO: 580014 - DNA, 315 bp, Homo sapiens
atatttagagcttcaagttaccacatttaaaagtaaagacttggcacggtggcacacacctataatcttagcactttgggaggccgaagtggatggatcatatgcagtcaggaatttgagaccagcctggccaacatggtgaaacctcatctttactaggaatacgaagattagccgggcgttgtgacgcacacccatagtcccagctaactccggaggctaggacaagagaatcacttgaacttgggagacagaggttgcagtaatctgagatcactccgctgcactccagcctgagtgagagtgagactgtgt

SEQ ID NO: 580015 - DNA, 180 bp, Homo sapiens
  misc_feature (176)..(176): n is a, c, g, or t
gcctatctctattagcgtatgtagtattgtaaaccatctgatttgcttgtttgtgtacctgcagtagtttggttttgtatgtgtgtggaaggattgaatgtgggaaattcaaggatcaatctccagagtgcaaccttctttggctgttttttccaaaattggcccatttacaactnaaga

SEQ ID NO: 580016 - DNA, 128 bp, Homo sapiens
ttatgagactcagtgtcactatgccatgcttctattatggttacatgtcttttttctttctttctttctttttaagaaagatttttttgcactttgcctgggtgtttttttttggttggagacagggt

SEQ ID NO: 580017 - DNA, 107 bp, Homo sapiens
tgagagcaatgaggaacctgaagtgagggctgaatggagaaatgatgatggggaagcaaggaccagtgacaagggttgggtgctgggtggaggctgctggcaggagc

SEQ ID NO: 580018 - DNA, 353 bp, Homo sapiens
  misc_feature (124)..(124): n is a, c, g, or t
aattacttcagaaatgttttttaatagtaaccatttaaggataaggaattccttctgaaagtagagacaaatgtttggttcacagtggcattttgcagccttcccatagattggattaatgttntcatgtgttcatgttgttaaatgtactaaatggaggaagactgctgagaatccttgtcatgattttaaacttgtagccataaaatatttactgaaatgaaatcttaattcttgttcattcctcctaagattagagggcagtttgtaaaaccattgtgccagtatatgtgtaactaagtcattgttggatttttgcctgagtcaaatgtcaccagctttccctcttcaaa

SEQ ID NO: 580019 - DNA, 391 bp, Homo sapiens
ggaataggtctactcctagtgcaggctgttttaccggtgatgttgttgtcgctcagctcttcagactcattcactgtcctgatctatatatataaagaaaaaacaggcagtattcccttttaaaatgagctatcaggaagttgctgagaaatggggtggaatacggccctgtaatggccactgaagcacgtgagagaccctctcaaaatgatgtgaaaggaccagtttcttgaagtccagtgtttccacagatggatacctgtgtgtctccataaaagtcctgtcaccaaggacgttaaaggcattttattccagcgtcttctaaagagcttagtgtatacagatcagggatccgctgctgctttccttcggaatccaatgcttccacaaa

SEQ ID NO: 580020 - DNA, 104 bp, Homo sapiens
cactacctggcttgtgacatttaaaaactaaagccagacgcatggctaactcaagcagcggcaagaccctagtcgaggagtctcatactgctgtccaacggggg

SEQ ID NO: 580021 - DNA, 253 bp, Homo sapiens
cttaaagcctgcccatcgtactcttcaccagcagccagcgatgatgtggagctttgggattgtgatgtgtcgaggtgctgagctttgtggagacaagccttatagggagagaatgagcaatcagcgaggttatgaacgagcattgaggtatgggtacctggttgcccacctcctgatgtgactgcccttgccccttcttgtttgagcctcatgcaagaactgctgggctctctcaccggtgcccgccgggcca

SEQ ID NO: 580022 - DNA, 1039 bp, Homo sapiens
gccgccatcttccagtgattcgccaaaatgactatccctgagggaaacgaggagtaaagcacccgatatatagttctctaggcctttcacataacatgtaattggttcctattgtgccacatatggtagcggaggtctatgacgtaacggtgatatctcgtacgaacgatcaacggcgaataggcgctactaagttacaacaagagagaatgcgcccactacagatgtgtgatccatgagacagataactgtgatagtagctctaacgagtagtctaagcccatgcatgtctggttgtgcattcgtatggtccacacatagcaaagtttaggtggctcaagattctttgaccgtcgatgagattatttgttgctgtatgggattgcacacttaaagcatcttcctatagacgctctacgaatagcgttcccgtgataacggtagtagagatgggatagatcgatcatgagatcgaaggataacgaacgcctaagtgacgaagatggttaacctgtggtgtcatatctgtaatatgtcggcctagtcctagacttcccactcccaggaggaatgcacaccttttcgtggaggaaacccaatggggaaaagataagtccctggaggctgcttgggaacccttaatttcccctggattggaaatttccattggggcaataaattaaggggttggttttcaacacaacacacgaaggaggactttacacacacactctctacaacggggacccccttcgttggggggccttaacgcgaaaagccatgaaccccctcgggccacacaacaatggcgtctccgaaaggggggcgatttccttcaaaattgtacgaaacgagttcgcgggggtatcaacaaacacgacagcgttaaaccttgaagaccttgttgggcacgcccgttgcggggtgctcttaacccccttggattcccgcctgttgaccccccagaagtgattaattgtggcggcgacacaacaaggagtgagggacaaactccactgcgcgggtatcaccccccatg

SEQ ID NO: 580023 - DNA, 115 bp, Homo sapiens
gctgtgtctagtggctgcctccatatgcccccacttagatcgatgcttgtccagacgtttccaaggtatatcatctgctggctcttttatattatttcaaacacacagtagcgaa

SEQ ID NO: 580024 - DNA, 223 bp, Homo sapiens
atcactgcatgtgggagtttgagaccatgcctgggcacagtggaagaaccccatccgtactaaaaatacaaaaaaagtatagccaggcatggtgacgggcacctgtagtcccagctattcaggagactgaggcaggagaatggcgtgaaaccgggaggcggagcttacagtgaaccaagatcgtgccactgcactccagcctggggacagagcaagaccccat

SEQ ID NO: 580025 - DNA, 194 bp, Homo sapiens
  misc_feature (73)..(73): n is a, c, g, or t
  misc_feature (94)..(94): n is a, c, g, or t
  misc_feature (130)..(130): n is a, c, g, or t
  misc_feature (157)..(157): n is a, c, g, or t
  misc_feature (167)..(167): n is a, c, g, or t
agctgctgcgacgagtccactacctttttcgagagtaactcccgttgtcccaaggcttcccagagcgaacctntgcggctgcaggcaccggcgngtcgagtttccggcgtccggaaggcccgagctcttntcgcggatccagtgttccgtttccagnccccaatctnagagccgagccgacagagagcagggaa

SEQ ID NO: 580026 - DNA, 625 bp, Homo sapiens
  misc_feature (7)..(7): n is a, c, g, or t
  misc_feature (33)..(33): n is a, c, g, or t
  misc_feature (71)..(71): n is a, c, g, or t
cctcaanttggtcccaccctgagtaccagtaanactatatcctattgtttgcgccccaagacttcggtatntcgccttttggtcaccaagtcttaagggcttcactttggaacccttttgggcttcacatggctcaaggcgaattcttcctgccttaataccttccgagtagctgggattacagggcaccccgaaccgcacccgggtaatttttggatttttaattagagacaggggttcacccatgttggccaggttggactcgaactcctgacctcaggggatctgcccgccttagccttccaaagtgctgggaatacagggagtgagccactgcgcctgggctaaagcccgttctttctttagaaagccttctataggaaccacggacccagtggtcttccttacctcaaaaattagagccgatgggccattctagggtgtccagccctttcagcaacaaaaattccctcatagttaattcttgcccctctattgccccatctgaaaacatctgtccttaccaaggaaactatttttcacattcgttaatttttggtatatccagccccaaaagggggcttatcttattcattgcccggaatataccacgcccggggtgaac

SEQ ID NO: 580027 - DNA, 203 bp, Homo sapiens
agatggccagcttttccccgaggtcaacgagaaagagatcgtgagatcacgtactataggtgaactttagctcctgcagctcctttgacagaaatgtggtcgtgaaaattggacttttgcttttgctccagatgggtcatactttgcttggtcacaggacatcgcacagtaaagctgttccgtggtccagtgcctcagacttc

SEQ ID NO: 580028 - DNA, 303 bp, Homo sapiens
aaacggggggaatgggagtggcggggatggaacgaagagacagccctgagagagagctggttagagcagactgaagtgatccattatcaaatcagatgctttgacttgtcttgctgcttacttggacagtggtcaatgaaagaaactattatctgacatttttggtagcagttcttaaattaattcacctttcttttgataatcttgtatgttagtctagcttaggctaatgaaagcagtgaaatgtctgctgctttaagtgccctggacaaaccttaggaagagtctgtctgatagaacttc

SEQ ID NO: 580029 - DNA, 163 bp, Homo sapiens
tgactgcagcttgctctgtggcagatcacactaagatcgatgggtgagaaggctaggatgctatgttagtgttcttagctagtcacgttggctccttccagtgatggacagaaggtgttggccactcccttctaaaacacaggcgccctcctggtgacagtga

SEQ ID NO: 580030 - DNA, 772 bp, Homo sapiens
  misc_feature (416)..(416): n is a, c, g, or t
ttaagaggcgccatttccccgggttcaccaggaccccccaggggagagaactgggggggagaaaggaaaaggaggagaaaaatcccccgtttttccgtggggtgtgcgcccatatagtggggggatagccccaaatatctcggagcgcgtgtttttcccaaacatcttgggtggtatatatgggtggacagagaaaaggaggagaggagagaaagaggatatattttccctcggggactcggacctcggatatactctcacccagtggcctcggccgcctcgggcgccccccaataggagagctttagaccaagagtataccgccgaaacatttgtgtccaaattctctctctctaaaagagaaagatgtatagtccccgcccccagatttatagttgttaaagagaaagaccccncttataattaaagagaagagttatagagaaaccttagggacccaaaagcgcaccccagattcagcggtcttgtgtacatcccacagtgtcctgccagcgcaccaaacggcggcggttattgctctgaagaagccagcgttacccagaaaaaatataaagaaagaggctgccagaattaatagcttaaacattttggcccagagaatgaaggaggcttaaggagaagccgcccaggggcaccaattgcgaagagacgccagactttcctctttgcgaggttttacttttaagtttggatcccgtccaggaataagaattttttggggtaaccaattaataagatccagactttgtga

SEQ ID NO: 580031 - DNA, 319 bp, Homo sapiens
gcccccccggggccccccccttccggggccccccgggggtggggaaatccccttctgggttttttttttgggggggggggggttaaagcccccgggccccttccccccccttttttttttaggggaaggggtttgggtttttaaaggggggtttttttcccccagcgcgcttttttttttttggtttttaaggggggggggcccgcgcgccccgtttttcccaaaggggggggcggtttttttttgggggggggggcccgtttttttaccccccccccgcccccttttttgggccctttaaccttttttttccccccca

SEQ ID NO: 580032 - DNA, 259 bp, Homo sapiens
catttattttacaagatactttatcagtgtggctcttctcttaaacatgacaaaaggaagaaaataattgtggagatggtgaagtacataaacctcaagttctgaatttcattctaaaagtctgagacttcggttctcagttgtttttcctaattaataacgaagtgaatggccactttaaaagttttctggcaattatttctctcaaaatttatgtgtgtgtgtgtttctgtgtgtgtgtgtatgtgaagggaagaga

SEQ ID NO: 580033 - DNA, 149 bp, Homo sapiens
taatgatctaacagaagtagcaggattatctggggcaatggtggacaagtagaagaacatccttcccctcagaaacttggggtgggctgggcttcaatcgtgacttcggcagtgggtgggcgggtccagaagtttaaacagtgcatgct

SEQ ID NO: 580034 - DNA, 921 bp, Homo sapiens
gcccgtaagatggcgatggctgcggtagcagcggggggtgttgcctggcccggtaccctgtggacgggggccgatagcgccttccccgggccgtgaaccggctgcgggtcgctcttggggggcagcggcgaagtcccaccacctggccctcggtcccgccctccggggcggtccatgaactcaggtgtcgcgggcgccgagacatgaaccggagcagcaggcccgggagaacgccgcgccggacggacccagaggccggaagtcccgggggtccccaaagggcacaaggacccccaaggggcctgggggccttcccggggagcccatgttggccccccggtttttggcatcctccccggggtgcttggcccctgatgtgacgtccggactcgaatgctggcacacaattttcacagtgcgacaaattttccctgttcggaatccaaggcctggtaaaccaacccgttcccaaaacttataccccgggggagagacaaaatgagtgaaggagagagactaaatatgagaggacggggggagagagagaaactacatataccaagaaagcaacacgagacaagcgcaagcagaagaagaagagggcgcgggtccccccaccaccggtaggtgtgcgggggggggtaacgaagaagaaacacaaaagccgcgacccccaagcagagaagaaggagagggcgggggggggcggggcgccgcgcaatctgatgtgttacttcagtatgaagagaagacagcaaaaagacagcaaggacgacgagaccgctcagggcggcccagcgacaagacaacgagacgagaaacagagacgccagggagggaggagagagagtgaagaaacaaccaaaccctcaacttatattaactccaatagcctagaacacgacatcagagccacgcagg

SEQ ID NO: 580035 - DNA, 1198 bp, Homo sapiens
gtggggccaatcctggcctcagggacgcaccgtgagccgcctttccgggcctcagtgcggattctcctggcgctggccctggaagcggtcggctctggagctcccgtgtgtgtgcggccctcgggtccgccaatgcgtgggctcgggggactcgcgtgagcggtgagtagagatgcggcacgtgctggtgccagagtgccttgacgtcccatgaggtcagaggagacaggggggcggagacgaggagggacgaaacaccgtattcacagcacaagcgagtgaggaagccacaacgacagtgatacgaggcacagacagctcagcacgcgacacggagatgcgtggcagataccgagacagaggagacaggcgcccaagggccactaggagatagttgccacctagctgtggtggtagcgagtgacacgcgattgggtgaaggcaacaatacgcaaggataagcattgcgcagtcagacgagagaggaagggcacctttgtggaatggggctacccagagagggtccaccatgaagagggaacaccaagggtgggattgagcagaccgtgggattgtgggcaacgcgggaacttggcagcgaaggcaccgttggttgggacgttggggccatccagcagatggacgagatacgacgagacgttggaaagagtcgcattggaggaggatagtacgagagagagccattagaggaagaagagagagggagagttcgagaaagagcggttcgaaagtttcgcatagggaactaaaggacggtagggagcgatagaaggataagcgcggaggagcagcaagaatgagatttatagtgtgtagggacataagaaagggagcaatgaattagacatattggaagggaggatgaacacaaaaggagagaagacacagaaacggcgaggacacagtagaccaggcgaccaatacagatagggcacccaacacggaccgaggcagacgcgtggtagcagacgccagtacaagtatgatcacgcgctaggagggaaacaaccatatgagggataggagagcagacagccagacgggggaggagacgacgacgagggcaaagatacacagcattaggaacagaggacgtagggctgataccataggagtgagttagacagggattaagtcgagagagaaggggcggaacagtgactgcagagacggcacg

SEQ ID NO: 580036 - DNA, 511 bp, Homo sapiens
catgcaccagggcatctcgaggcacccgggctggctgctttcagcccggagaaggtctagcgagaatggagtgtatgtagtgtgagtgtgtcttgcatggcaagtttggggcactgggcctctgactccctcccccccccagagcagggaggacccctcccccccccccctggcgagaccgtttactgttgccgacttgccctagtttttgcccccagccaagattttgaaggaatgagtggccagcgccacgggcccaggccatgtggcctgccccgcctcgatgtcacttggcgcgcggggttgggtgggggtggcccgccgcatccccgccctgagatgcttcactttccttctcgtaacccgactttggaaaattgttcgtttcatcaggctctgttcctcaatggccttttgctacgtgcctcccgagaaatttgtctttttgtataaatgaccaagtgttgaaaatgtatttcctgaaataaatgtttcccatgcaggaacccca

SEQ ID NO: 580037 - DNA, 558 bp, Homo sapiens
gcctgcattgtgaataggtaggtgatggtatatagaatgataggtttgtaggattatgatacgcatcagtttggcaggttacattcaggtatccaaggaacattcatatggttaaccacccaagtcacagcctttggagtttttctctcgtgtctcctattgctcctgattgataaccattccctggtatcattctgtcactcatatttacataacttactctcgattgccatatggtcaccttttaaaacatggtttctctttcaacgtgcgtctgcatagcatctccgttttctacaacctcttgcgttccctttctccactcttctacataggctatcacggtagctttataaagtgcaaatcttacttcactaaccaaaacttgttcgtagctctactgtcatctacttgagtccagattctttagtttgcagagttattccatgatctgaactctgctttatttcctaaattcttgttttcttcaaactcatgctttttcaagcatagcattcattattacatatggtatccaacctacctatttcacaatcg

SEQ ID NO: 580038 - DNA, 686 bp, Homo sapiens
gaataaaaggaagagctctgggtttgcttttgatccaagtgtaaattattcaaaagtttactccagatatagacctcaatatggctactgggttataggattacagaatacatgtgaatataatgcttttgaggactcctcctcttctgatcccaaggttttgactctctttatggctgtgcctccctgtcgtattggggttttcctagactatgaggcaggcattgtctcatttttcaatgtcacaaaccacggagcactcatctacaagttctctggatgtcgcttttctcgacctgcttatccgtatttcaatccttggaactggctagtccccattgaattggttttgccaacgaacttcttaattttctctatttctttacaccacatctctctgctatatatagccctttgtcgctagagactcagattctgcaactgagttcatctctactgagaccatctcttcctatctttcaccttcttttacttacgaatgtctttgtattcatttgctagggcttccactagcacagcatcatacgattgctgactttaaactagtaattgtcatggccgtactgttgggctggcaaatcccaaatctacgaattccagacagagacggaccatccactgaagtctgaaaggcaagggtctctgtaacatagactcttcatacc

SEQ ID NO: 580039 - DNA, 915 bp, Homo sapiens
gcccctttctttgcggaatcaccatggcggctgggaccctgtacacgtatcctgaaaaactgagggcctttcaaggctctcatcgctgctcagatacagcggggctcaggtccgcgtgctctccggacacactcacttccattttgggcctaaacacaagcacgcagcccacgtgaattgtctccgcaaaattttcacctgactcgtgcacaggtcccagccatgttgaggcgtgactgactggatccctgtgtggtctgagagccaacgcgcattgcctagctctgtgagcagatgaggagcttgcggggaagtacctcccagaggcagctagccccaggtggttgccaggggggtgagctgagctgattccgatatgagtgccccagtcagtgccctgggtgttgcccccataccttgggcattcaagtgtcacccacaacaaacaagccacttgtagacatggcaagaggaggaaggtgaggcgaattcttgggggcctggttgggattcttaccttgaaggacgaggacttgactggtgggcgaaccgaagtgacatggttggaccatcacagttgtgctgcccctgttgtggctctataagcaggtctagagcctcctttccggcggcatgcccaaataccaaccgctgttccgtcacctgagttagcaggccagtgcggggcggtctgggcgacggaaccggggtgaaaggatgcccggttgtccaaagtctgagagcccaccttaagggcgccagggaagagaggcacggaagaacgagacccggcggcccagggaaaagtcacgccgccgcggaaggtacgtgacacggctgcaccggcgacctcacccaacctgggggaaccacccgagcccggcgctagcagcagggcggacgcaacaagtagca

SEQ ID NO: 580040 - DNA, 248 bp, Homo sapiens
ccccgggcccccccgcccttttgtgttttccccaaaaaggggaaggcccccccccccccggggcccttttttgttttttccccccttccccccccccccgggggggggggggggggggggcccccccgggggggtttttccccccaattttttctttgggggggggggcccctttccccctttttttttccccgggttggggggggggggggggggttttttttttttttttttgttgggggggggga

SEQ ID NO: 580041 - DNA, 131 bp, Homo sapiens
tcggacatacttctggtggcacgtgcggaacttgaggatagatcagtgagctgcatgcacttacaggcatgtctgtctcctcacttagtgcatgtccactcgaccaaagccctattctgatcattactcat

SEQ ID NO: 580042 - DNA, 296 bp, Homo sapiens
  misc_feature (71)..(71): n is a, c, g, or t
gggggggggcccggggggttgggaatattccgccttttaagggggttaagggggccccccttttttggaantttggggggggggggggggcaagggggggttttttttttttttttttctttttcggcccggggggggtgttttttgggggttttggttttttccccccccccccccgggggtttttttttttttttccccccccccccccccccccccggccccccccccggggttttttttttttttttttcccccccgggggggggggggggggggggttgtaaaagggggga

SEQ ID NO: 580043 - DNA, 103 bp, Homo sapiens
  misc_feature (103)..(103): n is a, c, g, or t
agggctacccaagccgatgccagcatcaagctttcccttaattggagagctggctaaaaaagctgggaccttggctcccatattctgggcccttcaacctggn

SEQ ID NO: 580044 - DNA, 500 bp, Homo sapiens
tctagcaggatctccaaagatctttgagcatcacctgccatttcctcctcctctagcccgctggaagtcatcactgtattctatgtttctataagtatgactattttagatttcacatataagtgaggtcatgtagtacttgtcctttctttatgtggcttatttcagttagcatagtgttgtccaggtccattcataatgtcataaaaggtagaaaatctcagtcttacttggtatacttagaccacttacagttaatataatcacttatgtgttagggcatatgtctgtcattttacttttggttggtctctctgggtttggtttctctgtggtcttctctctacttttccatgggtaacttgaaaactctttagaattccatttctatttatttatagttttttagtgatttctttgcatgccttctttagtggttcctctaggcattacattatatacttaacttaaagtctacgggtgatgctcaaagatcttgg

SEQ ID NO: 580045 - DNA, 316 bp, Homo sapiens
  misc_feature (3)..(3): n is a, c, g, or t
  misc_feature (148)..(148): n is a, c, g, or t
  misc_feature (184)..(184): n is a, c, g, or t
  misc_feature (219)..(219): n is a, c, g, or t
  misc_feature (260)..(260): n is a, c, g, or t
  misc_feature (270)..(270): n is a, c, g, or t
  misc_feature (297)..(297): n is a, c, g, or t
ttnccctcacagagttttagttagaatcactttctctatttccacaaatccttcttttctttccttttattttctaaagtgaatgtccaagcaaaaaggaagcaaaaatggtcaaagatctctcttacaatatagtaataaatttatncaaacaacttggaattcaccctgtgcattgaaaatncaactccacactgcaaattatggcattttttcccnctcaaaggaattagtgaactccattggatgcattcatactnctgtttaggnaataagggaaaccgctttgtaaaagtncaacatggcctaggagtta

SEQ ID NO: 580046 - DNA, 308 bp, Homo sapiens
gactcctgcgccatcttttctgtccctggcttacctcaggctcgggcattgaactaagtacaagcagccaaggcgtcagatctagatagcagagacgtacgtctcattctacaacattgcaactactgttagagtccaccccatgaagctgtttcagatagagtatctatgactgaattctataagtatatattgtacagactaaaacaaatgtagctagctaggtaggcatgtgctgtctcagtaggacattgacagactccagcttacaccctctggcgaccttggaacctgagtgccacatgcat

SEQ ID NO: 580047 - DNA, 1013 bp, Homo sapiens
ctttttttattagggggcaggaggtgtgtttactgtgtacattcaaaccaagcagcagttccaacagattgaggcaggctttgtgcttgtacatggcggaaggccaggaagagcattcttaaaacgactaaatgagctcctgtgactggcaaatcaacaactgaagtttaatggtcaacatgtgcttccagtgtgctatggaatcttcatgcagcttagtcttcttataggcttcattttcccctatcatcaaatcaggggaacggccaggcacagtggctcatgcctgtaatcccagcactttgggagcgccagggccacgcagactgcttgagcgccagcgagttcgagcaccagctctgggcaaccatggctgcaaaccccatctccactaacaaataacacaaattagctgagcgtggtggctgggcacctgtaatcccagctactcgcggaggctgaggcaggaggattccttgaacctgggagcgccagaggttacagctcagccaagatagcaccactgcactgcagccctgggcaacagagcaagacttcatctcacaaatacctacctccatacaaatcgccaagagttccctcttcaaggcatgcgcaaggaacgtcagatattcttgtcactgaacagggtgccgggcccccgacgtgctctccaccattccctgcaccctgctccccaatcctcttaccccattcttgccgcgacaactacatccactctgcaatgctccctgggcattggccaacaggcgtacccaagctgactactacttacccaacctcgcaacttcgccacattcattaacaactagttgcatgttactccatctagccccccttacatctccacatctggcaccactcctactctcctaacatcataacaaatcttatgtcaacaccatcacttggaaacacctctacttttgccccacaaccacatccaaatccgcttataaacacgagctcaacaacatgcaccactatcgcaa

SEQ ID NO: 580048 - DNA, 878 bp, Homo sapiens
tatatactgccaacaaatatgcctgttgatagttaggcctcaccccataggtgtcctctgtctcgtaaacagacattatatatgtctgggggctgaagaaaaaaccttgcattccaaaggtccatactggttacttggtttcattgcccatcacttattggcaagtgtctcagattatagaaccatttgagtcatgcgtccctctggacggccttgcgacaggagcttgacttggtaagttgtggagaataactgctgaattctgcacgctgtttgtgagattgattctgtaagccactgcaaccactaagctcaatatgaaaactattcaaacttatttattcatcttgtgaaaagtatacaatgagaaattttgttcatactgtatttatcaagtatgactgaaaagcaatagaagtatatattcttattattatgttaaattatgattgccattattactcggcaagacatgtggagtgtatgttcttttcacagtaatatatgcctgttgtaacttcacttggttattttattgtaaatgagtacgaaattcttaatttacagagattgtatgtcactatttatttcattcaatttctttccttgtttacgtaaacattttcgaaacgattgcatgatttcttgaccagaaatcgatcttgatgctgtggaagtagtttgaggaaccatcctatgagtttcttagaatgtctaaccggttgaagcccatccaacttcaaagaaaaaaaattgaacacataactttgcaaccaggggtgacattgtgggctgctttcttattccaattttataaagtagcaaaaaggggttgcttaatgccaccgttctactgtgaaatactcgaagttacacgc

SEQ ID NO: 580049 - DNA, 209 bp, Homo sapiens
acttattaatacaatgtttaaaaaagaaatgtatgaccctgtcttaaaaaaatactaaacaaaaaaggaagaaatgtcagtattaaatcctacttgtatacgccaatatttgagtttgagtatcttcttaacaaattaaatgaagaggaaaatccttcttagttatctgcagttgcacatgatcttctgtggctgatgagaaaccgcca

SEQ ID NO: 580050 - DNA, 118 bp, Homo sapiens
ctgagccggtccgacatttttgggatatagggcataaatacatcatcatctagttcttctcattctcaataaaagtgcctttagtatacctgtgtatttttattttctgcattcacta

SEQ ID NO: 580051 - DNA, 946 bp, Homo sapiens
tctcgcatgtatcaatgatgagtactatgtatgtcctatatggtggatccgggggcagctggaaggagcatcactgacggctgtctgccaaatcaaagtgtttatgatgcctatcggaaggtactagtgagtagtcttgaccgtgtgggctgtccactccaggcacagggcaaatttggggaagatcatcagagagatcttaccctgacgatcaaagctacgaagggcttggtgggccggggaccagtccaagagtatttgctacaggtgggcagtagatggagtgaatgatctcttgtgtgctctatgaccagtccctgggcgcttgggagctgtgatcctaaagggttctgaggaggtccagaacgtgggcccagaagataaccccaggagctcgagatgaactggtggaggcagcgtgtgccctgacctgtgactggcgcagagcggatcctgaaagcggtccttcaggtttccatcgtatagagagtcagcccgcttccctgctacagcagcatctcatctctgcccgatctgcaacatgcccatgtgcttaaggccatggggctttgctgcatgaggacgaacatgcacctcgggaacggtcatctaaaccaaagaatggtaagagaagccagagggtggcagcccacaagaagccagagagactggccagtcctcctaggtgatctggaagcccggaactgtgggccgtgtcctctcgccactgtggacgagcgggaagcaagcagtgtaagtggagagctccggcccccattgttgccaataagctcgcgggtttacttgccctagttggctcgggttggcactctggctcccttaccacgggggcccgttggtcgattagttccgccaattcccagtctatcaagagaatacggggccccaaggattcctccagagtggcctgagaaagtggcacacg

SEQ ID NO: 580052 - DNA, 256 bp, Homo sapiens
tagctgtacttgcgtgtctatgaattacagtactctaggtacttcatataagtggaatcgatatagtatgggtcattttctgccggatagatttctgacatgtaagtgtttctttcgcggtgccgaggctctgttcctctcccggcatttcctccctggaagcctccaggtttctcatttggtttctgcctgcggttcttttcttttctccacacatcacactggcatgcagcatgtagtggcgtgtgggcatggg

SEQ ID NO: 580053 - DNA, 328 bp, Homo sapiens
ctgccgcttgtccttgtgtctgggctgctccaagtccttgtgctgggcaccctggacacgttctgctggtgagggacctcgggaaggtgacagtctgtgtgccttggtgtggagaccaacctgaggatgtcctgggaaatgtttccctgatgaattactacttgactggcctttaaagaacataagaattccctatgcccatccttagagcatttgtcaaatgctttctttagttcccagagtcagagaattggcaaaggttctctaattggttatattggccttgcctgtgagaaagactcacgataaaagccatgtgtgagaaagc

SEQ ID NO: 580054 - DNA, 303 bp, Homo sapiens
  misc_feature (30)..(30): n is a, c, g, or t
aggccagcccatgccagccggcttggcccnctgcaggcctcaggcaggcggggcccatggttggtcccttcggtgggaccggatttgggcctgccttttaaaaacccttagctaccttggggtttggggtgggtttttgggaaagtgcttccccaaaacttccctggctcctggcctgtgagtggtgccacaggggcaccccaatttagcccctccccgggaaggaggaaacccccgtgggcacgtgtccccttttaatcaggggacagggctctttaataaaactgctggcagggccccgga

SEQ ID NO: 580055 - DNA, 207 bp, Homo sapiens
cccgggatgtattggcttatgattgggttgattctcataataaagagagtgtatactgacatgggcaggatgataaaaagtcgagggtttgaagtattgtctttgggaaagctgtagtgccaacaaggtctaagttatgttgtacaacatgaagaaaacctcaaagttcttaatgtttaaaatgcctagaagacaatatttagtctg

SEQ ID NO: 580056 - DNA, 781 bp, Homo sapiens
ctgctggttgggtgtaagagcggcgcagtgccgggggagccaaaagtgcgttggcgccataaaaatgttagaggggaattggcgccctgcggccggcccgcgttggtgcagacctgtcttgcggagctctccacggtgccgcgtgggaaaatttgcctgtactagtgcttggaagtgcgatcctgtggagagggcgaagcaaagcgagaaatgttttctgctatctagagagcgtgtaccgccagagagactcccaaagatgtgtctcacgaggaggtttatatgaccgcgcgccgtaaaatacgcctcccccccggtgagaaaggtcatattcaatgggctggtaaaagcgtccaattggagctgtcgtcgccaaatttatgttcgttacagaacaaggttgagcccgcgagggtgaactcacttggcgctggcagttcaccatgcggggatgagatccccccacgcgcccgccccctgggacaaatttgagaggctatatatgtgatacgctgccacttgtatacttaggctttgaatcttgcgcaacgcggggaacctctggtgtaaggaggacaatttctacgaagaattggcagtcagggcaaacaggggcgctagatgagagcgagaaagttgtgcagaaatcccgcggcgaggcactggcaggagcaacaataaacgaatgcttctcgacgctacaggaagcatacccgtgcgggaacacagcacgcccgacaataaacaccagttgttcaaacgccccaacaatgaacagaaa

SEQ ID NO: 580057 - DNA, 384 bp, Homo sapiens
acttgtatggcgggacttaggtcaggagtcgagaccagcctggcaacatggtgaaaccccatctctactaaaaacacaaaaattatctggtcatggtggcgtgtgcctgtaatcccagctactctggaggctgagtcaggataatcacttgagccccggaggcagaggttgcagtgagccaagatcgtgccattacactccagtctgggtaacaagagcgagactccgttgaaaaaaaaaaggaaaaaaaattcctgcctgtaatccaggttacatgtcaggctgacacaggaggatcacttgagcctgggaggttgaggctgcagtgagccatgatggctccattgcactccaggctgtgacaaggcgagaccttgactccag

SEQ ID NO: 580058 - DNA, 558 bp, Homo sapiens
ggcgtgggccaataatctaccatttggaatggctgtatttacccaatgcctgtacccctatggtatctaaggaagtaactaacttgcttttcattttacaggctcataggcagaagggactagccttgtctaggatgagactttgaactgtggacttttgagttaacgctgaaatgagttgagactttcaggaactgtggggaaggcatgattgattttgaaatgtgaagatatgagatttcggaggggctaggggtggaatgatatggtttggctgtgtccccacccaaatctcattctgaattcccacatgttgtgggagggacccagcaggaagtaattgaatcatgggggcagatctttcccatgctgttctcatgaataagtctcacatgacctgatggttcaacaaatgggagtctccctgcacaagctgtcttctcttgtctgctcctatgcaagatgcgcctttcaccttccaccacaatcgtgacgcctccccagccatgtggaattgggagtccacataaatctctttctcttcgcagtctccagcgt

SEQ ID NO: 580059 - DNA, 132 bp, Homo sapiens
atgttcctgatgctgattgtcccttcactttaacaaagcacagaatcccaggcccactctctatttcgtgtgcctccgggctacgggagcataataaggaaatgcactctttctgcctaagttaagaacact

SEQ ID NO: 580060 - DNA, 229 bp, Homo sapiens
ctagtgacgcagctcttcccctgggactctagacaacatattgggtcacaatgaccctagttctaacctccctgtgcttatgaattcgaacagcatacccccgattccgctacgaccaactcatacacctcctatgaaaaaacttcctaccactcaccctagcattacttatatactctctctccttacccacttacactctccagcatttcccccgtcaaacccaaac

SEQ ID NO: 580061 - DNA, 105 bp, Homo sapiens
cattactcagagaaccttctactttgatacgtgttgtaattcttgagctaatacatcctgacgggcgctgacccccttctgctggtgggatgcgtcatttatcag

SEQ ID NO: 580062 - DNA, 216 bp, Homo sapiens
ctcctcctaggtccacctatgagaaggcttaggtactttcacagtggacacgtggatccaactctacagcaaactactctttaggaagagtacttgaactacacacaaaagctgctgctttctggctaatgaaagcaaggactattcagccacacagaggagggtaacagtacagcagaggctcctagttgcttacaagcttcagttagaggagtt

SEQ ID NO: 580063 - DNA, 158 bp, Homo sapiens
agcttctgagatacagacaatatgctctagattatacaaaagtcagaatactactaagatagacttgaataccaattcaactttggttttaacaatctgagtggaaaaaggccaaggatttcagtacaaatcttttgccagtttatgcaatagatgta

SEQ ID NO: 580064 - DNA, 787 bp, Homo sapiens
tctgagaagccggactacgcggcagggctcttcaaagcggacgccgggagttttgctacagttttcgccaccatgagtcgcagctataatgatgagctgcaggttctgtggagaagatcaataaaaactgttggaggatcaagagagggtttcgtgcccaaaataatgcaggttgacgggtgttttctatgtgaatgatgctctggagaaatggatgtgggaggaattagggaatgccttgtcgaggtggtggtgtggggggttcctgccaagcctatggaaaccagtttgtggcaatgtggcaagccctgctggattgtgtcatcgatctatgggggcttccttgatggtccatttcagggatatgggttgggctatgggggaacatggcagcttggggatatgaatgacccttgaaggcagtagtatccccaggttggttgtcgggttttgacactcaactgtggtgtccggtggcttaagaacccaatttagatgaacggggatgtccagcctgtgaaggagcacttgcccaaggctatgtgtgaccacatcctggtggggcggggggtcaaggggtgtcctcccactgaagtgcaaagatctggagggagcctggagatgggggggactggtcttaagagaagggtaggcctggggtgaacaaaggcgcccgggagggagcccggaggcgtgcggttgcccaataagttcggaggggaaaagagccccccgtgggcccggggcggaccttgcgacccgggggggaccccggtcgcaaagggcc

SEQ ID NO: 580065 - DNA, 164 bp, Homo sapiens
tcgctattcatcggcaccagggaccagttttgtggaagacaatttttccacagataggggatgcgggttggggggtgccgatgaatagcgaggtgccgatgaatagcgaagtgccgatgaatagcgaggtgccgatgaatagcgaccctggtgccgatgaatag

SEQ ID NO: 580066 - DNA, 469 bp, Homo sapiens
  misc_feature (65)..(65): n is a, c, g, or t
cacgaggccgggacacccccagcgccgcccaatgtgcttgcagcgcggccggcggcgcgccgtanaacgtgacgttgtgcacggacagccgtttgtgtgcgcccgtcatctcagccccggttttcgatcgggacgccgaaccgttcccggaacggccggaattcggcgtgcagcgcgtcgaggttctcgccgatatcggtcagcaattgcgtggaatagcggaattttccgtaccggtcgccggggttgtcggccaggtaggcccgcatcgccgactcggcctcggccgtgagctcgcgcccgcagaaagcgtaataacgccgcacggccccaacatgatcggcgatgaagtcggtgtagcgcaggtgcaggatgcgcggatcgtcgaccaggggattggtcatcgtgttggcgatgctggcccgggtcatctcgaggtgcttcttcgcctctgcgtgcaggtcgaccg

SEQ ID NO: 580067 - DNA, 97 bp, Homo sapiens
  misc_feature (39)..(39): n is a, c, g, or t
aaatgcaaaatgagttttatttgctagtcctttttattnttaaatatattaaaagcacatgaattatattgtcttaatgttgtttcagttaatgatc

SEQ ID NO: 580068 - DNA, 346 bp, Homo sapiens
tgaaaaagaatgacaagacgattcccatcagaccaaactggagggcccactggtggaaaaagagggagcatttcagccggctccgcatgatccatcctgtcttcagtcagtgccttcaggaagggagggaaagacttggatgcacctggcactcaatccactcggcccctcgctgctgctgcggtcctggggctggaaggaactcccactgggcacacatctacagaggagggcgcggcgcagtgaggacggttactgctggagccgacacacagcgaactacatacttttagaaagagcctctgtcacatggctagaacaacaacgacaacaaagaaaacccaca

SEQ ID NO: 580069 - DNA, 464 bp, Homo sapiens
  misc_feature (87)..(87): n is a, c, g, or t
ggtatatcccaacacccacatctctctttcatacaggattgctgcaatactatattcttccaaccagtgagtagtctcaaagtgtgntgggcgataacatcagtatgttatcgcccaacacgccttctaattttggtatttttttggtagagacagagtttcaccatgttggcccagctggtctcgaactcatgaccttgtgatccggctgcctcggcctcccaaaatgctgggactacagacatacccactacaacaaaaaaaaaggaaagaatgaaatcctgtcattggcagcaacatggatggaacgggaagtcattatgttaaatgaaataagccaagcactgaaagacaagtatcacatggtctcactggtggaggctaaaaaagtggatctcatgagaagatagactagatgggtggtacgaaggtcagggaaagcgggggtgtgggggataacatca

SEQ ID NO: 580070 - DNA, 236 bp, Homo sapiens
gcgcatctagggtacagaaataggaagtgagtaattcattagccatctggggtggatatctcaccgtactggtggaacacatagcagaacatcacagatattaagatgtctaaggtctctatttacctttaatatactaatatcgaaggaagcaaattcaaggagatcttcaggattatgaaaactttagattagtggaacagaatgattcataaagactttcaaggcctcaacac

SEQ ID NO: 580071 - DNA, 376 bp, Homo sapiens
cttagcagtatgataagataacattaatatcatgcagagaggctccagttattagaacaccacgataccgtcaagagccagaaaaagtgtccatgtaaataaaaagtcagctgagtatcttaagatgttttttctttaataaaaagttaagaggtagagttaaactaccagatatacgttagttcactcagcaaacatgtatttatcttctgacattagccagggatagaactaggcattggagatagaaagctgaataagtcatgaatggtccctgccaagaaagtgcttgtcattttagtagaagcaggcaaatgtgaaaaaaaatgaacactataaagtctgtgttcaaagagatgtcttctttacctgccat

SEQ ID NO: 580072 - DNA, 145 bp, Homo sapiens
tcgcgctggtcactctccggacagtgtgttgattgccatgctgacccggctgctgtcgtcgactggtcgagttcttccaccacagggcgcatgtgctgctggggggtggttggtctaggtgctattgacaccttctcaaactcgg

SEQ ID NO: 580073 - DNA, 329 bp, Homo sapiens
acccatacccgtaacacccactccctcttagccaatattgtagcctatgacatactagtctttgccgcctgcgaagaagcggtgggcctagccctactcagactcacactccgaaaacatgataggccaagactacgtacataacctaaaacctactccaaagctaaaactaatcgtcccaacaattatatgactaccactgtacatgactttccaaaaaacacatcattggaatcaacacatacacccacagcctaattatcagaatcatccctctactatattgcaaaccaaatcaacaacaacctaataaaagctgtagtaacagg

SEQ ID NO: 580074 - DNA, 140 bp, Homo sapiens
caggagagcatatcactgcatggagacacaggtcctgtcaaatcacagtgtggatctgcaggctgtgggacttgaagactatgggaagcaaggggactatattccacgccaggtacgaacctgggttaagcagtatcgag

SEQ ID NO: 580075 - DNA, 255 bp, Homo sapiens
acaaagaacacaaaaacaaaaccaaaaccaaaaaaactatacaaccacagactaatgtaataataccatgagtccccagtcagctccaaccccatggtgtgccaaccccattttttcccatgcatctaaatgatcaatccaggctatgaaattctttatcctatttgtagcagcttatgcaggtgcagccaaacaccaaagcttcaggaccaaattggtccaaccctttacaattgtggggatttaaattttaaa

SEQ ID NO: 580076 - DNA, 264 bp, Homo sapiens
gggactgtgactattcagagataccggataatcaggcgctccttctgttggcactggacagggccattacgccgagattgatcaatgacgacttcaccgtagctgactgccgaggacttgcgcctcggtacgtcggtgattttgtgcagcaattgcgtgaggcggggctgatccttgaagaccccgccaaggccaggccgggtacctattattgggagggcgatgagatttggatgttgagggagcaagtagcctatcgtttgg

SEQ ID NO: 580077 - DNA, 120 bp, Homo sapiens
ctaatcactgggtaaaatctgtgcctgccctttgaactattcacagagtaggttgaaagatagaaacaatgcatagaggtctaagtgtcacctcttacattatggaaagattttttcccc

SEQ ID NO: 580078 - DNA, 338 bp, Homo sapiens
cggtagtgtcagtacatgcttttgaacgtatgtaggtttgtcagaccatgctcccattttgttgactactagattaccaagaccgccgaccagccagaggttcaaattcgaacttggctggctacaacgggaaggattttaggttatggtcaaaagaatattggaaagaccagttgttggtgagtctccaatacagagatggaataataaaatatgttccttacgcaaacacttgcctagatgggctcgtcacacaacaggtttacttaaaaaagagaaacaccatctttcatctattatagatgacctcgaggctctagggggtctaaatgcaatca

SEQ ID NO: 580079 - DNA, 329 bp, Homo sapiens
catgtcactctctgtagggcaataagcgttctcactgtccagccccttcctaaaacaattttcaactacaacatggtgtatttaagcttccattgcatgtccctttagatttgagcagattacgtgtggtctttattccggtatcatattattaactgattttattttatttattcttatcttttgagacagagtttcactctgtcacccaggctggagtgcagtggcacgatcttgccttattgcaacctctgcctcccaggttcaagtgattcttgtgcctcagcatcccaagtagctgggattacaggcacccaccaccatgcctg

SEQ ID NO: 580080 - DNA, 377 bp, Homo sapiens
tccctcagtgcaatgcacatgtagcccaagagaatgaagcctggggagagcttctcaacaggacattcagcctcaggcacattctgtgaagtgccagaaagagctttatcaagagtttgggcacggtggctcatgcctgtaatcccagcactttgggaggctgagacgggtggatcacctgaggtcgggagttcgagaccaacctgaccaatatggagaaaccctgtctctactaaaaatacaaaattagccgggcatggtggcgcatgcctgtaatcccacctactcgggaggctgaggcgggagaattgcttggacccgggaggtagaggctgcagtgagccaagactgggcaaaaaagcgagactttgtttcac

SEQ ID NO: 580081 - DNA, 212 bp, Homo sapiens
tgttgacggaagcagcttgagggcaggcatgctggcaagaaaagggcgtcttaagatcttgtccgtatttggcccaggaccaagcctccgccctcagaatgttacagctggagggagggcggtggcgacacataatttctgccacgttctgagcacctccccaactgagctgggcagcaggaactctgagtacggggaggattggaaggccc

SEQ ID NO: 580082 - DNA, 137 bp, Homo sapiens
cggtaactagaatagatttacaaggagatcccgctgaatagcattgagaactcaagaaactatgttttcattagatgccttctaatatctgtaattcaaaagtaattatcttttgtcccttggctgagtattgcggt

SEQ ID NO: 580083 - DNA, 795 bp, Homo sapiens
ttttaggcattatttaaatttggaaagaaattgagcccttggggagttccttgaatcccgccgaaaactaaataattcaaccctttaaagtcgattcttctcagaattgaaaaccgagtcttttaaccataattacaggattctgcttaccctctaatggaaaaagttgtggtcattcctcggaaataacgaattccaatcccatccaattgaggaaacagcgttaacgcaaacattatcccctgggctcgaactcttaagcaactcataaacggagcgctctgggtaagggtgaaatgttttgtccaaggctcggaatcttcccttgcgcaagcgccccacagccaagagatctcaggggaccagaattcgcgcagaaatcagcaattgtgcctctcgcgcagcagaaaaggggaatccacatgtgtgcacactttgtatcagagcagacaccaagtctttggccataatctcgccgcgagtcgtgccacaccgacagtgtgcagcatgcgcccgcttgtgtgtcatagtcccgtcccgccagatacttgagcggtggctcagcacaggtcgccgttcttgtcgatgatcatgttcttcggcacagcgacgatgcagtatagcggcccaaccatgacagcagcggggggacctccgagcacgctcgttacagcagaacgcgcggtcaagtatggcgcgaaattgtggccgccccgcccccctcgtccccatttgtgcacgcgcagccccgccccccgcccctggcgcacgcaagggatcgttcgtgtcgcgccc

SEQ ID NO: 580084 - DNA, 180 bp, Homo sapiens
gtcgggtactgtacatacactgtaagcagctcaaggggctacagccctgacactagacgccacactgagcaggatgcacggcccggggtcacactgtccatggaggaggtggggtcagcctgaggtgagcggatggtggcccgagacaccgagagcttggtactagggacagaggcatac

SEQ ID NO: 580085 - DNA, 739 bp, Homo sapiens
cttcaaggcctttgggaaatttgagacggggtgcgcccaacttttttgtctcctgggggcgccacagtggtggtccggttgcgctcggcaggcgtttgtgtccaactggcaacacactccgcgcaaacaacatggcgttctggttaaaatgttgaaccacagttggtgtaaaccccctttctccctgtgagccgtcaccactgtgtcccttcgtttgcggtgccaacacacttctgggtgtgttgctgggggtgcctggtgttcaccacggcacaaaaactgggtggtgcaaaggaggttgtttggagttaaactgtggtcaagtttgccaacgtgttgtgtacccccccactgtgttgcgccccctctcatttaaaactgctgccctcttcatggccccctgagagcccattatagtggcgttttaatagagtctacccaccgtattgtcccaaaaccaaagcgcaacaagggctttgacattggtcagcgagcactcagctctgggttttgagaaccacacccccggtacttgctattctctcctacctctatgaccaatcgtccttccccgcctttactgcctgcctttttctgaggttttcccacgggtcctaggctcagaagtagggtagctcaaccctggtacaccaaggatttcctgagaagcctgtgaaaaagtccacagcatgtttctgggagtgattctaccaaggaaattaaaaattgtttaaaatcc

SEQ ID NO: 580086 - DNA, 498 bp, Homo sapiens
tgcctctcctcccacctcaaagtaccaggaatcccacactggtaaaattcctgagaatactgcatattgttagatatgcaggctcctagagtagaccagagttgcctaaatgaatcatcctcaatcttgttgcatactaaaaaaagagataccaggagaaagattttctcttcaatgcttgtaacataaaacctgtcttcctcctgagaagtccgcaagaatgaaaacgggtataaggcaatttacatttcaatgaaaagcactgcttagagtgaattgttatttccaaccggcactctcaatttgaggcacacatttgaaataccatggtgagctgccaacagaactctcttcacatactgtgtcgagggctaagaaatttccttgcagccagattaacaaagtaaagtgaatgtgagtggtgaagtccgcagtgtgcatatgtgtggtgtggacgtggagtgtatgtgtctgacaggggaggtgggaggagaggaa

SEQ ID NO: 580087 - DNA, 333 bp, Homo sapiens
  misc_feature (93)..(93): n is a, c, g, or t
  misc_feature (99)..(99): n is a, c, g, or t
  misc_feature (101)..(101): n is a, c, g, or t
  misc_feature (160)..(160): n is a, c, g, or t
  misc_feature (203)..(203): n is a, c, g, or t
cctctgtgctttgggacggcgatcacgagaacctctggagtgggagaaggccgtcaggcctggcagcatcagcaagtcaggagctgcggcggntctgcnangtccagcagcaatgggcctgtgccagtgcacagtacgtgtcccaggcagaagcctcagntttgcagcagcagcagtactaccagtggtaccagcagtacaantatgcctacccctacagctactactatcccatgagcatgtaccagagttatggctccccttcccagtatgggatgccggctcctatggctcagccacaccccagaagccatccgccgtcccaaggcacag

SEQ ID NO: 580088 - DNA, 695 bp, Homo sapiens
  misc_feature (597)..(597): n is a, c, g, or t
ctggactgcaaactcagcttgtgcctctctccagccctgtggcctcgctggacaatttttctaatctctttggagctgatcttcatgttgaaaaaggacaagtcccatcttcagatcaacacctgtcccagcgctgccattttcccaaggctcctccttggagtgtttgtaaggcacttttgccacgaagtaacccagccaccagcctcagtggaacctccaagcctaattctggaggagactttaactcggtgaccaaaagccagccccactgtgagttgaactctttcgtgttgaccggccactctcctgtgctctggatgatgtcggaacacgacctggccgatgtggttcagattgcagtggaagacctgagccctgaccacccaggtacagagctgtgggacagtaggtgaaatattattctctttattcttcaaaaaccaaaagctgctccagttattttctttcctttaagcagaagaaaaagtaatgcatgctgcgtatgaaaagtttgaatcctagagatgtgacactgtcggcccctcccttccctcgccccgcagcctcagccccacgtcccttctggaggggccnctgtgacactttgtactcgagggccatacctgctcccactccttgggggatagcgtgtgttctacactaactcccctgccgcgtctcagtgtcgcata

SEQ ID NO: 580089 - DNA, 519 bp, Homo sapiens
  misc_feature (411)..(411): n is a, c, g, or t
  misc_feature (421)..(421): n is a, c, g, or t
  misc_feature (487)..(487): n is a, c, g, or t
ctggactgcaaactcagcttgtgcctctctccagccctgtggcctcgctggacaatttttctaatctctttggagctgatcttcatgttgaaaaaggacaagtcccatcttcagatcaacacctgtcccagcgctgccattttcccaaggctcctccttggagtgtttgtaaggcacttttgccacgaagtaacccagccaccagcctcagtggaacctccaagcctaattctggaggagactttaactcggtgaccaaaagccagccccactgtgagttgaactctttcgtgttgaccggccactctcctgtgctctggatgatgtcggaacacgacctggccgatgtggttcagattgcagtggaagacctgagccctgaccacccaggtacagagctgtgggacattnttttggagantcatgtagtgacagatgaagacgaacctgctttgaaacgccagcgactagaaatcaattgccaggntccatctataaagtcattcctgtattccatca

SEQ ID NO: 580090 - DNA, 318 bp, Homo sapiens
tcgacgctgacacgtagactatatgacctttatgatctaacctgcctgactttcctatttactagagtactaagttacagtgatcactagtctccttggaatttccttgcaaggtcccccagcagttttcccagccctgggcttttgaacattctgggaaccgtctcttgtagagagtgttttgtctgtaatctttacgatcgtatatttcgaagtatttaaacgatctagtcttacagcacatcttcggcattctcaagattttttttttggagatggagtctcgctccttgggacccaagtgctggagttgcatgt

SEQ ID NO: 580091 - DNA, 128 bp, Homo sapiens
ccttattaagtgcggcatggtagctccattcctgaaacatttagacaatcagcacatatctgctgggggtgactcaacaatccagacagtgactgtatgagactgctactactgccccaatgacagag

SEQ ID NO: 580092 - DNA, 351 bp, Homo sapiens
agttcctgccttaactgatgacattccaccattgtgatttgtcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgtt

SEQ ID NO: 580093 - DNA, 114 bp, Homo sapiens
ggtcctcttgctcccatcagcggatttctatacattgacctttgttggttataaacagcagtaacgagtgtcacaaatgacgctggttgatgggactgatgggacgaagatgcg

SEQ ID NO: 580094 - DNA, 175 bp, Homo sapiens
cgcacactttgcagctgatctcggacgaaggttgcgaagtgattgccaagagcgacactggtgggcatggcagctttcctaactattaataatatttattatccgccgtgcccgccaagtcgtcaatgtgcggcatcgttgagctgcgtctgctgaggaggggtaccgcgctcga

SEQ ID NO: 580095 - DNA, 119 bp, Homo sapiens
ccgtactgagatgtagcagaaattcaggcttcacgtgggtctattacgtgtctgtacgtgtccggccaccggacacgtagtggccggatatatgtgttacctaccctacggtccggcca

SEQ ID NO: 580096 - DNA, 118 bp, Homo sapiens
atcacattatcagtagggtaaaattaacctggtctcactgacgtgtctttagtcccaggcttcacggttcctctattatgtgggctgaacaatccacacgtcttgcgtgaatttctgc

SEQ ID NO: 580097 - DNA, 759 bp, Homo sapiens
  misc_feature (103)..(103): n is a, c, g, or t
  misc_feature (289)..(289): n is a, c, g, or t
  misc_feature (679)..(679): n is a, c, g, or t
aagcacttctgtttccagtaacagcgattgaggtttgacctggtcatcggggcgaagttccaaggtgtagagcccagctggaccaaggcttgggctatctgcncatgctcgagcgggttgcaaaccagggtggccttcataggtggaatttgcgtcgttaccaactgtttggccaatgccgaaaggcgctttgggggaggcacttcctccaacaggcagtggaaggctcggttggcgatggatgttgcgtagtgttcgaggttgtcacacatcgccttgcgttggcgcncccacgcactgagttgcgcgtgggcgcgtgaccagaagtcgaggcgggcctgctcaagcatttcttcacgatgctcaaccgcctggcgcagcagctcttcagcttgggcccgtgcgctatctagcaactgcgcggactgaaagcaatcggcgagcatctcccgggtaatcagtacttttggctgcccggaagcgccgtcgtgcaattcgattttgcgttgggtcaacatagacaatgctctggtgtgttgccgttaacgacgagttgtttcactacccgttgcgtcgatacgccagacaatcgcctgccacagcgtattgagccggccatgcgcatcgtcaaatggcaggtgtgtggtttcaagtgcctgcacccggtcaggcggcaagngcagacgaaggcgttgccagacagcaggctcgacccaggccctcagcaattgcattggatcatcctccggcccctgaatg

SEQ ID NO: 580098 - DNA, 242 bp, Homo sapiens
  misc_feature (138)..(138): n is a, c, g, or t
  misc_feature (169)..(169): n is a, c, g, or t
  misc_feature (195)..(195): n is a, c, g, or t
  misc_feature (233)..(233): n is a, c, g, or t
cacacagcccagctgggtcttggccggcctttgttgttggggtagagctgcaggaccttctggaaatcagcccgtgcccagttcaaagtcattccacggcccaggtgggccctctcccccggcggaagaggccccttnctccgttgttgcctgtaccagttcctagggnccttgttaacagctttcaatggcagncagagcaaggtcctgtagtttacagatgaccacatggnccaggttga

SEQ ID NO: 580099 - DNA, 678 bp, Homo sapiens
attttaagccactgagtctgctaaaacatttaagaaataaacactcttaggctcacattagtttagtggatatttttttccccaactacataggtgacagtagcttattttttgagttttaacacaggttcttcatagtgggccttgaaactttttacttgatattcaatcttgcatggctcagaaatgtgttattttatatcactgtgtctaaaatttcaggaaataaagacacctgcttctcaatgtcttcataccaagaaaaagttgatatttgcccctttcctctccatctcatactcaaaatttagatgactataagtcaaatggggaagaaatggttggatataagtgaagaaggaggagttctcatccaaatgtcataaaaattcatcttttcagtagttggatatgtataaaagcatcattccaaaaattttgattttctgtactggaatagataattttgaaatatctcaataaattctccaaacttaagctaataacccacccagaaagatctgtgaacaatctctcttaaacaatcacaaacataataacattttacaatgttacatagtttgaagtctttgatgtatctataagaatattaaaaaatcaccagtgtgcaggaaataataaaggtatacttgaagattaaaaaaaaaaagggggggg

SEQ ID NO: 580100 - DNA, 463 bp, Homo sapiens
aagcctagggtaaaacttaggtttgggacatgcttgatgaaagcaagagttgagcaggttgttgtgtgtatgtaggtcaggtgctcagcggaaaagtctgagctgtgtagtacgtcaggcagatgtcagtttagatgcgatagtttaagccacaagagtaggagaggtcatctaaagagtacagcaggcctaagggcatctatatttaaggagaaatacagaagaagtctcctgagaaggaataatggggcgggtggggagggagaaggcagtgtcccaaaaaccaacaaaggttttaccaaaggtaataccatcatttctgagcagcagttccttaacttgtgaatgtggcaaatgttctcctttacaaattgttctgaaggtaaaatgagatcatgtaaacgaaaatcctttgtaaattacagatgtgtgttataaatgaagtatctctcgagtcactcca

SEQ ID NO: 580101 - DNA, 496 bp, Homo sapiens
  misc_feature (183)..(183): n is a, c, g, or t
caagattcctgtatcgtttgaatattgcttttaaagaaatatttgaagcgacttcaaattcagactgtgtttaaaaagatttaaaatcggaatccaaaatcaaagtattaaaaaataatgctgagtgtttaggattcacatacctctgagctctggtggcttttgccagtcctgtccctctgntgagcaccagcccttcctgcagcagtcctgccggtgtgtttctgtgcacctggggatgaagtgtgctcctcccccagcggttagcctcaatgcttttcctccctctgttttattatttgaaattagccaaaaaccaacaaaggttttaccaaaggtaataccatcatttctgagcagcagttccttaacttgtgaatgtggcaaatgttctcctttacaaattgttctgaaggtaaaatgagatcatgtaaacgaaaatcctttgtaaattacagatgtgtgttataaatgaagtatctctcgagtcactcca

SEQ ID NO: 580102 - DNA, 1090 bp, Homo sapiens
gtgtgccatgtgacctgcatgtactcctgggtgaatgcggaagcgcagtgctggagcctggtggaggctcttgtgctcgcttgtaaactgcctccggagctgactgcggtcgagtcagcggcacagaacgacgtcgtgagtggtttggagatgagctggctggagaataattgtcttccacattgtgtggccactgtgtgctcccagtgatggaaccagtccagacctctcctgcgggaagttctgcgccctgtcaccggggacagccacgcagcgtgtccgccgtaatctccgcagcctcggttcagggaggtccaggcaggaggggccgctaccgggttgctttcccagactgccgatcctatgggtgaccacctgagagcggggcagtgagtccggaggtacactgccaggggaaacccaggaagcccgccgaggaacttcgagtgctttcagatttgctgagcaccgttgtcccgacgaggacgggagcaacctgaagcctgcctcttgacatggctccttgcagaagagcatcttgacccacgatgtgatccctcttgcaaattctgtaagaagttgatccggtgaggcgattgacttgtgtctgaaggattggaccaggagctcagtgcgcccaggaaggacaccaaaaaacacggagtgaacatatgtagctattgacatttacgtactttggagaacggccactccaggcttggattgaggaacattctcttccgtgcagcccttactagggcaggaatgggcagcttggtaaacactgatcaaagaaagccagagggaacatttttacggacggattgaaaggattgacggaggacacagtgacgaccattaccctttggcggcaaaattatgttacccccaggaaggacggagcaagcaggtgactgggacacagagggaattccccagtaggggcttcttggaagaacttacaagacgacgcaggaatatgaagagaggcacgagaaaggcagacacacgaacagagcggagagtgtgcagacaagaacactccttggattgttgcggaaagggagattgcggatatgaccacgcgcca

SEQ ID NO: 580103 - DNA, 656 bp, Homo sapiens
gggatggaaatgtcacccgtaagtatggcaatgccagtggaaccacgctgcttgaggctctggatgcatcctacacaatcgtcccaatgaaagccttggctgcctctccaggatgtctacaaaatggggggctatgggtacgtgtaccttgtgtgccgagtggagactgggtgtctcaaacccgggtatggttggtcaccctttgtgctccagtcaaccgttacaccggaagtaaaaatctggtccgaaatgccaccatgaaggctttgagtgaagctcttcctggggacaattgtggggcttccacatgtgtcaccgaatggtgtctggtcaaggcgatgtaccgtccgggtgcaacggtatggcctggtgaaccaggcaaaaaaatgaccccagccaattggacagccagcttgggttccactgggctccagggtgattaatcctggaaccatcccagggccaaaaataacggcgccggggattaattccccccttgtaattgggtaattggccacaagtgtgcttcaacattttgacatttgcaaagtttgtgcctagaacctgcaaacggacaaacaattgggatccgccggtcctggcttaaaaaaaggctggaaagattggccctaaaaatctctggcaagtctgttaac

SEQ ID NO: 580104 - DNA, 398 bp, Homo sapiens
  misc_feature (120)..(121): n is a, c, g, or t
cgtgcgaaggatagggtatcccggcctgcgacaccttgagcgtgtagtctctggggacagcttgtagccgtgcctcccagcttcagtgtgatcgcgggcagggtggaccctttgcctgannccgcttcatgggcatggacatcccgccacccagcgggccactctggatcctgggcgacgtcttatcggccgctactacactgtgttgaccgtgacaacaacagggtgggctttgccgaggctgcccgcctctatttcccaaggcgttcgcgcgctcagcacagaaacataggagagttccatagcaggaggcccctggcccggcggtcccttccgcacacacccacacacttgcccgcccactgttctgggcgccctggaagccggcggcccaagcc

SEQ ID NO: 580105 - DNA, 1289 bp, Homo sapiens
tggtgacccgcgatggatgtctgctgcctgatgtgactgtgagatgccactgataccttgcagtggcttggtggcttgctgtggctccgtgtgtgtcaccacccatgtggcagacccggagggtggctgcctccgccgggcctgcaagctggagagggagcagtgtcccccaagcctggtgggagccaggtgacttgatgcacggcaactgctggggtcacctgccgggcatgtctgtgggagtgatgccatcttccttggaggcagcaaaactcaccttgggtgtgcggaagtgctccccctttgttttgtccatcccgggaagaccttggcagtgaggttctttcttgccttgccacgcatgatgatgttgcgcggcgggacgcaatacgccaggttgttggcaacaccgactgcgaagcgcaaggtcatgggaatgggcgcactgtgtgcctgtgcaccacgtcggctctcacgcccttggcagcccacttggcgttgcgatccccagggagacccgacaagaatgacggagagaaaccccctcttgggtagtactctccgcgcccgaccctgggtgtataaactccagtcggcaccaaagaatgacaacccccttttgtgactacatggaacttccaatttccccagagcgatgcccttacagcgaacatacccatcagcaccggccgagaaaatggcacctaacaacagaggacacgactttccggaaacttcccccagctacatgggcatacaccacagagttttaccggcatttctatcctgcaacagcaaagcgaccctttcacactactaattcacccattaccttctactattgcaccctttagccctccccacgcacgacacttccaaccctctcgaagttaccccaccaataacaccccttggcttgacataactcccactttattccatttccagacaaccacatttggcacagctggacttaccacaccttgtcacacacccacttctctcccctctacatcaacctcccaacttgcaacccacacttctgccacaaacacaaactagcacacaataacctccgctgctaacacaccactctctaattcccttcctgaacaacactaacaccccgtacccttaccgctcacagctctaccacaacacacacctccctacactacacacatcttacctcttacacaccacggcttactctattaacacctatcttcgcactatcacaaaaacaatactacaacctgataccattctgcaccccaccacaccatata

SEQ ID NO: 580106 - DNA, 714 bp, Homo sapiens
tttgtttgtttttaataaaattccaaaaaaaaatttaaagatgggaggatttgtttttgtacaaacaccggccaaagttttggtattttggcttccttctcgaaggggccggcattgtcaccgaggtttggcctattggaagcgtgtaaaatctgcagaagtggtcatattttcacaacgcgtacagtggttccccaaaccccaaaatcctcgtcgtggccacactggaaaccgacacctttcgcggttctctgtgcaattcttagcggtatctgttgattatccagattttgtactaatccacagtccttggaacatgtggacctaggtgtcccacataataggggtcacgaacccgttaagaaaaggcacttaatgtacattattactttgtttgaaccggaaatgttcagggaacaatggctcttagggatccgtgagtgtgatcctgccccatgaaggtgagcctttcaaggaggatttacattggtcttcctgtgcaggtggagtgcgagctagagaaacagttttttaaatgctgaagtctctacagatactgttaacgggggccatttaggggagcatgactgactcgttgtctggaaacagtacaaattagcctttataaattttaaatacaccccccgcccctcaatgatattgctttgtccaatggtttggaccagtttcctgttctataaagttgcgtcctct

SEQ ID NO: 580107 - DNA, 387 bp, Homo sapiens
  misc_feature (24)..(25): n is a, c, g, or t
  misc_feature (74)..(74): n is a, c, g, or t
acaatggtgggtcagtgtgctcannctgatgcgtcatgtatagctgatgatgttaacggtgtgactgatcgagngcggacgatcctggaacgcgtcaaggccgcgatgaagacgccgagagcgactgttgtcgtcaccgggtattgggacgtggggctggacggcaaggcgggccgcgagaacgggcccgactacgtcaaggtgaccgatatgatcaccgaggccttcaacgccaacgtcaagaagatcgcccacgaggtcggagcggtctacgtcgacttccgtaccccgttaaggggagcagatggcacgcgtgatgacacagcactgctcactgacgacggggatcatccatccgagcaagggcacaaggtgctagcggaggct

SEQ ID NO: 580108 - DNA, 146 bp, Homo sapiens
actctagtggatcccctgtggttcttgtgctggcgtgtggctcttgtcattggcacacttagatttgtcttcacccaccagcttcgttccagcacccagcacaagaccaccagcacaagatgacacgcgccagcacaagaaccaca

SEQ ID NO: 580109 - DNA, 505 bp, Homo sapiens
ccacctgctgatctgacaggaggcagagctcaggtggtaatcctcactcacctcctgctgtgtggcctagttcctaacaggccacagaccagtaccagtctgcggcctgggggttggggacccctgatctaggggctcaactggggctggaagggtttaattccatgatggctcactagtttagctgctggatggagaccaacagctttttttgtcatagtcacgtaaaaattcaatttcagttatagtaatattcttggttcacaggaattggctattatgtggatccatttggctctctgcctagcaacactccaattaaaaaaatattttctttgaacttgatatgatgagagtgttggtaaacacatgtgaccattttcccctccctgtctcccaagtccctgtttttttgggtgggtagtttgctgtgtatcaggtgagggttcctgatccaagtggcttaagactggaagatatgagaaaagcctaaatgctacatagg

SEQ ID NO: 580110 - DNA, 285 bp, Homo sapiens
ctttccgaccagtaacgagacgccggtccattaatttaaagcgtcatcttttcgtcatctaaacaagccagtctgtcgcccctcgaaacccacggagcttgtcatgctgcacgccgaaaaccaggaccgcctttacctgatcgcccccagtgaagaacagcaggcgctggtgggcgccctggccttcaacgtgcaggaccggcactggctggtgtattgcgccctgggcgggcaccagcacgcggacctgccggaaacagacctgctgacgggcgtcagcatgct

SEQ ID NO: 580111 - DNA, 655 bp, Homo sapiens
aggacaccccacaaacaagtaggccagcgtcatgcacaggttcatcctgaaggcacggagcccgggcgtgacatcgacccccagaaagatcccaccttcctaagaattcgctcaaagaagaatgaattgtggttgcccagataagaatattcctgattgtgaatcagaatccaaccgaataagccactctcgtggctcgcggtgttcctccttattttgttgccccccaatattgttgttgtccatcatgtcggaggactagccggtggccgtcgctaggcacccaatcacactactccggtgggcttgtgtctgctggcggctcttctcccccaccggcggccctccggtggtgcccattcttcccaagagctgaggggcgccttctcattactgcgaggtgttggagcagcatgctgcaggaaggccggcaccttcttcctactcaccttcagctagtttgcccgcggtggggctggtgggtcgtcctctaacgtcggctggttgcttcctgttgggccggcctctaaactctaaacgcccccccgccgcggacacaaaacaccacaaaaaacacacaacacacccaccacacaacccccaaaaacaaacgacacaaaaaaaaaccacccccaccacaaaaccacccaaacgc

SEQ ID NO: 580112 - DNA, 536 bp, Homo sapiens
  misc_feature (265)..(265): n is a, c, g, or t
ggcctccccccgtagcgccgctccggctgcaccgtgctcgctccgagtttcgaggctcgtgctagagctagacgccgtctgtcgtctcccttcagtcgccatcatgattatctaccgggacctcatcagccacgagtgagatgttctccgagcagtctacaagagtccgggagatcgcggacgggttgtgcctggaggtggaggggaagatggtcacgtagcgacagaaggtatacattgtatgactcgctcattgggtggacantgccgtccgctgagaggccccgagggcgacaggtactcgaaaggcgacagttaatcactggtgtcgagtattgtcatgaatgcattcaccatgctgggagaacaaggtttctccaagacaggaagcgctacagagacagtgacgactcaagaggattgagctatgtagaatcgaagtcacactgggacaacttggaggatacagagaccagaaggagtaaaagcttttatgacaggggctgcagaacaaatcgagcacatccttgctaatt

SEQ ID NO: 580113 - DNA, 195 bp, Homo sapiens
tatcagccggacctaattctatacttctgcatatgaacttactagtaatactttgcaggagagccatagctaagacccccgaaaccagacgagctacctaagaacagctaatagagcacacccgtctatgtatgcaaaatagtgggaagatttatagagtagaggcgacaaacctaccgagcgaggctatagttg

SEQ ID NO: 580114 - DNA, 383 bp, Homo sapiens
cgtgttagcagtgtatgcaggtctccatatctactagaaaatcatggctggtattcaccatgtagtcctagtctacatggggaggcagaggcatggagattctctggggcccaggagctcaagaccagcctgggcaacatggtgagactgtctaccaaaaaaaaacgaagaagaaaagaaaataagcccaatgtggtggtaggcgcctgtaatcccagctacgggagaggctgaggcaggaaaatcgcttgagcctgggagacagagattgcagtgagccgagattgccccattgcattccagcctaggtaacagagtgagactctctcaaaacacacacacacacagacagacacacacacccttagaaaacgggtctctca

SEQ ID NO: 580115 - DNA, 1409 bp, Homo sapiens
  misc_feature (278)..(278): n is a, c, g, or t
  misc_feature (483)..(483): n is a, c, g, or t
  misc_feature (1207)..(1207): n is a, c, g, or t
tggtcttggtccaaaattttataaagggtctttagaaaagcaacttccagactctccagaattacagctgtgccagggagaccctggtttagtgcgtggtggggacgtggctgtggggcatgtggcagggggctctcgtggctttcccaccctttcgtgtccgtgagaagtggggggtgggtgggcagtattctcactctttggggttcccacaagtgctctcacgggtggtctcgaggcagagggggctttcttaaaggggcccaaactcctttccncaagtgtggggctccccagggccagagcaagtgaaatcttttcaacctgttgatagtgcccgaggaacacacctcgtgtctctgtgaaacgcaaaccacggtgggcggccacgagcagaggtggctccacagtgtgataagtgatgagtttatacagcgaggggcctccctcccgggtgtggtgtgggcactacactacgagggngcccaactacccaacaaaaaaactttttcgatgtgggcatatttataagcgcccctctcgagttctccccgctgcgagagagtaatatcctcccccgaagaaaacacacccaaaaaaaccctctcgcgagagcccctttgttgtgtcgcccccccaacaactcttctctccagaggtgatgaagtggaaccaccccggcaagagacaaacacacaccagataatgaagaagaggaggcggcgcctctcgcggcgacaacagagaaaagaagccccctcatccctatagaggagaagagtcctgtttgggctaacactgtcagaagaagaagacaatcgtcttgtggccccttgtggggcggcaatagatgggggggcacaacacaaacaagagggaccctctccttattattgtgttgtcgccaccccaccccttatattttctcacaggcgacagaatataaaaagaggctttctaataaccaacgttgtggcgccctcttctgtgggggaagaaaacggccccaaaaaaactctcttctgtctcctttagaacaactatacccaggaggacaagactccaaaggttctccccaccgaggaaaatattcacggggcccgaggggccccctttttttattaccaccccgagaggaaaaccactctcgggggggggactcaccaggggggagtggcataaaagaaatacaagtggtagtattgcngggagccccgagaggatgggggggtggaaaaacattgtcggaaaaccgctctctaaaaattcttcccggagaaagtttaagcgcccaattttctttttacaaggccccaaaggtactccccgccagaagtataagagaaaaaactctccaaacttatcaagagcttatacaacggctatttgagtaagaggagatattgcgc

SEQ ID NO: 580116 - DNA, 3181 bp, Homo sapiens
  misc_feature (38)..(38): n is a, c, g, or t
  misc_feature (92)..(92): n is a, c, g, or t
agcgggtgtccggccaagcggcgccctgaaggcgtgtncggccgcagcttaggctctccgggagtccccggagagtaggggcggccggcggngctagtcttctggggagcgccgggtgcacaccggaccactgcgggaggcctagggccgagggccgaggagctggcctgcgcccggcgaccccggcttccctccgcagtcgcccaggcgtcccttcccccctacagccgagcggcgccgggcgcaggcgcattgggcgcccccggcagcccccgcggcgcgcccgtccgctgcccgtccgaggaggcggagggcgatgacgtcatcgagcggggcgacgggcattgggcgccattttgaacaaggggaaaaaagatccctccccggcggcggcggcggcggcggcggcgccggcggtggtggcggccccggggctgagcgctcggctgcagcggcgcggaggccgtctccctggtctgccgcggtccccgcccgtcccgccgccggctgccatggcaggagccggaggcggcggctgccccgcgggcggcaacgacttccagtggtgcttctcgcaggtcaagggggccatcgacgaggacgtggccgaagggcgtggagaggagagctcggggctgctgccacagatcatgctgagccgccagcagctccacctgcccttggctttgctcatccgtggaaatgacaacagcgtgaaaacggcagatgatgtacaaggattatgatgaaaatagtcttgacctcacggaccctctgagaggttcttgaccgttgcaccctcaagggcccacagaccgcactttgagaactgctgcttgaatgcaagctattagcagtaggagtgtcaaggacagggcagacttcaggattaactgttccttctcatctttaccagattgtactggttttgtctcaaaatacaaaaatagagtgtttattatgtaaagaaaatcaaatgatagaacagctgagaacagctggatcaagagcacagagcggaagttcctcttcatcccactgctgtcctggagtcttcctcaggacccactgctcctaactgtatctttgtagatcattttctatgtgtttatttatttatattttaaaacctagtttgtgtataagcaatcttttttaatccacaaatgtggaatcttattctagactttgaataagattttctgtattagtcagtattgttttttgctacttcttttcctttcctttccttttttggaaatagggtcttactcctctgtcacccaggctggagtgcagtggtgcgatcagagctcactgcagcctgatcaggctcaagcaatcctctccctgctcagcctcctgagtagctggaactataggcttgcactgccatgcccagcttttttctattttttgtagagacagggttttgctgtgttgcccaggatggtcttgaactcctggactcaagtgatcctcccacctcggcctcccaaaatgctgggaatacaagcatgagccatggcatgtggccgccacttgccttttttcattaagagtctataattggagatcttacagggaactgggctttctgctcagccatactcgagctcatttgacccccggccactgccccttgaaatcggacatcatttccaccgttgagtttaattactctggagatcttcttgcaacaggagacaagggcggcagagttgttatttttcagcgtgaacaagaggtactggcccagccccgccgtcctgccctgccatgaagtgtgagcagctttctcagcacttcctgcagagaagtctggcaggggtgtgaattctctcttcccttcagggagagaataaaagccgccctcattctaggggagaatataatgtttacagcacctttcaaagtcatgaaccggagtttgactatttgaaaagtctagaaattgaggaaaaaattaataaaattaggtggttaccacaacagaatgctgctcattttctactgtctacaaatgataaaactataaaattatggaaaataagtgaacgggataaaagagcagaaggttataacctgaaagacgaagatggaagacttcgagacccatttaggatcacggcgctacggatgacctgagaattaatttatggcacttagaaatcacagatagaagctttaacatcgtggacatcaagcctgctaacatggaggagctgaccgaagtcatcactgcagccgagttccacccgcaccagtgcaacgtgttcgtctacagcagtagcaaagggaccatccgcctgtgtgacatgcgctcctcggccctgtgcgacagacactccaagttttttgaagagcctgaagatcccagcagtaggtccttcttctcagaaataatttcatccatatccgatgtaaaattcagtcatagtgggcggtacatgatgaccagagactacctgtcggtgaaggtgtgggacctcaacatggagagcaggccggtggagacccaccaggtccacgagtacctgcgcagcaagctctgctctctctatgagaacgactgcatctttgacaagtttgagtgttgctggaacggttcggatagcgccatcatgaccgggtcctataacaacttcttcaggatgtttgatagagacacgcggagggatgtgaccctggaggcctcgagagagagcagcaaaccgcgcgccagcctcaaaccccggaaggtgtgtacggggggtaagcggaggaaagacgagatcagtgtggacagtctggacttcaacaagaagatcctgcacacagcctggcaccccgtggacaatgtcattgccgtggctgccaccaataacttgtacatattccaggacaaaatcaactagagacgcgaacgtgaggaccaagtcttgtcttgcatagttaagccggacatttttctgtcagagaaaaggcatcattgtccgctccattaagaacagtgacgcacctgctacttcccttcacagacacaggagaaagccgcctccgctggaggcccggtgtggttccgcctcggcgaggcgcgagacaggcgctgctgctcacgtggagacgctctcgaagcagagttgacggacactgctcccaaaaggtcattactcagaataaatgtatttatttcagtccg

SEQ ID NO: 580117 - DNA, 2405 bp, Homo sapiens
  misc_feature (38)..(38): n is a, c, g, or t
  misc_feature (92)..(92): n is a, c, g, or t
agcgggtgtccggccaagcggcgccctgaaggcgtgtncggccgcagcttaggctctccgggagtccccggagagtaggggcggccggcggngctagtcttctggggagcgccgggtgcacaccggaccactgcgggaggcctagggccgagggccgaggagctggcctgcgcccggcgaccccggcttccctccgcagtcgcccaggcgtcccttcccccctacagccgagcggcgccgggcgcaggcgcattgggcgcccccggcagcccccgcggcgcgcccgtccgctgcccgtccgaggaggcggagggcgatgacgtcatcgagcggggcgacgggcattgggcgccattttgaacaaggggaaaaaagatccctccccggcggcggcggcggcggcggcggcgccggcggtggtggcggccccggggctgagcgctcggctgcagcggcgcggaggccgtctccctggtctgccgcggtccccgcccgtcccgccgccggctgccatggcaggagccggaggcggcggctgccccgcgggcggcaacgacttccagtggtgcttctcgcaggtcaagggggccatcgacgaggacgtggccgaagcggacatcatttccaccgttgagtttaattactctggagatcttcttgcaacaggagacaagggcggcagagttgttatttttcagcgtgaacaagagaataaaagccgccctcattctaggggagaatataatgtttacagcacctttcaaagtcatgaaccggagtttgactatttgaaaagtctagaaattgaggaaaaaattaataaaattaggtggttaccacaacagaatgctgctcattttctactgtctacaaatgataaaactataaaattatggaaaataagtgaacgggataaaagagcagaaggttataacctgaaagacgaagatggaagacttcgagacccatttaggatcacggcgctacgggtcccaatattgaagcccatggatcttatggtagaagcgagtccacggcgaatttttgcaaatgctcacacatatcatataaattccatttcagtaaatagtgatcatgaaacatatctttctgcagatgacctgagaattaatttatggcacttagaaatcacagatagaagctttaacatcgtggacatcaagcctgctaacatggaggagctgaccgaagtcatcactgcagccgagttccacccgcaccagtgcaacgtgttcgtctacagcagtagcaaagggaccatccgcctgtgtgacatgcgctcctcggccctgtgcgacagacactccaagttttttgaagagcctgaagatcccagcagtaggtccttcttctcagaaataatttcatccatatccgatgtggtgtgggacctcaacatggagagcaggccggtggagacccaccaggtccacgagtacctgcgcagcaagctctgctctctctatgagaacgactgcatctttgacaagtttgagtgttgctggaacggttcggatagcgccatcatgaccgggtcctataacaacttcttcaggatgtttgatagagacacgcggagggatgtgaccctggaggcctcgagagagagcagcaaaccgcgcgccagcctcaaaccccggaaggtgtgtacggggggtaagcggaggaaagacgagatcagtgtggacagtctggacttcaacaagaagatcctgcacacagcctggcaccccgtggacaatgtcattgccgtggctgccaccaataacttgtacatattccaggacaaaatcaactagagacgcgaacgtgaggaccaagtcttgtcttgcatagttaagccggacatttttctgtcagagaaaaggcatcattgtccgctccattaagaacagtgacgcacctgctacttcccttcacagacacaggagaaagccgcctccgctggaggcccggtgtggttccgcctcggcgaggcgcgagacaggcgctgctgctcacgtggagacgctctcgaagcagagttgacggacactgctcccaaaaggtcattactcagaataaatgtatttatttcagtccgagccttcctttccaatttatagaccaaaaaattaacatccaagagaaaagttattgtcagataccgctctttctccaactttccctctttctctgccatcacacttgggccttcactgcagcgtggtgtggccaccgtccgtgtcctctcggccttcctccgagtccaggtggactctgtggatgtgtggatgtggcccgagcaggctcaggcggccccactcacccacagcatccgccgccaccccttcgggtgtgagcgctcaataaaaacaacacactataaagtgtttttaaatcca

SEQ ID NO: 580118 - DNA, 2787 bp, Homo sapiens
  misc_feature (38)..(38): n is a, c, g, or t
  misc_feature (92)..(92): n is a, c, g, or t
  misc_feature (2340)..(2340): n is a, c, g, or t
agcgggtgtccggccaagcggcgccctgaaggcgtgtncggccgcagcttaggctctccgggagtccccggagagtaggggcggccggcggngctagtcttctggggagcgccgggtgcacaccggaccactgcgggaggcctagggccgagggccgaggagctggcctgcgcccggcgaccccggcttccctccgcagtcgcccaggcgtcccttcccccctacagccgagcggcgccgggcgcaggcgcattgggcgcccccggcagcccccgcggcgcgcccgtccgctgcccgtccgaggaggcggagggcgatgacgtcatcgagcggggcgacgggcattgggcgccattttgaacaaggggaaaaaagatccctccccggcggcggcggcggcggcggcggcgccggcggtggtggcggccccggggctgagcgctcggctgcagcggcgcggaggccgtctccctggtctgccgcggtccccgcccgtcccgccgccggctgccatggcaggagccggaggcggcggctgccccgcgggcggcaacgacttccagtggtgcttctcgcaggtcaagggggccatcgacgaggacgtggccgaagcggacatcatttccaccgttgagtttaattactctggagatcttcttgcaacaggagacaagggcggcagagttgttatttttcagcgtgaacaagagaataaaagccgccctcattctaggggagaatataatgtttacagcacctttcaaagtcatgaaccggagtttgactatttgaaaagtctagaaattgaggaaaaaattaataaaattaggtggttaccacaacagaatgctgctcattttctactgtctacaaatgataaaactataaaattatggaaaataagtgaacgggataaaagagcagaaggttataacctgaaagacgaagatggaagacttcgagacccatttaggatcacggcgctacgggtcccaatattgaagcccatggatcttatggtagaagcgagtccacggcgaatttttgcaaatgctcacacatatcatataaattccatttcagtaaatagtgatcatgaaacatatctttctgcagatgacctgagaattaatttatggcacttagaaatcacagatagaagctttaacatcgtggacatcaagcctgctaacatggaggagctgaccgaagtcatcactgcagccgagttccacccgcaccagtgcaacgtgttcgtctacagcagtagcaaagggaccatccgcctgtgtgacatgcgctcctcggccctgtgcgacagacactccaagttttttgaagagcctgaagatcccagcagtaggtccttcttctcagaaataatttcatccatatccgatgtaaaattcagtcatagtgggcggtacatgatgaccagagactacctgtcggtgaaggtgtgggacctcaacatggagagcaggccggtggagacccaccaggtccacgagtacctgcgcagcaagctctgctctctctatgagaacgactgcatctttgacaagtttgagtgttgctggaacggttcggatagcgccatcatgaccgggtcctataacaacttcttcaggatgtttgatagagacacgcggagggatgtgaccctggaggcctcgagagagagcagcaaaccgcgcgccagcctcaaaccccggaaggtgtgtacggggggtaagcggaggaaagacgagatcagtgtggacagtctggacttcaacaagaagatcctgcacacagcctggcaccccgtggacaatgtcattgccgtggctgccaccaataacttgtacatattccaggacaaaatcaactagagacgcgaacgtgaggaccaagtcttgtcttgcatagttaagccggacatttttctgtcagagaaaaggcatcattgtccgctccattaagaacagtgacgcacctgctacttcccttcacagacacaggagaaagccgcctccgctggaggcccggtgtggttccgcctcggcgaggcgcgagacaggcgctgctgctcacgtggagacgctctcgaagcagagttgacggacactgctcccaaaaggtcattactcagaataaatgtatttatttcagtccgagccttcctttccaatttatagaccaaaaaattaacatccaagagaaaagttattgtcagataccgctctttctccaactttccctctttctctgccatcacacttgggccttcactgcagcgtggtgtggccaccggcgggtcttttggctttcttcgatccaggggaccctttggaatancgaagtgggccagcaggttaagggggccctttatccacagaatcgccggcacccctttgggtgagggtctttaaaccaaaccatttaagggtttttaatcccccacaaaaaataatcaattatattcgggcctttggccaatcccctatagggggggttaaaaatagtgcgcggtttatacaagcgccttggaaacccgtggtccacctaaaactttggtgaaaacctctttcgcgggggaaaataaagaacccaccgaggctttccaaatggccccttgggccggaatataggttatttttaaaatcggaatttttgtaaagttattttcacctcgcggtgggaaatcttatcacccccccttagggtcctctctctcataggctttataggtctctctacatgcttctttccggcgtccaggcctctctacattttgtggggggt

SEQ ID NO: 580119 - DNA, 2824 bp, Homo sapiens
  misc_feature (38)..(38): n is a, c, g, or t
  misc_feature (92)..(92): n is a, c, g, or t
  misc_feature (2689)..(2689): n is a, c, g, or t
agcgggtgtccggccaagcggcgccctgaaggcgtgtncggccgcagcttaggctctccgggagtccccggagagtaggggcggccggcggngctagtcttctggggagcgccgggtgcacaccggaccactgcgggaggcctagggccgagggccgaggagctggcctgcgcccggcgaccccggcttccctccgcagtcgcccaggcgtcccttcccccctacagccgagcggcgccgggcgcaggcgcattgggcgcccccggcagcccccgcggcgcgcccgtccgctgcccgtccgaggaggcggagggcgatgacgtcatcgagcggggcgacgggcattgggcgccattttgaacaaggggaaaaaagatccctccccggcggcggcggcggcggcggcggcgccggcggtggtggcggccccggggctgagcgctcggctgcagcggcgcggaggccgtctccctggtctgccgcggtccccgcccgtcccgccgccggctgccatggcaggagccggaggcggcggctgccccgcgggcggcaacgacttccagtggtgcttctcgcaggtcaagggggccatcgacgaggacgtggccgaagggcgtggagaggagagctcggggctgctgccacagatcatgctgagccgccagcagctccacctgcccttggctttgctcatccgtggaaatgacaacagcgtgaaaacggcagatgatgtacaaggattatgatgaaaatagtcttgacctcacggaccctctgagaggttcttgaccgttgcaccctcaagggcccacagaccgcactttgagaactgctgcttgaatgcaagctattagcagtaggagtgtcaaggacagggcagacttcaggattaactgttccttctcatctttaccagattgtactggttttgtctcaaaatacaaaaatagagtgtttattatgtaaagaaaatcaaatgatagaacagctgagaacagctggatcaagagcacagagcggaagttcctcttcatcccactgctgtcctggagtcttcctcaggacccactgctcctaactgtatctttgtagatcattttctatgtgtttatttatttatattttaaaacctagtttgtgtataagcaatcttttttaatccacaaatgtggaatcttattctagactttgaataagattttctgtattagtcagtattgttttttgctacttcttttcctttcctttccttttttggaaatagggtcttactcctctgtcacccaggctggagtgcagtggtgcgatcagagctcactgcagcctgatcaggctcaagcaatcctctccctgctcagcctcctgagtagctggaactataggcttgcactgccatgcccagcttttttctattttttgtagagacagggttttgctgtgttgcccaggatggtcttgaactcctggactcaagtgatcctcccacctcggcctcccaaaatgctgggaatacaagcatgagccatggcatgtggccgccacttgccttttttcattaagagtctataattggagatcttacagggaactgggctttctgctcagccatactcgagctcatttgacccccggccactgccccttgaaatcggacatcatttccaccgttgagtttaattactctggagatcttcttgcaacaggagacaagggcggcagagttgttatttttcagcgtgaacaagaggtactggcccagccccgccgtcctgccctgccatgaagtgtgagcagctttctcagcacttcctgcagagaagtctggcaggggtgtgaattctctcttcccttcagggagagaataaaagccgccctcattctaggggagaatataatgtttacagcacctttcaaagtcatgaaccggagtttgactatttgaaaagtctagaaattgaggaaaaaattaataaaattaggtggttaccacaacagaatgctgctcattttctactgtctacaaatgataaaactataaaattatggaaaataagtgaacgggataaaagagcagaaggttataacctgaaagacgaagatggaagacttcgagacccatttaggatcacggcgctacggatgacctgagaattaatttatggcacttagaaatcacagatagaagctttaacatcgtggacatcaagcctgctaacatggaggagctgaccgaagtcatcactgcagccgagttccacccgcaccagtgcaacgtgttcgtctacagcagtagcaaagggaccatccgcctgtgtgacatgcgctcctcggccctgtgcgacagacactccaagtgtaagtgcgtctgttgttgagatggagtctggctctgtcacccaggctgcggtgcagtgacacagtctcggctcacggcaagctccgcctcccgggttccagcgagtcttctgcctcggcctcccgagtagctgggaccacaggcaggtgccaccatgcccagctggtttttgtatttttggtacagacggggtttcaccatgttgaccagactggtctgacctcaggtgatccccctacctcggcctcccaaagtgctgggattacaggtgtgagtcaccgcacctggtcacgcctggcgtcttttaaagcatctcatttagagccacttgtncttcagacactccaaagacttagagagttcttcctgttccccaagtgcctttgcacaactggggagccctcctttgctggggccgtccgagtgtggctgtgtcagaggctgctgctaaataagtggaactcgaag

SEQ ID NO: 580120 - DNA, 164 bp, Homo sapiens
cttaatcaaacacgtgggccagtgggaggagagagaatcgtagtgatatgagcaaggaagggaaagtgaggaatgactgggcctcctaaataaggccggcttggacctgagagtgaagaaacaaatctgggacacaaaccttaaaactccccaaactcctattc

SEQ ID NO: 580121 - DNA, 524 bp, Homo sapiens
cgagtcggtaccatacatgtcgtgatgacatgaacttatatacagaaaatcctaaggtatccactaaaaactactaaaggtaataaatatgttcagatggttacaggatacaagatcagtataaaaaaatttttgtttttatacacttccaacgaagaatctgtaaatgaaattaagaaatcaattccaggctgggcacggtggctcacgcctgtaatcacagcacttggggaggctaagttgggtggatcacctgaggtcaggagtccgaaagcaacctggccaacatggtgaaaccccatctctactaaaaatacaaaaattagctggcatggtggtgggcacctgtaatcttagctacttaggaggcagaggcaggagaatcacttgaaccgaggaggcggaggttgcagtgagccgagatggtgccattgtactccagcctaggggactacactaaaactccatctcaaaaagaaaaaataaacaaaattctgtaggctttgaccttactatcttctgct

SEQ ID NO: 580122 - DNA, 225 bp, Homo sapiens
tcactttctacacagtagtttttttttggtttggtttggtttggttttgagacagagggagtttggctgtgtcgcccaggctggagtggagtggagtgcagtggcgcgatctcagctcactgcaacctccgcctcccaggttcaagctattctcctgcctcagcctcccaagtagctggggctacaggaatgtgccaccatatctggctaattttggtattgtta

SEQ ID NO: 580123 - DNA, 636 bp, Homo sapiens
caggccggggcgaggccgcgctggccctcccttggcggcgggcggcgcgtcgcgggagacggctgcacgtgggacggctggtggatgaccgctgtgtggtggatgccctgtcggccccggtgggacctgtgaccagagcaccccactaatgaatgttcctggtgtatcttgccttcgttcaatggatgttgctccactattgtaacctggcgtagcgttcgtgcctcgaggtaaaagctatgctcacatgtggaaatgggacccatagggccgagggatcctaaagaggtcaggagggaccataagggggcaaggcaaaggaaataccgagtctgggaaatgtgcttgagcattgtgtttaggctatggcaaggtaactacgcccgttggcaagaacaatgtgatcccgcggatccgtggccaaggtaacttgaggcacgccccaagaatataacgacccaaccataccacttggaaaacaaaactgggcacacggaaaaaatcacaacaatgggaacacgctgttctgtcccacttaggagcgggggcatttggatttccaggattgggcaaacagggttcaactttgggggccaaaggtttgagattggaaatttcccccaagtaccttcctcc

SEQ ID NO: 580124 - DNA, 348 bp, Homo sapiens
catctactccaatgtggccaggaagcagaagataggacacccctgttctagaggttgcacttaaatatcataaataagtgacaggtgcactgtctttcaggctgaaggaagagggtatgaggtcaatacattctccaaaggtataataaaatgaggagttctgcaaattagaagaacagcgaagatcagaatattggaaaagaaatagtggcctatgtgacaggtagctttggattatattctctgggtctaggtttccccatctattaaaaacaggggatacaactagatgtattctaattaactttctgatctcattggtactttacaaaaacactgaatagagat

SEQ ID NO: 580125 - DNA, 912 bp, Homo sapiens
  misc_feature (15)..(15): n is a, c, g, or t
  misc_feature (114)..(114): n is a, c, g, or t
  misc_feature (148)..(148): n is a, c, g, or t
  misc_feature (317)..(317): n is a, c, g, or t
  misc_feature (319)..(319): n is a, c, g, or t
  misc_feature (459)..(459): n is a, c, g, or t
atacatacactacangataggaacagcagcaaaaagtagaacctctactactaatgtacccttcgttgttttccacctaaaattttagccgcttccctataaatgttcctgttngattactgctgccttgtcactgtttaatacgagngcaaccttccatagatgggccagcggtctcctacacccaaatctttgttcgcaagtctaacacccggtctggtcaaacgcactccctttggtgcgccaaggctaacccgttttggtctttgaatatcttatccggacgcctttctttatcatatacaggtttacatgtntncctgtgcctttacattattttcgcccgaacccctaagccttgcttagcgttacacacaaaacccgcgcaaaataattggggctgcagaaaaccaccaattcgggcaaagtcccttttccccccccccccgcggtattggnaacactttcgttccaaccactttctgcgtacctactactcgtcgccctaaaaagtgctcctcccccccacccccactatagttaaagtggtactctttcccccatcttaaatcaacgtctcatatcccgtgtacatacgtatcgtggaaatcagcttttttagcacaaacttttctggagtgggtcctcacggaacaagtacatttcccctctcctcaacagtaacatgtgttttcactaaatatcagggacacgattttctttcccgccactccaagatcttttttaccctctatacctcgtcatcgatagttttcccgcagttcattcttagataaagcccgctgcccctatatacaaacatgtaccccccgttacaagcatcctcggctattagttcaaatagcaataaatttccccctgccaaaaaaggaccaccagacaacaataaca

SEQ ID NO: 580126 - DNA, 319 bp, Homo sapiens
cgcctctggggttcaagcagttcttctgcctcagcctccagagtagctaagatgacaggcatgtgccacgacactcagctaattttctatttttgtagagaggtctcactatgttgcccacgctggtctcaaactcctgggctcaaacaatccttccaactcagccacactgggattacagctgcgagccactacacctgggtcaatcaactacttcctatgaatgtttcacttctgaacttttatgaataccctcaacttaaaatccaaaggagtcacatattatgtaattccattcattatccatttagggttgatg

SEQ ID NO: 580127 - DNA, 179 bp, Homo sapiens
gatccgcacagaatagcctttccaagacagtagatccaaaaagcctgctaaatagcataagacaggacgaagatcaggaagcaaagggtgcctgggaagctttaatccagagctcccgatctactacagaggcatcaactttctttttaagactgtttgcatttcctatcagctttctg

SEQ ID NO: 580128 - DNA, 152 bp, Homo sapiens
ctggtgacgtccgggacacccccccgcactcgcatgtcgcctgctcttccatgtgaaatagtggcgtccggggtacctctgcagcagtcgcatgtcgcctgcctcttccatgtgaaaaggtgacatccagggtacctcctccacactcgcat

SEQ ID NO: 580129 - DNA, 731 bp, Homo sapiens
gcgtcgcttgacgaatagttctacaatgggctgtgatgttccatttactgatgtctccagatgggaccccttactagtcaatgcctcacgagtattggccaggcatccaaggtaagactcccaatcgttgctatatagatgtatacaggcgaagatatcagaataaaatggcggggatattgaactataggactatctgcctgtctgtcaccagtttaaaagcattttaatactaagaccgctaattcgtttaatcttatattttagtcattgagtgtggaacttgtaggagcaggttgaataagaggatctctataacagatcctttcaaaagaagagttttagagaaaatagatttaactttaaccacgagtggaaagtggaccctatagggggacaaagccttaaaatgcattgaaagaattagatcggttcgtgtgccttgttatctatgggagatggagtgacaacctgtgtgagagaatttatcacaccaggtccttatggaataataagctagtgtgcctatgagttatattaatgtcagggtgggtaacacgtagtgttttcaaaaattgttaaaaaagcagttgcattgttatagaagttgggaatatacaaccaattttttgtagtaaatggtagttaagaatatcacattataatgccaactagagctccagtttcttttttaacaaaagcaggggatctggtatgaaattacatggtgt

SEQ ID NO: 580130 - DNA, 1679 bp, Homo sapiens
  misc_feature (66)..(66): n is a, c, g, or t
  misc_feature (359)..(359): n is a, c, g, or t
  misc_feature (921)..(921): n is a, c, g, or t
tccactgtgtagtacgctcgtccgatgcgtggctcgcttggagtcgctggtctgcactcttgtttntgttctattagcacagcgcgcgcgtgcctgtttctctctgcgtgatgttgggctcgaccacatctcttcttcagctgggggcgctgctccgttgatctgtcgtcgacataagcttcttcgcgggggtgcgctgttagtttgtcccccccttcgtgtctcacagtgtttttagtatggcggcgctccgggtgtgttggtgagagcccccccctttgttgcttagcacgcggtgcttcttcgctccccggtgatatccacccacgggggtgtttcgggggaacttccatccaggntcccccacagccttttgtttagatagggtgattattcctggtgtctcgctctgcgcgccctctttgggtgattgattctcgagagacacaccccgtggggggattctcctcttctctcccccccaagttgttgtgaaaacacaggcggatttattcctcctggtggttccacgcacgggggggagggatgtcgtccccccccacaatttgtgtagtgccgctcccgcctctgtggtgtccccccccccctcagagtcgcgcgccccacttgtgtggtcttctgggaggcgccctctcctttaggccgcccctattttctgtggtgggaacatccggggccgacaaaatatgggcccccccagaggacaccccttttaggcccccacccgggggggacaacggcttttttgggaagcagtacacacaaatacgcggggtgccccacaacaggatgccgcaccaccaacgacgtgggtgttgtcgcacacgacgacgggtgcggtggtggagtagtacacacccgcgcccaccacacgcgaaacacattacgcccagaaattgngtagagcccccatataaatctttctggggaacacaagagatctctctcggagagtaaagagcaaatagggagctctcttctcggggcaccaccccgtctccaaagagcacactctgtctctctgttttctctctctcagagataaagagctcggggagccccacaaaaactctttctcggtgcgcacatccacattttttcacgcgcccctcacgcgcacacacacataataattgtatatgttgtccacacgggctcgggctctctgttatattcgcgagagtgtctccacacgcgccacgagaatatacacacatataaacaaagagaacacactgagtctccgcgagaccacataaagagactctgttacacaggccacagagtgtcacacacactctatagaggctgcacacacacttctctctacacccccacatataggcccgcgagagggggtgtacaccagccttatttcccgcgcctctaaaaatattatcacataaatgtgttggtggttctctttgagaagaatttcatagtgccacaaatagtgtatttacgcctcgggggaatatttcttctaaaaggacgccctcgagtttctgtggtgtggtggagttttaaaaaggagagaacacactgggtcacagcacaagtccctcttgttaaaggccacaactcattgatatttccttaatttttaatttactttaaaaggggttttaaattttatttaaacctttgggttaagcata

SEQ ID NO: 580131 - DNA, 218 bp, Homo sapiens
tccgggttgaaagttggggggaaatgtgaggggaaaaaaattttccccaggaaaaaattatgcccaagaaaaccccaagcttgaaattaacccccccaaaagggaaaaaaaagggggggcccccccgggggggggccgctttaaaaaaaagggaacccccggggggaagaaattgggcccgaggaaaaatccccccaaaaaaaacccggcgaagggga

SEQ ID NO: 580132 - DNA, 1592 bp, Homo sapiens
aacaatagagcaggtagaggccccgggttaatcgcgacgaggcaagacggcggattaagccacgcgacgctgctgcgtctgagatcccggggctgaagactaacgccggaccccgagcatcgggacgtcgtagggtgcagcgactgaaggaggaactatcagctcccttatccggctatgtggacgaacaacaagaatgctgacaacgactcggcttccgactggagtccaacaaggcaaggacctcggctggttcggcacaaactgctggtatactccactgaccgtcctgcaacactactgcagcttctcgacatcgcacgtttgacacttcctaatcacatatccatacgtactgccccagcaacactctgcagcttccctgcagcctggaatggcaaacgaccagccaaacgcatgtaccacggggctggccaacacactactgccctgcacggcactcatctctcaacaccctcttgctgcgccccacggacactgtgcccaacacgctctctggcaccctagcctcactcctcactgggcccatcctgggcgcccatggggactccactgggcctgcgccagccgggcacaactccccccttcacctcctgcactaccaggacaggggccgcctcactcccaaaccaaccacacacgagcacaactgcaccacccacaacccgcacacagcaaactcaaaaccgcacacccatgcaagcggccaacgggagcccaaggaaaggagcaacccgtgtgcggcactcacagcggcctaaccgcacgcaaccgctaagtacgccaccccatggcaggccacttgcaacgagcctaccaaagcccgtcccacatcctacgaccctgagacatgtaagcgcgaccggcgggtaccccaccgacccccatatccacccaaacgacccggtacccatcaacgcgctcgggcccgagacgcccataaaacgaccctcaagcgcccttgcccacagggaccttagccggccgccacacttcggccctagcgccgccagaaccgacggacaagcatcgaaagcaacgcatccgactcagaatcccacaacaagcacaacgaccaatccctgggcgatagccccataatacagcactacgcaccgcgtatacagaccacgggcacgacatgggcccagcccacagagcggagagaccacccggggcgcacagacacacagccaaaccattgaggccgccccgatccaacgggcgcaaccgacactcctcctacacagcaacggcgcttcaaccacacaccaacatacatttccccgggccacactcccctcaagcagggctgtgcgcacgccaagaccacatagcgccgacaatctcaactatgggcgcagccgcccacccgcggcgcccgggcataacgagcccgtccacacacacgcgatgcaaccacaagccagcagaaagactgacgccaccccacacacgacacggcgcgacccaccttcgggcgaagcacagtacacacccacagcaagctacacacaccaacaacgacacgccgcgacaacaccagcaccggacgacacaaacacacgagc

SEQ ID NO: 580133 - DNA, 110 bp, Homo sapiens
agaatcgagctcggtaccattcacgaggggttggcatgttcttctcccatggctgatgaggatattccgggccatctccgcggacacaggctctcaccaagcggagacgg

SEQ ID NO: 580134 - DNA, 236 bp, Homo sapiens
aatgtcgttaactgataaatgaataaaagtggtatatcatacaatggaatattacttggcagtaaaaagcagtgatgatgatgatacatgctatgacatggatggacctagaaaacattatgctaaatgatagaagccagacacaaaaagctacatagtctaggattctctttgtatgagatccctagaacaggcaaatctatggagataggaaataaatcagagtgggttagtgt

SEQ ID NO: 580135 - DNA, 214 bp, Homo sapiens
ttccccgggggtccccaaaacccggtgggcaaatccataaaaattgagcgctatgggtgttaacgggcatgaggatcagtttgcacccgcaaggccaaaaggagaaaaggaacatccgttgaatgagggtgttttgtacataacttcaaaaacttgtgaacatcccttatatttgtcccccaactgtcagaataaagaacattttaaaatgaga

SEQ ID NO: 580136 - DNA, 109 bp, Homo sapiens
caaacctgtaggtgctgatcaaaaaataagtaaaaggtgcagatcccaagtcttgtagtatgtgcattcttcaagcaaggacagttactaaaggagataagtgtaaggt

SEQ ID NO: 580137 - DNA, 360 bp, Homo sapiens
cagcatcaaggtctataagagacgtggctgtcctggttctttcttctttgcactgagagacattgattaccaactatgtagattatttcctgacatgactctttctgggtttgtccttgacaaaaacatccaggaaacctgcagcaacatgactaattcaagcatgtacccactaagatctttgaagacatgcattatacacatacagagtctttagaacagactcataaattcagacagacacataattatgaaagcatatttaagtttaaattaactttcagcactaactagctatggcctatattactatttaaactttcctactccccagattgtggtatttaacttcagtttagt

SEQ ID NO: 580138 - DNA, 1109 bp, Homo sapiens
ccaggaggcggagcttgcagtgatgccgagatcgtgccactgcactccagcccgggtgacagagcaagactctgcctcaaaagaaaaataaaaaaaaaaaaaaaaaaggggtgtaaaaattttaaatcacttttggccccggaagggttttcccaccctctgtgtttacggtaactctcgaagttcctccaccacttagaagcaaaaactaggctggcacaaatactccctctctcgaagcgggcactcaacattgtgcttttcgtgtcatcctttcggagcaaaaacaacccaccaggactaattcccacaagcccgtgacccagtatgaagcgcggtcctattggtcccacaagcaccggagcactcgcctgcgtcggtggcgccatcttgggagcactgcttgcgatcgtctctataaaatctccatatcttggggctactccactcttttgtgaaaaacgcgcgcccaaaaaacccgagtggacacttctcttggacccgagaccaagacaacgcccccatgcatgagcaaataaaatagcgcgcactttaggaaccgcaacgccacgcaaatgggggggagtctcccccaatacaaacgaccaccacttgaggcgtcagtatgaccacacaccctctgtgtttggacacccctccttctaatgagagagacacatcgctcgtttggctcactattcacccccatatggcacgatttccccctacacgcgcgacatcgtaatcatcaacgaaagccaaagcgcagcgcgaaccatatattcaatcttcccccacacaattgcatatgaggcggcgccgccccaaagagcagacgtttcctttgtaggaccccatgcggtcgcttccactcggacacccttcgcccccaccttttcatacgcgggaggccccaggcctttaatgatgcaatgcggccatggtccctctagcgattacttccctctgatgtgagcgagtggcagctcatatgcgaccctgtggagccgatgacactgtgtggcccctccatgccgccctctctatttccgcgcgcctccgtgcttgttggacttcctgcctcgtgcgtcactaggccctactcctcc

SEQ ID NO: 580139 - DNA, 230 bp, Homo sapiens
acaggcgacggtggccctggcaagggcccgagatgccagctcaacgtctcttatctccatagctcgtcgggctacctcgaccccgatgtcgcgaaccatctggatcatgtcgatccgccattcctcggcccagtgccattggccgggtgcggcatcggccaaaggagccccacgaacgaggtcaagggcgctcacaagattggctagcggagccgtagatactcccccag

SEQ ID NO: 580140 - DNA, 121 bp, Homo sapiens
gcaagttcagcagtcgggatgatgaaggaccggatatgggaagttcaaagcgttcgaatgaggagactgatgactatgggaagaacagcaagtggccattgtgcctgcagtctgtgctcaa

SEQ ID NO: 580141 - DNA, 353 bp, Homo sapiens
ctcacagagatattcgtggagcttggtctgtaacacagaagcagtgatgagcaaggtctcttgtgccctgaagcccagcgaggtgtccacacttcacccttggctgggctgtgtgccaggaaaccctcccggtccaaggtcttcacaaccacgccagtcttggtagggaggcagactccacatcatccgcctttggggcgagcaggctcactttgtggaatcaccatcaggaaaactatcttaacctatcaatcagcagactttcttccttctctaattctgacataatatttgagatttcaaagaacccatcttgaactaaaatgtaaataaaggctgagctttaagttgta

SEQ ID NO: 580142 - DNA, 247 bp, Homo sapiens
tgtctctgggatcgacacttaaccaacctggaagtttgtatacggggaaaaaccaaattactagacttcagaagctggatgcgctcaccaactgacagtcctcagttatgccgagcaaccggctgaccaagatcgacgggtctgcagaacctgcgtgaaacctgcggtgagcctgtacctatagcttacaactggcattcgaggttcatccgaggagcctcggagacccaattaacaatactccacg

SEQ ID NO: 580143 - DNA, 618 bp, Homo sapiens
  misc_feature (34)..(34): n is a, c, g, or t
  misc_feature (78)..(78): n is a, c, g, or t
  misc_feature (114)..(114): n is a, c, g, or t
  misc_feature (132)..(132): n is a, c, g, or t
  misc_feature (183)..(183): n is a, c, g, or t
  misc_feature (185)..(185): n is a, c, g, or t
  misc_feature (220)..(220): n is a, c, g, or t
  misc_feature (288)..(288): n is a, c, g, or t
  misc_feature (291)..(291): n is a, c, g, or t
  misc_feature (293)..(293): n is a, c, g, or t
  misc_feature (296)..(296): n is a, c, g, or t
  misc_feature (318)..(318): n is a, c, g, or t
  misc_feature (326)..(326): n is a, c, g, or t
  misc_feature (328)..(329): n is a, c, g, or t
  misc_feature (337)..(338): n is a, c, g, or t
  misc_feature (345)..(346): n is a, c, g, or t
  misc_feature (349)..(349): n is a, c, g, or t
  misc_feature (369)..(369): n is a, c, g, or t
  misc_feature (373)..(373): n is a, c, g, or t
  misc_feature (382)..(382): n is a, c, g, or t
  misc_feature (413)..(413): n is a, c, g, or t
  misc_feature (416)..(416): n is a, c, g, or t
  misc_feature (450)..(450): n is a, c, g, or t
  misc_feature (454)..(454): n is a, c, g, or t
  misc_feature (466)..(466): n is a, c, g, or t
  misc_feature (474)..(474): n is a, c, g, or t
  misc_feature (483)..(483): n is a, c, g, or t
  misc_feature (504)..(505): n is a, c, g, or t
  misc_feature (541)..(541): n is a, c, g, or t
  misc_feature (550)..(550): n is a, c, g, or t
  misc_feature (554)..(554): n is a, c, g, or t
  misc_feature (588)..(588): n is a, c, g, or t
ctgagactgtgattgacagccaaagggattaacnaacgttttattctctgccccccaaaatatcctgtgtatccctangctcccataacgcttcccttcctgcctttcaagganatcgtcaagcgccatgcntttgcaaaaattgtggttataatgctctaaagaattttttgcatagcattnangccaaaggagtctatgagcaagtactttgccaccnggtagttcgtgcgtatcctacgccccccggggggtcactgtcatcctcaccggctgggacacggttcngananccntcgccccagccgtggccaagcnggccccgncnnggccaggnngaatganncanttacctcctggatcaatgcngcanggagcagtnaacacttgcttctgcttccgctgcagtgggngcnggccagcccccgcgcctgcagtggtggccgcggnggcngcggggtggggngggggganctcgaggcnaggctatgaacagtgagagannaagagaattgctggtgcttctccagggagatacggnacctacacnccangcaggtttttactttcaaacaggccaccaccagnaagcaaagagacctatgccttttttttttt

SEQ ID NO: 580144 - DNA, 454 bp, Homo sapiens
ggtcgacctcatcacggtcagtgggacagaggtggtccctgactttggggagatggtatcccagtggcccttccattccatccaagccctttctttccacggaagcacagacacccctctcttacctgcactcttttctttaggcaactaagcctcaacatttgaatctatctaaaaataaagaagaagaaatggcattttattagagattttttaaagataaaaagtaatcaagcctctggagaaaagaccatccatctccctgtggcctcgcagccatcacgaaatgctgtaatttggggagagaagatgcattatactgcatcttaatattagagaaacgcgcagtctgtgactcagcagtcccacttttaggtttctatactgcagaataaaagcgtgagtacatagacactagaatacgaaggcgttcattttcagaattataacgcaa

SEQ ID NO: 580145 - DNA, 335 bp, Homo sapiens
tcatcattcaaagctcttcttgtattcctccgaggctaggtagagtagaactcgtatgaagaacttggtgctggatggctgtcttcacaatggcctcgatgctctcaaactcaatgtaggcctggtctgaagtcttagagagccctttcttggagatgaactgggaggtaactccaacctcaaatgtcccaaacacgggggaatggtcgctggtgacgatgtcttcagtgcaatcataagaattgcagatgatgtgagtttcagggtaggattccacagaatccggtcacaccatgagggcacgttggtccggaccccatgagtgtctgtcattg

SEQ ID NO: 580146 - DNA, 113 bp, Homo sapiens
gggcccacatgaggaagagagagaccctcactgctggggagtctgccacactcagtcccccaccacactgaatctcccatcctccatggtgctgacatcctccatggtgctga

SEQ ID NO: 580147 - DNA, 388 bp, Homo sapiens
gtcccaaatattcacatgtgcctttctttggtgccggaaacgaacagctgtgcttgcagcatttgaaatctgattgtatctacactgacatcatgttccagctcggccagtatgtcaaagtgttgtctttgggtgcctggaatctacttgtaggaacatcagaccacaccttcactgtaaacgtcccaccgaatgacaataatatatgcccgttgtcatgccatagcagatcttactatcagtcatcattcatgtcccattaacgtgtcctggcgtcttcctaattctatggtataaatatagacattattatcccatgaagaaattatgacggtggcttctcctggttgaaattcaccagacgatgtatccatatttgtacctgata

SEQ ID NO: 580148 - DNA, 179 bp, Homo sapiens
  misc_feature (99)..(99): n is a, c, g, or t
  misc_feature (105)..(105): n is a, c, g, or t
gccactacacatcctctagaatgaccaaaaataaaaatacagcatcaaatgggacgacatggtgccaactggaattccttataccctgctgatgggagntataantgtggtacaggtcactttggaaaaaagtttgacaatttcttatccaattatacataaacctgtcctacgaccta

SEQ ID NO: 580149 - DNA, 557 bp, Homo sapiens
gatagcagctcaaaaacttactgggtatgtattccttttcttctttaaatattgcacattctgtgaattggtgtatcccggtagaatttttccctgaaatatattcatttggtactttctttctattcccattcccattggcatggtcttggatcgggctcacattaactcctaactggacttttgaaataacttcctcactgtactttcggtcttttcttttcctatgcaccttttactctgccacagatttgagaagtccaatcacagatctgaccgtgtcttgctgactggcttcctcaatcatgtacaacgtaaagcctaagatgtctgctttgcttctgactccctcgggatactgaaataccccagcacaacacctgccaatagagtcaggctacacacaactcagggatgttcccggcagttacctaggaagctcctcacttgttcccccgcgattcataattcatacttcatcttctgccaactccagcataccagtcctggcatgccactttgggatttatctctgccactgtggcgctgatctaccc

SEQ ID NO: 580150 - DNA, 937 bp, Homo sapiens
  misc_feature (9)..(9): n is a, c, g, or t
  misc_feature (75)..(75): n is a, c, g, or t
  misc_feature (85)..(86): n is a, c, g, or t
  misc_feature (89)..(89): n is a, c, g, or t
  misc_feature (92)..(92): n is a, c, g, or t
  misc_feature (105)..(105): n is a, c, g, or t
  misc_feature (109)..(109): n is a, c, g, or t
  misc_feature (119)..(119): n is a, c, g, or t
  misc_feature (129)..(129): n is a, c, g, or t
  misc_feature (148)..(148): n is a, c, g, or t
  misc_feature (152)..(152): n is a, c, g, or t
  misc_feature (177)..(177): n is a, c, g, or t
  misc_feature (181)..(181): n is a, c, g, or t
  misc_feature (184)..(184): n is a, c, g, or t
  misc_feature (189)..(189): n is a, c, g, or t
  misc_feature (195)..(197): n is a, c, g, or t
  misc_feature (204)..(204): n is a, c, g, or t
  misc_feature (207)..(213): n is a, c, g, or t
  misc_feature (223)..(225): n is a, c, g, or t
  misc_feature (240)..(240): n is a, c, g, or t
  misc_feature (254)..(254): n is a, c, g, or t
  misc_feature (273)..(273): n is a, c, g, or t
  misc_feature (307)..(307): n is a, c, g, or t
  misc_feature (350)..(350): n is a, c, g, or t
  misc_feature (382)..(382): n is a, c, g, or t
  misc_feature (384)..(384): n is a, c, g, or t
  misc_feature (386)..(386): n is a, c, g, or t
  misc_feature (405)..(405): n is a, c, g, or t
  misc_feature (420)..(420): n is a, c, g, or t
  misc_feature (422)..(422): n is a, c, g, or t
  misc_feature (438)..(438): n is a, c, g, or t
  misc_feature (476)..(476): n is a, c, g, or t
  misc_feature (479)..(479): n is a, c, g, or t
  misc_feature (482)..(482): n is a, c, g, or t
  misc_feature (508)..(508): n is a, c, g, or t
  misc_feature (559)..(559): n is a, c, g, or t
  misc_feature (563)..(563): n is a, c, g, or t
  misc_feature (574)..(574): n is a, c, g, or t
  misc_feature (582)..(582): n is a, c, g, or t
  misc_feature (584)..(584): n is a, c, g, or t
  misc_feature (594)..(594): n is a, c, g, or t
  misc_feature (605)..(605): n is a, c, g, or t
  misc_feature (652)..(652): n is a, c, g, or t
  misc_feature (656)..(656): n is a, c, g, or t
  misc_feature (662)..(662): n is a, c, g, or t
  misc_feature (680)..(680): n is a, c, g, or t
  misc_feature (691)..(691): n is a, c, g, or t
  misc_feature (700)..(700): n is a, c, g, or t
  misc_feature (792)..(792): n is a, c, g, or t
  misc_feature (829)..(829): n is a, c, g, or t
  misc_feature (844)..(844): n is a, c, g, or t
  misc_feature (846)..(846): n is a, c, g, or t
  misc_feature (856)..(856): n is a, c, g, or t
  misc_feature (876)..(876): n is a, c, g, or t
acccaggcngagggcttcttggttcctggagacatgcccagccacagcaaacacagggaaacgcgaagggggcanccggaaaaannggnccngaacggggggggngggnaagggagganccccacgacnggagcagcaggaagaaggngggncgggggaagggccgggccgcccagngggnccnccccnccccgnnncctgccnccnnnnnnnaagggaaacnnncccccccccccagcnctgaggaaaaggcncctggccggggcccccccngccccccccccacccgggggagaaacggggcccntgccccccggccccccccagccgcccagaagccgggcccgggncagccgcgggaagaagcctttgccgaacccanangngccgaacaagaaggcacangagggggcagccttnangacccgaggaaggaancccgcaaaaagtcccttggtgcccgactcggcccgganccnccncagcagcagccaggcggagtccacangcagggggttcactctcacagccgccagcgcgcccagagcgaccgggcggngggnctttaccacgncaaagggnanagtcagcacngcagccaccgnccccgagaagccaccagccacaaagctcatgcccacagaagtttggncctncggccngagcccattgagccagcncttcaccagcncatagttgnaccagtacagggctgagaagggcacatctcgaagggcagtggggccccagcccagccacagtgagcgccaccaccctggagccactgcagtncgaacacaggcacccagctcccggtacgacacaagcngagcctgcagctttntncgcataagcnccagggggctgatcacagtnacggtgcccaggcggccagcgcgccaccaaccatgggtgcgtagaggtcagagggcagggc

SEQ ID NO: 580151 - DNA, 508 bp, Homo sapiens
cagtataggagagcaaaagtgaggtgcacacccaaaattagaaattagaaaaataaaatcagaagataaagctgtgaaatcaacatataaacttatattgtcagaatggctcccagaatagcaaaatttgccaataatcatgtttttaaagcatgcacacacacacacacacaccacacaccacaaaatatgaggaacgatgtatgaaatattaaaacaaaaccaatgcaatttcttttctatgttggacactatcaaaattagaattagaaaaaaaagataaaatcgtagctattttctgtaagttttaattaaattaaaaataagcattttcgtaattgtctcgaatgaatttttaaatgctcatttgttactttctgttagattcaaagtaactagtttattcacaatcctaaaaatacctcaaactactttttcaaggctctgacttttttgctaacgtttatttattaaagacacattatcatgggatgtattttatttaaaa

SEQ ID NO: 580152 - DNA, 253 bp, Homo sapiens
tgggggaaatttaaaaatttttttggaccggccgaggggggtttgttttgaacccaattgggggggggggggtttttgaaagggggaaccgggcccttgggacccaaaagtttttggttttttgggggaatttcaaccccaataacgttttgggaacaccccccccgggtttgggttggcaaaattttttttttttttgcccaaaaaatttttgggggcccgggggaaaagccccccatggggggtccccttt

SEQ ID NO: 580153 - DNA, 828 bp, Homo sapiens
gatactgtgccctccatgaaatggaggagccctctcctaaaccgtggcctgcacatagtaacttccttccaaagaatacaaaatggaaaggaggggcaaaagagtaagtttacagtggagaaatgtgacaaatactacctcagccaggtgatcaaggtgaacagcagaagcaagaaggtgtgttgatactatgtacccttgatatgatgtgatgagaccagcattttacctttgtggtcttcctctcgaaaacccataactccgatccaatcatgtgaacaacagtagatgaatcccagctgagggacattctagaaacaaaccaggccagtactcccccaaactgcccaggtcatccaaaagaaggaaagtctgtataattgtcacagccaagaggagcctgaggagacaggatgactaaatggaatatagtgttcttgatgggatcctggaaccacaaaagaacattaggtaaaaactaagaaaatctgaaaaacatatggactttaatcaatagtgataaacaacatcgttctttaattatgagaaatgtaccatatgagtaaaagatgctaataataaaagaaacttggtgtggggtatatgagaactctgtactgtcttcacaaaattctgtagatgtcatctatctaaaataaagttatttaaaacgttaaaacacaagggggcgcctaagttctgagggcaagtaggtacagtctgtcaaggccaagggggataaaagagagggggttaaaggggggaagttggctggagacctccggggaatggaccggtagcagaaaataggaggattggggagtgtag

SEQ ID NO: 580154 - DNA, 245 bp, Homo sapiens
  misc_feature (95)..(95): n is a, c, g, or t
aatttaaacagtctcactgtgttgcccaggatggagtgcaatggcacagtcttggctcatggcaaactctgcctcgcaagcagctgggacttatnctccttttgtaaaagaaaaaatatttatttatcatacaaattgtacatacattctagtgtaagatttcaattaaatactaaccgcgctacctctgcagattggtttgttataacttggtgccagaataaaactcctttttttttcctcaa

SEQ ID NO: 580155 - DNA, 947 bp, Homo sapiens
actccccccacccgcgcgagtgtcgcgcatgaggcttcttgggggggcgcgcacacatactcccccccacaggagagcgtgggagagtaaatatcactctactctctctccaccagcttcgctcttcttcccgccctgtttcttcccccgggcctctgctgctcttcttttgtcttgtctctcgtcgcgtctcttccactcttcttgtcgtgcctctctcgcgtcgcgtggggatgtctgtcctcctctcttctgtgtgtacgcgtcggtgtgttcctcatctcctgttagcacagatatgattctttttcgtcgtgcgctcccgcgcgcgcactcgcgcgttgtagagagagcgcggcagctctctcggtgagagaggagagacagctctactccctctctcgacgcgcgcgcgtatgtgtttttctctccacgctgatttgcttggggggtggccgggtgtgttgcctctgtgctctgggacgccccactctggcgcgctctctccacatcacagaagcagagcgctctctctctctccccccgcaccactcgcggctgtgtctgtgctgtgcgctgggcgcccaccacgcaccacacgctctctctgctctgtgtgagtagtaggcacagagccggcggtcgttgcacaagtgactgtggataatattcttgtaatatatgtcttctctcacacccctcccagagagagagtagagaaaaagccgcctagaggaacgagcactcaatatttgtttgttgtggtgcttctttgttttgttctacgctccagagagatgagaacgagaccctcctgttgtctccgcgcggaaattggtgtcatgtgggttttatatatgaattgttctgttcatgttgtattaaataatatataatcataataatgaaaataaataataataataacaataagaataataaaataa

SEQ ID NO: 580156 - DNA, 157 bp, Homo sapiens
gcgagatcgtaagtccgtcatcacggtcaggactgagccagagcagacagaaaatcgtcatatgctcgctgggagactagtaaaggttacagcgtccggcattcgtatctgctggtctggcgcattttacttcctagtacgaagtgacgccggctgc

SEQ ID NO: 580157 - DNA, 701 bp, Homo sapiens
tagagggcggctaacacatacaggatgaacatcgaaatacagccacgagaagcagaggacaagagacgacatgctgacaccacacaacacgcaaccaagacggcaagcacagagccagaaaaggaccggaacaagcaccacaactaagaagacacaacaaagcacaagaaaacacaaaacaacacacacaaaaacaacaaaaacaaccaacaagaacaaaaaacaaaaaaaaacacataaaccacatatataaactaaataacataacaaaaaaaaaggagcaaaacatacaaacaaaacaaaacaaacaaaaagaaaaaaacaaaaaaaaaatacaacaaataaaaataaaacaaaaaatatccaaaaatacataacaaatataaagaaactaacacaaaacaataacagaaaaaaaacaaaagaaaaagacatacaaataaaacaaaaaacacaaaaagacaaaaaacaaagaagaaaaaaaacaaaagaagaaacaaaaaacgaccaaaaaagaacaacgaaaaaaaagacgaaaagaaacacaaacaagaacagaaaaaagaaaaacacaaaaaagaaaaaagcagatagaaagaagaaagagagaaatatcacaagaagacgcaaagagagaacgactagaagaggagagaagagagagaaaagtaacaacgtccaaagagacaataacgaacaac

SEQ ID NO: 580158 - DNA, 526 bp, Homo sapiens
  misc_feature (526)..(526): n is a, c, g, or t
gcctgtaatcccagctctttgggaggccaaggcaggcagatcacctgaggtcaggagttcgagaccagcctggccaacatggtgaaacccagtctctactgaaaaaaaaaaatacaaaaaattagctgagctgggtggttcgtgtctgtagtcccagctactcaggaggctgaggcagggagaatcgcttgaacccaggaggcggaggttgcagtgagccaagatcaatgccattggcacttccagctgtggggtgacagagcaagacttccgggtctcaaaaaaaaagaaaatctcttactttcggcagttttctcaaatggtgtgcactctcttattgggttatttaacctttaagtccggccttgggatcccggcagtagaggcctcctgggaaacttaacccctccctggcgcttaacgtgggaatttggtggtggtccttttggacccggaattcttcggcccagggtcccccttccccccaaggccatccaggtaaccaccaatttaaggtcctctgggn

SEQ ID NO: 580159 - DNA, 955 bp, Homo sapiens
gggctgacgcctcgttcaatttctcatagggttgcgcttgttaccgccgtgtgctaatggagcactgtaatggtttcaataggtgcgcgttccagatacggtgaatgagcctctttgatctcttccggtgctttgtcggctttcattggcatgtcgcgtagtgacagtagtattcctttttgggtagggtatgattcgtagattgataggagttgatgatgagcgaagaagaatgaggaagggggttcatggtggctcgtagggcatggcaaatggttcaatcagtggtcatctacaccacatggagggatatggagttcggggttcaagatgtcgaagcgccgaggacgggagggatgcagtctcgcacgtattaatttacgcgctttgaatgatccttagatagctgagatttacaattatgttagtcttcatgctgattatggggtgagcctggtcacgttgccgttttctcattacttctgaagcttctctaggctcctgagttctgagaccgctcgtggtgagagactacggtccagggacagaccactttcgggactcaatgcttaagtatccagatagtcaaccagcccaggatctcgggggggtctaggagagatgatgctcgaagtgaattcacccgatctagtctgccagtactgtgggtttccagaggccattttaatagggccgaatgatgatattgctaatggaccccagttcagaaaccagagaggcatatgacgggattccgaggtttcccaggtaggctggccgcttctggggcgagcaagtctttcaagaggtccggtactaaccctaaccatgggtatggagcgccgccgggtgcgtgtgggcaaacatatgtaccactatgagatggggggtgcgaaaaaaaccacgggtgtccgggttgggagggcaaccagcaggcgttttcccgaatttcagg

SEQ ID NO: 580160 - DNA, 279 bp, Homo sapiens
tatgtcgctggtacaaaactcacaggacatgatttggtctaagggaattttcatagttttggcaagggtgcagcaactcttctttttttccttctctgtgcccaggctggagtgcagtggcacaatcaccacttactgcagccttgacttcccaggctcaagcaattctcccacctcagcctcccaagtaactgggaccatagatgtgcaccaccatgcccaactaatttttttttttttttttttttttttttttttttttttttttttttatttttt

SEQ ID NO: 580161 - DNA, 213 bp, Homo sapiens
tgaggatgcaagtgtcaagaagggaacattgtataccagtataaactctctatagtgggtctgcaagtatgcttaacctctcggggcctcagttttctcatctgcaatatgaaggagttggactcgataatctttaaagtccattcctgctctaaaatcctatgcttttctgaagtactctatttaacagaatgcgttgctttctcactttga

SEQ ID NO: 580162 - DNA, 226 bp, Homo sapiens
ccgcgcagctgtactccaccggcaggttgtactgtctttgtctggttttggtatcagcgctaatacctacgacaccatgaaaatttgccttttcttttttctaaagggagattgtacagaattttgacgttcactctattttatttttttgataacggggtcttgctgtgtcacccaggttacagtgcagtgatgcagttgtggctcactgtaacctttacctcca

SEQ ID NO: 580163 - DNA, 324 bp, Homo sapiens
tacttaagcagtactccatgaaataatagataaaaggcattactgccaaagaaatctccagaggggcataaaaagtacagttcttacaaactatcttaaatataaaaacatgtcaaggtacagaacacatagtacgtacgattaacaggttataacagctttgcattatcacatgttgctaagccaagggtgttcctcaaacttctcttggctgcacttcaggtaatcttcttcccctcatccccccaggcctgaggtttgatattctccaataatgtggtaggctcattcctggctagctttttgctagctgaataatctcaa

SEQ ID NO: 580164 - DNA, 287 bp, Homo sapiens
  misc_feature (281)..(281): n is a, c, g, or t
  misc_feature (286)..(286): n is a, c, g, or t
gggggattaaaaactgaaagagctcattatcattgacttaaaataccgtaagtgtcacttgaggtcaggagttcgagaccagcctgatcaacatggcgaaaccttgtttctactaaggatacaaaaattagccaggcgtggtggcaggtgcatgcaatcccagctactcgggaggctgaggcaggagaattgcttgaacccgggagacagaggttgcagtgagccaagatcgcaccactgcactccaacctgcgtgactaagtgagaccccgtctcaacancatang

SEQ ID NO: 580165 - DNA, 253 bp, Homo sapiens
  misc_feature (55)..(55): n is a, c, g, or t
gactgaagtggagtatgggcgtgtggacggcggacttcagagtcactggtcccanagtagaggtagcacacgaaaaggaaacccaagaagcaccagtagagaaagcaaacaaccaaggaggggcgggaacacctcacattgggaaaaagaaagtcaggcaggaaattatatttttaagttatttgacctgatatttgccaaatgtgaacttttgctggcctttacttttccaataaaatcaactatgatcatg

SEQ ID NO: 580166 - DNA, 127 bp, Homo sapiens
agaggatcggggtgagaagctggagaacagtgtagttaggtgtggtcctaacccacattgagtggtggcatgtggattggtctatcaaaaattaaatagaagcgttagggggctcactcttttattg

SEQ ID NO: 580167 - DNA, 1235 bp, Homo sapiens
gaagaggaggaggaagaagaaggtgatggtgaggaagaggctggagatgaagatgaggaagctgcagtcacgctacggcgcaagctgggcagctgaagatgatgaggactgacgatgtcgataccaagaagcagaacaccgacgaggatgactagacagcaccaaaggaacacgtcacactaacgaaaaaagaaagggccggccgtgttccacaggaagcccacggaagggcgccacccagcaacaacgagtaaccaagacaacatcggaaccaaacgaggacaccaaacgacgaagaaggacacactccatacaaccagagcacacagaggccacgccacagaagaacaacaccgccccaacaacacagaagcaaaccaacagaccaagcaccaaggcgaactcccacatgcacgacagagaaccctcaaaactaaccgcaggcaggagacacccgcactaggcaacacccacgaaccgcagaaaccgcacgacgcgcacacaggacaaacgtaacggagtaacaagacacacccacacaccaaacaagacaaacggtcctacgaccgcaggtaaaaagaccacacccaagcaccataccgccacggccaggacacgcagagaagccacaggcatacaccgggcaaaaaagaagcaccaaccgccaacgaccaataaaaggcacaggcgagacacaccggagaatacaccagagaaggccaagagccacgcggcgcaacaggccggcagcggcagacacgacgacagaccaacaaaagggaccagggaaccacgcggcgcccgacccaggaggagcgccagagaaggaagagagaagacaaggagggaggcgcgagggcagcgagaagcgagagcccgaagaagccgcgaggcgacgcgggtgggaggggggaggcgagacgcgaggcgcgggggggaggaggaggggaagcggcgccggacgcgggaggagggggggaggagggagcgaaggaacgcgcgcggccggcgagcgcgagggaagagagcaggaggcaggaggaccgggaagggatggcgcgagaaccgacggccacgcagagaaaacaaacagaagagagcagagacgagaggcaggcaagaaggcggacgacccggagacacggccaagcagaagaggaagcaaacgagcgcggaacgggagcgcagaggcggcccagcagaggaacgagaagcgggacacaccgaccgagccc

SEQ ID NO: 580168 - DNA, 695 bp, Homo sapiens
gcatggtgccatggctcacatctgtaatcccagcacttttggaggctgaggcgggtggatgcttgaggccaggagttcgagaccagcctggccaacgtggtgaaacactgtctctactaaaatacaaaaaaatagggctgggcgcggttgctcacgcctgtaatcccagcacttttcagaggccaaggcgggcaaatcacctgaggtcaagagtttgagaccagcctggcaacatggtgaaaccccatctctactaaacatgcaaaaattacctgggcatggtggcaggtgcttataatcccagctactctgggggccaaggcaggagaattgcttgagcctgggagatggaggttgcagtgagctgagatcatgccactgcactccagcctggcaacagagcaagactctgcctcaaaaaaaaattaaaataaatttaaatacaaaaaaaaatagccaggtgtggggtgcatgcctggaatcccagttacttgagaggctgaggcacgagaatgtgtgtgaacccaggaggtggaggtgtgcagtgagccaagatcaaaagaagacaactgactccagctgggtgacagagtgagactctgtctcacaaaaattaataaattttataacttcagaaatgctggggatctcatgttctttttagcataatgtaatttccttaggaatgtttagaa

SEQ ID NO: 580169 - DNA, 1360 bp, Homo sapiens
ggggcaccggggcggcgggttggtctacgctgtgcgcgggtgacgtcggaggcagcggtggagcggagcggggccgcctggggcctcatccaagtggccgcatgctggcaggcacgttagggccccacctgaccactgcgctggctggacctgaatgaactgcagggaacgggggccagagggaggacccatgccaccactgagcctggcctgcaggccaattgaaactccaaactgttggaggaaccttagccaccctgccacaatccatccggccgtgcgtgtaccaaggcagcgtgacaggacacgtgacaccagcagaaacccaaccaccgaatgggcaatcaaagggatcgtttcccacaaactgagggaagagaccgtcaaccggagcacatccaagggatccacgcaattcggacgggggcccccattgacggcggggaacaccaccgaattacatcgccattggcacacgcggtcatggtaaccacgagctagtttggaacaaccttattcacgttgccttaggttgcgcacatctgaacctaatcccctcgttggcaccttccgccacgaagcaccaaagaggtggcgcattcaccgtttcccagtagaaagccacaaacaaagtaagacttccgatttaccaccacaccgcggagcaaagaccctgtcttggagcgctgggcactacacaacttgtgcgacgcgaaggaacttctagcttgggcgggttacacaaacgccggcgtggaccttcccaacatgcacggggctgcaacccatggggcgaaccggcgtcgctataggtaacccattacggcggagcaaaagttcaccggggaacccaaagcagggtagtcccggttggccgctggtaagacccgaactgccacgacgccgttgaccgccttgtagcattgaaatttcgacgaaaagacgcgataacaatgcgcccgacgtgaaagcactctcctggacagaacattacgaaaggaggagaggcgtgacagcggaagggggagagcaaccggacccacgtggcgcatacatatgtgaggacacgcaacacctacacccgagaagcgagaagagactcagttggaccacagccacaccaaggcagggaccacgccgaatcaagttgagagaatccaaacgaacgcaaaggaaatttccccgcaaccggagcagcagacaagccagcccacagaggcagcagcgaggtgagtccgcaccaacgtccgggcagacaacaagacgagagccccagcagaacagaaagcaccacaggagcgatcacagagaggagccagccaactaggagcagagcaaagacacagggagacacacagct

SEQ ID NO: 580170 - DNA, 254 bp, Homo sapiens
  misc_feature (17)..(17): n is a, c, g, or t
  misc_feature (48)..(48): n is a, c, g, or t
  misc_feature (86)..(86): n is a, c, g, or t
  misc_feature (192)..(192): n is a, c, g, or t
gaggcctggggcatctntgtactgaaccccaacaaaaccaaggtccanggaagctgtgagggtgcccatccccacctgcttctttnattcccctatggacacctcagctttggattcatgcaggacctccagcagaaggttgtctacctgaagctacatggcggtggagtacaatgtgtccttcccccacgnagcacagtggacattctcggctcagaatgcatccctttcgagatctccaagcaccccttggg

SEQ ID NO: 580171 - DNA, 938 bp, Homo sapiens
tggtcaaaaaagccagttttttttttattggtaaagctctgccaaaaatcttctagggggtgccaagggtcaccggccacactcgccccaggttgtccgtgtacccagcaaacagattcgggccttcagcaaaccaaggccagggaaggctgcacgggggtgtggtttcttgccttcgcttggcgtggttactgtgattaacttccttttggcttacagttcactcatacaagtgattcttttcccttctaaatctcccagaatctttgatgctgtggggcctgtgttggcagcacacagccagatacgcggtatagggctgaacgcacaggggcgttgagtaattgtccccaccattcatagcgttgtaaggggtggttggccttcgttgaaagattcccataaacaggggccgggccatcctggcctccagaagcacagaggggatccatctgggagagacagtcacggggtccagatacgccggggtggggcatgggggtgggtctcacgctggcagtaagccagggttccatacctggaccaagttggtcccacgcacaggaaagacgatgatagggtcgtggctagtggggcgacaacgcggacaagaacccactccggagggctctacatccctgaacaggggcttcgggcaccaccccagggttataccaatcaagctgaggggtaaactcccggaaaatcccaagaaacaattcgccggtctgtcaaaggaaaaaggcaactccagcatctcttggtgaggggccacaaatccctctgggtggtgccgtcggtggacccccagagggggaggctccacaccagggacggaaggggaatgcccttgaggacaacccatcacacaaggggtgccgaagcgggaaacccaggccaccggcaggccagagaggtctcaagggaagattcgacgg

SEQ ID NO: 580172 - DNA, 327 bp, Homo sapiens
  misc_feature (9)..(9): n is a, c, g, or t
  misc_feature (16)..(16): n is a, c, g, or t
  misc_feature (81)..(81): n is a, c, g, or t
tcaagtgtntccctanttaagttgggttgtttccttacctgttgtttttgaggttttttccctaatagtctgggtaaaaancctttggttatttgatttatcagcaaatattttttgtatgtaacttggcttttcattgtcttaatggtgtcattcactaagcaagattttcattttgtttttttttaagacggagtctcggctctgtcacccaagctggagtgcagtggtacaatcttggctcactgcaacctctgcctcccagattcaagcaattctcatgcctcagcctcccgagtaggtgggactacaggcgcacaccaccac

SEQ ID NO: 580173 - DNA, 170 bp, Homo sapiens
ctgacctagaggatcccgtgctctgtggaggacgcaaggaggggcagcctttgaaaacgaatccctccaaggaaatgtttccaccgacctaagaagtattactaaaaagattcagtcccaaagaattttcaggggtaactttaacgatgtgttttgattaacgatttgag

SEQ ID NO: 580174 - DNA, 532 bp, Homo sapiens
aggagtggtttctgtgaaccggtgctaataatacgacattggttctatttctgttcccgacgtgaattactgattcacttatgccacctttcttggacgtctcaacaaaatgggttaattcttaggagcaatagcagatgttcatggagtagatttgttcctcagatacatggtacccctttcacccagccccagagtggcccatggactaggcagtagaggagccattgccttgagtgtctttgcgtttcccaagaatgttgttgtagaagggcactaatgtttagtgagttgtcagctaatgggcccagcactttggtgattgtgttggttttttttaagtagagatggggtcttgctgggttgcccaggctggtctcaaactcctggctataagtgatcttcccaccttagccacccaagttctgggattacaggtgtgagccatcatgcctggccaggcctagcactttggagacactgtatgcgtgatagcagtttttttttttccctgtgggagtaggagttctcg

SEQ ID NO: 580175 - DNA, 112 bp, Homo sapiens
gcccccttaagacacagtagtgatattgtaaatgcgattatggaattaacaatgcaaccatatgggagcaactttttttggtgtctcaaaggagtaactgcagcttggtttg

SEQ ID NO: 580176 - DNA, 399 bp, Homo sapiens
gagtttccacccccaccccatttgcgggcaaaaaaggtttagtttgtccacccccattataataccaggactggttacttggttaaggaggggtttagaaaatctgtcccttttaaagcccccttacttacaataaagtacttgggaaagtggttttcaaaagtataaatatcctgtatttaaatgatcaccctctaaacattttatcatttattaacccccccggccggggtctattattaaattcaaatctccccccggcaaatttggggtctcaatttttacgggccctttgtttttaaaagtgtctgctgttgcaaaaaaaaaacattttctgcctgagttttaatttttgcccaaagttaattttaatctaaccaattaaacccttttgccttc

SEQ ID NO: 580177 - DNA, 444 bp, Homo sapiens
aaagacaggctattttatttcaaaaaaagaaaaaaaagtgggctctgggaacaggattagtccaatcgggccttcagtgtccctggtggtgattaagtccttctacgatgatgtggacaatgaatcccatgcctgacactgcatcccggtccatcggctgcagaccggcgctacgggatccaggcccagatggtgaccacggacatccagaagatctagcccatgggtgaccggctgtacatcggtctggccgggctcgccacatgacgtaccagacagttgcccagacgcctcaagttccggctgaacctgtatgagtgaaggaaggtcggcagatcaaaccttatacccatcatgacacatgctagggcaaactcttgctatgaaaaaaggtatggcccctatactacactgagaccagtccatagccgggttggagcacga

SEQ ID NO: 580178 - DNA, 170 bp, Homo sapiens
aacaggttgatgctaggatgtgtgtttagagagagagtctcgatatctgtcagggatctgcaagctatttcggaacaataatgaaagatgtgggagtagcgcggatagtggtgcaagtggcaaggggtggtctcccagtgctatgatgtgggaagtggcaagctccacgc

SEQ ID NO: 580179 - DNA, 220 bp, Homo sapiens
ggactccacagtgacgtagttctcagagaacccgtactgctgacatatgcaaccacacaccaccgagacttgcagacacgtggacacagatacagtctcatgcacagacacacacacaaggacatactacacagacgtgcacacacagttacatatgcatggaagacacacaccatgcacacagattctgacacatagacatgcacacacacacacacat

SEQ ID NO: 580180 - DNA, 290 bp, Homo sapiens
cccccggttttcttttttaaagggggatccccccccccccgggggccccggcccctttttttttgggggggggggcccccaaaggggggggggcccccccccggggggtttttttggggggggccccccccccgggggggggggggggggggttttttttttttttgggggcccccctctcggcccccctttttttttcggaaaattacccccttggggcccccccccgggggggggaaaagacccctttttttttggggggggggggggggaaaaacccccttttttta

SEQ ID NO: 580181 - DNA, 629 bp, Homo sapiens
cccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaagggaaaactctgtgttgagggactttggttagtaaatccctctcagtattattccctccttttccccacagcagcttcctttaccggtcacctagaagggagcgggtctgtactacactcccatttggggtgtgacttaggccacaccacttcttaatcatctcccaatttccttagacattctcgattttcaggggcgggtaccctcggtgtacctcggaactttggaagcggtcactgggtttccaaaaagggcccacggcgggggtaacgaggatgggccctttacaccacttagtggttccccaagatttcttcacccgctaaaattaaatctcctttggagacgacaacacaaaccta

SEQ ID NO: 580182 - DNA, 551 bp, Homo sapiens
  misc_feature (31)..(31): n is a, c, g, or t
  misc_feature (75)..(75): n is a, c, g, or t
  misc_feature (103)..(103): n is a, c, g, or t
  misc_feature (125)..(125): n is a, c, g, or t
  misc_feature (263)..(263): n is a, c, g, or t
tttggaaggccaaagccaggcagttcccctnaggtcaggagatttaagcccagttgcccaatatagagaaccccngttttctacctaaaaatccaaaaatcanctgggcgtggtgttgcatgccnagtaatcccagctactcgggaggctgaggcaagaggatcacttgaaacctgggaggtggagattgtggtgagctgagattgcaccattgcacttccagcctggacaatgagaatgaaactctgtctcaaaaaaaaaanccaaaaaggccgggcgcggtggctcacgcctgtaatcccagcactttgggaggccgaggcgggcagatcacgaggtcaggagatcgagaccatcctggctaacacggtgaaaccctgtctctactaaaaatacaaaaaattagccgggtgcggtggcgggcacctgtagtcccagctactagggaggctgaggcaggggaatggcctgaacccgggaggcggagcttgcagtgagccgagatcgcgccactgtactcccgcctgggcaaaagagcgaggctccgtctt

SEQ ID NO: 580183 - DNA, 161 bp, Homo sapiens
gttcccaatctcgaaaacatctattctggggaatccgggataaaccatagtggttaaacccaggggggccaaatataacgtttttccccgagtatagtaggaggccccctcctctcccagagccatatgagagccatgtactcgcatatagtcgggacaga

SEQ ID NO: 580184 - DNA, 184 bp, Homo sapiens
caggcacaggagttatgtacatgcactggcatattatacgtgcccaacaaatcatacttgcacatgaggagcatgaatgaaagaagggctgtgatggtcactaacacacgagctcaccggtgttcatccttctttccttttctttttttttttggctacgtatctccgaacaatcaccagggcg

SEQ ID NO: 580185 - DNA, 220 bp, Homo sapiens
cggaacatagccgacgctcagtcggcgtcacatctcattcagcactatcgcatccatgctcaagaaaggccttaccagtgtcagctgtgtgggaagtgcttcggccgaccctcctacctcactcaacactaccaactccattctcaagagaagaccgttgagtgcagttactcctgaaaaacctccagtcagaacgttctcaacatctttggctttctcc

SEQ ID NO: 580186 - DNA, 385 bp, Homo sapiens
caggtctagcccagagtagacacccctggttgctcaggtctagcccagagtagacacccctggttgcacaggtctagcccagagtagacaccactggttgcacaggtctagcccagagtagacacctctggttgcccaggtctagctcagagtagacacccctggttgcccaggtctagcccagagtagacacccctggttgcccaggtctagcccagagtagacacccccggttgcccaggtctagcccagagtagacacccctggttgcccaggtctagcccagagtagacacccctggttgcccaggtctagcccagagtagacacccctggttgcccaggtctagcccagagtagacacccctggttgcacaggtcgacgc

SEQ ID NO: 580187 - DNA, 157 bp, Homo sapiens
gctccgcttttaccgctgcacagccttccaaaaagctgattataggcgtgagccactgcacctggccaggcccttaaaaacttttttttaattaagtaattgttttgagacagggtgttgctctgtcactcaggctgcaggattgtttttttgtttt

SEQ ID NO: 580188 - DNA, 519 bp, Homo sapiens
cttaagtttgggtaaaaatttgcggtggttcttcattatttgttcaagaagcattagagttttcacaaacttggtgtaagttgctctttaattgtcttcctgtggatatgttttgtaggactctctgctttttctaaatttcactactcacatcccacaacattatcttcccataattctggcaaaaaggagtcctgggatacctctgaagtgtggcccttaaatcccagttcctgttcatacctgactcccaccaagaaagacttttaacttgaaagtgaccaaaacaaataggaaaaaaaggaaccatcaggaagcagaaggtatgcagtgagaagaatgctttagactcttgaggaagattatcttttgtcttctcagagagataagaaatggtattacattcaaggtgctattaaggaagaaaaagaatagaaaagagtacttacaaataaaaagtaacagtagacaactatttagaagggctaaaagataaaggaaatactctttaaaaaaaaa

SEQ ID NO: 580189 - DNA, 554 bp, Homo sapiens
cgcgcacaggcctggaccaagctacccacatctgaactatgtactgatcttcttattctcaaagtctgcaagatgactgatgtgcaataccatggctatgccatgtgactttacttgacctggatggtcagtgtcccaatatttcactgactttagtgggggtgcacatatgccataagttcttccatctatcatccccatcactcaccatccatgtaatgacataatcatgtcacagagtgacctcggaatcactattcctagctgagtatactaaggctcactatctaggtcaggttcaatagtgtctgtgtctcctctaaaccctccttcatcatgcctaccttgaggaatacagcaagtgatcattcacgcaaggctcaaaggattacagctttctctgccataaagattattgctcaaatacataccatacaacaaaccaacccatttcccacaaatcttactgtctgccttctcacagaatacataatgccttctatagtgtctcttccttctggtgtactctttcctaactgaacttgttctttatc

SEQ ID NO: 580190 - DNA, 209 bp, Homo sapiens
cggtgactcagaggatcccctcggaacgaggtactggactcgcgaagaggtagggacctggggctgggggaagagggggcggtggcccctgggcaggggagagcccagccggtgactggctcaggcagcctcggccatctcctcacggcattggctctcctgagctccagtgcctgcagccatttgatcttggtctggactctccaagt

SEQ ID NO: 580191 - DNA, 146 bp, Homo sapiens
  misc_feature (39)..(39): n is a, c, g, or t
aaagacggcgatattgctctgctcagtatggtcattcgngcacacgccgaggatcagacggacaggtcaaagcgaagtcgccgatcttcacgctgaagatcggcgatttcggtctggtgcttcggcgtgtgcagtctgggggctgg

SEQ ID NO: 580192 - DNA, 862 bp, Homo sapiens
  misc_feature (283)..(283): n is a, c, g, or t
tttctgccattttgttatcgcccgttatgtttcatgcctccaattattgtccaccccccggcaaaaccatgctgacccccttcctgccaatatccccttgggctctaattataccagccaccattgtggcctgtgaacaaccacggccctcatagtcgccttcctatcaatgaattggtcaatgcctaccccccatttgccccccgtggggtacaccacagttatgtcacgccaaccccctccgtatcgttccccggcgccaaccaattttcatacagttcgncccccgggtgttacactccgccgggtgtatttcgtgcctggcctactcgcgattcaactggactgcgcaagtccacccttcccgagtctattcatctcctcttcttcaaagcggcacttctcaaccacttcatcatctccccaataaaagcctttttgtcatcaacgtatcttttgcacaaacactccttgctaccactcgcgccgtgcccctcccccgctattttaccacaacatgcggataagacctcttctctgtgtcgttaataaacccaccctcttctctcctgtacgccaaaagctccatctctccatacttaccatggcaattcacccaaatatagtcccccaccccctcattactccctcttgtccaaaaattctccccacccaccgccatggaggctcccacatcatcccccaaccacccatgtacacaaccacatctagacaccatcctatatctcaccacgatgggacacaacccctctcatgttctatacaacacctatccccccattttctcttccctaatctccctcctaaccccgaccacatcaatatacccgggtttccacgc

SEQ ID NO: 580193 - DNA, 276 bp, Homo sapiens
ggccccctgaacagtgagaagccatgcctctgtggttgtcagcccccgtctggctgtggtttgctgtgccacccccggactgtcaccccccttgcagtttttctatctgtggctctcatttactctctttcttcttcctttctcatgggcttcccctgcaggaagtacacttactgctatgtcacaaggtgcaagcgaatgctcatgctgtgccccctggctccctttgggattttcctggggccccagggactagaaatgagaccaggtggtctt

SEQ ID NO: 580194 - DNA, 391 bp, Homo sapiens
ccctacccaggttcctggtgtgtgcatagagaaacaggacagcttgctgctcttgttacagaggggcgcagatgcctgagagaataggaatgatgcccgctcaccaggaagtataagctacttgccttcatacttcaccaagcttgaaaatacatcacccatcgatgtgtggagaggaagtaaagtttaattaatgcctaattggattgaggttgatgaatgaggtggcgatttggtgctgtgaaaattgttaacggtaataagcttactaggtcagggtaggtctaaggaggagtaagggccaggtattggctcgtaaagaaggcctaagatagggggatttgtggcgttgttgtgatggctagggtagcaatccgagtatttgcggacg

SEQ ID NO: 580195 - DNA, 542 bp, Homo sapiens
atcccagcactttgggaggccaaggtgagcggaccacctgagatcagcagttcgagaccagactggccaacatggcaaaccctttctctactaaaaatacaaagaaaaattagccaggtgtggtgataggcgcctgtgatcccagttactcaggagtctggggcagggagaattgcttgaacctgggaggcagaagttgcagtgagccgagatcacaccactgtactccagcctgggtgacagagagagactccgtctcaaaaacaaaacaaaacaaaaaaagacagaaaaaaatataatatatatatatgtatatgtgtgtgtgtgtgtgtgtgtgtgtataaaataaaatataaaatcacatgcatatcttgggtaaatctgtctagcgtgaaggggtctcagacatgaatctaggcaatgggcgaagacacaatcgttttctcccacaagagagtcaacttactcagaaagaacacaagtggcatctctgggtggacccaattatatgactctaaaatattaaagcaaacattgacgag

SEQ ID NO: 580196 - DNA, 199 bp, Homo sapiens
cccgcgaagcaaaattgacgttaatattattcaggatgcctggcgacgccagtaatcgcatgacagatacaaggctttttgcggtgcgccggcgcacttgatggggagcggtggctgagaaaatatcgcctggccgcctttcatttcgcggaccagttgccaggtatattcggcaagatcaaagcgataattagaggtg

SEQ ID NO: 580197 - DNA, 320 bp, Homo sapiens
gtaaaccataatagctaaccctgtggctaatgttagtcctacaaaggccatctagtccccaggcaagaaggagttctgcttggggacagggctgttaacatctttgtttaaactataaactacattcctctcaaagacagttcagccgacacccaggaatgaacaaggatggcttgagattagaagcaagatggagttgattcagttagagctcttccgctatctcagccataattttgcaaaggtggtttcgaataatccacctggacattctctggcccacctcaaacgtgcatccagagtctcaccccttctcactg

SEQ ID NO: 580198 - DNA, 81 bp, Homo sapiens
aaagattttatactacatcttgttaaagtcctatgaatgtgtgtgtgtgcgctattaaaactgctttttctcagtttgata

SEQ ID NO: 580199 - DNA, 466 bp, Homo sapiens
ggtcagtggacagaaaagtactgagaggaaacaccgggggtagtggatattcagagcaaaccaacctaacaggattcttgctgaagacaggccagagtgatcagacaccacctgggggacagtggaagctgaggaacctaatcaggttgtgagggtaatcaggtagcgagggtaatcagaaagcgagggccagctgggtgcagtggttcatgcttgtaatcccagcactttgggaggctgaggcgggcagatcacctgaggttgggagttcgagaccagactggccaacatggtgaaaccctgtctctcctaaaaatacaaaaattagcctggtgtgctggcgggcgcctgtgatcccagcttctcggaaggctgaggcaggagaattgcttgaacccaggaggtggtggaagttgcagtgaaccgagatcacgccactgcacagagcaaaacttcgtcttaactc

SEQ ID NO: 580200 - DNA, 770 bp, Homo sapiens
gttgaaaagaagtagaaaggaagctcggcaatatcttaccccgccgtgtttaccacatacacccatcgacctcttagcatcaccctagtattgaggaggacatccgactctgtcgccaagtagacagcgatgtttatactgcgtcgctgcaggtacccgtagaactcgatgcagatagtgtatgacataactcacattgtatcacttaatagtagtggcacctgttactcgactatggctcctacgaaggtgttgcatgctgagtctcttagctttgtataccaggtgatacagttgaggcctgtcccgtgacaggagtgcgggcatgagcatcatgcaaggcacgacgagaggatccctactggaggctcttaacttctatttaaatggcaatagcaggtatctctaacagagaacccgacatggtgccttaaattctacctaaacctagtcattagagtagatttcggcgtatggaggcagactctcgcgaatcagagaccctaaacacttccgagtcacgtacatggctaagacgttcagccagtcgtagctgaatctactatactcctattggatccaatgagcttgatcaacggaacatagttatcctagggtataacaggcgcgaatcctattgctaagagtccatagtcgatgcaactaagggtttacgacctcgatgttggactcaggacaatcccgagtggtgcagccgctatgtgacaggttcgtcccgttgcaagcgattgaaaagtcctacgtgatcc

SEQ ID NO: 580201 - DNA, 986 bp, Homo sapiens
taaagattgggctcaatgatatatttggccagttattttattttttctaaaaacaatagaaaaaaatcaactttaaaaagcaaaagcgtacttaaataaaaaaaattagggtttatagtcacctatatatactaggtactgatatactaggattggaaattctggtgtaactggcgtataaacggtttgtattgaaagttatttacttttaagtggggaatatttacaggaagaaacattggtggtaaatcttaaaattttttaaaaacaattcttaaatcacaaatctggtgtaaaggaaaaaaaaaaaatgggtaacgcttaaaaaatgttctttaatggcccaaagtccaattggagggcagtttacattatgggctaaatctttcagtctcaaagactcaggccaagggttggtcgaggttggcattggactcatgctttgtgaaacaagttctcatagggtgatggcctcgaggacatttcgtgttaaaaggaactcgtttcccttactttcccttacgcacaagaagttccgatagcgtgtccaagttgggtgttccaactgttctcgatgagtattccgaaacaagtcctcttcagaaagtgacctttggcacctctgcttgtgacggacaggattgtattgcgggggctattaaagcataactacctggggggctttcattggtgtttccaaatccgggagacgcgggcacccaggggaaaaaaaagccccgataaagaaagaacacccccggggggccaaaagcttgtgttctcccctgaaaatacccaggagcgagaaccagggagagagaacaggggagaacaacgctcagaacatgacatacactagaccctggtagaaaacaccctctgagaagaaaaacacaaatacaaaagtgaaaagaagaacaaaaaaagataagaaaaataagagaaaagaaagaaaaatagaagaagagataaaaaaaaatagatag

SEQ ID NO: 580202 - DNA, 385 bp, Homo sapiens
gtgaagactattgttagttcatgggcaggaaaaatacaggcaactggcgagatgtggtgccatagtttgctgactcttgcttttaagtatttgtatcgttgacaagaaaattgttttgtttagccatccccaaagttagtattttattctgatttgggcctataagaaatatctgggccgaggcgagtggatcacaaggtcacgagatcgagaccatcctggctaacatgggtgaaacccccctctctactatagatacaaaaaactagcctggcatggtggcggcgcctgtataccaactctttggaggctgaggcaggagattgcgtgaacctggaagcggacttgtttgacccgaaatgggcccttgacttccgcttggccg

SEQ ID NO: 580203 - DNA, 306 bp, Homo sapiens
  misc_feature (17)..(17): n is a, c, g, or t
ttgcccccaaatttttntttttttccctcaaccaaaggagggttttctccaggccagggtgggattttaattgaatttttaaataaaaggattggtcttaatgttaaaaccaataaaaaaagcctgtggtttttcccgtccaacaaggaaacccctttgtaaaaaaacccggagtcccggatgggggcttaaaccgggtttttttatcccccaaaaacccaaaatgttaaaaaccccaggaaggggttgggtttagaaaggggttttgggcctcccccttaaaaaaagggggtttgggttttttta

SEQ ID NO: 580204 - DNA, 727 bp, Homo sapiens
  misc_feature (50)..(50): n is a, c, g, or t
  misc_feature (471)..(471): n is a, c, g, or t
accgacgatcctattgtcatcatgggccgccgcccgcccggtgttaccgntattgtaagaacaagccatacccaaagtctcgtttctgccgtggtgtccctgatgctaagatccgaatctttgatttgggacggaagaaagcaaaagttgatgaattcccactttgtgccatatggtgtcagatgaatatgagcaactctcttctgaagcactggaggctgcccgtatttgtgccaacaaatacatggtaaagagttgtggcaaggatggctttcatatccgagtgaggctccaccctttccatgtcatccgtatcaacaagatgttgtcctgtgctggggctgacaggctccagacagggatgcgtggtgcctttgggaagccccagggcacagtggccagggttcacattggccaggtcatcatgtccatccgaaccaagttgcagaacaaggaacatgtgattgaggntctgcgaagagccaagttcaagttccctggccgccagaagatccacatctcaaagaagtggggcttcaccaagtttaatgcagatgaatttgaagacatggttgctgagaagcggctcattcctgatggctgtggtgtcaaatatatccccaatcgtgtcctctggacaagtggagagccctgcattcctgaaggcttcaatagttctcctataccctaccaaatcgttcaataataaaatctcgcatcaagttaa

SEQ ID NO: 580205 - DNA, 723 bp, Homo sapiens
  misc_feature (723)..(723): n is a, c, g, or t
cttttgcatggcaaaaggaacagtcagcagagtaaaccagacaactcacagagtgggagaaaatcttcacaatctatacatctgacaaaggactaatatccagaatctacaatgaactcaaacgaatcagtaagacaaaaaagaaaaaaaaaaaaatcatcccaagaaaaagggggctaagggagatgaaatagacaattctcaaaagaagatatacaaattagccaagaaacttgaaaaatggctcaagcaattactaaggtgaatcagggaaaagtgcaaatgtcaaaagccacaaagcgataccaccgtactcccattaaaaagtggccataatcaatgtaattacaactacaatagtagactgttgacgttggaattgcagcaattcagggaaccactttctacactgcggggtgggactttgtaaactagtctacagcgtgctagtggaaaaacagcgttgggagaatgccttctaaaaaaagcttgaaaaggtagaagctaccatttggatccaggcaatcccacttactggggcgtattcataccccggagagaaaaagaacgtcatttagttcaagaaaagatacttggcacccagcgcaagttttatatcgcaggcaccaattcagccacttgcaaaaatcggtgggaaaccaacccaaactgcccatcaattcagttgaatgggattaaagaaacgtcgtggtatactaatan

SEQ ID NO: 580206 - DNA, 201 bp, Homo sapiens
cacaccacctgagtcaagcacatcatttcgtatctggagcaacaactcaaaatcttcctcatatgtatcaaaactgggatctcttcctttatctgtacggaactttaagagcacttgaaggagaaagtagtcggaggtcgtgcgcttcaaagcagcctttgctttctcacagtacattttgtgtgatgaattgatttttct

SEQ ID NO: 580207 - DNA, 512 bp, Homo sapiens
  misc_feature (37)..(37): n is a, c, g, or t
  misc_feature (71)..(71): n is a, c, g, or t
  misc_feature (94)..(94): n is a, c, g, or t
  misc_feature (153)..(153): n is a, c, g, or t
  misc_feature (215)..(215): n is a, c, g, or t
  misc_feature (218)..(219): n is a, c, g, or t
  misc_feature (221)..(222): n is a, c, g, or t
  misc_feature (226)..(227): n is a, c, g, or t
  misc_feature (234)..(234): n is a, c, g, or t
  misc_feature (243)..(243): n is a, c, g, or t
  misc_feature (253)..(253): n is a, c, g, or t
  misc_feature (258)..(258): n is a, c, g, or t
  misc_feature (299)..(299): n is a, c, g, or t
  misc_feature (347)..(347): n is a, c, g, or t
  misc_feature (508)..(508): n is a, c, g, or t
cggaggccggggccggggcccgacgtccccgcggggncccggtgaccgcgaggaggacggcgtgggcctgnagcccgcggccgtggcccgctanctattgattgggcacatctaacatgtcattttaggaactgttggaattgcagagccaangttgggactaaaacgtacaaacaattggtagctggaaacattcctaaaaaacaacgttcgtnaannanntatnnaaaatanattttttanaaataaacanaagcntcttgaaatttcaaccaagatccgattaccatttttacgtnaagtttttcccattattaaaaatgtatcccgggaccctcgctttaatnatctttcaggggaatataatccttaggtgttttacaaaacataccaattcttaaatgacatccgagccaaaaaaaaaaaacttgtcaaaaaacagtttaaaaagcacctttcatgagattatcattataaacttcagcaacttcttcagcgaatggagcangcaa

SEQ ID NO: 580208 - DNA, 205 bp, Homo sapiens
cctggggggtccccttttttcccttcaagccaagcttcctggtcaggattagtttccagctaagtttgcaagccctagaggggtttttcccggctgtttgtgaagcctgggggaccccccggccactgggggatttgtgggtgaaccctgtttctttttaaaaggcttttgaattttttttcatggtttaaataggtcggcccca

SEQ ID NO: 580209 - DNA, 122 bp, Homo sapiens
ggggggggcccctttggggaaatccccccggggggtttttttatttttttggccaccgggggggggggggccccccccgtttgggttttttttttccccccgaaaaggttttgtttttttta

SEQ ID NO: 580210 - DNA, 137 bp, Homo sapiens
gctgcggggcttgtgccaatctggccatcaccgtccctcggaagaggcacgcacactccagaggtctcgttcattgatcagatttctctctgggtgtctctattcctaagtcagagttactctggctggtgccgctg

SEQ ID NO: 580211 - DNA, 844 bp, Homo sapiens
  misc_feature (54)..(54): n is a, c, g, or t
  misc_feature (68)..(68): n is a, c, g, or t
  misc_feature (72)..(72): n is a, c, g, or t
  misc_feature (77)..(77): n is a, c, g, or t
  misc_feature (79)..(79): n is a, c, g, or t
  misc_feature (93)..(93): n is a, c, g, or t
  misc_feature (97)..(97): n is a, c, g, or t
  misc_feature (99)..(99): n is a, c, g, or t
  misc_feature (105)..(105): n is a, c, g, or t
  misc_feature (114)..(114): n is a, c, g, or t
  misc_feature (117)..(117): n is a, c, g, or t
  misc_feature (119)..(119): n is a, c, g, or t
  misc_feature (128)..(128): n is a, c, g, or t
  misc_feature (134)..(134): n is a, c, g, or t
  misc_feature (136)..(136): n is a, c, g, or t
  misc_feature (138)..(138): n is a, c, g, or t
  misc_feature (141)..(142): n is a, c, g, or t
  misc_feature (144)..(144): n is a, c, g, or t
  misc_feature (151)..(151): n is a, c, g, or t
  misc_feature (153)..(153): n is a, c, g, or t
  misc_feature (155)..(155): n is a, c, g, or t
  misc_feature (165)..(165): n is a, c, g, or t
  misc_feature (179)..(179): n is a, c, g, or t
  misc_feature (187)..(187): n is a, c, g, or t
  misc_feature (189)..(189): n is a, c, g, or t
  misc_feature (194)..(194): n is a, c, g, or t
  misc_feature (203)..(203): n is a, c, g, or t
  misc_feature (209)..(209): n is a, c, g, or t
  misc_feature (219)..(220): n is a, c, g, or t
  misc_feature (231)..(231): n is a, c, g, or t
  misc_feature (233)..(234): n is a, c, g, or t
  misc_feature (236)..(236): n is a, c, g, or t
  misc_feature (242)..(242): n is a, c, g, or t
  misc_feature (251)..(251): n is a, c, g, or t
  misc_feature (253)..(253): n is a, c, g, or t
  misc_feature (261)..(261): n is a, c, g, or t
  misc_feature (285)..(285): n is a, c, g, or t
  misc_feature (287)..(287): n is a, c, g, or t
  misc_feature (291)..(291): n is a, c, g, or t
  misc_feature (294)..(294): n is a, c, g, or t
  misc_feature (306)..(306): n is a, c, g, or t
  misc_feature (321)..(321): n is a, c, g, or t
  misc_feature (330)..(330): n is a, c, g, or t
  misc_feature (335)..(335): n is a, c, g, or t
  misc_feature (341)..(341): n is a, c, g, or t
  misc_feature (354)..(354): n is a, c, g, or t
  misc_feature (387)..(387): n is a, c, g, or t
  misc_feature (391)..(391): n is a, c, g, or t
  misc_feature (401)..(401): n is a, c, g, or t
  misc_feature (405)..(405): n is a, c, g, or t
  misc_feature (407)..(407): n is a, c, g, or t
  misc_feature (422)..(422): n is a, c, g, or t
  misc_feature (470)..(470): n is a, c, g, or t
  misc_feature (476)..(476): n is a, c, g, or t
  misc_feature (479)..(479): n is a, c, g, or t
  misc_feature (485)..(485): n is a, c, g, or t
  misc_feature (495)..(495): n is a, c, g, or t
  misc_feature (508)..(508): n is a, c, g, or t
  misc_feature (551)..(551): n is a, c, g, or t
  misc_feature (558)..(558): n is a, c, g, or t
  misc_feature (572)..(572): n is a, c, g, or t
aggcagcggctcaggcgaccctgagtgtgcccccaccccgccatggcccggctnctgcaggcgtcctncctnctttncntgctcctggccggnttcntntcgcanaccgggganaananaatttgaanattgantncnatnntngcataantngnaccatttacnattacggagccctnaccatttntngggangattacatncccttnaagcattatnntggcaaatacntnntntttttnaacgtggcnanttatttangctttacgggccattacatttaantnaatncantacaggaagagnttgcaccattcggtntggtcattntgggntttccntgcaaccaatttngaaaacaggaaccaggagagaactcagagatcnttcntaccctcaantatntncgaccaggtggaggntttttccctaatttccagctctttgagaaaggggattttaatggaganaaagancanaaattntacactttcntaaagaactcctntcctcccacctcggagctcctgggtacatctgaccgcctcttntgggaanccatgaaggttcangacatccgctggaactttgagaagttcctggtggggccagatggtatacccatcatgcgctggcaccaccggaccacggtcagcaacgtcaagatggacatcctgtcctacatgaggcggcaggcagccctgggggtcaagaggaagtaactgaaggccgtctcatcccatgtccaccatgtaggggagggactttgttcaggaagaaatccgtgtctccaaccacactatctacccatcacagacccctttcctatcactcaaggcccagc

SEQ ID NO: 580212 - DNA, 691 bp, Homo sapiens
tggaaacagagtcatgctctggcccggtctggtccaggcgggagtgtaggggtgcggtttcggctcacggcagcctcgcggcctcctaggttcaagcgattctcttatctcagcttcccgaggtagctgggactacaggagtgtgccacttgcacccactaattctggtattttgggggagaaaccccatctctactaaaaatacaaaaaattagcgtgggctgcgggtggtgcgtgccgtgtaattccagctactccagattgttgaggcaggagaagtggctgggacccgggaaggcggcagggttgcagggggccgagaatcgcgcaacggtactccagcccggggcaaccagaggtgagaactccgtctccaaaaaaaaaacaacaagggggctaaaacccctcgtgcaaatcggatccgcccggctcactaaagcttctctgcagtgggagaactccctaaagagggccgcgtctcgcgacagttttcccacagaaggtaaactctgcgccgagcaccccacgcacggcggcttaccgggggaaaacctcgggagcctccttagggggcaacggcggggaactcactccattcccctgaggattccccgagggtggcagcggggggggaaactcctggcccagccgacccccagggggggccactagggggcacagtatgccctgt

SEQ ID NO: 580213 - DNA, 387 bp, Homo sapiens
aaggctcagccttctttacagtagaatatcctgaagtagtcagttgttcaaacaaaagatctgagggagtaggtgtaagtcctgcagagttgagatactaaacgactttgcatacacaaagggtccattagaaagatgttgagtataggaactaattctgacgtttataatgcacatatattactagaatgttccagtaacgagcataatgctgaaccaattacttcacctttcagtttaaattcctcacatgtaaatgtaacaattaccatctatccctcagtgttgctctgtggcatcaatgtgttactttattaactaaaatgtcatggtctggcgtggtggctctgagtacgttaagagcattatttgcgttattcctggtcc

SEQ ID NO: 580214 - DNA, 311 bp, Homo sapiens
tcttggggggggcccccgttccttaaaatttccaaggggaaaaaaacccctggtaaaaaagccaaaatgccccccaaaaacccttttttttccgggcccccccggaacttttttggggagggacttacccggcccaaaaggaggggggttggttaaaaggggttaaaaggcccaaaaaaaaagggttctttttttttccccctttgggccaaaaaggggggggtttttttttttggcccgttttgggggtgggggaacccaagttgtccccccaaaacccgggatttttttttgggggggggttttcccca

SEQ ID NO: 580215 - DNA, 477 bp, Homo sapiens
  misc_feature (44)..(44): n is a, c, g, or t
  misc_feature (46)..(46): n is a, c, g, or t
  misc_feature (344)..(344): n is a, c, g, or t
  misc_feature (371)..(371): n is a, c, g, or t
  misc_feature (380)..(380): n is a, c, g, or t
  misc_feature (393)..(393): n is a, c, g, or t
  misc_feature (458)..(458): n is a, c, g, or t
ccacagctgatgctctctggaaagtgccacctcctggaaggagncncaaccaacacaaaaattgaacattaaaccaccaaagctaagaatcctcatggtgtctattgcatcccccgccacctccaccagaacaggtgttggtatctctggctgagagatccatagatggttcacatcacaggactcagtgcagacaacccccaataccagcccagagccagggtagacttgctgtgtggctagacccagaagagagacaacaatcactgcagtttgggatcacagggaagctacatccatagggaaaaagggggagagtactacattcaaagggaacacccctngggaccaaaagattttgaacaacagcntttcagccntaggaattttccntttgaacagagggttaccccaattgaggaagggcaaccaggaaaaccaacctggggtattttggncaaaacagggtttttttca

SEQ ID NO: 580216 - DNA, 396 bp, Homo sapiens
ggatgcatggtgacactgatgtatagaggagagaccggatgagaggacttgactgagcttgacaggtcattgtaaggaggtaggctgtaggcacaaagaagcatgaaaacaggcaaggttgtgcaggagaaatcaagggcagagcttcaaggagagagggcgtgatcaaccatgttgattgctctgaggtgtcaggaaggaggaacatagataagtgatggatgggtcaggcacggtgattcatgcctgtaatcccagctctttgggaggccaagactggcgagtcatttgagcccaggagttaagaacagcctgggcaacatggcaaaacaccatctctggcaaaaatataatcaggctggcgttgtggttcgcctgtagtcccagttacctgaa

SEQ ID NO: 580217 - DNA, 116 bp, Homo sapiens
gctattttcacgtagagacggggtttcaccagtgttggaccaggctgttcttgaactcctaactctcaatgtgatccgcctgcgctgggccctccgcaaagctgcttgcgagatta

SEQ ID NO: 580218 - DNA, 1425 bp, Homo sapiens
cgcacgccggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaacgaggctgtgaaggagggtgtggtgggccccgagctgcaccacaagctgctgtcggccgagcgcgccgtcactggctacaaggacccctacactggccagcagatctctctcttccaagccatgcagaagggcctcatcgtccgggagcacggcatccgcctgctggaggcccagatcgccacgggcggcgttatcgaccccgtgcacagccaccgcgtgcccgtggacgtggcctaccggcacggctacttcgacgaggagatgaaccgcgtcctggcggaccccagcgacgacaccaagggcttctttgaccccaacacgcacgagaacctcacgtacctgcagctactggagcgctgcgtggaggaccccgagacgggcctgtgccttctgccactcacggataaggctgccaagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggacctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacgtcatcgcgggtgtatggctggaggaggcggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcc

SEQ ID NO: 580219 - DNA, 733 bp, Homo sapiens
atccttagtgtagtgagctcttaaaagggacagaaatgtgcacttggggtgctcggattttaaggcagcagcttgccgatcctcccagctgaataaagcccttccttctacaacttggtgtctgagaggtttgtctgcggctcgtccttctacatttcttggtcccctgaccgggaatcgaggtaactgagggatggccgaggtagccccttaggcagcttaggcctgccctgtggagcatccctgcaggggactctggtcctagctgagtgacgtgatccaaagagcactcctgggtacgaacattgcctgggtggaacgcctcaccagaacagcacgtagcaggccctgtggaggattaacacagtggctgaaccaccgggaaggaactggcacttggagtccggacatctgaaacttgaattgacaagccgacatcagtatccagcagtgaatccaacggagtgtgtcccaagaaaatttgtgtctcgtgattgtggctgtgcatattacctgttcatctctggatgcataaactccctacaagtgcgtctgggggcagttgtacagattgcggagcgatcatctccacgatgttcttctacagcccactaaatcctccattttattcatgtctcctgggatgggttcctgaattctcctttgcaagttattcaacaagctttttatggttaccaatcggcgcacggcggccacgggaaaccgtggggca

SEQ ID NO: 580220 - DNA, 174 bp, Homo sapiens
gaggcgcagctgagcgcgggttgcttgctgcgatgcgagggcgacgagacttaaggacctgtgagggctaaggtctggcactgcgcgtcagtagccgggccttctaagccctgggagagcgatggcccagcacaggcaggaagtgatggacccaggctcttggtgagcagcaca

SEQ ID NO: 580221 - DNA, 662 bp, Homo sapiens
atttttttttgagcatctatatttcagagaattttgtttggcgttttttctctggtattgatctggcaattttccatgatatcttctaacagcgaggtgaaaaatttgttaaagatgagctaagcttgtaaattgtgtaagttagggcatcacataaaaagaaaactcaatcaagggaaacatgaatggaatatttgctattgagaagcctagcggtattacatccaatcagtttatgctaaagttgcaacatgctttaactaaaagtcaagtattctcgaaggaaattcaaagggcaacagcggaaagaaagcagcaatatgaaaaacagacaggtaagaaggccagcaagaggaaacttcgtaaagtctcaaaggtaaagatgggacacggaggcactttggatccgttggcctctggtgtcctggtaattgggattggagcgggcaccaaaaaacttgcaaattatctttcaggcaccgttaaagtctatgaaagtgaagccttgtttggtgtttccactacttcaggagatgtagaaggtgagattttgtcccagaactccgttaaacatttaaatttcgatgatttaaagactgtggaggaaaaatttgttggacaattaaagcagacgccgccaatatacgcagctttgaagatgg

SEQ ID NO: 580222 - DNA, 188 bp, Homo sapiens
gtgcttgaggatccgagtggttgtgggtaggatctgctgcaggttcagcctgtctatgcggcggatgtcactgaaaagcagggcagacctgccctcaggtgaagaactggttcagcagctgaaggcaggcactgtcctggagcgggtgttggtgctagagctgagctgtgagggtgacgacgaggaca

SEQ ID NO: 580223 - DNA, 444 bp, Homo sapiens
  misc_feature (341)..(341): n is a, c, g, or t
  misc_feature (360)..(360): n is a, c, g, or t
  misc_feature (404)..(404): n is a, c, g, or t
atgatgctaagtgaaaaagtggtcactaaagactacaagcgtgtgccaccatgcctcgctaatttttgtattttttagtagagacaagagtttgccacattgcccaggctggtctcaaactcctgagcccaagccatctgcccacctcgtcctcccaaggtgctgggattacaggggtgagccactgcaccctgcctatttatttacttttcttagagatgggggtcttgctttgttgcccaggctggtctcaaactcctgggcctcaaaagatccacccacctcggcctcccaaactgttggggattacaggcatgagccattcttcacctgggccagtnaatgtatttcactccaagnaacaactcatgaattagggaactgtttattaatcccctttctgnagggggagggaaagagagggttcagagaggttaaatgtat

SEQ ID NO: 580224 - DNA, 164 bp, Homo sapiens
  misc_feature (72)..(72): n is a, c, g, or t
ggttttattgccacagatgacattactgatctatactcaactcttggaatgtttgggaaaatatcttacagngcatcctatctcaaaggggaaagacactactttttatttgcagcacttcctaatacagtgcttcatatcagctctcttctttgcagggacac

SEQ ID NO: 580225 - DNA, 372 bp, Homo sapiens
accctcacagttgcagtgtgcttttgctaggcagccggcagagatggcccacatatgaccactgcctttcaaccctacctgttttaaggtggactcacttggattgagaaactggtattttcccctcacttgcacgtattttggatgtataaatattttcaaaagataagtttgactaatacatgcacaccttccttgactatcaccatccaaacccacagagatgactgggaatttccaagtcatgtaatcctaatgttgatttgagcatccacagcctgtcttagaacactttccaaccaagactggaaccagcactttggcacttgcagaatcacagccttcccttcacagccttcccttacgagaagt

SEQ ID NO: 580226 - DNA, 282 bp, Homo sapiens
gtatggatgatccagacccagttatattctttaaggtcactttggttgctatgtgcagaacctggatgtgttgcattcagaaaactattatacatttttttaagtgatcttaatgcaaagaatgattatacaaaaggacattttccttagttgattatacctctgtgagccatatatgttcttttctggattcttgggtttttttgagacaggtctcagctctgttgtcccaggctggagtgccgtggtgcgatcttgggtcaacacgacctccacctccca

SEQ ID NO: 580227 - DNA, 436 bp, Homo sapiens
  misc_feature (226)..(226): n is a, c, g, or t
  misc_feature (337)..(337): n is a, c, g, or t
gtgtggtcgctctagagatccaacaagagtatcagcatacgagctatccagtctcgagtcttaatttgcatgatttgagcagtgtactgttgtcctttcatgttagtgcttcttcagagctctttagggcaggctgtgtgcaaatctctcagcattgttgttgtaagtattaattctctcattatgagctagttgctgatatgaaatctgggtgaaattctttctnaagaatgttgatattggccccactctcttctggcttgtagagtttctgccgagacatccgctgttagtctgatgggtttccctttgatggtaaaccgacctttccctctgnctggccttaacattttttccttcatttctactttggtgaatctgacagttatgtgtcttggaatagctgcttagttgcttggaatagctgctgtagttg

SEQ ID NO: 580228 - DNA, 378 bp, Homo sapiens
taccgtatatatctgccaacactaaagctgtgaaggctctaagtaacacacacagaagatagccattgtgactctgcaggagagacaaaaaataagccgggcgtggtggcgggtgctgtagtcccagctactcgggagcgtgaggcaggagaatggcatgaacttgggaggcagagtctgcagtgagccgagatcacgccactggcctttaaacttgggcgacagagtgagactctgtctcaaaaaaaaaaacaaaaaattttaaacccactttatatggggggtaggattaatatttaaaaggcggggctttgtttaatggttacaacacctcccatgagttgcccggaataaagtgtgctcaccggtggaaaatcc

SEQ ID NO: 580229 - DNA, 207 bp, Homo sapiens
ctccgcttttatccctctaaaatcttcacttcctgaagaaacaaacaaacaaaaaagccactgagggcccttggactaaatccaggcctcagttgctgtcgcataggtcatgtcttgtccagactctgggcagatacataattcgagtcacacaggtgggtcaccagagaacgaatccagcctgcaaatggcctgtgcaatcttcag

SEQ ID NO: 580230 - DNA, 171 bp, Homo sapiens
  misc_feature (40)..(40): n is a, c, g, or t
  misc_feature (75)..(75): n is a, c, g, or t
  misc_feature (111)..(111): n is a, c, g, or t
  misc_feature (151)..(151): n is a, c, g, or t
ttccttatagccaatgccttgaccaaagcttactaatttngccacatttccttgtgggttatgataatcttaatnaattcacaactctaccaaattataatacagtctttnattatgccaccatatgaatgcagctgcaaattcaattttntgaaatacaaagtcctttcc

SEQ ID NO: 580231 - DNA, 549 bp, Homo sapiens
  misc_feature (53)..(53): n is a, c, g, or t
cctttctctttacgcatatagtatattaatttgaatgtcacaaaatctattanagatattttgttatccattttccctcactgaaatgaaaccttcacggaatggggtctttattttgttcactgctatatcgccagtggctgggacaatatttggcatgtaaatattagttgaatttatatggatttgcaaagcacctttatatgacagttctatacttgtatccgcattgtccttcctacaggtctttaaaatcagagaaacaggagaaatttatatccagactaaacctgcattcattttattctttaaatcttgccatattgaagtactttaaatcctggtatagtaagtaaccctaacatgtgattgaaaacatagaattattggaattgtttggttaccactaagcttgaaaacagattcccaatgaggagaaaaaacaattctattgagaggtcatatggataggaatgagaggacagtcaaatgttggtacacccaatttgttaggtaacctagcgtttggctcatcttattatgggaatt

SEQ ID NO: 580232 - DNA, 319 bp, Homo sapiens
ctgttttggggggggttgggggggatttttgcctgtttattggggaaatttgtttttgccaaaccggttttttgggggttccggggcccccttctttatttgggtggttttgggggcccaaccgggttccgcccgtttggggggtttggatatttattgactttgtcctcggattggttgagggggaaagggccccccaacacccccaatccaggttttggaggcattgagcccccgactttcttgggttttttttttttgtccccccctgggccccccccccccgccctttgggaataaagggccctccttttgccca

SEQ ID NO: 580233 - DNA, 546 bp, Homo sapiens
aggcccctttgtgtatgtgatttacagctactgagccggggctttaggctgggtgatctccccccagatttctggtccttgactacaccatgtaccacgtgataatggtatagaatttcaaaaaatgatcacgcgccatgtttccaggctggaagtaactcttgggctcaagtaaacctccatcttggcctcaaaagtgccagattacgggcatggctactgacccaactattgtaacattccgttatactaatgcttacttgttgttcttgaactgccactatattgaccactgttttaagctccgcaacatttttttagggataaacctgaacatgaaaatgaactttatgttagctggcattggatccatacctgtttatttttatcaaattagctaaaagcgctgggaaagcagcatatttttgaaatgccattgaatataaaacgagagtattcatattatggtaaaaaaaaccctggccctaaattagacttttatttttatgcaaatgaatcagactaaaaaaccctatggaatttcag

SEQ ID NO: 580234 - DNA, 567 bp, Homo sapiens
aacagtatgactctggtaatggcttcatagctaaagtataaaaccaaagaggagggaagaggaggagaaaaagaaagaaaagaaagaaaggtgacatactgtgttgaaaactcataggtactagtgaagtttttgggagctggcaaggctctgactgatgagggagggatggtgctgagaaaaaccagtctagagtcacagtaattcatttcagcagcaaggagttaacactggtcttaaagttacagcaggtcactttggcagctggccttcaagataatcccggggcagacgctctgtgtcccagcttttcctctcccctggtccctcgactccagtttagttgggtgtgacagggtaagtccaattcgtatcatcgattttcacagactctatactcgctgagagcagaactcaaggggctcagttgccactgcaagctccagaccaagcacagcggcaggagctacgtcaatcccctccaggaagtaacaagagtccaggaggcagaagctgctggagaattgtgtcctattggccgatggcataccgaactccccctgtctc

SEQ ID NO: 580235 - DNA, 1009 bp, Homo sapiens
  misc_feature (772)..(772): n is a, c, g, or t
tgtgggagccggctacgaacacaggccccgccgggggccaaaaggccgtaaacgttcgcgaaacgaaccctctgccgcccgtagaacggcgccctaggggatcgaaaaacggcggcccacaagggttattccatgcgactgaaggggggcaccgcgcgccggggcaaaaagcggcgcgcccgctcgagaccgttgggtcgccagcaagggcagattgagacgggggcctcttggggacccgggaaacgccggcccgcgcgggacgcccacttcagaggcacgcacagaggtcaggccctcgaagctcatagctgcgtgcgaagtatagactaacacgggcggcgcaattacccagggagcgccctgccgggctctccaaagaggaaccgcgacaaccaaccggcaccagaggaacaccccgggtgacctcgcccgtagtaatcgctaggcttcaaggaggcccctggagcctcggggcactaggtcgtgacaccgatagggctcagggaatccattgagctcggaccctggcgaaggcgcacggtggcccacaaggccacgtagcatgcccgacgccgagcaaccgaggacaagcgcggcctcccacgagccatatgggacatggcgcacacaacagtcgcctatgttcgctgccccagagcacccgtcgcgctgcacatttgtgctaccgagggtagaagacggagcgcccgtctgggaccactgaggatggccatcgtgggcaccatttcgtccttgtcgtcacggcacnactccgctctggcaggcgacgtggctcagtggcgtacgtgtcgtggtacatgagcgtggctgcgggcgacccttcgtgccacgccccactcaccacagccagccaggctggtctcctactagcctgtattgttgtggggtgggggtatattgtgtaaccaactgggcccccagcccctcttttgcagaccccttgtcctgacctgttctcggcaaactaactaggaaccccagggga

SEQ ID NO: 580236 - DNA, 167 bp, Homo sapiens
  misc_feature (38)..(38): n is a, c, g, or t
gaaaaattttttaaaaccccaaaatttatatggaactnctaaagccccccaaaagctaaaccagttttgagcaccccagaccaaagctaaaagtcttcataccccccgatttcaaattatgttccccagctagaggaactgaaccagcaaaggacgggcctttttta

SEQ ID NO: 580237 - DNA, 81 bp, Homo sapiens
ctgacgcggtgccgtccccagcacggtgattatgtcccagagctcggctgccacctccaccggaatcgcctcagttgatag

SEQ ID NO: 580238 - DNA, 147 bp, Homo sapiens
cttcgaaaacttgagacccttcgccctggtagacacctagcatgatgtcatagttgaggaactcgccctgtccatgaggatactcagggtcatcaggaatgacatcaccatcaatcacagggcccaagcccagttggtacccggact

SEQ ID NO: 580239 - DNA, 1259 bp, Homo sapiens
  misc_feature (280)..(280): n is a, c, g, or t
gctgttcccctttctcccgctgtgtcccctctgttgtttatgtgaagatgaaggtgcggaagacccacacgcgcggtgtggtatgtgtctgttccgcccccgcccgcgaaggtagtgtgtgcgcctcaagggagagcgcttttttttcgcgccccccccctccgcgggatgctgtgttaaggcccctcttttttatgaggtagttggggacacacgccgtctccttcgggggtcccagccgctgtgtgtatattgcttcctggtgttttccacaaggagngaaccacgcggcggtggtggtggccaacaggagaggcccacttcggggagaagccctttgtctttccatttccggcctttagactgaagtaaattggttcttcccccaatgtccgggagcccctctcaacgggccccacatatttggggcacgataaagcacactcggtgggcctcttttggggagagagttttttcctctggagagaaaagtaattctctctttcaacagcttcgaggggtttagtgccacacagagaaccccgcccacagagactcgggagagagagattgtgtgtgctcccagagagactttttctgtgataaacacctcctctcttcgggtgtccttttaaaccgagtgtactcttttcgggcgccacacaaaaaaccccacctctgggtggtcacagagtgtgtctctcacagagttggagagaataccctccgaggaccaaaagagcccacggtgtgagaggtatatccacacatttgaggcgtttcacatgtggagattgtgtaaaaatatatggcacacgcagctttctttatccgcagagattgtttgtgtgtgttcacacatgagagtgtgagaagccacagggtgcacaccctgagagagccgaccacacaattataaataaataaattcactgacctcgggctcttgggagaaaattcactgtgagaaaattaaagttctatttctctataaactctctgccacggctcttcacaggctcaattctggttaatggcactaagctctgtgcacacttcacaaaaaggcttataattaagtgacacacccaccaccctcttccacgccactagagagttttaaatatgcccacaactaagaaagcctatgtgtgtgtgctttcttaaatgtgtgtgcccacatggtggagtctttgctaactgaaagtgtttgaacatgttttgagattttttttaaataaattattatttgaccacca

SEQ ID NO: 580240 - DNA, 841 bp, Homo sapiens
  misc_feature (8)..(8): n is a, c, g, or t
  misc_feature (11)..(11): n is a, c, g, or t
  misc_feature (24)..(25): n is a, c, g, or t
  misc_feature (27)..(27): n is a, c, g, or t
  misc_feature (30)..(30): n is a, c, g, or t
  misc_feature (50)..(51): n is a, c, g, or t
  misc_feature (74)..(74): n is a, c, g, or t
  misc_feature (79)..(79): n is a, c, g, or t
  misc_feature (81)..(81): n is a, c, g, or t
  misc_feature (101)..(101): n is a, c, g, or t
  misc_feature (112)..(112): n is a, c, g, or t
  misc_feature (261)..(261): n is a, c, g, or t
gcgcgatnctnacacgtgaaagcnntnatnaccaaggccaccacacaccnnctgtccaaaaaggccttccgatnacggntnaatccctatttacttacccnccagaagtttntttcttcgcaggatttttctgagccttttaccactccagcctagcccctaccccccaattaggagggcactggcccccaacaggcatcaccccgctaaatcccctagaagtcccactcctaaacacatccgtattactcgcatcagggntatcaatcacctgagctcaccatagtctaatagaaatacaaccgtaagacctaaataagttcaatgcacgtgcttgattagcaacttttgactgggttgctctattgtgtacgcctgctctacataagcctgcagagtacgttacgagttctccacttcgaccatttcctgacgggcatctgacggcatctagagcatttatttgtgagccacaggcttcctacggacttcacgtcagttattggctcaactttcctcgagtatcgtgcttcatccgccaactaatatttcactttacatccaaacatcactttggcttcgaagccgccgcctgatactggcatttggtagatgtggtcttgactatttctgtatgtctccagtctaattgatgagggtccaaaaacatccgaccagaacatgcaaaaactctctgcgggccccagggaaccaccgataatccctcgaacccctcccttgggcaccgggaccccataggcctaggaccccggcgcaagccggctcccgaggaccaatctggcaccacggtgtccgaggacccgccgataggacatccgat

SEQ ID NO: 580241 - DNA, 375 bp, Homo sapiens
agcgctggcagtaacggatctgaacaaccaagatcaagccgaacacgcggaaaagagcgccgcgcaaacggaacgggtggtgcgtaccatcgcgaacaatctgcagaagttggctgaggcatcgcaagaagcgatgaccaagatcggtacgctcgacgagcgggcgcagcagatcagcggcatcgtcaatctgatccgtgagatcgccgatcaaaccaacctgctcgctttgaacgcggcgatcgaagccgcacgcgccggtgaacagggcgcggatttgcggtggtcgcgacgaggtacgcaaactcgccgagcgcaccgcagtggcacttccgatatcgcacgactggttgttcagatccgttactgccagcg

SEQ ID NO: 580242 - DNA, 222 bp, Homo sapiens
tggttgattagaggatccccttctcagccagtctgacagcaagtcgaagctcaccaaggacttctccgcgctggagtccagctgcaggacactcaggagctgctgcaggaggagaaccggcagaagctgagcctgagcaccaatgctcaatgcaggtgtgaggacgaagaagaattccttccggtgagcagctggaggatggaggaggaggccaatgcacaa

SEQ ID NO: 580243 - DNA, 779 bp, Homo sapiens
tctgctaccggtaactaaaatggaagcgttttgggggtcgcggcccgaacttggggcggggggctccggccccaggacagtttataccgaatctccgtccactctcccgattctcctttcagtggatctccgggcgtcgtgcacttttacaggaggctccaatctcacgccggacccagaaaccccatgtggttgaccggggaccctcagctccctcgcgcgtaaagtttcagagggcggaggttggtgatgtgccgcaaaacattgcgtgggactcctaccggcctcctgtggcctcgttccccgaaaacattcctctctctcgcattatagtggcgagtctcaacaagcagttcaccatgtgcgtggggtgccctcgtgggcgaactatacgcgtgattttcccagtatattgtgtgaacgcaagttctcctgcggccaaaagtgggtgattgtgagtgaggagctttcgtgggagaagtggcacacagcttattagctcctagaagctatttcatctcatgtggctgaccagggccaagtgtacagccggcgcctcgaagatgaccccttttggtggaaccccatggtgtctatcggaggctatgctgatggaaagagctctccccggttatgtggacatgcttggttgtaccctatgaagcccctttcgttggccactgttttatggggcatactgtggctcagcctctgtgcgaaaaagttctggaaaagcagccagtgttaagcaaacagaggcccggaattattaaacgcgg

SEQ ID NO: 580244 - DNA, 193 bp, Homo sapiens
aatgttcatcctagtatgtgtatatagtgtgtgtgtgtgtgtgtagtgtgtatgtgtgtgtgtgtgtataccttagaattctatacaggctgtatagactataaaaaacagttataactcttcctccccagcgtacatgccttataatttcttatccttctgtacccttactcgagtgcttagatcacaagga

SEQ ID NO: 580245 - DNA, 172 bp, Homo sapiens
  misc_feature (60)..(60): n is a, c, g, or t
caactcagctgtagtttgtaaaagaactccagtgagtctctataatagactacgagagtnggctttaacgagtatctgcagcacactaatagctaagacccgaactgggtattagataccccactaatgcttggccctttatcgaagcgggtatcctctagatgtcgatcct

SEQ ID NO: 580246 - DNA, 271 bp, Homo sapiens
  misc_feature (12)..(12): n is a, c, g, or t
  misc_feature (39)..(39): n is a, c, g, or t
  misc_feature (51)..(53): n is a, c, g, or t
  misc_feature (72)..(72): n is a, c, g, or t
  misc_feature (76)..(77): n is a, c, g, or t
  misc_feature (163)..(164): n is a, c, g, or t
  misc_feature (180)..(180): n is a, c, g, or t
  misc_feature (185)..(185): n is a, c, g, or t
  misc_feature (189)..(189): n is a, c, g, or t
  misc_feature (202)..(202): n is a, c, g, or t
  misc_feature (213)..(213): n is a, c, g, or t
  misc_feature (223)..(223): n is a, c, g, or t
  misc_feature (247)..(247): n is a, c, g, or t
  misc_feature (260)..(260): n is a, c, g, or t
ctggcccccgcngccaggtttaacaactcccagttcatnggtcccccggtnnnccagccagggaggctcccngccnnccagcatgcagctgcagaagctcaacaaccagtatttcaaccatcacccctacccccacaaccactacatgccggatttgcacccnnctgcaggccaccaganggaangggncaaaccagcactntccgagattgnaaccccaagnacagcgggggcagagcaccccggngttcggggcggcnagcaggacccc

SEQ ID NO: 580247 - DNA, 119 bp, Homo sapiens
tatatatgggggatgtgagggaaaatcaagaatcgaatttgaaaggtctggaagaagtgcaaaaaaatgtgtacaagagataatgcaaacagggttataacggcaacattgccacaagg

SEQ ID NO: 580248 - DNA, 307 bp, Homo sapiens
  misc_feature (23)..(23): n is a, c, g, or t
agcggggagccattttggagccntggtgtcagtttccaactctggccttcaagcggtggcatttttttccaaccctcccctccctcttcggtcagctgtctgtcgtgtgcaaggtaaatagaaaaaggaagaaagcaatgagaagaacagacaaaaacaaaaagcaaacaaagaaaggaatcgtgaagtggagacgggaggagagaaaagaggaggagagaaagaagtgccagaagaaaaacgaagaaaaagcagaaaaaagaaaaaaacagccccaaaaaaagaagagggggaggagaagaaaaca

SEQ ID NO: 580249 - DNA, 551 bp, Homo sapiens
attgatttctttatttttgtgcggcttgtacttctcctgaaaaaaaacattggtcgatgttgaaaatacttctttgagacaggtctcactctgtcgacccatgctggagtggactgatgccatctaggttaactgcagcctctgtttccggggctcaaggtgatcctatcccctggtgcatgccatcatgctcagctaaatttaaacggtgtattcgtagagatgaggtttcactatattgcccaggctggtctcgaactcctggacttaagtgatccttcctcttgggcctcccaaagtgctgggattacaggcatgagccactgccccagccaagactgtcttttctccattgtattgcgtaaggcttccttgtcaaagatcagttgactatatatggtgtggggctatttctgggctccctatattgttcccagtgataatagtctatatttttcaccattaccaccctatcttaattcactgtagctatatagtgagtcttaaagtggggtaatatcagtcttctgacctttcttctctttcaatct

SEQ ID NO: 580250 - DNA, 366 bp, Homo sapiens
acctgtaactagaatggatgtgtttgatcagagtgcgctttaaactgaagctacagggagagaaatgtacaagctgtatcctagatgcgccgaagagctcatttgaaaacaggaggcaatttcccatacctgtgcacaagtgcaaaggtcaatctttatgtacagatacatttgctgcaattccatggaaccaaatacgcggccattgacccatcaatggtcattgccaaggagcttgaggtgcaaaaaggcagccttggcatcagccaggaggagcaatagtgtgtctctcgctgtcaatgatgagttgacccggagtgttcttgtatagtcagtggcatcagcacccgtcagccggccttttcc

SEQ ID NO: 580251 - DNA, 362 bp, Homo sapiens
gtcctgatgaagtctccgaccaacgccggctagctgccgaacaggcttgcgagaagggcgctgcgcatttcctgcaggccatgcaacgcagcgcgcaaccggttgccgctgtgatcggcatgctgcacatcagcgcgtacttgcgcgagcccggctggttggtcgaattgttcgctggccaagtggcgcgctatcggcccagcgcgcatgccgatgtggaagtgcaggaggccgctgcgccgttgttggtcaaatacggcctgacgccgttgctggagctgccgcaatcattgcctgcaggtttaggcgcgcgtttgcatgagcaaggcgaaagtgcccgggattactggctgcgccatgca

SEQ ID NO: 580252 - DNA, 450 bp, Homo sapiens
tcaatacggttggactgtgatcctgtcctcttgtcctgtaaaataggaggcacttcaaggttctctgcgtgggtcaatagagtgcagacttgtgttcccatgctactcaggagcgccacggatgtgcgcatgatggttgaagctcagcgagatccctgaactatgcttgcgacaatgtcctgtagggagagctcgcatctatgaggattactgaaaggttacctggtgtgtgtgagaggcgcatcctcatagtcctcagtatagttagcgagtgcaggaagctggcgggaatcattttgcgcacaggcagcatgccgagcgtggatgcgaggcgtggtgatgcgttgtgcatgtagttcctgcataatacgtgggccccaggcacgaggtagccgtggagtagtaccaccactttggggcgattcaatggcaagctaacaacattcaaag

SEQ ID NO: 580253 - DNA, 289 bp, Homo sapiens
  misc_feature (23)..(23): n is a, c, g, or t
  misc_feature (177)..(177): n is a, c, g, or t
  misc_feature (200)..(200): n is a, c, g, or t
gaggcagggtttcactgtctctnttgcccagactggagtacagtggtgtgatcatgacacactgcagactcgacctcctgggctcaggtgagcctcctgccccagcctcctgaacatctgggattgccagtgtatgccaccactccctgctaattaaaaaaatttttttgttttttnagagacaggttctcactatgttngcccaggctggtctcaaactcctgggactttaaccttatccttcccgccctgggacttccaaaagtgctgagagtacaggttgttgagc

SEQ ID NO: 580254 - DNA, 187 bp, Homo sapiens
gctccccaccccgcatcagctctgtcaccaggtacgcgtgtttgccatcatcatacacatctttcagagtgatgatgttggggtgctggccataccgcagaagaatctcaatctcttctcgtggtcaatggcctctttgctcaggccaaagtcagtgagtttgatgtggccctcctcatccagaagg

SEQ ID NO: 580255 - DNA, 294 bp, Homo sapiens
agactcctttggaagggacaggggctgaaggttgagttgataaaccaatggccagtgatgtaatcaatcatgcctacctaatgaagcttccctaaaaacacaaaaggagttctgagggctcctggacagcttcacactccttaagggtggttcaccctgcttgtcttttctcctatacctcgccctatgcatctcttccatctggttattcatctgtatcctttgtaatatccttcacaataaataaggtgtttccctgagttctatgagccactagagcaaattaatcaaact

SEQ ID NO: 580256 - DNA, 941 bp, Homo sapiens
  misc_feature (420)..(420): n is a, c, g, or t
cctgtgttcggcgcccgtcggacttattccgctgctaaccacaaacacgtggtgcactgtacctataattcggggcatgactcggtcagtcctaggcatccgtgtgtcaggccttcacgtgattcgtgaggcctgagcgttggagtcgaagtccacggtagaaacatgtcatgggtacatgatcgacaatcttactcacactgtctatctgtcacgggacgcaaaatagcattttgtcattcaatcattcctctccataggtaatatcgcgatcaattaatcggacgagctaggggatcctgagtagtttcctataatagtccggtggcgctcgattatgggcagtcttgcgcgcgatcataaccagacattataggctttctggatcatccgttcactcgtgccctctgcgtctcttanctcgctggctctgtatttcgctatatgtcggagaggcgcggacgcagggagcccaagggttgagagacatgtctgagacccgatcccttaagtcctgcgtgaaactaccttccgcagcgctggaagcctgcacgttagagtcctaccccatgctttgctacctttttaactcgaagactaggttgtcgtcctcttattcttatgggtgtcctatttccactgttactattccacttctccgatttaggcctgtatccacatcctcgtgcgatacacaccattgataaatgcctgctcttggtctgatgcgatggttaaatcagggggagtccctactttcgtccatatgtcctccccagttacatagcctgggtggttgtcacttatactaactaacaagaacggaaaccttaaaatcagcttcttttgaccccgcggaaggagggttaaccccaatttttacaagaacctaattccgagatttggggggcacccggagggaaaatgtttatacaaaaaag

SEQ ID NO: 580257 - DNA, 571 bp, Homo sapiens
  misc_feature (273)..(273): n is a, c, g, or t
  misc_feature (341)..(341): n is a, c, g, or t
  misc_feature (425)..(425): n is a, c, g, or t
  misc_feature (462)..(462): n is a, c, g, or t
  misc_feature (472)..(472): n is a, c, g, or t
  misc_feature (499)..(499): n is a, c, g, or t
  misc_feature (518)..(518): n is a, c, g, or t
  misc_feature (559)..(559): n is a, c, g, or t
  misc_feature (564)..(564): n is a, c, g, or t
  misc_feature (571)..(571): n is a, c, g, or t
gggcaagaaccggctcatctttccaggcgagaaggtgctcttggcgtggtctggggggccttcgtccagctccatggtctggcaggttcttgagggcctgagcaagattctgccaaaagactgcgctttgtggcaggagtcatctttgttgacgagggagcagcctgtgccagagcctagaggagagatcaaagaccctggccgaagtgaagcccattctgcaagcaactgggttcccatggcatgtggtggccttagaggaggtgttcagcntgccaccgtcggtgctttggtgctctgcccaggagctggtgggatccgagggggcctacaaggcggcngtggacagcttcctccagcagcagcatgtgctggggggccgggggttgtcctgggcccgaattcaaggggaggaacagccaccncagcccccgttgaacccccagaactgggcaagaccgnttgcccttgnccagattgaggttttttcccaattttnttgttcagtgaggacattnattgccaaggaaggagttttgagaccttgcggacccattgntcttncagttgn

SEQ ID NO: 580258 - DNA, 893 bp, Homo sapiens
aatatttctttgtaaggtataaggacttagttgacatgatagtgtgcagatgaggaagatatgccattaagtatcttcagttttgtgaataatgaattagaagattttaattatctatctagcaggatgtttttgagatgggcattctccgtctggtacgtaggatctagcatatcctcactatatctgtggatgattacataggtcgaggggagcaacgagggtaccagctatgggggctgaaagacatgagaggtctatccggtgtggacatggaatccacgcgagtcgccttgggcatatagtaatacctagaaattggctttaccttaagcagggcacacagcatttactacacacagctagtgtgtgaagcaaagcactgtgctgtagagggtaaaactgggaatcacaatgaaagaatcttgccaaagtggtctcatgcagcaatgtggaaggatctgtgtcaaattattttggatgtaaagatgcctgtgtctcataatatgaatgtatcgcggatatacaagatatgacctaaaggtgtgaggagacactataattaccactgtgaagaatgatgtagtcatcctggttcatcttttctgcaatgattggttctctaaaattcctatatgtaacttgccgttttgaaaaggtagaggctgagaataaaggtggctagtgtgaactatgagccccaatttgtgggggaggttgaatccggcctggatgggatagggggtaccacaggggcattacgcgaccatttgtgggaggagacttccttcaaaggtgaccgggaaggaggagagaaaatgggggggaaaaaagggccccaaggttgtgtaaaaaaaaaggtggcgggcaaaaattgcgggagaaataaagca

SEQ ID NO: 580259 - DNA, 887 bp, Homo sapiens
gcgggcccaacgagggagtggaatggccgcgggcggctcgacgacagctgaggcgacgcgagatggcggcagcttcagtcggcggcgatctcaggagctggtcgctgtctgggctaagcaagattggagctactcgtcgtccacctccagctcgcgtaagggtgtgctgtgctgactgcggcccatttgtggatgcgaacatgcgggaggcaagtgatcccccctgtgtgcggggcttggacagttgctctctagagattgctaactggagtgaaccagcaggagactctcaattaccagtttgatgccttctatggggagatggagtactcagcaggacatctatgcaggttcaggtgcagcccatcctaaggcacttgctggaagggccataatgccacgtgtgcttgccgtatggagccacaggagctgggatgacgcacacaaatgctgggcagcccagagcaatcctggtggtgatcccgcagggctctcatggagctcctgcagattcactaagggaggagggtgccgatggtgccggaccatggggccctttctgtcaccatgtcttacctagagatctaccaggagaaggtatcagacctcgctggaccctgtcttcgggagacctgtgtaaatcctgagcatgacttgccgggggaatatcctgattccgggtctctccgcagaagcccaatcagatagcgtcttgctgaattttgaggcggcacttcgtgcccagccaggtcgaaattcggactgtaggagccgacccgggttcaacagggtcgcctcacgctgtcattcttgtgctccctggtcacaggtgggccagcgggaacggttgggcccatttcgcaggagaaggacaactctactgattg

SEQ ID NO: 580260 - DNA, 337 bp, Homo sapiens
atctagaggatccgaagctctggaaaaggggagctggaaaggggatgggttgggaagataatcttcccgtggagttcaaccgcccccagccaaactctgatcatccccaaccgaactcctctcgaccttcaggtgcttattctcttctctcctcctctgctgcgcctctctgctcttgtgtcagtggagtttggggggttttatgggtacatgatgggtgtgtggtgggccagggtggttttggaaaaagcaacatttgggcggggaaacagggataacttttcatttggggctgtggtttccaggcttgagggtggggcctttgtgggggaacatc

SEQ ID NO: 580261 - DNA, 902 bp, Homo sapiens
aagaggcaggctggaatggaactcagctctcaccgctgctgtcaccatggccacggaggagggtgtacagaaagactcagcgcgaaatttcagaggacactatgatgttctggacaaggcctcagctgcatgtagggctgatggaagcaaggttgtctgcaatataccagcacaggcaacatcagcaggagctactcaggggagttcagcagcggctcatccaggctcccttccaagtcacagatgctgctgttctcaacaatgtagcacactcacatttgtgcctcaatggcacaacagtcaagcacaggttttcagcacaacagcaaggcaacccacagtagagccagggaggaagcaaccagtttctctcatcactctgagcagacttgcgcaacgcccagtcggagcgcagcagcacagaagcacggcccaggcctcacaaggcatgaaaaatctcacgacagttcacactgtggtactgactgccttgtgagcacatcacataagccatccaaaaaggccccggctccatgcggccagactaccacacacatgatctttgagcccttctcctccatgtccagcagcctcagtatcaccagacatctacacccatcaacccagtcaacccaagtggggtcagtcaatttttgcagtgggggcacatcatttcccaagtgagtcagaccatcaagccacgggcgtccacggacctggttaactcgtccaccaccatgtctttattggccattaacactcatcccgctaatggcacaacagaggggatacctctggccaaagagacaagtcacacagaaacagtgaacgttacaagcttataatacagagtttggggcaggttcagccatctgccctgcagcttgagagtacactgggag

SEQ ID NO: 580262 - DNA, 147 bp, Homo sapiens
cacgagggtcaccctcacactgattctatcagcgacagacagcttctgcatcacggagtgtttgtattcagtatctccattgcgttgtctggtgagaacatgcccatgatacagctgttaccagcatccctggtcacagatgggaac

SEQ ID NO: 580263 - DNA, 175 bp, Homo sapiens
cccggggtaactcaccactgataagtggggtgcagatagggatatatcatagcctgctgagcttctgggctgacttgtgaccttgccgctccagcagtccttcttgtcactgctttgatcacacccaccgcaactgtctgtcacatatcacgaacagcaaaacgacccaggggac

SEQ ID NO: 580264 - DNA, 428 bp, Homo sapiens
caaataccagatgagagatcaaaatgtgtatactggaccattgataactctggacttctcaaagatggtcatgcccagttacttaagggacaccttattgatgaattgggagtacatactgttgccaactgaaggttggaataagacttgtcaagctggtacacattgatggaaggtacaagaagcaaatagcaagaaaggttggaaaacagggtatgtgagtaaagcactacaaagtagaagtataaatcacagaattgaaggctatgtgaaactggaaacatgaattatgttgtaactcgaagatttagcaaaactgacacaatagaatccattgaaaaggaagtaagaaaaatcttccgtattccagatgaacaaggagtccagaatgtggaacacatacatgagtaacacatttgaaccggcgg

SEQ ID NO: 580265 - DNA, 598 bp, Homo sapiens
  misc_feature (2)..(2): n is a, c, g, or t
  misc_feature (434)..(434): n is a, c, g, or t
  misc_feature (454)..(454): n is a, c, g, or t
  misc_feature (473)..(473): n is a, c, g, or t
  misc_feature (524)..(524): n is a, c, g, or t
  misc_feature (545)..(545): n is a, c, g, or t
  misc_feature (568)..(568): n is a, c, g, or t
  misc_feature (595)..(595): n is a, c, g, or t
gnactgtttagccacaccaccatccatctccagaactgttttatcttccccagctaaaagtctaccaataaacaataacttcattctcccctcccgccactgttgggaaaaagctgagtgtagggagggaaactgaggcagggcttgcatagtgtcctttggaatgtgtctagacttgctggctgcttgcttctagccctcctaggctcctgttcccattatctcaagtagcaggacatgttccatataaatgctaaaccatcacagctgtaaatcatgtgcttaatggaacatgtggaggtgttgacctccacaggtctcaacacctgtttctttgttggattaccaataaataccgtgggctctcagagttcggggccttcgcagcctccatacatagtgatggccccctggtgtcccactttttctctcantgtctttttctcaatccttngactctgctgggactttgntaacccccacgaactggtgttgggtctgattaccccaaaaattccaacccntggcagtcgacattctgctgnctctatgaatttggactaagtanctcatataagtgggaatcgtccaatanttg

SEQ ID NO: 580266 - DNA, 906 bp, Homo sapiens
  misc_feature (215)..(215): n is a, c, g, or t
ccagtttcaccccagaaacaggtctaaatttttcaacgccaatgctcctaacttaatgctctcgggtccttttataaggaagcccccttctgaaaataggtttgtcttggatcccccccatgccggcccttcccgccctgggggctcccccacccctcgctgtagatggtcccctcttaagaatatcatggggtataatcaacaactcgtggcgnccacaggggtagaatggccgtcatcgacactaataacatagcagctctcgtgtgtcgtgcacaaacacatacatgcgagctctctttccccgcaaagatggatgtcccgaccacacatagatgacgatggctcgccacgcataggatgtctccgccctcccccctgtcaggagggtattcatacataataggcttctctccgcagagcagctagttcttgccacctctcacagatgtcttatcttggtagaatccctctctggggcacacacatcagtcgtcctctctgagaaaacattaagcgaaattatctccccgcacaatggtgttcttctgagcccccgcgggtttgattagtgctccacgaggatggatttatatcccagccacctctctgggggcgagcaaaagcgggggcgatcaacccgacgggacacacgacgttcgactctcaccccgcgccccaacaggtgaaaacccgcgctctcttactcatgaacataccacgcaaagtatgcgacgaacagtggggtggggaccccttaagacccacagctcctacaggagaagctcgagagcccaaagaataccgcctggagacccataggaggcgaaagggacccactaagattactagctcgcccccccgcccccccccccggggccaaaaaaaaaccccccctttcaaaac

SEQ ID NO: 580267 - DNA, 413 bp, Homo sapiens
  misc_feature (86)..(86): n is a, c, g, or t
tttatttatatacagtgcatgacacacacttagatctactctcctatagatatgcataaacacgcacattattatgcataatgtantactcaggcacgcggtctgtgcatcgagtgaacccggcgcgaggggtgagagtgtggaacccaacgtacccaatcacagattcgcgagagcataaaaaaaagaaagaagaagaagaagaaagaaaagagaaagaataaaggcatcctcggatgtctctgagctcagctggcggaagaaggccggccgggcgaggtctggccctggccagcggcgcagccccgagcccgcgggagcccctagtgtacagggcagagccccctctgcgcgctcgcggcgctgacagtgggacagggcggagagcgcacaggtagaggctcgctcgtgcc

SEQ ID NO: 580268 - DNA, 154 bp, Homo sapiens
atacttccccagggtgtcgattggaagctgtccagtggctacagcttgtggtgatagaaactctcagtgcaggggtggggtctttatgtcctgtgccagtagatccaaacggtaaggaatcgttttagtatggttacagcagctagtagagagc

SEQ ID NO: 580269 - DNA, 247 bp, Homo sapiens
gtcgacccggttgccacatgtgaaaccccctcttctactaagaaataccacaaattagctgtgtgttgttgggggccctgtaatctcagcttctcaggagagctgaggcaggagaatcactttagacccggaggtggaggttgcgagtcagtcgagatatgttccacgggactccagcatatgggccacagagcgagactccatctctacaaaagagcaaaaaaaaaagggaccaggcggcgggttg

SEQ ID NO: 580270 - DNA, 82 bp, Homo sapiens
ccattctgagcagaagactaagaagcaagaagattatcagacatcaataaatattctttaaatactctcatgaatgtcgacg

SEQ ID NO: 580271 - DNA, 169 bp, Homo sapiens
ccggtagtggcaaaggggggcagcccactgggaagtggaatatggaatgagcgcaaagaacaaaccctagcatttgacagaacggactgatactcatgggggaacagcagagccccacaaggcggccacagaaggaagttccaagggtacattgtttacaatttagact

SEQ ID NO: 580272 - DNA, 864 bp, Homo sapiens
ggcacccggaacaacaaagcaaggaagacggagtccgagcctcgggggctctaacaacgggccgggcgggagtccatggagactgggagcgcgcccgttcatcctcatccttgtctccagcttctccttcgcatccgacgcaaccggagcagcggtgccgccggtctcagccaacgtcctcttcccacggatgtgatctccgtggtgaacgctaaattttaaaaccaccccagtggttgcagacagtgatgtgcttgggacattctatttacaatgtagtctggtgttaagaacaggatgtcttttaaatttaggaagatgggttgggagcggagcaaatgtattttataaacgcgtgatgtggggaaacggtatagtgagagcttaagaaaaaccttagaattacagctacaattgtggtctctcagggaaaatttattgtgcctgggagcaaacaagtgaagaagaagcttaaattggggtggcaagacgcttagccgtagtctggcagaaactaggtttcagggtaactatttcacacggatttccaggtgtgtcaccgttctggcaggtgttgtacccttgtccattgtgaaatcggtgtggcaggaattcacaaagaacaattagacctcattgttagtaacgaagctggaattcatccggcgtggtgccacccgggtaaaattctctaagaactaccttaccgcatttttccacgcggagcgttccacgctgacacggggccatgtgaagcgggtggcctgcggcgcgcaacatttccccttgtgtgggacgccggacagatttttttccccccgtcgtgcgggaatctaggcgccttaacgggcggggcacagaagg

SEQ ID NO: 580273 - DNA, 264 bp, Homo sapiens
  misc_feature (1)..(1): n is a, c, g, or t
  misc_feature (7)..(7): n is a, c, g, or t
  misc_feature (20)..(21): n is a, c, g, or t
  misc_feature (30)..(32): n is a, c, g, or t
  misc_feature (104)..(104): n is a, c, g, or t
nctgatntaaccctgagagnnctcattgtnnnggccaattgacacattttgaagatacagcttccttctcggccataagatcatcaaactgcattaataaaatnatagagcttgataatgaagtaggctgagaataatctaatacaaaaccaatagcaaattttgaaatgcatccacttgcaataaaatgttatctataatgtagtagattcttcaaatgttaacccttaaattactcagaattttaagaacaaagttaaagct

SEQ ID NO: 580274 - DNA, 409 bp, Homo sapiens
gcacacacaagcatttaccaaactcctatgcaccgcactgctatccacacgacaatcaagaggacctctcacaaggcttatggtgaacttctcctgaactgttcccaaatcttcacttttccctgaagaaaagtcttgttgattagtgaaacctttgccactagtgttctccattgtatacaggtaatccatataaaaagccccaaaccgttgcattccagctatctcagtgtatgtctccttatgatgagtcgaatccaagatacattctgcacgagtaccattattttctgggcttcggtaatcaaaccatgactctgtcaggtatgtgaaacctttcgtactcaaattgtcaccacacatgaagaaacaggcttcagtttcacttctattcatattctcttcacaa

SEQ ID NO: 580275 - DNA, 372 bp, Homo sapiens
  misc_feature (304)..(304): n is a, c, g, or t
cggcggacgagctccaccgctgaggccaacgaggccgagccttttattgttacagacattatgtcgacgctttcgaagggtatgtgggctttgcaataaatcatcacttatttaacattcataaccctatttttaatcaactaaatggggactgaagataaaataattgtgcatgtagaacagaagatatgccagttttatgaaagtccaggttattattttaggtgggggggggaatgattgatttgggtggtctctcttgtcttctttaccattggcccaggggggggagtgtgtggattgnttttcgccagggtgtctgcactgggtgggggggggagggggtgggcataggccatggtatgtggcggg

SEQ ID NO: 580276 - DNA, 163 bp, Homo sapiens
gaccgaagtctgagctctatccttctcagcctctggaactatattctgtcttacgggtcatcagtactcgggccgtctgccattccagcctcgggccctgagatccctgaagccccgatctctgtctcctgggccccagctagctcagattctagccctggga

SEQ ID NO: 580277 - DNA, 1058 bp, Homo sapiens
gcgcagggagcttctgctgagggtgtgcagtgcggagcttgacggaaaccgcagataagtttattattctctttgaaagatagagattaagtacaactacttaaaaaatatagtcaaataggattactaacgatattggcttagcgttaagtttttaacgtaatatttaatagcttaagattttaacgagacaatatgacacgacttagcaagagtagcatgaggaaggccaacagactaaacagcgtttctaacacatgacggcagagttgacgcatgaacgcttcttcatggcgtaaaacacatgtctttacacaaagacaacatcgagagcacaggactacagagcacccgcaatctaataccaatagacagggcaagagccttatagacttcacactgcaaggtgcacttaacacagcttaacagttgaagattaaaacacgtcgtagcgtgacttaaccactcactctggaaaggccgatcattatcacacaacgagactcaaaccccgacacggatgacttccaatgacccttgaacattccaatcgaccgccagtgtcaggacacttggcagttcacattaacaagcgcgataattacacacaggccatttacactaacagaggccagacagacacagcttggaacagacttaacattcgggcagcatgtgcgctaggactggaaaaccaaaatgggaagaaagaactatgaaggccttcggcacagggtggcacaacaacctggcacaagcacgcaggaacaacgcaacgagacgaaaaacaaacgacaccacacccaagagaagcccggaccacagccccctccgaacgaccgggtccgagccgacgacccaccacgctgagcgaccacgaagagccaccgcggctgaaatgggacccgagaaggtacatacatcaccccaaaagagaaacacggggaaacaacacagcggggcgagacaacgaccacgacgaaaccaaaagcggaagcacccccagcagcgcagcaaaacacaagagcaggacacgaggggacgaggccactaacaca

SEQ ID NO: 580278 - DNA, 176 bp, Homo sapiens
ctcaacgctttatacttccttcaatgctttacttcattagctctagaggtccatgcatacttaatattatacttgaattcagtacggaagtataaagcgttgagaaagtataaagcgttgaggaagtataaagcgttgagaaagtataaagctgaggaaggtataaagcggttgag

SEQ ID NO: 580279 - DNA, 175 bp, Homo sapiens
tgctaactgaaatgaagaatctctaagggctcatcaataggatggatatggctgaagaaagaatcactgagttgaagatatgtcaatagaaacttcccaaactgaaatggcaagagaaaaaaacgggaaacaaaatcagaatattggagaattgtggggcaaaagtggttacatg

SEQ ID NO: 580280 - DNA, 278 bp, Homo sapiens
  misc_feature (69)..(69): n is a, c, g, or t
  misc_feature (122)..(122): n is a, c, g, or t
  misc_feature (209)..(209): n is a, c, g, or t
  misc_feature (256)..(256): n is a, c, g, or t
cggacccacccaagagaacccgggctgctgtttcgcgactcaccagcacagatttgctcagaaacctcncccaagattgggcagaagttactttaaaaagacttggttcagctggttcacgngtgtcacgcctgtaatcccagcactttgggagccaagccagatggatcatgaagcccaggagttcgagaccagcctgaccaacatgntgaaacccccatctctactaaaaatacaaaaatttaacagcagtagncgagactctgtctcaaaaaaaa

SEQ ID NO: 580281 - DNA, 312 bp, Homo sapiens
aatcaacaaccttcctaggccttactactaataattattacaatttgacttacacaacttaacggcttcaatggaaaatccaacccttacggagtcggctttggacccatatatccccggcccgggtcccttttccaataaaatcttcttgagtagcatatcaccttcttattattagctatagaattcgcctcctttacacccctaccatgagcctacaacgacttactcgccataatagttatgcatcctcttataatcatcatctaggctaggctggctatgagcgctcaaaagggtgagctgaccgat

SEQ ID NO: 580282 - DNA, 364 bp, Homo sapiens
tccatacagcaacctgacccagcaccctgctgcgataccagactggggctacgtagaggataagcagagagatgaagatctacctcaggaacgaggcaggatatacgagacaaactctacgccgatacacatacgctctcaactatctcctatggaccccacaagccccagttataacagccacggactacagcccagccctaacataaatcagagcaagagccggatagagtacaaggctatttaatatgcttgaactgccgggcaagacaacatctgtgtagcctaacctgcagctggaaatgtacaggggcgcagaaccatagtgtaccaaggtagacaaagaatagccctgaaccacact

SEQ ID NO: 580283 - DNA, 134 bp, Homo sapiens
gttatccagagacccgatcaacacatcgagatggtcatcgtagtgcatgctatcctgcgctacacacgttcaatccacacattttttttttcttgcatgcatttacctgtgagatcaatccacacattacttat

SEQ ID NO: 580284 - DNA, 483 bp, Homo sapiens
  misc_feature (167)..(167): n is a, c, g, or t
tgctctctgagatccagggctgtcgagctcattgaagcctgcaaatgggacagcactggccttcctccttttcattcagccactggacggggctggcccacgagccagcagataaaagaagtcatttaagcttcgatttcagataaaagacttgaggttcatgaaangctccagcataacagtgcagcttctgttctgtgctgcaaaacacattagaatacaaacaaaggggctgctccgtggagcctgcaggatcccgaccctgtccaggctgggtgccaggtctgagggtttgggcgtcctctccgccaatgagaaatccacctggcggcctcctctgtcctgttcacccacccactcccatccactctgtcttcttaccttaatttgcacctacttggccttaatgttggcagaaaggttacggagagacagtttaaggtcaagtgcaataaaatgatttcatttacccaaaaaaaaaaa

SEQ ID NO: 580285 - DNA, 217 bp, Homo sapiens
  misc_feature (73)..(73): n is a, c, g, or t
ctggacctttctagaagggcagcatataaaaacatcagtcccgaggagggacaacaatactacctcactactncatctctgatgactggttgttcaacacagtggagtgtgtaaggtatatgttttataattcataaccataggctcgatcatcaagagatactttcgaatttcattttccttcagatatcttaagagtgctaaatttctactgtct

SEQ ID NO: 580286 - DNA, 243 bp, Homo sapiens
cagaatctgaaccatcgcaaaagggagtcaagaacccatatgttttgaggttaataaaaagcctccaatgagactccacagcagacatggtttctcagactattagaaatcgcctctgaggtagactgtaagggaaactgactccatactgggattgactactatttttctgctgcacagacaatatcctccagatgcccactggacaaggagaaagccccacaggaatttaacggagtaaca

SEQ ID NO: 580287 - DNA, 212 bp, Homo sapiens
ttgcctgccgcgttggagttggtctgggccgtggcctgagctgcgctcttggccccagggccaccaacgccgcccccgtcggcttcttttttcttgttctctgctgcctttcagcactcgaaggggtccgattcgtcgtcaaataactggtcgaataggatggtaccacgcagaatgcgcctatagccgattctgagatatcatcaactggc

SEQ ID NO: 580288 - DNA, 131 bp, Homo sapiens
gatatagggtgactactaccgcataccttgcccaggtggccaccggtgaccactaagagagcgcatcattaactcagcccggtcacgcctatccagagaggccatggaacatcgagcatgaacgtgagatg

SEQ ID NO: 580289 - DNA, 919 bp, Homo sapiens
  misc_feature (224)..(225): n is a, c, g, or t
  misc_feature (536)..(536): n is a, c, g, or t
  misc_feature (591)..(591): n is a, c, g, or t
  misc_feature (599)..(599): n is a, c, g, or t
  misc_feature (607)..(607): n is a, c, g, or t
  misc_feature (660)..(660): n is a, c, g, or t
  misc_feature (663)..(663): n is a, c, g, or t
  misc_feature (678)..(678): n is a, c, g, or t
  misc_feature (688)..(688): n is a, c, g, or t
  misc_feature (715)..(715): n is a, c, g, or t
  misc_feature (722)..(722): n is a, c, g, or t
  misc_feature (732)..(732): n is a, c, g, or t
  misc_feature (735)..(735): n is a, c, g, or t
  misc_feature (751)..(751): n is a, c, g, or t
  misc_feature (753)..(753): n is a, c, g, or t
  misc_feature (756)..(757): n is a, c, g, or t
  misc_feature (763)..(763): n is a, c, g, or t
  misc_feature (776)..(777): n is a, c, g, or t
ttaagctgcagtgactctggcctccaagtgctgggattacaggcgtgaaccaccacgcctaacctgagctgggctagcagcaggaatcacattaaacattgctggtaacaatcgcttagtgccagtagaaagagttacaggtgaagatttttggattctttccaaaattttaaagaattgtctgtatattaatggtttggatgttggatataaccttctatgtnntgttggtgcatactatgctgcgaaactgcttcagaaacaacttaatctcatttacttaaacctcatgtttaatgatattgggcccgaaggtggagaattgattgctaaagtgctacataagaatcggactctgaaatacctaagaatgactggaaacaaaattgaaaataaaggtggaatgttttttgctgcaatgctgcaaattaattcatcattagagaaattagatctgggtgactgtgatctgggaatgcaaagtgtgatagcatttgctacagtactaactcaaaaccaagcaattaaggcaatanacctaaaccgacctatactgtacagtgaacaggaagagtctacagtccatgtagnccgcatgntgaaaganaatcactgtcttgttgcctacacatgtgtaagcatgatataaaaaacagtggnatncaacagttatgtgangcactgtatntgaacagtacctgcgctaccttgatgncagctgncacaaaatanctnatgatggaatggtgtntntgnntgatgnactgaaagcaacnntaccctggaagtaataaatcttttctttacaagaatggagaaggccggcgcaactatcttagtggaactcttacctaccaacaggaatcttatagcgtatttggtttttattcatcaaacacacaaactactttttattctg

SEQ ID NO: 580290 - DNA, 133 bp, Homo sapiens
ggacccgggcactgtggcgctcactctgttattcccagaactttggaggctgaggctggtggatcagtagatcctggaagtttgagaccagcctgggcaacagcaagacacttacttctttttcttttctttc

SEQ ID NO: 580291 - DNA, 222 bp, Homo sapiens
  misc_feature (62)..(62): n is a, c, g, or t
  misc_feature (69)..(70): n is a, c, g, or t
  misc_feature (79)..(79): n is a, c, g, or t
  misc_feature (81)..(81): n is a, c, g, or t
  misc_feature (97)..(97): n is a, c, g, or t
  misc_feature (111)..(112): n is a, c, g, or t
  misc_feature (141)..(141): n is a, c, g, or t
cactatgctgcagaaaataatacaaatgtgtcttcgaacaatctacagtcaaaaagtgcacncccgatnncttcatagncngattctgaagtagtcncatccatgagtttnnctggaattgaatgaacttagtctaatatntcttcaagtaagtaattaagaagtcctgcttccttgcatatcataagaaaaggaactatcacagatagcatctgagtgtct

SEQ ID NO: 580292 - DNA, 989 bp, Homo sapiens
atccgtatttcgccgccaacattgtggtttccacaagacctgtgcgggccggttaaatatctgtgggcgcgctagatccaataatatcgcgttcggcgggtgcgcacagcgcaggttgaactctgccgtagatcagtgtctgaacaaactcctgatttgctacttgttaaaaccttgacacagttgtgcgggaggccatattggtgtggtaccattggagaaatggcctccccggcgcccctcttttggtatgcatgcattgccagtgccgcaacatactctcgtggggtacagcgacaggtatcccacgcgcgtacatttctgctgccgcgcccatggcgcccccgtggaagactcgtaataaaatgggggagacacccacataagcggtccccccactattcgcttgagccccctctggtaagccaacagttttattttttgctagcaaatcgcccgtcatttagtgaaaattgaggccttggtcacaaggaggcactagatttgtccttcgttgttgctgagtaggtccgtccgcattcaaactgacgggggctaagttgctcagtacccttgcgtgcggcagcccactcttgattaggtgacattatgctgacagtccgggcgagaagtaacaacagtggaattaatttcttccgccgaggcgtcggccacacaccctgcttatgtacaggtcaccccgtgtgggtgacaacacagtcccgggtcgccgaaggttttgctctgcctcgtagagagtgacacgagcgccttaatgacttttagcccccgcccgtgtttttgtacacccgaggcggagtcctctccgccgcccctgttctatataaaagtcctgtagtacagggattatgttgattacaacggctcccgctttttctgcgataagtcagaatactgcaggggggcaaaccgaagtgtcacttgctagcgtaaccaaaaacaagcccgtgtggaaaaaacaaacaaga

SEQ ID NO: 580293 - DNA, 81 bp, Homo sapiens
  misc_feature (36)..(36): n is a, c, g, or t
gccgcggacacggccgtgtattactgtgcgacagtnccgtacagtggtgacccgagaggctttgactactggggccaggga

SEQ ID NO: 580294 - DNA, 331 bp, Homo sapiens
agagcatcctcagacgcgtgcttcaggtgagcctcagatctcaccatctgggaaactagttgcccctggactgtttagccaaatgacccagtgcattttattttattttattttattttattttatttatttttcagacaggaactttttctgttgcccaggctggattgcagtggtgtgatcatagctcactacagcctcaaacttttaggctcaagtgatcctctcacctcagccacccaagtagctaggactacaggcacacgctaccatgcctggctaatttttgcttttttttttttttttttttttgtagagacagagtctccca

SEQ ID NO: 580295 - DNA, 1449 bp, Homo sapiens
atttatttgaagcacagtaaaaacaaaaaaattggtacccttgtggaaattcagtggcacaaggtacactgccataaacttgcagggacattatacagtaaaaaagcaacaaaatcaacagaacatcacaacaggacaaaacaaaattctcctgttccacaacactgccttcacatcaattttacctgcccaaacagaccatttacaaatattcacggtcaatacaactgctccaccatccataacacaagcatcagctctcactctacctcacacaactgctacagcacatctcaacacacccatcgggtcatcttcacacacgcaacacacaacaccaacaccaccactggcacatggcacaagccttacaatcatccaccatctacaccctccgcgggttccccgcgtccggaggccctctcgctacccatctttcctcctaccactcttaaccccactattcacgtgcatggacaagattccaggtcccaccatatcccatctcgtaggcacccccttagaatcccaccaccctaaacatggacacccgacgctcacttccctctgcccccaaaaaagtccgaacacatagctcaagcggccacttgcgccacccatatcccccaattcaactgtggcaaaacccaccccgttctcgatagggctattgcacagggctcggtacatcacagcccccatgtcatttttaatgcttcttcaattaacccattcttagttgtcgcccaccgagcgcccagcccattcccaacaacaaggtatgcaaaacaatcctactagggcgccatccgtgtcatccccacacaaggggacaatacacccccacaaaggagacaatagggacacctaccccgccccacatcccactatacacacgtgtccgctatactccccgctgctcactacccatagtttaaacccatattcgcagcgtggctactcttatccaacaacactattggcgcccccaccaaacgagttcttacaccctctccaacgcttgtataaacacacacccaaactcactccccctccaatctactcacttcataccactctcagtagcaccccaaccgccacatccttactaaaccatcaattcaccacctcacacaccctcacccacgcgccataatacctctcctttctccctcactacctattcactcctaccaaacctcgacctctcccatacgcctccctacacccacaccataacgctattcactcaacccctctctctcccatactcacactcggatacccgccctctcactccctcccactctcaccacccgtcgtatactaaataatttgctcccctccaccccaactcacacacctccctacataactcctccttctaattcagattcttcctccaccactatatataacaaattactcacttttcctcctccacaacaa

SEQ ID NO: 580296 - DNA, 1175 bp, Homo sapiens
acaagtgccatcctgatgggcacctggaaaacaagcccagctctggtaggaaactgctgacgtcatatcctggggtgacatgtgggcttgttgtatcaccaaggaggacctcactgagatcagggacatgttgctggccaataagtgtgccagctgctggccgtgctggtgccattgcacccatgtgaagtcaactagtgccatgcccaggaacagctggtctcaggtgccctgaggaagacctcgctttttccagggcgtaggaggtatcaaccactaagaatctccagggtgcacctattggagaatccctgatgttgattgtagcaggcatgatcaatgacgttgtgagacaaatgttgggatgccaagcgaatagccgactgcatgcatagaacaatgctcaaacatcttccaccgcttctcctatatgcggcatgggtcgattcacaagccagggtagtaacggacaattgggcaggccatcatactagacccatgagagattgctattgactatcgacagcatggaaacggtcgtagacattcatctgcatatccattggaagtgagtgtccggcgaaacgtatcgcacacggtggtactagttactagacacgattgggcctacgcacaaaactagtactgaccattcagatacacccacattactaatacatacgaaacgtggtaacacaaaccgcgagtccttgggaccatggctactagattgagagaaccggtgagttcaacaatcctatacacagcaaatttaggctagaaagcaaggggtacaaaaggagacttaacattaggggcattgactcccacattcgtgccccttatagggagcactagattagagcccctaggtagaggataggcataggcaaaaccaaagagactggcgtccccttggcatgcatgggacatggcaagcacccacaaagtacatacacagggacatggcaaggacccaaagcgacaaggcaagacccacggcacgagagcaacagcgcaacgcacgagagaacatgagagaaacaaacgagggcgaccaacgggacacacaacatcgacgacacaaaaagagcaagcaccaacaatatcaagcaagcagagacaaagcgcacaacgacaagggcgacaacataaacgagcacaaacgaacacac

SEQ ID NO: 580297 - DNA, 1043 bp, Homo sapiens
  misc_feature (215)..(215): n is a, c, g, or t
  misc_feature (222)..(222): n is a, c, g, or t
  misc_feature (224)..(226): n is a, c, g, or t
  misc_feature (229)..(229): n is a, c, g, or t
  misc_feature (231)..(231): n is a, c, g, or t
  misc_feature (233)..(233): n is a, c, g, or t
  misc_feature (236)..(236): n is a, c, g, or t
  misc_feature (241)..(242): n is a, c, g, or t
  misc_feature (249)..(249): n is a, c, g, or t
  misc_feature (256)..(256): n is a, c, g, or t
  misc_feature (260)..(260): n is a, c, g, or t
  misc_feature (266)..(266): n is a, c, g, or t
  misc_feature (269)..(269): n is a, c, g, or t
  misc_feature (273)..(273): n is a, c, g, or t
  misc_feature (285)..(285): n is a, c, g, or t
  misc_feature (372)..(372): n is a, c, g, or t
  misc_feature (392)..(392): n is a, c, g, or t
  misc_feature (395)..(395): n is a, c, g, or t
  misc_feature (408)..(408): n is a, c, g, or t
  misc_feature (412)..(412): n is a, c, g, or t
  misc_feature (414)..(414): n is a, c, g, or t
  misc_feature (427)..(427): n is a, c, g, or t
  misc_feature (434)..(435): n is a, c, g, or t
  misc_feature (439)..(440): n is a, c, g, or t
  misc_feature (444)..(444): n is a, c, g, or t
  misc_feature (446)..(446): n is a, c, g, or t
  misc_feature (448)..(448): n is a, c, g, or t
  misc_feature (451)..(451): n is a, c, g, or t
  misc_feature (454)..(454): n is a, c, g, or t
  misc_feature (457)..(457): n is a, c, g, or t
  misc_feature (464)..(464): n is a, c, g, or t
  misc_feature (467)..(467): n is a, c, g, or t
  misc_feature (482)..(482): n is a, c, g, or t
  misc_feature (542)..(542): n is a, c, g, or t
  misc_feature (553)..(553): n is a, c, g, or t
  misc_feature (566)..(566): n is a, c, g, or t
  misc_feature (614)..(614): n is a, c, g, or t
acagccggtctctctgcaggcgccgggagaagtgaccagagcaatttcggctcctacaaccagcacaacttctggtcctggaactaccccaagccctgttcccacgaccagcacaacctctgcccctacaacaagaacaacttctgctcctaaaagcagcacaacctctgccgctacaaccagcacaacctctggtcctgaaactactcctaganctgttcntnnnacnancncanccctnntcctacnaccagcncaanctctgntcntacnaccagcacaacntctgcttctacaaccagcacaacctctggtcctggaactactcccagccctgttcccaccaccagcacaacctctgctcctacaacnagcacaacctctgcccctanaancagcacaacctcngccncnacaaccagcacancctctgnncctnnaacnancncanccntgntcctacnacnagcacaacctctgcncctacaaccagcacaacctctggtcctggaactactcccagtgctgttcccaccaccagnataacctctgnacctacaaccagnacaaactctgcccctataagcagcacaacctctgccactacaaccagnagaatctctggtcctgaaactactcccagccctgttcctaccgccagcacaacctctgcttctacaactagcacaacctctggtcctggaactactcccagccctgttcctaccaccagcacaatctctgttcctaccaccagcacaacttctgcttctacaaccagcacaacctctgcttctacaaccagcataacttctggtcctggaactaccccaagccctgttcccaccaccagcacaacctctgctcctacaaccagcacaacctctgccgctacaaccagcacaatctcggccccaacaaccagcacaacgtctgctcctacaaccagcacaacctctgcctctacagccagcaaaacctctggtcttggaactactcccagccctattcctaccaccagcacaacctctcctcctacaagc

SEQ ID NO: 580298 - DNA, 1114 bp, Homo sapiens
gtgtagggggaagtaacagggtttgctgtttgtaagtagaaatgttgggaagttgtagtgagaaaggtgacgtgtgtggttgctatgattcggcggtctacaaagtgggtagagatacgggtgtgcgggtgaagtttgccgagaggtgtgcaagatgtttgcgcggtgcgcggcggcggtgtgccgcgtgtgcgaggtgtccagaggcaaaagtttgggggtttaagagaacagtgaatagagggtatgttggttccgtctttaggagagcggttgttgttgttggggtgagatgaggtggcgcgataggggttggaagtggaagggggacgtttgtaggcgtgggaggttaacttttgccagaagcagttaagggtggcgcggtggtagagagtgtgtagagagtaggagtcgtgcgaaggtgttgtggtgttgggcatggagccgcgtggcgcagccgtgagagagggagaggttatgtgggggagaagagatagagagggcgcgtgtgggcgttggtttagtcatgcttctttagggttttgggtagcagggcgcatgcgtggctggggcgcaaggtgtcgcagtgtgtgccctgtgccccctgcgtgttgggtttgcgtggaccgtgggaggagccgcgcagggtgtaggcgagtgacggtcgtgtaggccagtgtgtaaagtactaggagagagtgagtatgcagagtagagcgtaagtgtctagtgtagcgttggagacaagtgcgcagaagtatatggaacgtgtgttagggtttggtggcagtaagctgtgtggtgttgcgtcagaagttgtgtgcgctgtgtcaggaagcaaactggaatggacgaagtacttagtttagagctaatgccagatgttgctgttctagtgaaaagtcgtaagtgtctggacttatcgttcctgtgttgctcagtggcgctaagaaataaggagtcaataaggagatgatgttgaagtgtaattgttgtgaatgtgtggaaaatataaagcagggattcagcgcttaataaaggtaaccttctgacatctgttgttaatccccctttgactcttctcctttatttaacctcgttaggtttgagatgg

SEQ ID NO: 580299 - DNA, 112 bp, Homo sapiens
tatgcagcaaggaaagtgagggagcatgccagaaggacttgccagaggtgacccagctcgtgaggtggtaacgcactgggagaacagaactccagacgcaggcccagacact

SEQ ID NO: 580300 - DNA, 366 bp, Homo sapiens
ccaagccctgaaccaggaatcaaggggaatcaccctcccacccaccccaaaacacacatgcgcatacagaaacgtgtgcacctggctgggcgtggtggctcacacctgtaatcccagcactttgggagcctgaggtgggcggatcacctgaggtcaggagttcgagaccagcctggccaacatggtgaaactccgtctccactaaaaatacaaaaattagccgggtgtggtggtagacacctgtattcccagctactcaggaggctgaggcaggagaatcgcttgaacctgggaggcagaggttgcaatgagccgagatcgcgccattgcactccagcctaggtgacaagagcaaaactccatctc

SEQ ID NO: 580301 - DNA, 803 bp, Homo sapiens
  misc_feature (215)..(215): n is a, c, g, or t
  misc_feature (222)..(222): n is a, c, g, or t
  misc_feature (224)..(226): n is a, c, g, or t
  misc_feature (229)..(229): n is a, c, g, or t
  misc_feature (231)..(231): n is a, c, g, or t
  misc_feature (233)..(233): n is a, c, g, or t
  misc_feature (236)..(236): n is a, c, g, or t
  misc_feature (241)..(242): n is a, c, g, or t
  misc_feature (249)..(249): n is a, c, g, or t
  misc_feature (256)..(256): n is a, c, g, or t
  misc_feature (260)..(260): n is a, c, g, or t
  misc_feature (266)..(266): n is a, c, g, or t
  misc_feature (269)..(269): n is a, c, g, or t
  misc_feature (273)..(273): n is a, c, g, or t
  misc_feature (285)..(285): n is a, c, g, or t
  misc_feature (372)..(372): n is a, c, g, or t
  misc_feature (392)..(392): n is a, c, g, or t
  misc_feature (395)..(395): n is a, c, g, or t
  misc_feature (408)..(408): n is a, c, g, or t
  misc_feature (412)..(412): n is a, c, g, or t
  misc_feature (414)..(414): n is a, c, g, or t
  misc_feature (427)..(427): n is a, c, g, or t
  misc_feature (434)..(435): n is a, c, g, or t
  misc_feature (439)..(440): n is a, c, g, or t
  misc_feature (444)..(444): n is a, c, g, or t
  misc_feature (446)..(446): n is a, c, g, or t
  misc_feature (448)..(448): n is a, c, g, or t
  misc_feature (451)..(451): n is a, c, g, or t
  misc_feature (454)..(454): n is a, c, g, or t
  misc_feature (457)..(457): n is a, c, g, or t
  misc_feature (464)..(464): n is a, c, g, or t
  misc_feature (467)..(467): n is a, c, g, or t
  misc_feature (482)..(482): n is a, c, g, or t
acagccggtctctctgcaggcgccgggagaagtgaccagagcaatttcggctcctacaaccagcacaacttctggtcctggaactaccccaagccctgttcccacgaccagcacaacctctgcccctacaacaagaacaacttctgctcctaaaagcagcacaacctctgccgctacaaccagcacaacctctggtcctgaaactactcctaganctgttcntnnnacnancncanccctnntcctacnaccagcncaanctctgntcntacnaccagcacaacntctgcttctacaaccagcacaacctctggtcctggaactactcccagccctgttcccaccaccagcacaacctctgctcctacaacnagcacaacctctgcccctanaancagcacaacctcngccncnacaaccagcacancctctgnncctnnaacnancncanccntgntcctacnacnagcacaacctctgcncctacaaccagcacaacctctacccctacaagcagcacaacctccactccacagaccagcacaacctctgcttctacaaccagcataacttctggtcctggaactaccccaagccctgttcccaccaccagcacaacctctgctcctacaaccagcacaacctctgccgctacaaccagcacaatctcggccccaacaaccagcacaacgtctgctcctacaaccagcacaacctctgcctctacagccagcaaaacctctggtcttggaactactcccagccctattcctaccaccagcacaacctctcctcctacaagc

SEQ ID NO: 580302 - DNA, 127 bp, Homo sapiens
cgtcctcgaggcctaatacagcacacccttcctgctccccaggtgacagccaagagtggcctagacgaactggtgagtgacctgctccaggaggcccacactgacctggaaagggtccgcgccatct

SEQ ID NO: 580303 - DNA, 372 bp, Homo sapiens
aaaatcccctcgggataactggcttgtggcgcccaagccctgttcccactgaccagcacaaactctggccctaaaactaggaaaaaactttttggttcctataagaccagcacaacctctgcttctacaaccagcataacttctggtcctggaactaccccaagccctgttcccaccaccagcacaacctctgctcctacaaccagcacaacctctgccgctacaaccagcacaatctcggccccaacaaccagcacaacgtctgctcctacaaccagcacaacctctgcctctacagccagcaaaacctctggtcttggaactactcccagccctattcctaccaccagcacaacctctcctcctacaagc

SEQ ID NO: 580304 - DNA, 361 bp, Homo sapiens
tccggaattccggccatgggatcacaggcatgtgctaccacatctggctaatttttgtttttttagtagagacagggtttcgccaagttggccaggctggtctcaaactcctgacctcaggtgatccacccaccttggcctcccaaagtgctgggattacaggcgtgagccactgcacccggccctattccttgctttttcttatttatttgttctgcaatgatgtttcagatcttttttttttttgggaattgaacttttctttaaaacccattcggggtttttaaaaaaactctttcatttttaagggagggatcccccctttttggtccggggggggaaaagaatggaaaaaaccctt

SEQ ID NO: 580305 - DNA, 305 bp, Homo sapiens
  misc_feature (204)..(204): n is a, c, g, or t
tcgaacgtgtatcccagcagtttgggaggcgaggctggtgaatcacgaggtcaggagttccagagccagcctgagcaatatagtgaaccccctgtctctactaaaaatacaaaaattagccgggcatggtggcgcgcgcctgtagtcccagctactctggaggctgaggcagtagaatcgcttgaaccctgggaggcggagatngtagtgagccgagattgtgcctgggcaacagatgcgagactcctgctcaaaaaaacaaaaaaaagggctttacttgggcgtttcccataataattcatagg

SEQ ID NO: 580306 - DNA, 264 bp, Homo sapiens
tgccagatgtgctagcttcctaagtcccagtggtgccccagtcagctggcctgggagcacctcccttgctctacattggggcccaggaagagaggccagctcctcacgggcgatagggtgtgcagcctagcaccatgtccatgagcccatgaatcacaggcacgaatacctctataacggcctccggtggaatgggaagaagcactatcaaatgcagacctatggaggaagcgacgcttggacgtttagagttgagggtttatt

SEQ ID NO: 580307 - DNA, 188 bp, Homo sapiens
tagaggatccgctacaccagcatcaggtgcacgtttcttacgctgcagtgcacacagtggagacgtgcggactcactgagtcgcaagagcatcccagcttcagagctcttctcacgacgggtaccttctcaagtatggcgtgccgatgccatcctcgccatgctgccttctatcgtcaacaaggacgg

SEQ ID NO: 580308 - DNA, 223 bp, Homo sapiens
tgagactcgcatcatcctagggcttaggatatcccagcctaccaatatgctcattcagcatctaactaggcatggtgatgttggccctgatctcttcattttttctggaacctcagatttcctacagtgagcatggtatataatgcactagcccttttgattctgatacagttataatattctagtgtgttctagatcattaggtctcagagggtgggatacg

SEQ ID NO: 580309 - DNA, 218 bp, Homo sapiens
ggatatgaggatcaaaaagcggcgtgtttgtgcaaaactcaatgagtccccctcaaacgccaggagggtagaagtccttgaagtgggggcagtgaagccgtctttgttgttgtgagggtgctggacattgacaggctgacccaatgagcgctagaagggccggccctgcacctgggccagatagcctgtgagtccaagaagcacccagttccaaggcg

SEQ ID NO: 580310 - DNA, 183 bp, Homo sapiens
  misc_feature (29)..(29): n is a, c, g, or t
  misc_feature (82)..(82): n is a, c, g, or t
  misc_feature (119)..(119): n is a, c, g, or t
  misc_feature (145)..(145): n is a, c, g, or t
  misc_feature (162)..(162): n is a, c, g, or t
  misc_feature (183)..(183): n is a, c, g, or t
tacagacagaggttcaggatgtttttggntctgacatagcccaaaccagggcagaggctgtggccaggggggggagctgggnaagcctgggggtcagaggggggtgggggtggacaggntctatggctacggtttttcagccgcncagccgtgctgggcccncgatggcccgtgggggtgggn

SEQ ID NO: 580311 - DNA, 342 bp, Homo sapiens
gatatcagagaccttcaatttcaaaatttttaggtcaactactatacaatccagcaatgcgactactgagatttatccaaaggaaaggaaatccatataccacagggatgcctgcaccccatgtttactgcagcactgttctcaatagcaaagatatggaatcaatctaagtgtccatcaacagttgaatggataaagaaaatgtaatatagatacacaatggagtactttttttttttttttttggattggagacaaagttttgctttgtcgcccaggctggggggcagggccccattctgggttaaccgaaaactccacctccgggtttaaagcaatttt

SEQ ID NO: 580312 - DNA, 328 bp, Homo sapiens
acatttacagaagggcacatgaggcactgccatacccatggattgccagatgtgggtaggcttcgagataaaaactgcacttccaaagagggggaaaaagaaaaagaaaaagaaaagagggcgggggtggtggctcacgcctgtaatcccagcactttgggaggccaaggtgggcggattacctgaggtcaggagttagagaccagcctgaccaacatgctgaaattccacctcgtactaaaaatacaaaattagccgtgcctggtggcgggcgtccataatcccagctactggggaggctgagaaaggggaattacttgaaccgagg

SEQ ID NO: 580313 - DNA, 255 bp, Homo sapiens
aaccggcgcctctgcagtcggtaactcctttggcatgagttagaagaattcggcaggcctgtaaatatagtagcctagttgaacaatgtgaaggactttcgtaacggaagtgagtgcaagatcaagagtaattaccaatcttaaggttattgcattggcactttgagttaagattattcttttacatcctgcaggactagcattaattgacagctgacccaggtgctacacagaagtggattcagtgaatctagg

SEQ ID NO: 580314 - DNA, 311 bp, Homo sapiens
  misc_feature (3)..(3): n is a, c, g, or t
  misc_feature (64)..(64): n is a, c, g, or t
tancccttccctgacccatgccatatttattttgagaattgaatgttttttggcccaggtgcangtgtcacgcctgtaatcccagcactttgggaggctgaggcaggcggatcacaaggtcaagagatcgagactatcctggccaacatggtgaaaccctgtctctactaaaaatacaaaaattagctgggtatggtggcgcacacctgtagtcccagctactcaggaggctgaggcaggagaatcacttgaaccgggaggcagaggttgcagtgagccgacattcgcgccactgcactccagcctggtga

SEQ ID NO: 580315 - DNA, 620 bp, Homo sapiens
ggagagaggataagaagggataagttcacttacctgtgtacagggacttgagcactgagacacttttcatctggatgcagtggggttgagctcctcagcaagcctccgtatacagctgccctgcctacacctgtcagagctggtaggttctcgtcctccctgctgctctcaggagtgttcaagggtggatggcaggtaatggggcctgaggtacttaaggctaatgatatgtgggggacaggtgcccatctaccagccttcatcaggtaagtgaaagggctttgggtgtcaggtggcagctattccccaccaagagattcagggtcacaggtttttccccacacctgcagaatctcagggcctagccaccgccaaacttccaaatcccactctttgtgatatgtgaagctactcatttcttacccttggaggctgtatgtggcaatttccagcccttcttatgcatgtgtgatcccacctctacccctatagattgtaataaaggctcatagtgaagaagactggagggaagactgattcagcaagatcatagggtgggatctttagattttctcactttgacaacccccgaatgatacacgcagtttgtgcatgtgttt

SEQ ID NO: 580316 - DNA, 145 bp, Homo sapiens
aatacctggatggtgatatctggatgtgctagaacaccagaatagtacagcaggttacaggaatacttaaagatgctggagtacacaatttaacaattcaagtggaaaaggaggctgaggcaggagaatggcatgaaccgcggag

SEQ ID NO: 580317 - DNA, 443 bp, Homo sapiens
tccactagtgtaggcgttggtgttaatgtaaaattatgcagctgctatggaaagcagtttggtggttcctcaaaatggtaaacatatggacatcatatgatccagcaattccactcttagatatacaccctaaaaaactgaaaacagggactcaaacaaatatttgtaaaccaatggtcacagcaacattattcaaatggccaaaaggtggaaacaacccaagtgtccatcaatggatgaatggataaacaaaatgtggtataaacaaagaatgggggccgggcgcagtggctcacgcctgtagtcctagcactttgggaggccgaggcaggcggatcacctgaggtgaggagttcaagaccagcctggccaacatggcaaaatcccatctctactaaaaatacaaaaatcagccccggagtgtggtgcgtgcctataatccc

SEQ ID NO: 580318 - DNA, 768 bp, Homo sapiens
  misc_feature (454)..(454): n is a, c, g, or t
  misc_feature (458)..(458): n is a, c, g, or t
tgccgcgccgcgcgcctccgaggctgcgtccgggaagccggctccccgagcgctccggcctggcccggtgccccggacctgagtgcgtcccatggatggcgcccgggctggcccaggcggccgcgggggagagcgactcccgcaaggtggcggaggagacccccgacggggcgccgcgctctgccccagccctgaggcgctgtcgccggagccggctgtttacagcctgcaggactttgacacgctggccaccgttgggcactgggacgttcgggcgggtgcacctggttgaaggagaaggacagccaagcattttcttcggccctcagggtgatgagcattcccgagcgtcatccgcctaaagcaggagccaacacgttaacacaatgagaagtctgtcctgaaggaagtcagccacccgttcctcatcaggctgttctggacgtggcatgangagngcttcctcttacatatgcctcattggagttacgtgccgggcgggggaggctctttcagttaccttgcgcaaccggggggcgcttctccaggcaccagcgggggctcttctactctgcagaggatccatcttgtgccactcgaggttaccgtgcactccaaagaggattgtctacaggggatttggatcgccggagacattcctgtggggtagggttgcgcgttaggctcgggcttggttccgccaaattgttaccggcttgccctttggaccccggttctaccccgattttaggagcgcgagggcgtata

SEQ ID NO: 580319 - DNA, 112 bp, Homo sapiens
caagtccaacagtcaagccagcagcagcatggcaccaggggcacacaccacttcatagcatgtggccagcaaccatctctatcggtactcaacagttccatagctgcacact

SEQ ID NO: 580320 - DNA, 1192 bp, Homo sapiens
  misc_feature (525)..(525): n is a, c, g, or t
acacatcaccagaaggggcatcaccagaggttgcatcaccagaggcagcatcactagaggagggctcgctagaggtgggatcaccagaggtggaatcaccagaggccagtgctccggaggctggatctccggcatccagatcaccaggggctggatcgccagaaactggttcagcaggcagtttagagactggttctggagttatattatggggagacaaaggttcacaatttaaatcatcatcctgcttgttttttacattaacacttaggatacagggtgtttccttccattctgctttacttccttcaggatcaaaacaaatctcttcaatgccattcacctcttccttgtctttaatgtaatccatgttttccaaaggtgaggttgggtccaaatctccattttcatggttgccatttaacagctggacatcagttttcaacagttcttctttgacccttgacacttgctcaagttgctgacgatcactcactctcatcggttttcgagccttaaagactnttttctgagggtcttctaaactggccattcttgatctttaagaaaaagagaaagagagttaaatactgaaacagaagcaacctattggagacttaatacaattgatctaagagagatgcaagcagaacctcatgtaaggttaagacatggaaacctactgcttgtggatactaattacatattactggaacggggaaaccaaatccaaaatggccatagctactaggaaatcaactggaaaggttaaggggaaacgggacaaggttttttccaatatggattcacagggtttggggaagttaagccaaaaaagggtcgttagggaaaaaaacccactaacattgcggcccgaattgggctcattgggcaatatgcccttaacggggcgtttaacaataatgtgccgccgtttacaaaggcgggctgggaataccctgggggttcccaattaatgccctgtgggaaatccctctttggccactgggggacaaacgcaagacgcccccacgaaggcgctttccacaaagtggcacctctaagaggcaacgggaaatgtagcgcgtaatatcttgtcacgcgcacaaattcgttacacgtcatctttatcccacagggggcacatcgcaacaaccttataccgacaccccccccacgggtggggtggtct

SEQ ID NO: 580321 - DNA, 437 bp, Homo sapiens
taacaaagtaaacattggggaaatctgggtaaagagtatatgggagttcttgtaagtataattgtgtgtatatacacacacatatacttttttttaaatgtagatactggggaagcatattaagaacgtactgtgaaacaaaacaaaagaaaaatagatacgtgggcttctaccctggaaaattctgatacaggagttctcatggtaggtctcgggaatctgtatttttgaaggtgttcttggtgaggataatgcacatctgacaagacattaacctctgagctcgaagtaatagaaaactgtaactaaacatccatgtacctggcacctactatttaaaaaaacaaaaatgggcagggctaggagggtcacgcctggaagcccagcactgtgggaggaccgaggctggcggatcacgaggtcaggagaacgagaac

SEQ ID NO: 580322 - DNA, 132 bp, Homo sapiens
atgttaagacacttcaattgtagtgtgctgcactctgagtagatctatacaggcgatcaagggtttgcttgtgctattaagatcgagagtgtagataaggtcatggatcaaaagacataaatgattggaagg

SEQ ID NO: 580323 - DNA, 504 bp, Homo sapiens
gcctcccaaagtgctgggataacaggcatgagcactgtgcccggtcctctttctttatttctaataatacttgcttatatatctgggtgctccagtgttgggtgcatatatattaacaattgttatatcctcttgctgaattgatccctttatcattatataatgaccttctttggctgatataaatgtagcttcttctgctcttttttataggtttccatttgcatggagtatctttttccatacctttattttcagtctgtgtcttaatagatgaagtgtgtatcaccatattttaaaacccattcagccactctgtgcctttaaattggagagtttagcccatttacactcaatgtaactgatacgtaaggagtaacacctctgtcattttgtgactgtatactaggctggttatatccattttgatgaggtccagttgatcagtttctctttaatggaatggtattacatagtaatctacaaaattgttgctccccaaga

SEQ ID NO: 580324 - DNA, 375 bp, Homo sapiens
gggcggggttcggtgggggtttccaacccccaggggcctttgggattcccccctgggagggggggggggctccccctttcccgggccaaaagggggggccttttcccagccccgccctttttttggggggggtttttttaaacccctttttccccccaaaatttttccccccccccttttttgggggggttggggggtttttcccccccggggggcccaagggtttttccttttttccccggccccccggtttttttttttttttttccaagggggccccccaaaaccaggcgggggggggccccccggggccccttttcccccgggaccccccctttaaatttccccgggggcccttaattcccttttttggga

SEQ ID NO: 580325 - DNA, 925 bp, Homo sapiens
  misc_feature (23)..(23): n is a, c, g, or t
  misc_feature (25)..(26): n is a, c, g, or t
  misc_feature (28)..(28): n is a, c, g, or t
aaaaaaaaaaaaaaaaaaaaaananngnaatagttcctcggatgtaaactcaggataacggtcttgccggttttggccaggctggtcttgaactcccggactcaagcaactctcctgacttggccacccaaagtgttggaattacaggcatgagccactgcagtagccctgattgttttaaatagaagaaggtctttagacaaactcaaccaattgttaaccagaaaatgttggaagttacctcctaccccgcccgcctttgagtcgcccggcctttctgcacctaacacacgtcattcttaaatatatctgattgatgtctcatggctctttaaatgataaaagcaatgttgtgccccaaccccggtcaccttgggcacatgttctcaggacctcctgacgactgggttcacacgccatggccactcatcttcggctctcactacatctttccacttattataagtgccaccaccccccgccatttcccccacccacttcacgtcttttgtcatatatacacctcacactcccccatcctctaccctaacaccatgtcgtcaactccacttctctttctctagtcgtctctaactcgttcatatatgcctactcgcaacccgcctctcatcttcaccacccactcccccctctagatctatcttcgctctatgttcctttagctgtgtcccatggacggatactataccaccacttcagctttctgttgatcttcctttctttccatctagtcactttaacggttgtataacgccttcatctatcccctccagctcctattttacgatccttctttcgctttagcatgaccgatcaccttaacagtctacacttagactaactaccattcaacaatattccatctcctcactcactcttttcacctcacccgtcttatttcatg

SEQ ID NO: 580326 - DNA, 395 bp, Homo sapiens
  misc_feature (9)..(9): n is a, c, g, or t
  misc_feature (50)..(50): n is a, c, g, or t
  misc_feature (87)..(87): n is a, c, g, or t
  misc_feature (113)..(113): n is a, c, g, or t
  misc_feature (152)..(152): n is a, c, g, or t
  misc_feature (172)..(172): n is a, c, g, or t
  misc_feature (216)..(216): n is a, c, g, or t
  misc_feature (224)..(224): n is a, c, g, or t
  misc_feature (230)..(230): n is a, c, g, or t
  misc_feature (239)..(239): n is a, c, g, or t
  misc_feature (241)..(241): n is a, c, g, or t
  misc_feature (243)..(243): n is a, c, g, or t
ctcggattncattcgaaatcccgggttctaaaccccactctgctactaanttgtctgaccttccccatttataaactgttgtgggtnaaaggtgggactaggtgaactctganaaccctgcactcggcgcggacgagggatttaggggaaantgtgctgtattccccgcganccttccccaagggccccgcctcccgggtgaatccccggggccancgcagctnaggcancgatcctgngncngcgggggccggcagcttcctggaaagttacttcttgttggagccggcaataggcaaagtgtgttctgtgaaaatccgcagagccgagattgactacgttccgggaatgagagggctgtgtcattcccctcaattcctgctgcattgacggcg

SEQ ID NO: 580327 - DNA, 390 bp, Homo sapiens
acgcggaacagtaccaccctcagaccatgtgaacatgcgtcttcctgtatcatgtcctaagggctgaccaggactggtgagcaataacacactgcaggaggcccctaatttgccatttccacaccactgccccatccctccagcccccttaagttggcagcaggccactctgtcttgtctagtaatggtgatggagagcctgagtgattcttaatcaaagaaaatgacaactccatttacatttgtacagatctgatattcacatttggatgtatgcctaaaggtacctgggttgaaaatatgtggtgtaacattgctttatcttcctcaatcatcctgacacagccttggacttaatagggagtgggacccagaattatgaaatcatcg

SEQ ID NO: 580328 - DNA, 114 bp, Homo sapiens
atgtgtgaaccgcgcgcgaattcatcgaaacaacgcgctcaaggtcgccaatcttgacgtctgagtcgccggaaatccggccgatgacccgccgggccgcgctcggcgatttcg

SEQ ID NO: 580329 - DNA, 3752 bp, Homo sapiens
ggcacgaggcctggctgggacggaagttgcaccacaagtacaattagtttcagttttgtttcttttccaggcacccagcaacggcggcctccaggcctcaggccccctcaccatcctagaggtcaagatcagctctggctagttctcacaggtctgacccaacaagtagcactgacatttttacgtttgctggatgtacacacggaagtggaggaggaggaggagaaggaggagggcagctccttagctcaagagcaagtggcccaaggcctcagaagactagaaggaagttcctggccattcagcatggtttcccacgggtcctcgccctccctcctggaggccctgagcagcgacttcctggcctgtaaaatctgcctggagcagctgcgggcacccaagacactgccctgcctgcatacctactgccaagactgcctggcacagctggcggatggcggccgcgtccgctgccccgagtgccgcgagacagtgcctgtgccgcccgagggtgtggcctccttcaagaccaacttcttcgtcaatgggctgctggacctggtgaaggcccgggcctgtggagacctgcgtgccgggaagccagcctgtgccctgtgtcccctggtgggtggcaccagcaccggggggccggccacggcccggtgcctggactgtgccgatgacttgtgccaggcctgtgccgacgggcaccgctgcacccgccagacccacacccaccgcgtggtggacctggtgggctacagggccgggtggtatgatgaggaggcccgggagcgccaagcggcccagtgtccccagcaccccggggaggcactgcgcttcctgtgccagccctgctcacagttgctgtgcagagagtgccgcctagacccccacctggaccacccctgcctgcctctggctgaagctgtgcgtgcccggaggccgggcctggagggactgctggccggtgtggacaataacctggtggagctggaggcagcgcggagggtggagaaggaggcgctagcccggctgcgggagcaggcggcccgggtggggactcaggtggaggaggcggctgagggcgtcctccgggccctgctggcccagaagcaggaggtgctggggcagctacgagcccacgtggaggctgccgaagaagctgctcgggagaggctggcggagcttgagggccgggagcaggtggccagggcggcagccgccttcgcccgccgggtactcagcctggggcgagaggccgagatcctctccctggaaggggcgatcgcacagcggctcaggcagctgcagggctgcccctgggcaccaggcccggccccctgcctgctcccacagctggagctccatcctgggctcctggacaagaactgccaccttcttcggctgtcctttgaggagcagcagccccagaaggatggtgggaaagacggagctggtacccagggaggtgaggagagccagagccggagggaggatgagccgaagactgagagacagggtggagtccagccccaggccggagatggagcccagaccccaaaagaggaaaaagcccagacaacccgagaagagggagcccagaccttggaggaggacagggcccagacaccccacgaggatggaggaccccagccccacaggggtggcagacccaacaagaagaaaaagttcaaaggcaggctcaagtcaatttcccgggagcccagcccagccctggggccgaatctggacggctctggcctcctccccagacccatcttttactgcagtttccccacgcggatgcctggagacaagcggtccccccggatcaccgggctctgtcccttcggtccccgggagatcctggtggcggatgagcagaaccgggcactgaaacgcttctccctcaacggcgactacaagggcaccgtgccggtccctgagggctgctccccttgcagcgtggccgccctgcagagcgcggtggccttctccgctagcgcacggctctatctcatcaaccccaatggcgaagtgcagtggcgcagggccctgagcctctcccaggccagccacgcggtggcggcactgcctagcggggaccgcgtggctgtcagcgtggcgggccacgtggaggtgtacaatatggaaggcagcctggccacccggttcattcctggaggcaaggccagccggggcctgcgggcgctggtgtttctgaccaccagcccccaggggcatttcgtggggtcggactggcagcagaatagtgtggtaatctgtgatgggctgggccaggtggttggggagtacaaggggccaggcctgcatggctgccagccgggctccgtgtctgtggataagaagggctacatctttctgacccttcgagaagtcaacaaggtggtgatcctggacccgaaggggtccctccttggagacttcctgacagcctaccacggcctggaaaagccccgggttaccaccatggtggatggcaggtacctggtcgtgtccctcagtaacgggaccatccacatctttcgggtccgttctccggacagttaaaggggctaggactagggtgagagggagtggggagggagagggcaggaaggaggcagagctgtccgtgggaggtggaggccgaggacattttcctgaagggcaggggttggcaacttttcaacatggagtgccaaactgctaacccgtcttctagtgtgtgagaatagggaccaaggtggtggcgtgaccttaactctcagaagcagaggaggcaggtgggtggagggggatgctgggaattcacctgcctcttgctttttgtgggtggctgctgccaccaccgccgctgctatatagtttaggtttctgaggtttgtgagcctgtcctgctttgcattcttcaaaaccattcctgatagagtagccgagggagagtcttggggccaagaagggcccagggtgggtcaggcgtgtgcactgtggaacagagctgagaccccggccccccttggactggcacagggtcctacagagtcagaggaggcctgagatttcgaatgggcagtgaatggcctcttctgccagccacaggcaggatgctccttgatcacggcatcccccggcggtagtacagggtgagcttgcaggagggtctgcaagtgcagacagcagctggggccaaagaggtgttaggttcaaaggctgcgaagagaataggctactggaaaaccaaacccaacagaattcacgtccaaaaatccacattctccatcgcttctcagccttttggctaagattaagtattaaaaaaaaaccaggctctgccaggcgcagtggctcatgcctataatcccggcactttgggagtctgtggcaggaggattgcttgaggccaggagtttgagaccagcctgggcaacatagcgagaccccatctctacaaaagattaaaaattagctgcgtgtagtagcatatgcctttcaacgtagctactcaggaggctgaggtgggaggatcccttgagccgaggagtttgagtctgcagtgagctatgatcgcaccactgcattccagaccccatctcgaaaaaaaaaaaaaaaaaaaaaacagaaacaacagaaaaagcaggttatccatcacttctcagctaagatcaagtgttaaaataaataaataaataaataaataaataaataaataaataccaagttatgagtgcaagaggcagtaaggaaat

SEQ ID NO: 580330 - DNA, 210 bp, Homo sapiens
tcaagattcggcacgaggtaacttactactccggaaaaaagaaccatttggatacataggtatggtctgtgctatgatatcaatgggcttcctagggttttatcgtgtgagcacaccatatatttacagtaggtatagccgtggccacacgagcatattgcactccgctaccataatcatcgctatcctaccgtcgtcaagtgtttggct

SEQ ID NO: 580331 - DNA, 707 bp, Homo sapiens
gggcttttgcttgtagctccagccagagctcggttagggcctcatcgctctgctcccgctccttagggaagcctcggtgattctgccacagcctcagcctctgtggctctgtgacctgccggtattggatgattcgtatctaagactctgggacactcctgaagtcgggaaatggaactcttaacattcaaggatgtggccatagaattctctccagaagagtggaaatgtctggacatttcccagcacgaatttatatagagatgtgatgttggagaactacagaaacctggtctccctgggtgttactatctctaacccagacctggtcaccagtctggagcaaagaaaagagccctacaatttgaagatacatgaaacagcagccagacccccaggtcactacaggaaaagatatcttcattaaagtgcaacagcacactgagagcaacacaccaccacagcagttaattttggaaaggccactgtaagctccactagtgactgacattttacagatgacagattgaagcaagcagcaacattgaatgctttatcaggccaattgctgaaggtttctctctggatctggatgaatcataaatttgggcaactctgtaaaattcttggaaaagcctatgtggtatctgaggtaatcttttctaccttgattccatgccactggctctccattcctgggaagagaa

SEQ ID NO: 580332 - DNA, 1212 bp, Homo sapiens
ggcacgaggcctggctgggacggaagttgcaccacaagtacaattagtttcagttttgtttcttttccaggcacccagcaacggcggcctccaggcctcaggccccctcaccatcctagaggtcaagatcagctctggctagttctcacaggtctgacccaacaagtagcactgacatttttacgtttgctggatgtacacacggaagtggaggaggaggaggagaaggaggagggcagctccttagctcaagagcaagtggcccaaggcctcagaagactagaaggaagttcctggccattcagcatggtttcccacgggtcctcgccctccctcctggaggccctgagcagcgacttcctggcctgtaaaatctgcctggagcagctgcgggcacccaagacactgccctgcctgcatacctactgccaagactgcctggcacagctggcggatggcggccgcgtccgctgccccgagtgccgcgagacagtgcctgtgccgcccgagggtgtggcctccttcaagaccaacttcttcgtcaatgggctgctggacctggtgaaggcccgggcctgtggagacctgcgtgccgggaagccagcctgtgccctgtgtcccctggtgggtggcaccagcaccggggggccggccacggcccggtgcctggactgtgccgatgacttgtgccaggcctgtgccgacgggcaccgctgcacccgccagacccacacccaccgcgtggtggacctggtgggctacagggccgggtggtatgatgaggaggcccgggagcgccaagcggcccagtgtccccagcaccccggggaggcactgcgcttcctgtgccagccctgctcacagttgctgtgcagagagtgccgcctagacccccacctggaccacccctgcctgcctctggctgaagctgtgcgtgcccggaggccgggcctggagggactgctggccggtgtggacaataacctggtggagctggaggcagcgcggagggtggagaaggaggcgctagcccggctgcgggagcaggcggcccgggtggggactcaggtggaggaggcggctgagggcgtcctccgggccctgctggcccagaagcaggagaatcatttgaacccaggaggtggaagttgcagtgagctcagatcgcaccattgcactccagcctgggtaacaagaatgaaactccatctc

SEQ ID NO: 580333 - DNA, 724 bp, Homo sapiens
  misc_feature (4)..(4): n is a, c, g, or t
  misc_feature (81)..(81): n is a, c, g, or t
  misc_feature (84)..(84): n is a, c, g, or t
  misc_feature (99)..(99): n is a, c, g, or t
  misc_feature (102)..(102): n is a, c, g, or t
  misc_feature (116)..(116): n is a, c, g, or t
  misc_feature (127)..(127): n is a, c, g, or t
  misc_feature (216)..(216): n is a, c, g, or t
  misc_feature (222)..(223): n is a, c, g, or t
  misc_feature (225)..(225): n is a, c, g, or t
  misc_feature (233)..(233): n is a, c, g, or t
  misc_feature (235)..(236): n is a, c, g, or t
  misc_feature (238)..(239): n is a, c, g, or t
  misc_feature (293)..(293): n is a, c, g, or t
  misc_feature (297)..(297): n is a, c, g, or t
  misc_feature (315)..(315): n is a, c, g, or t
  misc_feature (347)..(347): n is a, c, g, or t
  misc_feature (370)..(370): n is a, c, g, or t
  misc_feature (373)..(373): n is a, c, g, or t
  misc_feature (375)..(375): n is a, c, g, or t
  misc_feature (380)..(380): n is a, c, g, or t
  misc_feature (389)..(389): n is a, c, g, or t
  misc_feature (396)..(396): n is a, c, g, or t
  misc_feature (470)..(470): n is a, c, g, or t
  misc_feature (496)..(496): n is a, c, g, or t
  misc_feature (500)..(500): n is a, c, g, or t
  misc_feature (518)..(518): n is a, c, g, or t
  misc_feature (527)..(527): n is a, c, g, or t
  misc_feature (600)..(600): n is a, c, g, or t
  misc_feature (626)..(626): n is a, c, g, or t
  misc_feature (641)..(641): n is a, c, g, or t
  misc_feature (707)..(707): n is a, c, g, or t
tggnttcttttctagtggtcatgtgactcactctgcctaaaaaaaaaatgcttctcttatcagggattcctttactttttnatnatcgattccatgttnttntttcgctcttctcntcttgacagtntccctgtggtttcactgtcaggtgaaaacagtacatctttctcgagacttggtggtccctatacgttaataaaaaaaaaaaaaaaaaancccccnncngggggggngnngnngtttcccgggcggggggtgggcgccttggggccggctgcggggattcccctggngggngggggtttttggtttttncgcggggggggggcccgtgttgttttgccttncctggggggcccggggggggccnggncngcgtntggcgttgngcttccnggggggtcgggtgtccgggttttcgggtgggcgtctttgcggcttgggtctccccctttttcctggttgccggnggcgtctttcggtttttgtccttcgnggcncggccccctccctccttnggctctgtnccttcctccctctggcctttcctttcctgggtctgaaaaacttggggatatagcataagaagaaaaataatcncccataatattcccctttctgtagcnactttagacctgggntactagaaaattcctgaagaaaatttcaacgttaagtctgtggctttgttgaatcaagcccccctnattaatatttagaaaac

SEQ ID NO: 580334 - DNA, 545 bp, Homo sapiens
  misc_feature (270)..(270): n is a, c, g, or t
  misc_feature (277)..(277): n is a, c, g, or t
  misc_feature (305)..(305): n is a, c, g, or t
  misc_feature (362)..(362): n is a, c, g, or t
  misc_feature (380)..(380): n is a, c, g, or t
  misc_feature (475)..(475): n is a, c, g, or t
aagaagagatgaaaagagagtgggggcgtcttcaagtaaaatgcctggttgtgccagacatttcacaagtctgaaatcaaatgggattagctcaactagctggcgtctatcaagatatataaatactcaacacccctgcccctaattcaattggagggttctccaattttttacgcggggggcccgaaaaagcccaaaacccttcaaaaagacctcgccaaattttaaatcaagagggggccttccccccagtacacttatctcactaantataccncctccaaaaaccacattatcactccagnccttcaccgagacctaatttgacgccccctcccataatttcctcattatacctactncgaaacctctaaattttncaaaaacctccctctcttttcctttttccctccccttccttatatacacttacttatcacccctctccctttctacattcccaacatctactttncccttgccctcaattttccttcctctcttaccctatcctctcctcctctctcttgtctcattcactactt

SEQ ID NO: 580335 - DNA, 815 bp, Homo sapiens
  misc_feature (634)..(634): n is a, c, g, or t
  misc_feature (657)..(657): n is a, c, g, or t
ggcacgaggcctggctgggacggaagttgcaccacaagtacaattagtttcagttttgtttcttttccaggcacccagcaacggcggcctccaggcctcaggccccctcaccatcctagaggtcaagatcagctctggctagttctcacaggtctgacccaacaagtagcactgacatttttacgtttgctggatgtacacacggaagtggaggaggaggaggagaaggaggagggcagctccttagctcaagagcaagtggcccaaggcctcagaagactagaaggaagttcctggccattcagcatggtttcccacgggtcctcgccctccctcctggaggccctgagcagcgacttcctggcctgtaaaatctgcctggagcagctgcgggcacccaagacactgccctgcctgcatacctactgccagggcgctccgacgtgctggtggtggtggtttccatgctgagcaccgccccccgagcccatccagcaacattcgtgttccaagtcagcatgtccaccaaggtttatgaagggtgatagctgcaagccactcctcagggcacaggagctgcacagcattttaacccctatcgtcccacccactcaagcaatcaccctaggtcctngctgcttgccaacccaccagaanggagataggttcgcctccagctacaagctcaccattcaccatgggtgaccagacctacaacgagatgggggatgtggaccagttccccccacctgaaacctggggtagcctctgaacagagggctgggagagaaggcagagaccagtccttcagtaag

SEQ ID NO: 580336 - DNA, 3698 bp, Homo sapiens
ggcacgaggcctggctgggacggaagttgcaccacaagtacaattagtttcagttttgtttcttttccaggcacccagcaacggcggcctccaggcctcaggccccctcaccatcctagaggtcaagatcagctctggctagttctcacaggtctgacccaacaagtagcactgacatttttacgtttgctggatgtacacacggaagtggaggaggaggaggagaaggaggagggcagctccttagctcaagagcaagtggcccaaggcctcagaagactagaaggaagttcctggccattcagcatggtttcccacgggtcctcgccctccctcctggaggccctgagcagcgacttcctggcctgtaaaatctgcctggagcagctgcgggcacccaagacactgccctgcctgcatacctactgccaagactgcctggcacagctggcggatggcggccgcgtccgctgccccgagtgccgcgagacagtgcctgtgccgcccgagggtgtggcctccttcaagaccaacttcttcgtcaatgggctgctggacctggtgaaggcccgggcctgtggagacctgcgtgccgggaagccagcctgtgccctgtgtcccctggtgggtggcaccagcaccggggggccggccacggcccggtgcctggactgtgccgatgacttgtgccaggcctgtgccgacgggcaccgctgcacccgccagacccacacccaccgcgtggtggacctggtgggctacagggccgggtggtatgatgaggaggcccgggagcgccaagcggcccagtgtccccagcaccccggggaggcactgcgcttcctgtgccagccctgctcacagttgctgtgcagagagtgccgcctagacccccacctggaccacccctgcctgcctctggctgaagctgtgcgtgcccggaggccgggcctggagggactgctggccggtgtggacaataacctggtggagctggaggcagcgcggagggtggagaaggaggcgctagcccggctgcgggagcaggcggcccgggtggggactcaggtggaggaggcggctgagggcgtcctccgggccctgctggcccagaagcaggaggtgctggggcagctacgagcccacgtggaggctgccgaagaagctgctcgggagaggctggcggagcttgagggccgggagcaggtggccagggcggcagccgccttcgcccgccgggtactcagcctggggcgagaggccgagatcctctccctggaaggggcgatcgcacagcggctcaggcagctgcagggctgcccctgggcaccaggcccggccccctgcctgctcccacagctggagctccatcctgggctcctggacaagaactgccaccttcttcggctgtcctttgaggagcagcagccccagaaggatggtgggaaagacggagctggtacccagggaggtgaggagagccagagccggagggaggatgagccgaagactgagagacagggtggagtccagccccaggccggagatggagcccagaccccaaaagaggaaaaagcccagacaacccgagaagagggagcccagaccttggaggaggacagggcccagacaccccacgaggatggaggaccccagccccacaggggtggcagacccaacaagaagaaaaagttcaaaggcaggctcaagtcaatttcccgggagcccagcccagccctggggccgaatctggacggctctggcctcctccccagacccatcttttactgcagtttccccacgcggatgcctggagacaagcggtccccccggatcaccgggctctgtcccttcggtccccgggagatcctggtggcggatgagcagaaccgggcactgaaacgcttctccctcaacggcgactacaagggcaccgtgccggtccctgagggctgctccccttgcagcgtggccgccctgcagagcgcggtggccttctccgctagcgcacggctctatctcatcaaccccaatggcgaagtgcagtggcgcagggccctgagcctctcccaggccagccacgcggtggcggcactgcctagcggggaccgcgtggctgtcagcgtggcgggccacgtggaggtgtacaatatggaaggcagcctggccacccggttcattcctggaggcaaggccagccggggcctgcgggcgctggtgtttctgaccaccagcccccaggggcatttcgtggggtcggactggcagcagaatagtgtggtaatctgtgatgggctgggccaggtggttggggagtacaaggggccaggcctgcatggctgccagccgggctccgtgtctgtggataagaagggctacatctttctgacccttcgagaagtcaacaaggtggtgatcctggacccgaaggggtccctccttggagacttcctgacagcctaccacggcctgggtaacgggaccatccacatctttcgggtccgttctccggacagttaaaggggctaggactagggtgagagggagtggggagggagagggcaggaaggaggcagagctgtccgtgggaggtggaggccgaggacattttcctgaagggcaggggttggcaacttttcaacatggagtgccaaactgctaacccgtcttctagtgtgtgagaatagggaccaaggtggtggcgtgaccttaactctcagaagcagaggaggcaggtgggtggagggggatgctgggaattcacctgcctcttgctttttgtgggtggctgctgccaccaccgccgctgctatatagtttaggtttctgaggtttgtgagcctgtcctgctttgcattcttcaaaaccattcctgatagagtagccgagggagagtcttggggccaagaagggcccagggtgggtcaggcgtgtgcactgtggaacagagctgagaccccggccccccttggactggcacagggtcctacagagtcagaggaggcctgagatttcgaatgggcagtgaatggcctcttctgccagccacaggcaggatgctccttgatcacggcatcccccggcggtagtacagggtgagcttgcaggagggtctgcaagtgcagacagcagctggggccaaagaggtgttaggttcaaaggctgcgaagagaataggctactggaaaaccaaacccaacagaattcacgtccaaaaatccacattctccatcgcttctcagccttttggctaagattaagtattaaaaaaaaaccaggctctgccaggcgcagtggctcatgcctataatcccggcactttgggagtctgtggcaggaggattgcttgaggccaggagtttgagaccagcctgggcaacatagcgagaccccatctctacaaaagattaaaaattagctgcgtgtagtagcatatgcctttcaacgtagctactcaggaggctgaggtgggaggatcccttgagccgaggagtttgagtctgcagtgagctatgatcgcaccactgcattccagaccccatctcgaaaaaaaaaaaaaaaaaaaaaacagaaacaacagaaaaagcaggttatccatcacttctcagctaagatcaagtgttaaaataaataaataaataaataaataaataaataaataaataccaagttatgagtgcaagaggcagtaaggaaat

SEQ ID NO: 580337 - DNA, 155 bp, Homo sapiens
acactgtgatgcatactctgctcgcgcgaagctagcgaggacgggcctggcaggtgacggcagcatccgagtagcaggagcaggtgggggccgcacagccaggctggggggctgcagagcaggggcccacacggtcacacgagaaacggggacgg

SEQ ID NO: 580338 - DNA, 357 bp, Homo sapiens
  misc_feature (105)..(105): n is a, c, g, or t
  misc_feature (137)..(137): n is a, c, g, or t
taatacagagtctcactctgtcacctaggttggagtgcagtggtgtgatgtcggctcactgcaacctctgcctcccgggttcaaacgattctcctgccccagccnctctagtagctggaactgcaggtgtgcaccancacgccgggctagtttttgtattttaagtagagacggcatttcaccatattggtcaggctggtctcgaactcctgaccccaagtgttccgcccgcctctgcctcccataagtgctagaattacaggcctgagctactgcgcttggccccttgcggtacttttggcccaacctcctccactggctggggacgcggaggccgagagagaagtcacttgccct

SEQ ID NO: 580339 - DNA, 92 bp, Homo sapiens
ctgttaaattcccaacccgatgtttgacagatagtagaaacccaaatatttgttggtttaaataaattaagatttaaaaaggaaaaaaaaaa

SEQ ID NO: 580340 - DNA, 2961 bp, Homo sapiens
  misc_feature (1759)..(1760): n is a, c, g, or t
ggcacgaggcctggctgggacggaagttgcaccacaagtacaattagtttcagttttgtttcttttccaggcacccagcaacggcggcctccaggcctcaggccccctcaccatcctagaggtcaagatcagctctggctagttctcacaggtctgacccaacaagtagcactgacatttttacgtttgctggatgtacacacggaagtggaggaggaggaggagaaggaggagggcagctccttagctcaagagcaagtggcccaaggcctcagaagactagaaggaagttcctggccattcagcatggtttcccacgggtcctcgccctccctcctggaggccctgagcagcgacttcctggcctgtaaaatctgcctggagcagctgcgggcacccaagacactgccctgcctgcatacctactgccaagactgcctggcacagctggcggatggcggccgcgtccgctgccccgagtgccgcgagacagtgcctgtgccgcccgagggtgtggcctccttcaagaccaacttcttcgtcaatgggctgctggacctggtgaaggcccgggcctgtggagacctgcgtgccgggaagccagcctgtgccctgtgtcccctggtgggtggcaccagcaccggggggccggccacggcccggtgcctggactgtgccgatgacttgtgccaggcctgtgccgacgggcaccgctgcacccgccagacccacacccaccgcgtggtggacctggtgggctacagggccgggtggtatgatgaggaggcccgggagcgccaagcggcccagtgtccccagcaccccggggaggcactgcgcttcctgtgccagccctgctcacagttgctgtgcagagagtgccgcctagacccccacctggaccacccctgcctgcctctggctgaagctgtgcgtgcccggaggccgggcctggagggactgctggccggtgtggacaataacctggtggagctggaggcagcgcggagggtggagaaggaggcgctagcccggctgcgggagcaggcggcccgggtggggactcaggtggaggaggcggctgagggcgtcctccgggccctgctggcccagaagcaggaggtgctggggcagctacgagcccacgtggaggctgccgaagaagctgctcgggagaggctggcggagcttgagggccgggagcaggtggccagggcggcagccgccttcgcccgccgggtactcagcctggggcgagaggccgagatcctctccctggaaggggcgatcgcacagcggctcaggcagctgcagggctgcccctgggcaccaggcccggccccctgcctgctcccacagctggagctccatcctgggctcctggacaagaactgccaccttcttcggctgtcctttgaggagcagcagccccagaaggatggtgggaaagacggagctggtacccagggaggtgaggagagccagagccggagggaggatgagccgaagactgagagacagggtggagtccagccccaggccggagatggagcccagaccccaaaagaggaaaaagcccagacaacccgagaagagggagcccagaccttggaggaggacagggcccagacaccccacgaggatggaggaccccagccccacaggggtggcagacccaacaagaagaaaaagttcaaaggcaggctcaagtcaatttcctgtgccagccctgctcacagttgctgtgcagagagtgccnnctagaccccacctggacagttaaaggggctaggactagggtgagagggagtggggagggagagggcaggaaggaggcagagctgtccgtgggaggtggaggccgaggacattttcctgaagggcaggggttggcaacttttcaacatggagtgccaaactgctaacccgtcttctagtgtgtgagaatagggaccaaggtggtggcgtgaccttaactctcagaagcagaggaggcaggtgggtggagggggatgctgggaattcacctgcctcttgctttttgtgggtggctgctgccaccaccgccgctgctatatagtttaggtttctgaggtttgtgagcctgtcctgctttgcattcttcaaaaccattcctgatagagtagccgagggagagtcttggggccaagaagggcccagggtgggtcaggcgtgtgcactgtggaacagagctgagaccccggccccccttggactggcacagggtcctacagagtcagaggaggcctgagatttcgaatgggcagtgaatggcctcttctgccagccacaggcaggatgctccttgatcacggcatcccccggcggtagtacagggtgagcttgcaggagggtctgcaagtgcagacagcagctggggccaaagaggtgttaggttcaaaggctgcgaagagaataggctactggaaaaccaaacccaacagaattcacgtccaaaaatccacattctccatcgcttctcagccttttggctaagattaagtattaaaaaaaaaccaggctctgccaggcgcagtggctcatgcctataatcccggcactttgggagtctgtggcaggaggattgcttgaggccaggagtttgagaccagcctgggcaacatagcgagaccccatctctacaaaagattaaaaattagctgcgtgtagtagcatatgcctttcaacgtagctactcaggaggctgaggtgggaggatcccttgagccgaggagtttgagtctgcagtgagctatgatcgcaccactgcattccagaccccatctcgaaaaaaaaaaaaaaaaaaaaaacagaaacaacagaaaaagcaggttatccatcacttctcagctaagatcaagtgttaaaataaataaataaataaataaataaataaataaataaataccaagttatgagtgcaagaggcagtaaggaaat

SEQ ID NO: 580341 - DNA, 163 bp, Homo sapiens
gggaccagtcactgtgtgatactcatgacaatgtgcctacgcgaagatcttttggagatgaatttcccaggtgatcttaatgcttctggtattgggatgtctacgtctctagcaaggccagtgaagttttcctcaatttatccccccagaatatgttttccaa

SEQ ID NO: 580342 - DNA, 943 bp, Homo sapiens
tagagggaacgtaggccactgggcaccttgcccttcaaggagtcctgtgttgggagaccggccacgcccttggcttttgacctgtgttgaaatccatcttggtggactcgtttttaacccaaactcagtgcattttgtaaaatagttaagaatccaagtcgagaacacttgaacacactagaagggagaccccgcttagcatagatttgcagttacggcctggtatgccaagtcgccagcccagctgttccccttcgggatacatgaggtgatgctggcgcagcagactgcgtatcaatgtctcgcatggtcacagtagagatccccgcaactcgcttgtccttgggtcaccctggcaattccatagcaatgtagcttgtccctgtagctcccacggttcccaggggcctaggctgggtagccctactagcctacccctactatgccgcaggccgccctaccctaccgttaaggcagcctatgggacgcagggcacccatctgtccctcggtcgccgtgtggccagagtgggtccagtcgtcccctaacactcgtgctcgctcagacactttggcaggatgtcttggggcctcaccagcaggagcgcgtgcaagccgggcaggcggtccacctagtaccctactagcccctagggagcaccaccacctcctgtgtgtgatgtagctttctctccgctcagcctgcaagggtctcgatttgccatcgtatttatatatcttacctctacttttttctttatgtgattataggaagtataactactgctagactggcagaattgattaacagtatctgtggggtcagcctctagaaactggtctatctaggtagttcgtggaccctcgtatacagcatatcagataacacgattacgtgtatcgacggtccttgtatacattactttccaggggttatttcgctt

SEQ ID NO: 580343 - DNA, 1008 bp, Homo sapiens
  misc_feature (407)..(407): n is a, c, g, or t
gtgactgcatccggggcctggaccgttgactgtggagagagctcggaaacacagctgcatcatctgtcctgatgcggagtatcttctatacactcagagatgcaatctccaagtcgtcaatgaacttgacagcttcctctatgcggacgtcttcgtcgtgattgcttcatctggcattacccatatcatcctactcactcatccacgatggcttagcaagcattagcaaggctcctcgcgtgtgcgtcgtgcaatggtccagcgtagctatgagaaacaacctatctgtgtgatgggtctctccagttgtcaatccctctgatagactagcttgagtcaatacgaattgaccggtgcgcggaaaatagcgcgagaagcttatgaattcgtaatgttgcacgcgcaancaaggtgtgaaacctctcgagacaggcaaatcccccccgcggaccctgtgtgaacgacaacgtgtacccaacaattgcaatggctatgtatcactgtggcccccagcaagagtaagtcatacataatccagtcagacttggaggcgtgaacactcgtctgcgctggctaggtccgtatgcgctgtccttctcacggtaacttggccctcgaggtggagccttcttcacttgtttccgcctaagacaaggtggcccgacggaacttggccgtatgagctccttccgacactgggaaagggcgtttctatagaaacaggccaagtgcgggatggaaatcggacctaaggctggagagcggggcccaaaggaaaagttaccagtggggcagaggcagcacagtggaacccagggcctccacaggagagcgggacgctgcgctcgctcgcgcagcgggaagggtcaacaaggtacgcgcatcgtacaagggggaacctgggtctggaagcggccaacacaggggggaaacgcggaagcggacggacacagagggagagccccccggcacacggggaagttggaacacgaggacacggaaccgcca

SEQ ID NO: 580344 - DNA, 175 bp, Homo sapiens
gaggatacccgaggcagccagcatccaaaggctgggataaggtgtgagcaccagccggcaatcatatactcattaccttccttacctttcttccttcctttctaatctctctctcttcttttctttctttcttttcttttcttcctttcctttattttttattttttttattttt

SEQ ID NO: 580345 - DNA, 374 bp, Homo sapiens
cacgcgatgagtcatacattacctgttggtagcccccaagtggcgtgcagtgacacagtatcttctctgtcttttcatcattctttgtgtgggcattcggcgtgtgcagcaacaacttcgtccatcacgatctcaacccttggtgacaggtctgtgcatcggcgtgtggtatgggtactcggcgtgtgcagtatggatgttcggcgtgtgcagcaacaacttcgtccatactgatctgattttaagaagtatatggaggttcggcgtgtgcagtttggaggctcggcgtgtgcagtatggtccctcggcgtgtgcatgcacacgccgaggatccagacccttggtgacacaagtcttaatggacgaagttgttg

SEQ ID NO: 580346 - DNA, 128 bp, Homo sapiens
tgagtgccatgtagtgctgtgtactgtcagagtggtcaggtgtatcacatgttcatgtatactcggcggtctagactagtatcagactctgctgctcctcactggctaaaggcagacctgactgtgca

SEQ ID NO: 580347 - DNA, 740 bp, Homo sapiens
ccccgttggcaaaaattctctcgcccaaagggggtaaataacccctcctagatgttgccgcccgaggagttacaaatagccttttcgcccagcaattttcgtcgccccacgggtcattacgtcactctttggcaaccactacggttcccgctctggccggtgccacaccgctccgatggtcccccccccgttggttcgcagtgtgtaggacacacagaatgcgataggggcgagactccttgtgtgtaaataatgttgcgctagtcactcatgtgacgtacgacgggcactatccgatttataaaagccatgtcctggatatctcctaggaggagcaggaagccctctggagcgagctgtgcttggcgcataatacgcctcaggagtccactcgcttagtagcgaggccacgatctcttcgcccgtctccgagatagatggatctcgcccataagatatctccccacgctcgttgataatagtgttagcgagctttcatacatccccctacgtggtgtattctgctgactgtgttctttgaaagcaagatgcgcgtgcacgcactactagaacctaggctcctgaacgagtaggatgattctggtgctatcctatgcccccggtcgggcgattatttatctatcttgcgaaacaggctatcttctatgcgtgtaacaagatgatttctgttcataataaaataggtgaagaaaaacagacacaacaatagatcaagaaat

SEQ ID NO: 580348 - DNA, 1063 bp, Homo sapiens
  misc_feature (393)..(393): n is a, c, g, or t
  misc_feature (397)..(397): n is a, c, g, or t
  misc_feature (405)..(405): n is a, c, g, or t
  misc_feature (410)..(410): n is a, c, g, or t
  misc_feature (414)..(414): n is a, c, g, or t
  misc_feature (428)..(428): n is a, c, g, or t
  misc_feature (432)..(433): n is a, c, g, or t
  misc_feature (442)..(442): n is a, c, g, or t
  misc_feature (450)..(450): n is a, c, g, or t
  misc_feature (465)..(465): n is a, c, g, or t
  misc_feature (469)..(469): n is a, c, g, or t
  misc_feature (477)..(477): n is a, c, g, or t
  misc_feature (485)..(485): n is a, c, g, or t
  misc_feature (489)..(489): n is a, c, g, or t
  misc_feature (497)..(500): n is a, c, g, or t
  misc_feature (527)..(527): n is a, c, g, or t
  misc_feature (890)..(890): n is a, c, g, or t
  misc_feature (922)..(922): n is a, c, g, or t
  misc_feature (944)..(944): n is a, c, g, or t
  misc_feature (950)..(950): n is a, c, g, or t
  misc_feature (955)..(955): n is a, c, g, or t
  misc_feature (975)..(975): n is a, c, g, or t
  misc_feature (986)..(986): n is a, c, g, or t
  misc_feature (991)..(991): n is a, c, g, or t
  misc_feature (1041)..(1041): n is a, c, g, or t
atgagctttatttatatcaaaagatctaattcttaaacattataaaaatttaaactttactttgaaatattttatttaatattttgatttataatgatttgtcttttgccttttaattttataggcaattttgaatattttgaaagaaaagattttgaaaatatgaacaataacttttttacatttaatttacatcttcaatgaaaatatattccagttttgtatactttgaatactttcaatcttttatatcgttattatctctagaacattaattatatacacatcttcaacatgacataattagtaatttttctaaaattgatattacagaatatataatcccaaatacatttttatgacttacttttcattttaacatcatcagactcnaaanagaatacncaggnatgnacaataatacggtntagnnatttttacnttggcccnaaccacattcctgcnacangcatagcnttacatgnatgnggagattnnnncagtaggggggcatatgtgtcacaganggggggcatattcgggttatcagcgtgggatatggagtgagagttgggatagattgaactcgaggtggtgggtagccctcgggactcgggccccaggccccgccatgtgttaagagtgggtctggttactgaatatcttcagcaagggagtagcgtgattgatactgcatttgaggacgattactccagtggagacaatgacatcagttaggaggttgagctacctcttcgtgagtagcgttttctatctgtagctggagcttctgaatgaaccctctgacttcttcccatagcctatcatctgagaagttttgagccctgcaactataggtttccttgtcagcaagttcctggccataggcntatccattttcagaccaggcattttgacagcncaaccacatttctggataaatngaaggncttcnactcctaactaaaaggaaanttgagaatccncaggngtctatcttgagtttcaaacccaggggtcatgcaaaatcaaacaacaccnttaaccccagagattgtgcagg

SEQ ID NO: 580349 - DNA, 398 bp, Homo sapiens
  misc_feature (69)..(69): n is a, c, g, or t
  misc_feature (102)..(102): n is a, c, g, or t
attttaaaaaatgcttaacctatatattgcccatatatgataattcaacttaaatttattcagatagancataacattcagttgactaaactattatttatnaatttattttgagacaatgtctcttattgcccaggctggagtgcagtggcaagatcagggctcactgcagccttgaccacccaggctcagatgatcctcctaccttggcttctgacacgccaccatgcccaactaattttttttgtattttttttgtagagatggggttctgccgtgttgctcaggctggtcttgaacttgcgctcaggatccgccaccctctgcctcccaaagtgttggaattgcaggcgtgagccacgagtgccagcctgggcaacagggtgactccctctcag

SEQ ID NO: 580350 - DNA, 994 bp, Homo sapiens
ggttgaactcagagcctggcatctcctggcgtgggctctggaagtgatcctggggactcgggtattgaggttgatgaatgacttaggagaggtaagtgctttgactctgtggtgtaatcctactttgcctggaagttgtgagtttggcctttccggaacttgacatgtgaggggctctcatcctgggcgaaatcttgtctctggactgagctgttgaggcattacttcgctcacttcgggtgaatctagcatatcgggactttattcatgctcggcattttatcttctagataccgctgacgagtcacagataagatggatgtctatcatgggtagcttgtggagttgtgtatcgctgtccgattgatcgtggtgtgctgtgcgattcctcttgaactggtggcaatcgtggtgtccagcgtctggagcttggcccgtctctttgagatgatgctctggtttgatccataaaagtttcttgggtaaaggatgattgacgttaaaggacatagttttgtgcttgactgttgttgatctctaagctacatgagagtaagatggtggcttgaatatatgccagagagttgtaggactggcttggggggattatgagaattagtacctgcttttggctcgaaagaattcctaatgagaatgattgggggtttgataatccggtgaaaggatgcttggtctgagataaagggtgtttggcacggcaaaagtgccgagggatcgatcatggtgtgccggagtgtatgtgcagtccgaacgaaggggggcagtacgagtcgtgccaatagtcaccgtaaagcgtgtaaggcttcataaaagaaagttggagcgcatgaatatgacgtgcgactgtacggtccctttatacggtgttgttcgggcaccatgacatttgcgaggacaacattgactaccaacatcgaactatacaccaaatgtggagtaacatgactgatatttacctctctctcaataccag

SEQ ID NO: 580351 - DNA, 128 bp, Homo sapiens
cggtacgctatgaggacttattattgtatggatactgacacgtcgtactttcctccaggcattgcctgctgccgctgcctggtgtcacgctgcttccgggggcatacgcagcgggaaatgatacactg

SEQ ID NO: 580352 - DNA, 216 bp, Homo sapiens
aagatgtttcccagacctgagaagcaaggatctaactaacatagtatacagctttgtatcatcctcaagtcaacactactgaaactttttacaaaaagttttaatcaaagtcctccctgaatgttttcaatggagaaaaacttcaatttcatactcttcattgtccagcatttctatggagttttcatgaagtaataactatacctcacagacatt

SEQ ID NO: 580353 - DNA, 433 bp, Homo sapiens
  misc_feature (251)..(251): n is a, c, g, or t
  misc_feature (395)..(395): n is a, c, g, or t
  misc_feature (416)..(416): n is a, c, g, or t
  misc_feature (429)..(429): n is a, c, g, or t
ctagctccaatgtggataaaagcttgcaggaaagtttacagaaaacaatctacaagcttgaagagcaactgcataatgaaatgcaattaaaagatgaaatggagcagaaatgcagaacttcaaacttaaaactagacaagataatgaaagaattggatgaagaggggaatcaaagaagaaatctagaatctgcagtgtctcaaattgagaaagaaaagatgttgctacaacatagaattaatgagtaccanagaaaagtggaacaggaaaatgagaagagaagaaatatagaaaatgaagtttctacactaaaggaccagtttagaagacttaccggaaagcaagtcagacctcaccagcttgcctaatgagaaagctgaccacagttacagaancagttggaagaagcgaatggncttctttgggacngaat

SEQ ID NO: 580354 - DNA, 1068 bp, Homo sapiens
gtgaccatatagcccataacaacggggccgcgtcatctctcctgttgacctccgggctaatgcatgtcatgtgtctcctaatccatgatggtcatcctgctaggctgtgctatgcacaacaatagcgcactctccccatgggtgaccgcgagagtgacatgaagaaagctgatactacggacagcacacctcaacggttctccaaggactatctgatgggataatcctggatccgagttactctcagagagctcctcttcccattcgcagtgaattgtccgtgaacctgtaggatgcagttccagacatgggctcgcatagcccagcagacttaggagggcagaggggctgcccagacagggtgtcaccccggtaagattgcccttccaagctcgccactgctactcagtgatcagcttatcattggacggatcgaagggtgtaatcgtgtcaccatgcatacttctataatttgtcgtcaaatagaaaccattgacggtgccacaatgaactctacccagcattgtgtcaaataaactgacttttgccgtcatctctggttttcccggtcccctatgaggccttcgaaagctaaattcgttatctccacttggtgcgatatcacggcgagggtgttattaccggatcaaggttgagcgtaggccagcgggcgttctcgcggcttcacgtcaattcgtggtggtcaaattacccgtcatgtagtgctgcttcagtccggcgaactaggtatgtgctctcatcatccccaggcatcactgggatgctgaataccgccgctgaatacctggcggtgggatcatgaggtggactattaccggtgagtcttcccactatggcaccggtcttaacgtcactggccttatacgaagacaaggacgacttcaactggtgggggaccttatcccacaatcctgggggtggcaaaccatgacgcattgtaaaaatgccacactagaccatagaaagcggggttttaagcattcggaacaacgtaaagtaggccaagtgtgcacaggccacaaaaagctaccaacattttcatctgaa

SEQ ID NO: 580355 - DNA, 112 bp, Homo sapiens
atctcatatgcggtgagccatcgcactccagcggtgaaacaagagtgagactccacctcaaaaaaaaaaaagtaaaggattagggtctgggcgcgatggttcaccgcatttg

SEQ ID NO: 580356 - DNA, 257 bp, Homo sapiens
gagatggaggttctctcggagtatctgggaactgtgccttttttttttcctcaggctgctggaggaaaactgggactcagacaggaaagggaaagccccacagacaaggtagccctggccagaggcttgttttgtttttttgtttttatgaggtgggatatccctatgcttgcctaggctgaccttgaacctcctgggtctcaagcagtctacccacctcagcctcctgtgtagctgggattatagattggcggcac

SEQ ID NO: 580357 - DNA, 701 bp, Homo sapiens
accgcgtgctcgtcgagctcactggccgcagctctggacattcctgacagaaacaccttgagcttgatggtaccctccagcagcaatggcagtgacggcgttggcggcgcggactgtggcttggctgtgtgtgggctgtgagtgaccatgcaatgccctgatggcttctggctcttgatcatgtcctgagaatgtcgacctgtgggctgcgggctccatcctgggaatgccggtggggccttctgtgaaatgagagagcagtgctgacagagtgaacgatatttccggtgaggctcacctgggtcccaagtccagccctggatctcccaatggccttccaatccttaaactgccaatcgacccaccctgtttcctacctggtgccttgggcgcccccatcccccaacagaactccctgggcccccaatccagtataccctaagccttgatgtcccgaccgttgccaacgtatagggcactctcaggttacgctgcacaacagtttcagtgccccctagaccgtttccacctggcgggtctccaaagacaaacccacggctacactcctcctttatcattaccatctcccgcgatgagttctcctcaggtcgtgcgaaacaccccaaattcttctgcacagtgtcaagatcgactgccaaggtttgctccagctgatccctcggccttaacaactgtaaccg

SEQ ID NO: 580358 - DNA, 511 bp, Homo sapiens
tgccttcatacaccccatctctacctttaagagggagagtgaagtaatgcttacctgaatactgtgtgtatagtcttattggaacaatctcatagattagatccttaaaaccacggctcaacatttcatctgcttcatccaaaacaaacattatgatccatttaggcgctagttagaaacaaagtacatactgtcatttctagatctactcagtgatacaattatgacttatcaactatgttaacagaataaaaaaaactactctcttaaagacaatacttacaaaggtatcttctgtataacatatcaaacactctcccgggtgtaccaacaacaatatgtggtgcttcagcctgaagtttatgcattacatttcgaacatttgttccaccaatgcaggcatgacaagtggctcccatatagtctccaagtgccagaattacctttaggatctaaaacccaagccttaattattattccgcagaactccaggatcaatgactaattttta

SEQ ID NO: 580359 - DNA, 163 bp, Homo sapiens
tacatacttggtccactggtgcagaatcagtgggaaagacacatgcttcaaaatcaaattcgcactgttgagagtactggctgataaaaatagcaggatggagggcccggcgccatggcttaatccttgtaatcccagcagtttgggagactcaggtaggagg

SEQ ID NO: 580360 - DNA, 266 bp, Homo sapiens
ctgcaaccaacttctgcaattcagaggatcatgcttgctctggccatgggaagactgcagagtagaaaggtgatgtgccgacaagctcccgacaatggatcaactgggagcgtatccatcatgtgctttcgtgaacgcagttcgaattgtaagagaaacgcgaatcaggaatgagtttcgtccatttcctagactaaccatggcgcagagcaagcatggatccgtctgaattgcgagaagttggttgcagggccgatacagtgaaa

SEQ ID NO: 580361 - DNA, 221 bp, Homo sapiens
agcacaagtcatcaacaaactgagtaaactattcttgaggggcactgacaacgctgttctttgacacttgcatttatatctttttacttgcaacaagaatatactagtgtatatgagtctgacagtgtgctagggtctgtatgtagggcaaccactgcactgatgcccatcaattttgccacttcaacaggctcatcacacattcacatcagttagcctgt

SEQ ID NO: 580362 - DNA, 193 bp, Homo sapiens
ttttggggcccccccccccgggattttttcggggccggggggcgggttcgcccccctgtgtttttttttttggcccctccgcccttctgggtcccggggttcccccccccctggggttttccttttaaccttggctcccggaggggccgggggggtttttttttttcccttttacttttggtttcccccccca

SEQ ID NO: 580363 - DNA, 209 bp, Homo sapiens
tcatcccctttggttttttacatacaagggctggttttgttacccaggctggctttcaaggtccatagtctttaagagatcctctcaccacagtatggccaaaagtgctgggcattgcagagtgctgattcatggacacccatgactttgcgtgtcctttacttacatggatccaggacccatgaacccaaagcgtcaggcactcgtat

SEQ ID NO: 580364 - DNA, 236 bp, Homo sapiens
  misc_feature (200)..(200): n is a, c, g, or t
gtagctagcgctgtctcacggtcctccacgggagctggcgctggctgatggcaggtgcaggagcacctcgcttctctccggatcttccagcaccttcacttcagctttatccgagacaggcgagctccactgcgaccaggctatcatgggctgagagtagtctcatttctcatctcacacccgacacacctttccatggngagtgaaacgtgccccgaggtgcctgtgtccaggtt

SEQ ID NO: 580365 - DNA, 360 bp, Homo sapiens
cacgaggaagaactaccaactggctgaaaatgcttgtaggatgggaaaaatacaagaacactgaaaagtttcatatgcgaatttacaaaggaatatcactccagctcacaggtgaactctggggcctccttcttgagatccctaagatgatataagagacatgggatctgtatagtacattaaaacacagagcacggtgctgttcacctgacatcagacacatacacctgcatgtcaaccgcacatttcgggaccacattatgtttagagacagatatggtgttaagcatcaatccttattccatgtgcttgctgcctactctatttataacacggaagtcgggtattgtcaggggatga

SEQ ID NO: 580366 - DNA, 1070 bp, Homo sapiens
ggaccacacccacggtgaccacgccctcgctagccgcagaaggtgggctccccgcactcgaccgaggtggacgagtccctgtcggtgtcctttgagcaggtgctgccgccatccgcccccaccagttgaggctgggctgagccctcccgctgcgtggaccccgggcgcgtgcgctcggcgttccccacacgatgtgtgacctgtgccctggttgtcaccctgttgaattttgagcatcgcaaggcggtggccaaatggccacccggcacctggcgtcccccggcagctcgaatgacatgcaagtgcccggtcacaggaatcgggcaggtgggcttgggggcctgaggagacgccagccacatcggtcagcgatgtcccttgaccaccctgtctgactcggatccctgtgcccctggtcccccggtgccggcagactcatgacgaagacaacagagggcttcggagtccctcgccacagaccctttgccctgagcccagtacaaaggtgcacgcacaccactggctgaaccaatccagcatcctgacatgccatgaacaccccgtatcatgacattcacctactcaatcatctgcaacaactcaatactgtactaaacctttcagaccagcaaccccattaaactccttgcaccacgccacatacatacacaacgaactacccgctcacccaaattaccataccactctgcctaaatacactaataatatcctcagggggccatatgcctgcaatgggtgtacaccagagcacaacgcgaaacactatcagatgccctacggtggattacaccccaagcatgaaacatgggactcgcctcgtgcataaccaccctgactccagaaatcctaaacctcaaaacacccgacacataagcttgaccaaacttgaagcaacatcacagcacaagatcccaacacacgcaacactactcgacgatatataacccactccctactactcaccatcctcgactctccccgtcaacacttatatacatacattcccaccctacaaaatacttctctcaaacatctaaaaacataacaac

SEQ ID NO: 580367 - DNA, 267 bp, Homo sapiens
tccttagtgtcaaaggaaaccatgggaacgcagcatccaatttgatcgacaggagacggggttagcagaccacgagggggtgtattagtatagttctatagctgtttccacgtgtgtcgtgtaattcatcacaaggattttgagaatggaaactgtcactaatcaaatatacaaaattaatgagtagtttacaccattgcaaagggtaggtagtgaacagtcgagcagaacaaaagcaataagactctctgggcacatattatggag

SEQ ID NO: 580368 - DNA, 178 bp, Homo sapiens
attttgacttaaaaagatgaattgggaaatctttttttctttattttagggtcaagaggtacatgtgcagatttgttacatggggtaaactttgcatgtcaaccggagggagggtttaggtgtccatttgtttttgtcaccagggtaatcagcataatacacattaggtagtttaagt

SEQ ID NO: 580369 - DNA, 322 bp, Homo sapiens
  misc_feature (34)..(34): n is a, c, g, or t
  misc_feature (44)..(44): n is a, c, g, or t
  misc_feature (284)..(284): n is a, c, g, or t
aagtttgatcggcgaagaaaccgagatttttcgnaagcgcgccnaatctccgctgcggcaccgtcatcgtcgctcgcccaggaacacgactctcctgccaccatgtacggccggatcctgttcaaggacggcagcgcccaaatgattgaaacccttaaccagtctgccgccagtgaaggcctccgcgacggcccaggaagaaggttgtccccccagctcctcaggaggcactccgtaggcattggtcacatcgacgatgatcttgcccgtccaggtgggcaagnccttcgcgacatctcggtgggactcgaaacggacagcc

SEQ ID NO: 580370 - DNA, 981 bp, Homo sapiens
taaacttcagtttgaaatacaattaaaaacaaggggtagcagggagtggccttcagaacagttagagtggcagggacacaacttaaggccgtggcttctggggccaaagacacgagccctcctgtggggagcctgtgtgtggggcccccttcccttcctgtgtgtaaggctctcgatcgtgggggtgtcgtgacactttcgtgatttatacatttctcaatactgtggtctggggtgcccgtgggcaacattgtggccttctctatctttctcgtgcttctccagacgtggctccgtggtgtgtgggagggtgacaaggcacacggggccgtgacagcgtgaacgccacaaacgtgtgcagggtgtccacagagaggatctgtgtgcgtattccactgtggaggccgtgcactcagacagggtttcccactctctagacacgccgggctctccaaacattaaagcgaggggttcctcaacaacagctcacaagacactccaagagacgtctcctctcacagcgggtataataggggactacgtgggaactaatccgcgggggggacacacacaacaaggcgaccaccaaagagcggtgcttcacgtggtgaacgggacgttggtgagagcggcccagcgccccatattctccttcacgagtgagccaacacacggggttgaagccagtatcccgggacgccccaccatcacccaagggtggacccctttgtgggggagaacaaacaccccggtgtactgtcgggcttcctacacagagaacgcacgacaacacttcccttccgagggaggacaaggtcccacaaggtaacgagagcccccccaccgaaggggaggaccattattatcgtccattaccccccttttgtgcgtcagaggcgctaccgcggcccacaatcaagcaggcacacacttaggggggcggccacaccccataatacaagtgaaacagccattcacacc

SEQ ID NO: 580371 - DNA, 851 bp, Homo sapiens
gtggagaaaatttatcacctaaaatatacccatcagtataaggcaagcaaaagtcttaacatggcagccattctgcctttgccgtggccctgtcctgtttagttcttagtgggttaatttttgtactttgcagaagaaacttcagcaagctagaactggaaggtactttaatttttcatatatattgtatttttttttaaatggaaggctcatttacttgaaaggtaaaaactttcactgaatacaaatagaaaaagtgatgtgttaatatcatatggcttttggtccatcttgggggtaagttattactcacttcatgtttttcacctataaaatggtcaagctagcaaaaaacactctggttttcctacatggggagagaagagacctgccagattatcagacctcttcacggttcaaagaccatctcctgtaaaactgacctagtgggacaagcttgaattggaactagactggtgaagtaagcctgtaactggtcattaaattggtataccacggtaacggacttagatgagttattaaatacccaacgataagggaaaaaggccgcctaaatctatgagaattcctcggggccaacaagcacggggggacacgaacggtgtaatcgagtaagttatgggcagccattaataagtcaaaaatttccagaaaaaacaaagcaaacaaaaattgtggcgcgtcccctgcgaagctcagaacacagtgggcggcggccaatggaagggaacggccacacgcgaccacagaccggcacacaaggggacacaaaaaaccgggacaggtgcgaacacaggcgagaagagacacagaaggccaacacgcgcagg

SEQ ID NO: 580372 - DNA, 360 bp, Homo sapiens
gccatgatgaacagtgagcatgtccttattattcaatgggtctgtttacagagatggtggtaatttacgttcttgtaaatttgcagcaatttattaagtaaagacaagttatagtctgcagacccgagaccaggacaattcctccgatgaaattggctgcatcaaaggtagactttcgcacaggttgtgaggtgggaatcactgtggttgtttgttgtacctgatgtagtaactgtcttggaagttgtagaaggggagggctgaactgtgggtttagctgtagaattggctgttggcactggagtggccgtggaaacggaacagaagtctgtcgtgttccccacttgacaatcactaact

SEQ ID NO: 580373 - DNA, 260 bp, Homo sapiens
ctgctgcttttgacgtctagagtgatcccatcaggcgattactgtggggagcggggtccggtgtgtgagtgccttcgtcctgggcaaactgtgtgctgcggctggaaaggtggactggcggctcgcccgtcactgcaccggacgttcgtggggaagctggagctaaaccattcgtagacgacctgcttctgggtcggtggtttcgtaggtatccctgagctgcctcgccacagtcttctgcctgatgtggtaccgaggct

SEQ ID NO: 580374 - DNA, 181 bp, Homo sapiens
gatccccctatgtctcgtatcgtactaattcatttcttcagtctttatatacgtatatatcacccttgacatattatatatcagttcatttactatctgccttccccatcagaacataaattctataacaacagacactttgcctgttctgttcactgctagaattcccaagtactgagaa

SEQ ID NO: 580375 - DNA, 213 bp, Homo sapiens
gcgagagagagaagatcggggggctgaaatccatcttcattctaccgctccgccggtgttggtggaatgagcgtagcatggtgtcttgaagagaaaagcatttgcttgggcaggactctattcagcccccacctagaaacatcaccgctcagagaaccgagctaactcccacacatgccgtgtggtccttgacactctggacacatgggtcgc

SEQ ID NO: 580376 - DNA, 306 bp, Homo sapiens
tttttttttttctcagttagtttagaaagtttattttgccaaagttgaggatgtgcccgtgacacagcctcaggaagtcctgacaacatgtgcccaaggtgctcagtcacagcttagttttatacattttaaggagacacgagacatcaaacaacatatgtaagaagtacactgtttcggtctggaaaggcgggacaacttgaagcaaagctaggaagacttgaagcagagaggaggcttacaggtcacaaataggtgaggcacaaatggttgcattcttttgagtttctgattcgcctttccgag

SEQ ID NO: 580377 - DNA, 204 bp, Homo sapiens
ggacgaagactccgggaatagccttggtctgcccaacagaccattggctaccttctcatgtctggtcacagagtaactgctttgtcgtgggtacctctccgtccaccttcatgtacacagtgggcacctaccttcacaaatgtactgtgaacatcatgcgaggcttaggggcgcacgtgacattaggtgtggtccaagggggtt

SEQ ID NO: 580378 - DNA, 154 bp, Homo sapiens
aacgccatctcctaatgaccaagaccccatacccacctgtgtgacgctagcctttttatacactgtcctcctccaccttgatggacccctattgatgcatcctgcctaggctggacttcaccccttcctccctgtccccacgatccaactgtcc

SEQ ID NO: 580379 - DNA, 235 bp, Homo sapiens
tcctccaaggtactaaagaaatacgggagaggggaaaaaaaaaggtccttcttgacacagcaccatcttcagaatgttaaaaaaaaaaaaaaacattctctcctttctatctcccattaccacaataaattcaggggcaaatccatggccgccttgtcccctggtaacaaagggtgaagccgccctccgggaaacgtgaggacagggctcctgatgcgcaggcttaaagctctcc

SEQ ID NO: 580380 - DNA, 129 bp, Homo sapiens
  misc_feature (95)..(95): n is a, c, g, or t
ggaaaaacgtttaacttttatttgatgcttctgaacataataaaataaatgaacctaaaacagcgctataggcatcctgctagggattatacatnccatttagggtaaaatacatgggaacgatccgca

SEQ ID NO: 580381 - DNA, 105 bp, Homo sapiens
  misc_feature (105)..(105): n is a, c, g, or t
gaattcaaaacgctgcacgcagcagtacttctagagtcttccacgcttcgcactagctttcaccacccggtttgggggtagcacaccaagacagtacccatgttn

SEQ ID NO: 580382 - DNA, 295 bp, Homo sapiens
  misc_feature (64)..(64): n is a, c, g, or t
  misc_feature (158)..(158): n is a, c, g, or t
  misc_feature (270)..(270): n is a, c, g, or t
aattagccaggcgtggtggcatgcacctgtagtcccagctgcatgagaggctgaggcagaaganttatatgcacataggaggcagaggttgcagtgagcccagatcatgccactgcaatccagcctgggccacagagcaaaactctatctcaaaaaanttaaaagaaaaagaaaaagaaaaagaaaaagaaaagttaaaaggcaggtataagatgatcccatttatgtaaaacatacaaagcatacaaaacaaagttatgtgtgtatgtntaaaaggatgttaaaggatgttaac

SEQ ID NO: 580383 - DNA, 813 bp, Homo sapiens
  misc_feature (50)..(50): n is a, c, g, or t
  misc_feature (60)..(60): n is a, c, g, or t
  misc_feature (64)..(64): n is a, c, g, or t
aataaatcccttcacagagaacaaccgaaataactaaaaaaaaagtttanagtgactccngctntctttggcgtccaaccttagaacctcaactgacatatagcattgggcacactccagcagacgcccgaattcaaatcctggaaggatggaaggaacgcctggagaatatttgggatgagacaccactgtattttgctccaagcagcctctttgacctaaacttccaggcaggattcttaatgaaaaaagaggtacaggatgaggtttttttcaagaaatttggcctttctgtgggccatcacttgggcaagtccattccaactgacaaccagatcaaagctagaaaatgagattccttatcctggattcccttctaacatggcataaaaactgggactctctccaggctagcctgacttgctttagattctaaagacaagtggccatcttcctccacaatgaataattgacagggaatagactgtaaaaaaacaaaatgtgctctatggcctacacgtaagaatctgaggaccgctaactttattgagggacacttcatgatacacgctcactgacacgatgctaacgaaccgatagcatgacgactactacacacggcccccaacggcaggtttcaggatattacaagcagcgcgggggacccgaggcaaagcccgacatataattaacatcaaaagaactaactcctcaacgagccatatgctagacctattcatagggagcgcttccatagaactaaaaaacgacctcctccatatactttgtacgccccgccgcactcctaaaatc

SEQ ID NO: 580384 - DNA, 276 bp, Homo sapiens
tgactcttgaggaaacactgcggtctgctatatctacattagcatggagcatctgtcacagactaatgacccaatattgacacattactatttttggttttggagacagagtggggctctgttgcccaggctagagtgcaatggcacaatctgggctcactacaaactctgcctcccgggctcaagcgattcttctccctcagtctcccgagtagctaggattacaggtgcctgccaccacacccggctaattggtgtatttttagaagagacggg

SEQ ID NO: 580385 - DNA, 385 bp, Homo sapiens
  misc_feature (172)..(172): n is a, c, g, or t
tcggatacgtgcatcaggttgtgggctctcccaggtctgagtgtaccaacctcctcctcgtcctcctttaaacagaagtcctcaggaagaggtctgctggcctctggttctgaagcctccatatccttgtccgggcttgctattcttgcagcacgctctgtgtgatggtccnatatgcttcatgttcagcaagctccgcttcaaaaatgggggtccagtctgggcccatcagtgttgttcagtgtgctagctctgtctagggccagcgtgtatgtgtcaacttgggccagcttgttgctcttgactgcagttggctgctagcttgctttgccttccttcgtggagacaccgcatgtttcatcttttcccgctgcaatacacttgt

SEQ ID NO: 580386 - DNA, 517 bp, Homo sapiens
cagtctcattttcccctgaggctagctataagaaactggaatccctgttccccaacgtgggttatagaaaccacaattccttttccccaaagccagccataaaatctgaaaatattactctaatttttcttccgctcttctgtgtaaaaactggccataaagaaattatcttacctaccttgtctaactgaaggtaataagatcctcatttcaaaaaaggcccctgccacatagccaaaaggaagaagtgcatgctcagacaggtcaagaagaatctagacagacaggcctttctgggtttccctactcaatctattagtattaggtcatatcccttttgtccagtcatatttcttcatgactgttcataccttgttgaacctaaggattaaaatggtcaattttccctgtgtctttggtcttcattctgaaggcttatgttggaaatgtggtgttcaaatttcatgtaaagctatgatcaaataaatttgtatgccttttctcctcttaaaaaaaa

SEQ ID NO: 580387 - DNA, 590 bp, Homo sapiens
gagacgggggtgggcgccgagcagcgccggcctggcctgctgatgctcgctggggcctgggcctgtgagaactgcgctggggcgcgccggggcctgatggtctcccatggccaggggcgcctgggacccccagagcccatcagcccggtgcagcgccttgcggccctccggcgcgccgggcaaggcaagccgaggcgggtcgacaggattggtgggaatgacttagggacacccgggaagggcagtagggggctggaaggtatggtgggcatggagctttcaggggcaaaatgtcacacactgggaaggggaatgaagaggagttgggaacaaatccccacagatttaacaccagggtggtcccttgtgaaatttgactaagatggggacttctccgtggttttgggtcacggtcttccagtcataaaggaaagttaaaagagatcagattcacggaagagaaggaattcgcaaagagagggggttaaaggaagacgaagcaaagcaaccagtgggtgactggagaaatgaaaggacttcaaagggaattctgcacaggattcgaacagagacgcaactgtgactatgac

SEQ ID NO: 580388 - DNA, 528 bp, Homo sapiens
ttattacgccccaaactctaaccctaaacttaaccctagctcctaaccctaaaactaaccctagctcataaaccttaacgtaagtctaaccctaacaatagatttaaccttaacctaaccccctagaataatattttaccttgtggggactaataaaatgtccccagttttcttttctttttactcttcttgtgcggacacacaaacaaacgcacacggctcactggagtgtgtaagggctgttcagagagaacccttcactggagtgtgtaagggctgttcagagagaacccttcactggagtgtgttagggctgttcagagagaacccttcactggagtgtgtaagggctgttcagagagaacccttcactggagtgtgtcagggctgttcagagagaacgcttcactggagtgtgtaagggctgataagagagaacctttcactggagtgtgttcagggctgttcagagaggacccttcaaatgaagtgtgtaagggctgttcagagagaacccttcactggagt

SEQ ID NO: 580389 - DNA, 475 bp, Homo sapiens
tgacacagagaccttgttcacgtgtttatctgctgaccttctctccactattatcttatgaccctgacacatccccctctccgagaaacacccaagaatgatgaataaatactaagggaactcagaggccggcgggatcctcgtctgctgaatgccggcccctgggctcccttttttctttctccaaaaaaaaaaaaaaaaaaaaaaaaaaaaaatttttgggcggctgggcccggaaaaggtttttaagacccttacctgttggggggccgcgccccagtaagttaagctgtgcacctgggccaaacgatggtcccaaggagatcccggctcaaggcataggggctggtttctctacacaattaaaaaagcgccgggggcaacccgcgtgtcgtgacaaatccaggtgggagtcggagccaccatacggttctatcacgggagccaaacgagcgaataaataccggagcggata

SEQ ID NO: 580390 - DNA, 446 bp, Homo sapiens
gaaactaatataaggtacactgcttttgtctgtttttttaaacgtcattctttctctctaccttttcccacacacaaaacatacctcacagatagttttcaccaaatcacagatcaaagaggaattcatccatcctattggagactgttggtgtatcagcagtggccgttttccaactcttgaactacagctaagcagtacagtcgcaacacaaggtcttctgagactagctgcaactgaagtcatgagttcactctggcctcatgtgcctctgcatgctggctcccgaggttgccaggctaagatggagaccacatgctgtcaatattaagaccacttctgaggtggatatgtggacatacccgtcctcccgacatttgagagcctgaagtttgtgaagaaggagtttaaggctgtcctcaactacatgaggtcatgatctcact

SEQ ID NO: 580391 - DNA, 430 bp, Homo sapiens
caccattgcactccagcctgggtgacagactgagactctatctcaaacaaacaaacaaaagaatagggctatatcctgaacataaaacaacaacaacaataataataaattctaaatatcaattttgagccatagtttataaatcacatattctggatgaggccaagccaggtatgcggcaggccctgtaccaggcactgcacatggagtgatgggaaagatcaacaatgctctgccctcagggaacttatattctagccagagagacaaacccaaagaaaggaaatacaataatagcacattgtgatgaatgctgggaaagaagcaaacacagtactggaatccaagataataagagactacaattgactggcctctgaggagaagacatttaagctgaaaagctccattattagatgggtcaaagggg

SEQ ID NO: 580392 - DNA, 1265 bp, Homo sapiens
  misc_feature (346)..(346): n is a, c, g, or t
  misc_feature (973)..(973): n is a, c, g, or t
tggtccgcccaagtgcactttccagtactccttaccatgttaacaacttgtctcccctatataaatgcgtagggggtttcatggtaaattgtcctttgaaggtattactatgaaggagggcgtcagcgggcgcgggtgtcgtactcgcagctttctaggggccgctgctatcagaaatcaagcgactgctatctcgtcgagtattagctgtgctaaatcgactccttactgagcccttaagttccactaaggggcatacacgataggatttcctgggggtaaaaaaatatgttagctccgaattttcgtgtgcctcacctctaaattggggtgtacaccctattgnacctataaacggatttttgaacagtgaggatcactttcgcaggctatagcatttgtggtaggcgcttttccatctcagggggtagcgctgacaaagtggcgggtataataatgagggccgtggaacccagagaaaggtgtggtatggaagcgatatgacacacgggagaagattaatagtagcaatttaactcaaatgatgaggggcagtcacccctttaaagagggggcactcgtgaaacaacgactccgcctaggggttcctttctagggaccttgtttaagatgacctgtgggcgtggactatcgacacaattcgtgtgtttcctgggggccagcacagccctgggtctatttcggggtgggacctttgcaacccttgtcggtttgctgggacagccggtgttgtaggtcgagggccattaaacgaaccatttgaggggtggcggaggttcatctacctgaaaatgtgcccgctaagttgtcgcgcgggcgcctcctccccacgtggcacaatttgcgcgggtgtgggtttcccaaggagaatccttggtgtacaataggcgccccaggggtttatccggtggaagcgctgcaaacattaactcccgtgcctaggttccgagancgagtgtacgcagttctattcctggaaaagaccaagccagtgtgcacataagcagatgagaatggtctataccaccggccatactactagtctcgggaggacagggggagagaagtatacaagtctgcaaataagacccacttctccattttgaagcaaacaggcggtgggtagcacataaatggaagcagcgcccacggggagagtacaacaaatctcagggtggtgtatagccaccgaagttggggtcgacgagctgcgctcacgtaaaccacattggaaccccataccc

SEQ ID NO: 580393 - DNA, 104 bp, Homo sapiens
aggatagcgtcagattagcacagcattatttgataaaccagcacacaaaggtttaaaacagttttgagaagtgaagttagctgtcttgaggtcaaggggaatcc

SEQ ID NO: 580394 - DNA, 855 bp, Homo sapiens
  misc_feature (491)..(491): n is a, c, g, or t
  misc_feature (549)..(549): n is a, c, g, or t
  misc_feature (586)..(586): n is a, c, g, or t
acccacgcgtcgcggacgcgtggggccacatagtgctgtgtgctgagctgacctacactctggtccacagaggaagcggaacgcatggtgtataccatgtagcacgaatgagagcaacaggcaggggagagaactccaatgtgcgctgaacaactttgatagctgcagcacagggccattcgaagatgctgactacgagcttccgcagtcgaagctcatcgttggagtacgtcataggcctctgaaggcgggagaggtccaccctttaattcatgagatccttgggggaggccttatgcgctgtgtcactagtcttcccggtgctccgaagcgagcaagacgacatgttccaatgacatgatgtttgtaatgtgatacgaagtatgcgaacgagcgtgtgcggcgtcgcatgggccgtacgcatgcagagcgcacctattcaacccaaaataatcgtggcggacataccgattgtaacccaggttatagtngaacgcacagttcgcaaatatgtccgtcttagacgcacacacgtacacaaatggggcntacgcggcacgtgaacgcaaagtagcacgggacctcntgtatttgtactgaactgcatgtggtacacatcttgaaaaggggcgcctcgtatacgcgtaccggacggttcgtcaaaaggccatatcgtattcgccatataaatggcgggcaagggggcgacatgcaacaaccattggtcccgttttcggaatgaatggcacataaccaggttatgcttcagattctcaaatccaaacatagggggcgcatgccaaggctccccctgtggaatgggactcccaaaaaacaaagacaacatagatggca

SEQ ID NO: 580395 - DNA, 173 bp, Homo sapiens
tctcttcccttgcactattcgggagtttggccaggttgggggagcactatggattaaaaaaaagataggcacactcatgacatggtgggagagcagttaagcagttctgatctcaagggcccactatgaggcatcagtatatatacagggccagtgtagggcatctcgtgggc

SEQ ID NO: 580396 - DNA, 373 bp, Homo sapiens
atacccagtgtgtttcctcttttctcttccttggtagatttgatgccagaagaaaagaaaattttagttatgaaaaaaaaaaaacttccctgtaaaatagaaaggaaagttccattagcataggcttataaggaagtatattatttggaagactagcctgctatctggtctttctactcatataatttatttttgtttttaaattttttttctatttttagtagagttggagtttcactgtgtttgcgggctggtctggaactcctgacctctagtgatccaccagccttggcctcctaatgcctatttttattgtttttgagatagggtctcgctctgtcacccaggctgtgagcagtggcacaatcttggc

SEQ ID NO: 580397 - DNA, 406 bp, Homo sapiens
ttgttccagtggctctcggagtccctgttgagtgcagggaacatgatggggaggactctggcagtattgtcacttatgaggctcatgatgtactgattgttccagaaagagagagcacgctctgccacctggaaatgggggctagagacacactcggacagctggcggaagaggggttccatcactttgtggagaataaagcaccctatgtacacagacaaaagccgtactgcctgcgcccctggaacctgggtgcggtctttctcagaccctggcccctccaaggtacctataagggacaagataaggcctgtccaacgtagcacacacaaggaaataaataggtgttggcaggagccatgcttggggcaccgatccctgctatcttctttgtagttttgggaac

SEQ ID NO: 580398 - DNA, 699 bp, Homo sapiens
aagaccagcctgcctcgccctcattctggcatctttggacagaaggtcacccacccctggcaagcaaatgccgtggatgtgcgcacccagactcatcgtggccctggaccagggtggatggtgatgggttgcccaacccagatgaaagtcttttccttgacccagggggaccagtccagttttgccaaaggactcttatacctgtttaatatttgtcttcctaattgggataatttgatgtaccagattgactagaagtgaaactgccaccactaacttccccctgctgtggtgtgacctgagattggtgacaccggccacagaccccacgagcttggcttttgaaacaccactcagggcttttgtgaaggttcccccgctgagatctttcctcctggttactgtgaagcctcgttggtttgctgctgtcgtttttgaggagggcccactgggggtaggagccgttgaacctggggaccaacctcacttgagctgtgcctagaccatgtgaattcctgtgttgctaacagaagatggcccgtaagctcctgtgctccgcgagggaagcatttcctggtaggctttgatttttctgtgtgttaaagaattccatctactcatgatgtgttaagcattaaacctttttggacctggatttgtgttccccttaaatgtggaaataatcctattttttatgga

SEQ ID NO: 580399 - DNA, 359 bp, Homo sapiens
  misc_feature (40)..(40): n is a, c, g, or t
gcggagctttatcgcgtacagttgcgaagaaaaacaagtngacatgccaaatgactatcgccccgtcacactcaccctggtcatcatgaagtgcttcaagaggctgatcatggtccacatcaaggacagcatgccagacacaccggacccactccaatttgcctaccactgcaacagatccacggaagaggccatttctatcgcaattaacacatctggacaagaggaaaacctacagtatgttagaatgctgttcattgactatagttcagcattcaacactatatgtttccctccaagctcgacacccagctcagagcctgggtcttgacgccatcctccgcaactggtacggcggg

SEQ ID NO: 580400 - DNA, 411 bp, Homo sapiens
  misc_feature (1)..(1): n is a, c, g, or t
  misc_feature (363)..(363): n is a, c, g, or t
  misc_feature (398)..(398): n is a, c, g, or t
nactttgctcaggaaatatttggttgctgaaaaagagctttgctcagcagggtcaaatataaattcatcttggcattccaacttctcaagaatctggatcctccccatttcgccttggccaggtagtaaatctcatttggttccttcctgtttgtcattcatgccttcacatctttgcttacactgggtactccatgcttgggactcttgttttctaggggcctatccttcctacccatctaaatgccactccaaaagtcttaaagcttgctccctggaccctacatctttcttctaggccttcctatggcaagtaaggactggatcttggcccttctctggaatcccggcagtactcattgnggggagggtaaattgtttttatccccttaatcatnttcaggggggcta

SEQ ID NO: 580401 - DNA, 380 bp, Homo sapiens
atcgagcttaccctctcagctcccaaagtgtaggatacagcgtgaccacagccagcccctgtctcttttttaaaaacacaatttaacagcagaaagacaccatctgtgctgttagactcagattcttaataagctagtacttcttaattcaatcactaaattattaagaccttttcactgctccctttataaagtcttcttgggagtgatataagtgcttcttataaccaagctctcaaagagaagataaaattaaaatctgatgggtaaccattaacaataagacaagtggggtacccaatttctccgaggacccctctctgcaacagagagctatactctttcttgggcctagtaaacctctgctcttaaccttaaaa

SEQ ID NO: 580402 - DNA, 388 bp, Homo sapiens
  misc_feature (195)..(195): n is a, c, g, or t
ggatcctctgctcctctatgcagagtgtatacaatgtcagcactgtatgtatcatgagtgtgatttactgcccgtgcctatcggtacttgcttcacagaaggtcctaacttgcaagaacgtgcccaatgtggcgtggctacatctcacgaggaaggacgcgcttgttgatgtgacgagtgcgcgccactgctgangcctgtgggaagggacattggttcgttgaacttctcccggcagtttccgctgcgaatgcaagacgggttactaattttgacggcctcagcaggatgtgtgttcgttgtcaacgagtgccagcgctacccccggcgcctgtgtgggcaccagtgcgagaaaacgctggggctcctacctctggagctgttccgt

SEQ ID NO: 580403 - DNA, 230 bp, Homo sapiens
tggtgggatcattgcttgaacccgggggtggaggctgcattgagccaagattgtgccactgtcactgggtgacagagtgaaggagaccctatctcaaaaaaaaaaaaaaagggcctttggtattcagttttaaaaatagctctaaaagagtcccagagtgacaggtgaaaaaaatgtctttagttattaataaccatcccttttccaccacagttaagtttatgttaagg

SEQ ID NO: 580404 - DNA, 864 bp, Homo sapiens
agcgggtcactggcgctatcggcggacccggctggcgcagttgcttccccagaaaggagagattcctctgccatggagtcctacgatgtgatcgccaagccagcctgtcgctgatcgagcaagcggatccggtgtgattgaaacgtcctggttctttcgctggtgatcagatccccaaatactgcttggctcgaaaactatgtgggccgacccaacgcaccgttcgttgtccatggcagagagccctctgaagagcgacgatcgttcatctgagtcccacacgtctgacggagcaccagacgggctcgcttctcaactccgcctatcccactggagcatggcatcggtcaaggcattgggaacagacatggaaccgcatttggcaataatggttctacattcctgaattggcactcacggcctcgacgagacatttcttctaagcagggggagtccacttccttggtgtcgtcccgtggagcctggaaggggcgccctttgtgagcagcgccaacagacaaagaaaagcccggagtagagcggacggcttgccccgtaacagttttctcctttcagacgcagcccttcacactgtggccccagcctcctttttcagtctccactgcgcaagcttgtaactcaacgctcctttacgcctaccaaggcagggcaccagcctggggttgcggtgcttggagtttctgggcgcgagtggcgagtcgccccattgcttgtgccccactgcgtattgagggtctttgccgatggccccgactccattcatgcgccatcggagatcgcgggggcgggaggtctctccggttccctgcgcctctaactgcgtagaggaggggtatgatgcca

SEQ ID NO: 580405 - DNA, 174 bp, Homo sapiens
ccgcttctgccctcacaagacctgggagaatgtaggtccatggcagattttcatgtggacactttagtacattttatgcaggtagtttcctgacatatttaacattggtgatatagtaaacaataagaaggtactaacagtgcgtgggacttacagcgtatgactccaactgcg

SEQ ID NO: 580406 - DNA, 175 bp, Homo sapiens
accctgatagtttcttctccctccatccctgaggttctggccttcccaaactgcttttgatcttttgattcctctgggcagaagcaggaagcggcagaagcaggaagcagagaccgagacaggagagagattcaaaggttctagtctgaactgaacgcttgggggacataccttt

SEQ ID NO: 580407 - DNA, 142 bp, Homo sapiens
tgtcttctggtatccagttcctcctttattgtctgctcgcctgttctcagcatccacccggcgcagcatctcatcctgaatgttgcttcttggcctcacctagggctgcctcatgcttggccacctggccccgagcgtaagt

SEQ ID NO: 580408 - DNA, 504 bp, Homo sapiens
  misc_feature (344)..(344): n is a, c, g, or t
gaatccctaattggtccggccgctgcatggacactcatcacagccagcgcagctgcggaatgcagcactccattctaaggcatgcagagcacatctaactgatcttctccctgaacaagaataatcactggctcatgtatcaggggtgggaggttggggctgtggaggagaggcagaaagcagaactaaagccttcaaaaaccatgatgcccaacgtttgctgaaatatttttgtctgtaaagccaggagattttgttgcctgcttttgctgcacattaagaggatgctagaaaaatcaagcttgtttgcttctgcattcaaagctttctagatgcaccaactntaaaaatcggtttcttcaagttaactacgtagatttgttgttccaaatgcctctagcctcgacatgaatcccaccttttcccccttcctgttttgcctggttaaaagaggtgcctgcatgtcactattacccccctccccaaatgagaaaaggatttggt

SEQ ID NO: 580409 - DNA, 934 bp, Homo sapiens
tgtttaaccctgcacaggtaccagatgcagttcaagttcattggtacacccttcaaatttagatccttgtcagaaacaaggatttaaaacatctgagtagaaggtagaatgtagacgtacttcatcaatagaagaggtcattgaccagaccaccgctcttgataaggagaggcaggttttccgacgaagacgcaaccaggatgtgaggagccggtacaaggcgcagccagctccaccggaattgaactcggaatcggaggactactcccccagctcctctgagactgttcgctcccccaattcgcccttttaataagacccttttactcgaagtcctagcttaaccctttaagactctgagatttccccctccctccccaaacttctgtaaaacaggttcatctgatctatctagcactcagtgctgaccggcagaacagaaagtgtgtttgggtacctttgtagcaagttccctttactgaatgagaaggcatgtggtgttgtgacaatggtaatttgctgctaattggggtccttaaagggttaaggctaatttgcgattttttttttaacatagaagtaatgaatgttttcatcagtcaaactaggatctgcagtatgtaacatagcaatgttagccctctgagtgcatagaaattttcttgaaaatcctggctggggggaattttcaggcctggaatatttcacagcatatttgctggaatttctggccgacaaggggttgttagaaccaaaaaagggcccgcagagagtttaggtgtgctgggaacttctcgtggggtaaaaagagcaggttagtcaggagaggcactttttgattgagagggaggcataaagggagtgtgaaactgggttgggaaagtgggggaccaaaaggtgcggcaaaagtaacacggggtgagggaaaaaatag

SEQ ID NO: 580410 - DNA, 345 bp, Homo sapiens
ggcgactccagcatcatgttaggaaaacttatttatatttggaataaaatgacaaaaggccaagccccgtggctcatgcctgttattccagcagtttgggaggctgtgatggatggatcactggagcgcaggaggttgagaccagcttggacaacatggggaaatcccatttctattaaaatacattaaatagctgggcatggtggcatgtgcctgcctgcagtcccagctactctgcagactgaggtgggaggataaatggaggctggggtctctggttcctggcagtgagccaagatcacacctctgcactctagcctgggtggtagagcaagaccttgtctc

SEQ ID NO: 580411 - DNA, 249 bp, Homo sapiens
tttttccccccccccggggggtccccgggggggggggccctttcccttttttttggccccccccccccccaggttttttttttccccccttggggggggggggcccccccccccccttttcctgggaaaggggttccccccggggttcccctcttgggggccccccttcctttgaagggctccccccccccccgggggtccccccttttttaccccttttgtttccaaaaacggttttggggtttccca

SEQ ID NO: 580412 - DNA, 396 bp, Homo sapiens
  misc_feature (10)..(10): n is a, c, g, or t
  misc_feature (12)..(12): n is a, c, g, or t
  misc_feature (20)..(21): n is a, c, g, or t
  misc_feature (33)..(34): n is a, c, g, or t
  misc_feature (37)..(37): n is a, c, g, or t
  misc_feature (40)..(40): n is a, c, g, or t
  misc_feature (42)..(42): n is a, c, g, or t
  misc_feature (47)..(48): n is a, c, g, or t
  misc_feature (58)..(58): n is a, c, g, or t
  misc_feature (62)..(62): n is a, c, g, or t
  misc_feature (65)..(65): n is a, c, g, or t
  misc_feature (67)..(68): n is a, c, g, or t
  misc_feature (72)..(72): n is a, c, g, or t
  misc_feature (76)..(76): n is a, c, g, or t
  misc_feature (82)..(82): n is a, c, g, or t
  misc_feature (86)..(86): n is a, c, g, or t
  misc_feature (93)..(93): n is a, c, g, or t
  misc_feature (104)..(104): n is a, c, g, or t
  misc_feature (108)..(108): n is a, c, g, or t
  misc_feature (119)..(119): n is a, c, g, or t
  misc_feature (125)..(125): n is a, c, g, or t
  misc_feature (127)..(127): n is a, c, g, or t
  misc_feature (132)..(132): n is a, c, g, or t
  misc_feature (134)..(134): n is a, c, g, or t
  misc_feature (139)..(139): n is a, c, g, or t
  misc_feature (143)..(143): n is a, c, g, or t
  misc_feature (149)..(149): n is a, c, g, or t
  misc_feature (154)..(154): n is a, c, g, or t
  misc_feature (156)..(156): n is a, c, g, or t
  misc_feature (159)..(159): n is a, c, g, or t
  misc_feature (343)..(343): n is a, c, g, or t
gggcaaaaanancctcaaanngccctggttttnnatntananggcannactcctgtgngtanganannggangcancctctnactnatggccnccgcatccccntggntatatggaaanccggantncggangnggatnccantttggnacgtnanatntgctccaagtacatctatgaccagtgcccagcagtggctggatatggccccattgaggagctcccagactacaaccggatccgtaggggcatgttttggctgcgcttttaggcgggaagcctatgtaagcaagagggcagggccggggtttgtggtcccccccccaccacaaacacagcacttnggctcctttaacctgtgccacaggtgaccaccaataaaatcctttgctgagaa

SEQ ID NO: 580413 - DNA, 518 bp, Homo sapiens
cgactaatgatgaaactctggtacatcaattgatatgtctgttctttctgtttcaaacagatcaaaaggagcacgtcgtggacaaatagaagggctctgaattccaactgtccttcaactgaaaaatgcttcactgccaagtgatcttcccagtcattggtcaagctcttatagaattctccgtactcctcattagtaatatcgtcgggatttctggtccagatgggcttggttttgttgagctcttctggatcgatgtacttttccttaatcttcttcttcttcttctggtcaccatccttcttttcttcttcctcatcagaaccaacatcttcaatttcaggtttgtcttccgactctttctcttctttttctttttcttcttctttgtcttccttttcttcagcctcatcatcgcttacttctttatcacgttccttctccacaaaaagagtaatgggatatccaataaactgagaatgtttcttcacaatctcctttattcttcgttccggata

SEQ ID NO: 580414 - DNA, 444 bp, Homo sapiens
gagatatgactccctcaaacctgtgaaagggccaccagccttcaccgtgacactggccatactgcaaagtgcaaataaaactacaacgagcacgtagattacgtcacttacatcctataaagtgggtttatgtgcagcccctgccaaaccagacccctaggatgggggccgagctaagcggtgcaccccggtccccatgcggggcctcctctctgcttctgcacagcgacttccgactgtgacttgccttattcaccagcacgcaggggaatcgccagtgagaaaatggaatcctgccacctgccaaaaagggaaagcggcatcaggcgggcctgggagcctctcgcaatcaaacctgccccagctcgggaaagctagctgcggtccctgccttcccatccccttccctcgggcctctgactaacaacaaatgggcttatcact

SEQ ID NO: 580415 - DNA, 117 bp, Homo sapiens
atcatttcatcaacttcttcatctgttaaattctctccaaggttagtcatcagatggcgaagttcgtgcagcactaatatagccattgccatcattatcaaacagacggaatgggga

SEQ ID NO: 580416 - DNA, 592 bp, Homo sapiens
  misc_feature (163)..(163): n is a, c, g, or t
gagatggagtctcactctgtcgcacaggttggagtgcagtggagtgatctcaggtcactgcaacctttacctcctgggttcaagcaattctcccacctcagcctcccgagtagctgggattacaggcgcctgtcaccaagcctggcaattttttttttttttnttgtgtattttcagtagagacagggtttcaccatgttggccaggctggtctcgaactcctgacctcaagcgatccgcttgcctcggcttcccaaagtgctgggattacaggcatgaacccactgcacctggccctatttctttttttaaattattttttgtagagtcggtgtctcactctgttgcccaggctggtcttgagctcctggcctcaagtgatcttcctgcctcagcctcccaaagtactgggatgactttgggcacgagccacagtgcctggcccctgtattttatttctttttatggatgaatactatttcatcatatggagagatcatattttaattatgccgttatccattgagggacatttgggtattttcctcttttttttttggctactgtgaaaagtgctgctacaaatattcac

SEQ ID NO: 580417 - DNA, 402 bp, Homo sapiens
  misc_feature (143)..(143): n is a, c, g, or t
gctctaagatccgagttagggtaccagtagctggatcggcatgcacacacaacaagtaattttgtattttagtagagaaggtttcgcatgttgacaggctggtctcaaaaaactgatctaacttaagtgaccaaccaccacgngctcccaaagtgctgggattacaggcgggacgcaccatgagaaggcctattcattaattcttaatcacacctgtccttagtccttaatcatataaacatatatgtttaacacattagatattacataaggtgatattcacatttctgccatgtaatgtaatcacattatctaggaattaggatgtggacacatccttttggggggtcatcagtcaatccactacaccacaattacagtatcattgtttcatggccctta

SEQ ID NO: 580418 - DNA, 230 bp, Homo sapiens
tgaggcaggtggatcacctgaggtcaggagttcgagaccagcctgaccaacatgtttgtgaaaccccatctctactaaaaatacaaaaattagctggacgtggtggcgggcacctgtaatcccagctactcgggaggctgaggcagtataattgttagatttttggttagtcataggtttcagttattttagttttgtttcttttttttttattttttttttcacacgcg

SEQ ID NO: 580419 - DNA, 406 bp, Homo sapiens
  misc_feature (22)..(22): n is a, c, g, or t
taaaaatgttttaccaaaattngataacctccaaacctccatatcctaaactcccccactttagataacccctaaacctaccttccataaaagggaacaaaagccttaatacttgcctatcagaggtatggcaaaagaatcccttttccttcacaattagtttccaatttctgtcaaaaccagcacccctaccctctactgataatcagacttctggcagtagctcacacctgtaactccaacattcagaggccgaggcaggtggatcacttgagttcaggagtctgagatcagcctgggcaacatggtgaaaccctgtctctacaaaaaaatacaaaacttagccagacttggtggcatgtacctgtggtaccagctactcaggaggcggaggcaggaggatcgc

SEQ ID NO: 580420 - DNA, 1283 bp, Homo sapiens
  misc_feature (957)..(957): n is a, c, g, or t
  misc_feature (1153)..(1153): n is a, c, g, or t
taagttcaattattttctggttttttggggatgggtgttaatttgcttatttaaaaaaacatgtgtttttgtgaaaaaacttaaattaattcaagtgccgtggcagcctcaagtggaattatgtggtaggtggcattccccggggggagtggaagaggtggatttcccaacattgtgcgtgctcttgcaaatgtgtcccgtggccaaagaggggaaagtctcgacagccgcggacagccctttcgacagatagcccaaacgagggtgtatttccagggtctcagacaagggtctcagtgttctccatatacccgagtaacctccgtgttaacgtgacaagacaagaatgtgaagcgcacataggcacacattcttggttctcgtgcggtagaacttctctgtgtgacatatattgtggtgtggacacgcgggacaagcttctcacacacaaggggctgtgcgatctccttgtgtgtggagcacgggactctctgtgtgcgtgtgtatacgcaaatgtagaacacaccacaagcgcgctgtgtggcgccctagggggcggcacatattgcccccaggtctccggagcccctgtgtgctgtgtgggaaacccccgcgtgtctcccgagcgtgtgtgtccgtgagtcccgtgtgagagagtagtgggtctcctcatatgcgagggaaccccgaggagagagggggcgtctccccccaaaagtgtgtgcaagcccgggcgagagagcacaatctgggggggatatctacagaaaaggaggagattccaatccactgtgggggggcccccccccgcgatgggtgatgactgtgtccccccaaagagtgtcccggagaaaaaacacaagaggggccccgggagagatttggtctccccaggggggcggcccccccccgcgggggtgggatataaccccctattaaaagacacaatgatgaggnggggaatttctcccccccgggagaaaaatctctccccaacggataagaatctaaccactattttcacgagaggaccaggagaaaagaggcgacaccccatttctattgtgggtgcccccccgtgggaaaagccaggtttgggggggaacacccctgtgtaagaagcagacctcgtgatagggaacagactattaangcagcggattgtcagcaccccaagaggtgcaggtattatactcctctcgactcatctaaacaagcaccaccacggggggagacaccccctactctcacagatacagcacgggagagcagtcactccacag

SEQ ID NO: 580421 - DNA, 321 bp, Homo sapiens
aggacttccgctctcaccaccccactgcctctttgagtgggtggaaggggggtaggaggaggaagaaaaacaacaacaaaaaaaagaaaccctgggatccatctgtttttttttggtggttgtgtttttgttgttgttgggggtgggtggagagcggccgctccccacccacctcgtcttcagaaacagcaaagaggacctcctgctctctggcttctcgctctccttagctcctttggtgccctctgagttcgcggggcccatgtttccccttgaggctccccactgaccagtggcacagctcgctaggacggcaggctc

SEQ ID NO: 580422 - DNA, 323 bp, Homo sapiens
  misc_feature (15)..(15): n is a, c, g, or t
  misc_feature (58)..(58): n is a, c, g, or t
  misc_feature (72)..(72): n is a, c, g, or t
  misc_feature (116)..(117): n is a, c, g, or t
  misc_feature (144)..(144): n is a, c, g, or t
cttattctttgggancttagaatctttgtaaaattatcctgaaagaaaattgttcaancctattattttgantccttagaacatctaccttggattagcagattctttaaagatgnnaaatatatggtctttcaaataatcccntcagaaagtgggcaaaaaacatgaatagacagttctcaaaaaatgatatacaaatggccaaaacatatgaaaaattgctcaacatcactaattatcagggaaatgcatgttaaaaccacaatgtgataccaccttactcctgcactaatggccataataaaaaaataatggatgtggtt

SEQ ID NO: 580423 - DNA, 140 bp, Homo sapiens
acactgctactttggcggtccgcccggtgctcacctgtgtcgccggaacttgtcccgggcggcatgcacctgcgcggtggttgcatacacgttgaccaggctccatcttcccgatctttggcggtccgcctggtgctccc

SEQ ID NO: 580424 - DNA, 282 bp, Homo sapiens
tgctcaggcggaagctgttgatattcatcgctatccatgaacgaatcgacaagggcgatcgtgcgacgaataatcgcatcctcgtatcggcgcatgttttgcaaattcattcgcaaaaactcggcatttttaaaacctatttctcgtagcaactcagcggccatattgtgaaacgttgtcatatgaagcatatgcttgcctttcacttcatggaatcgcggcgactgagccactcgttttcgcgcgtcttcgatgagcgtcgtattgaacgggggaccgagc

SEQ ID NO: 580425 - DNA, 217 bp, Homo sapiens
tcagcactaggcggtcatcatcgctgacactcctatgtgtgcctctccgggccctgtgaccctcacggcagaggcaccggttctcttggatttagagtatgtgtttccatgtgtaatccagtgttccacaaatctagttagcgtggtcttcccaagagtggaacggttcatggtacaagagtccacgtggggtacccgagctcgatattcagtaatc

SEQ ID NO: 580426 - DNA, 704 bp, Homo sapiens
tcagtagcagacacagcataaatatataatgttccgcttgctagcatttccgagcacgatcgcccatggatagccgtgactcatcatggcgatgtggtgcaagctgcatcagtgaccctactactaaatgctgtcctcctcctgggccgtgcagcagtggacttatcatcctctgtaacagcccacactatgcggtgtagacggaggtccttagcttgttacccgggccaagctaggagtgtccgcatagcttttactctgaccagtggggattccatctaccttgaggcgtgcttggctgggccccgtttccacaccagcacatggtgagacagggtagcttatcaacaggctgctgggccttaatactgacagtgagtgtggcgggtcacagccaggaaaggactaacacagatgccctcccagcccccactgctggcctaattttagaataccacggaaaaaagctttgatgaagacaacaggaagtcaacacagcagagagtggtgtggacaacccagaagccagcctcacgcattccatgcccacagttaacgatgacaacaacagcaataataatactaataataaaacaaaggtacaggtgacaagcagcgcttggagtgtgctgctagcaactggggaaggcgcgtgcacacttgtcgagatcggggactctaaagtgaccgcgagctccagctgg

SEQ ID NO: 580427 - DNA, 389 bp, Homo sapiens
ctttggggccctaaaatgttgggcaaaaaggggcccccccccccccttttttttatggtttttttcccctttgggccggccgaaacccgttgcgggcttaaagggaaactggttttttttccaaagccttttggggggggggggccccgagggaaaggttcccccctcccaacaaaaaaaggttggttttttttttggggggagggaatttttttcgggccggccgagggttttttcccctttttgtttgccctttgggtgggtcgggggcccctttttataaaccggtttccctttttaaaacctttcgcccggcttaaaatttaccggggtttggttttatttggtttttttttttccccttttccctaaaggggcccttttttgta

SEQ ID NO: 580428 - DNA, 168 bp, Homo sapiens
tggaacccattatcactgatagtactgatcatatatcaccatcaggatatcaggttttaaaaaacagacactagttttaaaaggtttttgccttaataaaccttattcagaggcactcagtaactttcagtcttaaaaggcataacacacactgtcagtatgagagaa

SEQ ID NO: 580429 - DNA, 438 bp, Homo sapiens
  misc_feature (400)..(400): n is a, c, g, or t
  misc_feature (412)..(412): n is a, c, g, or t
tttacagttctgctcacggccatgatttattacagtgaaaggatacaaaacaaaatcagcaaaggaaaaaagacacatggggtgaagtcaggggaaactaagtgcaagcttccaagaatcctctgccagtggaatcacagaggatgagcttaattctcccagcaaccagttgtaacagcacttgtgaaacactgtcaaccagaaaagcttgttagagactgagtgcctggggtttttactgggagctggtcacaaaggtagtctctgcctggcacataccaaaattccagactcctagaaggaaagcaggtgttcagtagaaactatattgttttacagtttagatatagtaagctctttgatcagtctgggaatggtggaaccccctgaactccaagtnccagatgccaancaagggcaaccttgtaaaccaggtct

SEQ ID NO: 580430 - DNA, 793 bp, Homo sapiens
ccggcttatgttattagaatctttggatgtcaacaaaactggctgtgatgttgatgaccttagggaggtgtagctggtggtagtatcctaaaaggagtattaaaggtgggccaggagatagaagtaagactggtatcgttaccaaagatagtgaaggaataactcatgtgtaaaccaatctttaccaaaattgtatcacgtattgcggagcataagtgatctgcagatatgcgtgctcctaggcggtctaatgggagttggaacaaaaatggacgcccgacgttgtgccgggctgacagaatggtggggcaagtacttggtgcagtcggagcttgacctgagatatgcaccagaatgtggacatttcctatttcctgcttagacggcttctaggtgtacgcactgaaggaggacaagaacagcagccaaggttcaaaagctgtctacgaatgaagtgctcatggtgaacataggatccctgtcgaacaggagggagagttattgctgtcgagggtgatttgggtaaaattgtttgagcaatccagtgtgcacagaaggtatgagaaatacaattgcccttagccgaagagtagaaaaaaactggcgtagaatggtaggggtcggataagaagaggagtgacgaaatcaagccaacagtagatgatgacttgaagaataccagtttaataatacattcggatggatagggacgtggaattcctcttaactaacaaggggtttattgtccaatgcaatatgggaattgatttcaaagtcgttaccttaagaggta

SEQ ID NO: 580431 - DNA, 705 bp, Homo sapiens
ggggggtggccaggtcctaactataatcaccagaatactttagctcccatgtagaactgaactcaagtattcgccatctggctcgcaacacttggcgcatgtgatctagggccggtgggtactccataggggcattggtaggacgcccgtggtagatcatgatgcacaggtagctcaaggccataatcatgtctacctgccataaatagaggtgtacgccttatggagataaatgtatatggcactgaggcgtcgctcatagatacttcaaggattcacacgcagacacacggagcagcaggactgtgaccatggggaacaacacgacgtaaagaccgacgacacagcacgcgggcatactgtagccaaacagtcaaggggggcacggcaatagggatcccgataggagcgccagagcctttcaggttccggaagacaggcggtatccgccgaggatggccccaggaggagagagactggaagctctaacctttacagataacgcaagggtgtcatccctgtggcacccatcacgcttgattgagagagacaggggcataaggacctatcataggggaaacgaagatgaaagggaagaggacccaggggatagaaaacaccgcgtaggatggacgagggtctcattagggggccataacacacatcaggaagggggcccaaatctgggacgcctacctaaactta

SEQ ID NO: 580432 - DNA, 130 bp, Homo sapiens
  misc_feature (83)..(83): n is a, c, g, or t
  misc_feature (127)..(127): n is a, c, g, or t
gtgaagtactctctgtggcatactgtggatgcgcaccagatgcagagtctgagagctggatgaaccagtgatctctgcagagnctgcgatctggccccgagtcagagtgaatcggcatacagtattntgg

SEQ ID NO: 580433 - DNA, 504 bp, Homo sapiens
  misc_feature (5)..(5): n is a, c, g, or t
  misc_feature (38)..(38): n is a, c, g, or t
  misc_feature (184)..(184): n is a, c, g, or t
  misc_feature (232)..(232): n is a, c, g, or t
  misc_feature (408)..(408): n is a, c, g, or t
  misc_feature (429)..(429): n is a, c, g, or t
  misc_feature (454)..(454): n is a, c, g, or t
cgcgngaatcgtacatgaatgagggcttgttaaaaagnccttccttcctgcccctagaacaccgtattagagtgccccatggtgtgcttccccacagcctgtaactcgtgtttgtattcatgattgtgatggttagaactcgtggatagtttgtggaatcatccattaaacatactgcttaaanagtgttgcgtgactcagagacagctggaaggggcaccttaggagcccntcgcttcagttgctcgcttctgggtgtgctccttcgaggcccagataagacagggaacacttgtgagcacacagagcagcatctgatgcctgtggtgtttggcatgtgcccctgtctactgaccaatcagtgtggcatgaggcccacgccacccaaactttcactttccaaagagntagccgtcctccacccagtancatgtcctagcctgtctgcatttgntagtggtaatattctttatgtataataaatttttatacccaagcaaaaaa

SEQ ID NO: 580434 - DNA, 154 bp, Homo sapiens
ccaagggaggttggggattgtgggacaaggtcccttggtgctaatggcctaaaggggcctaaactgtgggcaaatccagttttttgtgggcttggggaacctctcacgttgttgtgtcctggtgagcagcccgaccaataaacctgcttttcta

SEQ ID NO: 580435 - DNA, 1396 bp, Homo sapiens
  misc_feature (280)..(280): n is a, c, g, or t
  misc_feature (1244)..(1244): n is a, c, g, or t
  misc_feature (1396)..(1396): n is a, c, g, or t
aacgggtgactgcgttgtatgatgaagaaaacactcagtgagaatgccgctgttacccagtggcactctcagtcgatgtgagcagaaagcacactggtccacagacctctctggcgttaacaagaggtcactacactcggctccacttcaagtcactgccacaatccacataaacgggaagctccaaggggtaaccagcgtgcaagacgggagcccatcacgtgaaggggcctcatcctttatttcctgtaaagcacactcagaaaccgacaatgcaaancatcttcctgacaggccacacatgacatacagacacgtgtttatattttaagctgccctgttggtttccgaaggcatgaaatccagaccttcaggtcccccaaccctggccgcctcctttgcccacctccatcggccacctgaacggaatgactcctgcgaggagaggacgtggcagccgatttaccgtaaccaccaccggaaggcacctcgctcctgactcccgagccctgagtccatcgcagggatgagcggagatgaagtcatcggccagactcagaagctgacatgttccccgcccggcaccaccagaccccaaacactacagccggtgtcttccttttctgaaggaaacatttgcaatcagcacagtgaaagggaaaggataaagtcccccggggaagaagtgtgaccagggaggaggagggaggagaccactgggactgccccccgtgccccccatgtgcccagccggtccttcctcccgtttccatagcacctggttcaggcatcgctgtgggcactttctcactcggccccataattcacacttgcttattcacttcctccactagataaaaatcatgctggggcacggccggcttcccagcaccgtgtctaatgtcagagcatggggttatgcagggcaaggtggatatgctcctatgtcagtggagccagtggagaagcggggaggcccccctgcctcaaggtgtgccgcttcaactggggactgttctccctttgacacaagcaggcctccaagggacaggtgtggcattggagccgcatgggctggatcccggaaaggtcggaccaggggccgtcagaggggctttacaacgagagcctatatgtaactggaatggcctggaaactcccggtgaaagcaccagggcccctccacgacgaagtgactgatgaagactcacggcaacccacagggacgcatgagcccaacaggncaggcaccgcaggaaagagacacaagagcgacaacacgcgagaagacaggcacgagggacagagcacaaaccgagactccatcggaggccgaacggagccacatcagcgacatcaatgagacagcgacgacgaacgatcactcagggatagn

SEQ ID NO: 580436 - DNA, 463 bp, Homo sapiens
  misc_feature (280)..(280): n is a, c, g, or t
  misc_feature (446)..(446): n is a, c, g, or t
aacgggtgactgcgttgtatgatgaagaaaacactcagtgagaatgccgctgttacccagtggcactctcagtcgatgtgagcagaaagcacactggtccacagacctctctggcgttaacaagaggtcactacactcggctccacttcaagtcactgccacaatccacataaacgggaagctccaaggggtaaccagcgtgcaagacgggagcccatcacgtgaaggggcctcatcctttatttcctgtaaagcacactcagaaaccgacaatgcaaancatcttcctgacaggccacacatgacatacagacacgtgtttatattttaaggtaagaaatgatcatttttactttattctaataagagcttcagttttcctttaaatcatgcagatagcaaactattcaaagcagagggtgataggggatttccgctccaaccgnatcacccgttcgggtac

SEQ ID NO: 580437 - DNA, 103 bp, Homo sapiens
ggtttttgggggttttttttttggaaaggccccctcctttaaaggggaccccggggtttttccctttgggaaaacccgttttaaaaaatttctttttccttga

SEQ ID NO: 580438 - DNA, 879 bp, Homo sapiens
tggtcgactgtgtgcagagttgaatggctgtattcaaggacaccttggaaccatcgggggtgattagggcattcaaaagcaaggatccgagctgaagttaccacatgccctagaatgatgatccgtgatccccgaactcatgccattgtctcatgagaaccttctaatttgatggacttaatcccgagagtatttagaagttcatcaaagtagtagtatgcacgcatctcgtcctcatagcgaagaatctggtcaatctgtagttccgtctggacagacatgtttctcattccatgaatctataactgcatttggagaaggaatcaaaggataagtacaatacctcttttatatgggattttagtcccatttcttgcgtggcactataggatggcatccagaaggcatttctgatagagggccttcagcttcagtccttgcagagccaagtctggggtcagactagctaggtagaagaaaagccaatgggcgggcgtgaacctgagtcgatcgttggttcactgagatatttctgcctcccaggttcatagtcaattctgctgcctctagactccgtagtgagctgggattagaggctgctgctacagcccgggattgagcagctaacgaaagggggacctgacacttgcctaaccttgagaatcttcatgtctccagggagtcgcccataatgcagaaggggacacgggccaaagtgctttgacaaagagttttttggccccggtcaagatgcccttatgttgggcaagtggggttcacaaaaccccctgtgttctttggaaacacccgtcctccttggtgctggaccatttggcccaccattttggggagctcccaaggaaggcgtagccgctcatc

SEQ ID NO: 580439 - DNA, 363 bp, Homo sapiens
tgggagtgtatggggagggctcacctagactgctgcggtaatggacgcgggaggcctggcactttacactgctcgtgttgcagcagccggtgcagcgtattcacctccacgcacgtggggctagatcatgtgaagttggcggacgtggggtcgacctgactccgaggaatctcgtaaatgaccgtcctggtcttgcagacagcggggacagcttcctcgatgcttctcttcctccgaatgggcaggtgtttctgcttctcgacaacatgcttagtggcatggacccccgtgagctctcaggctggtgtccaaagaatcctcactccctacggatgacatctccaggagtcgctggaagtccct

SEQ ID NO: 580440 - DNA, 1328 bp, Homo sapiens
atggcgacccttcgagcgtccattcaccggcgcagagcccattgcaagttacgtagtcagtgcgtgagtgcatcgtccagtaccacagtggtgtcaggctgggtgtccagaattgggaatgcctgctgggagctctagtgcctggaacagggcatccagcccgatggccagatggcaaggtggagcaaagagtcgatagtggaggagggagagtgatttcctgtacaacgaccttctctcagattgataacggggtagcgttggcgatggcatgtggccccgggccagatgtggtgtagactatggaagagccatcagtcgatctgaatgacagtttcagccacctgggcgacctataaccgacaagacatcattgccacgccatgcagccaagcgtcactcgagcagagccaaagggagagactgcctgccaatcaactgtactggcccggaggggctcatacaccagtgtggtggaatggacggatcagtttgacccctcaggtgtccgtgcctcaggaagttccgtcaaatcgcttgggcattgacgccagcatgcagctgggtccttcaaggcggcgtatcatattgaggtattttcccacaagaatttatgggttgggaggggaacatggattcgtggggtatacagctctcggctggctccagtgagaaaccgtaatctcatggtatgatatactgagcgaagagaggtccaaagctaggcagttctcccaatataaccccgggctgccgccagagatttccacaacgctggatcgatagatgccacttgacgaaactccgcatgcgtacaagcaagccaacgaaccaagcacctgggaagcacttcttgaataggtgccctttcaatgggtaagaccaattggacgggcccatactatggagagcatgatgggaccgtgaacgacaagcctcggatatctcgaagactgccccaaagcttagcactaaaccttaagcaggcttaatacgagcacagacaagagtgtacaccacaccaacgggtcaccgtaagacattggaagggagcccgtgaactggtgagacggacgaaaatcccagacagtctggagtcccgaacccggaaccacatgccagtggcacataggcaccgggaccaggcggggaagagcaccaaagcagacgtatgggacggacacaccagcgtgatgtggcagacaaacaaggggaagggacgccacggggaaaaggacgtggaaggacaaggggagagccaaaaaaggaaggcgccaaagcacacacgaggtgacgaggagacaccccaggagagagacagcaaaacc

SEQ ID NO: 580441 - DNA, 748 bp, Homo sapiens
gagtagtgtaggaatactgtagaaatactttttcagaaacgaatccatagctgacaaattcactcagtgccccaatatatggtgattattccggtgataaagaactagatacaaagacctctgaaatggatgataaaattgtgtatctcataaaattttattcaaaatgaaactaaaagtacatatgtattatacacttgaacatgtgttggtaatatctttaaaattttcctttatgtccattccatagggaaaaacacacatatgcacacaaaatcagtaatctgtggggaaacgtggtagtaataatggagattcatcaatactcatataatttcactaatagacattactgtgcataatctcctatacagtccttctaaacaaaatttcaattaaccagatgaactgaccttaagttttttcatcttattttttgtccacatgcttgtgatgctgagaaacaataatgtggccaaattgcagacatcaagaaagcaggcaggaaaaattggaaaaattggagattaattccaccaggtggatacaacagtttccgaggaaaaataccaatttgggtctagaatctccaagttctgtgttcctaataatggtaataagcatattaaggtgaacaagttctataagtggtactagaacaccgattggccaggggtgtcttcaaatgacatacctgtcgggccacttttgccatctacacttgtaccaagagtaatggtcaacctag

SEQ ID NO: 580442 - DNA, 918 bp, Homo sapiens
ggatcctgcgtgcaacgctcttgtgcgtatcagatctggttgatgtgcgaggtcgtctcggtctcgccgccataaggtgggccgtttcgcgccccctctatctccgggcttcctttcctctggatgcgccctccagtgccagatttccaatgccgcccatcgacccgcgggcaatccctccctggcctgtgggaattttccaggtggttccccctcgactgggaactttttaccagcgaactgtgtgttttgaagtgcacccgtccatcatgagaaggcatcgccggagtctcgctctgtcaccagctggagtccatggggccatctcggctcactgcaacctccgcctcctgggttcaagaccattttcctgcctccccctcctgagtagctgaactacaggaagctttcattggcttttgaggaaaatgatccggccaccatccaggattaccccccatggtatatcaccgattttgtagaactgctgggagaacccgcgagagataacatcccattgtcaaacagcgtcccaaccacttcagatgagaattttaccaggtacaccgattgatactcgtttgcttaccattgcctattaccacttgctatagaaagttggtgaccgatgatctgcacctcgtcaagttaactacccgtcttgggatcctccaagaatggtgttcgtttgtgttttaacttgtagttcccgtattatatgagtcactcattgaggttccccggagagttttcgtaatctgcatttctttatgtatatttcccagctatatttcataccaaatgttttaagaatggagaggtccattaacacctttactcttagggaaatagattcggccgccctccgtgaatattggtttttttccccttggtaagtccataaagtttaaccctgga

SEQ ID NO: 580443 - DNA, 292 bp, Homo sapiens
atctgcgctgggtctgatgttacagggccatatgcagattagcgcctggaagcgctggtctcagagccaggtgtcagagcataggctctgtacagccaatactaacggtgtgggaactaaaagaattaattaaaatttctgggctctttttcaccatccataaaaagaagaaaataggagcacctacttcatagggtggttcttgaggattaaatgaatgaacatgtgtgaaggtagctagaagaatacgtggcacaagaaagtgttagacaggtgttaactattgttatta

SEQ ID NO: 580444 - DNA, 1769 bp, Homo sapiens
  misc_feature (358)..(358): n is a, c, g, or t
ggagtgtgtttgtgtattgttagttgtgggagctagggtggttactggttgttgaggtgggtggtgtctgtggttcggcgagttgtttatgtcgcttgtgagtgtgtgtatgtgtcgtgtgatggtgcatagttcgtttggtgtgtggtgtgatcagttgtctggcttgtgcagtcgtaccgcttcttgtgtttgtgcgtccgcggctagctgttgtgatgttcgcgtgtgtcccctctttgttgggtgttcgcacagagaccgcagacatagcccgactttttttggggggtcactcccccctttgttttggaattcttcgcgtcaggggggtgccccaccacacagacgtggttgntgtcaccgcggaattaatggccagtgggccctttgtgttgatgaaatcgttgttccgcggctcccctgtttgattctgtggttgtgagcaccgggggttcctcactcataaaggggttatgatgccgtggagagtcccttcgtggtgtttgtgctcgaaaatttttgtccgtgttccaatcatgaaggggatttccgcgccgcgtctgtgttaagcagatagtcctctcactgtggtgggtgctccgcgccctagaagtggtttcgttgtcttgtccgcctcggatagctgacacccctcccttggttgttttcgcaaggctccgcgttttattctgcgggggaataatgatttctccatcgttccacaccggcggggggagaagactctccgtgtcgcttctcaggtgcgtttccgtcccaacaggtgtttccctccgggtaagatacccgccgttgtcgtaagaatttttggccaagattttctagagctctggtgaaagataaatctttagtggtaatttcccgccccacggtgataaggtgtactcaacaagagccgtcttttttcttccgagggagcacacactgctgcctacgagtgcatgttatatgagtgtcccccacgttctccccgcgcccctctcgtgaggtttttctctctcgctgttttgttgttctctcttcggggggggtatccccgctcacgcgcgccctggtgtgatcggatggtctcttatgagccccgctcgtgtatttattgtccccctcacctactggtatacactctcgcatggtgcgctctcttgagaaaaatagatctttctcacccacatagagatatttataaaaaaacgttgggctcacaaagagaatgctcttgtggcacacacaagatgaaggtaatagtagagatgcgcgtgtgtgtgtgggcgccttcacagagagttcttccttttgagttcaacaacgcacagagttttctctcctcgatatatctcctcgggcaccacagaggtgttataaatataaggccacgcgagataggtgtctccctttcccctgcgtctacacacacactccacccgagaatacacacgtgtggtgtgccacacaagttgtgagatagagagggtgagaaggtctcaccacacatcacaaggtgtctcaacatgtaagataagagtgtttatagtcttggccgtttagccttttggtccaccgtgatagatgcaccagacgtatgagctttgtgtatacaccattccacctggctgtccaacattctttggggtccattgctccaagaaaaaactggccagaatgtccgggcccttatatatccagagcaccctgggcaagcccccgcgcctatattaaggcaccatttgaataaattcttattacccagt

SEQ ID NO: 580445 - DNA, 1154 bp, Homo sapiens
  misc_feature (90)..(90): n is a, c, g, or t
  misc_feature (527)..(527): n is a, c, g, or t
  misc_feature (610)..(610): n is a, c, g, or t
  misc_feature (1012)..(1012): n is a, c, g, or t
ccgcttgttagtatacactcatgaattagtttactcaagctagtttgttgtgtttgtagaatcgtatgtcattggtatatgtgtcttgtnctctcgtctgttgaccgtcccttgcgttcccccgcggtttttacacactcatatggggtttctccctctctggacccgtccccgatcttttgtgtccgagcctcgccatctttttgcgacaccaaatacagttttcctgtcccgtcgcggaattatccccgggctcttccccctcttcctccccggggggtcctcgttctttttgttcgccggctgcggaacccctttattttttcccggccgccgggatccgcctttgtgccgccgggttttcttatgcgaccacaccgcttttttcagcgcgcgcgcccctaagttttgtttctttcccccctcctcctccgcgggtcaccgtgcctggtgatggggtctcgcccccccgccaattccacccctgtgtatcgtctggaacacaagcacggcccccaaatttgggngttatattgattcgcttcccacaaagaaggacaatcttcctatttggttcgaagcagattctctcctctgtccgatttaatangcttttgttgtttggacacgcatctctgtctcatcctccccgggtttgtggccacctctccccccggacgtttgcgacaaccaggcgtgttttgtcgccaacgtacgaagacgaattattcgtggggcaaaaatcacaggtcgctgagtgtcccgcccgcctagttgtgtgggagtcctcccgaaaaggtccccatccttcttatgatgtaggggttctaaacccaccaacaacacataatcgtcgagtgaattctgggaaccacaaatggccccctctgatgctctacctcgagacaaataggcaactttcatcgggaccacgcttttggtagctgtccaacaagcatcctattcgtaggtaggattaacaccgcgtatgctgttaaatcaggacgtcatngcccacccttcggtttggcatactcaccccttcgctgggaggttataaagagggtcattactgccctccaccccgcttttccacttttggccctcttttctttttgaaaaaacagcggggcccccttctttttacaaaaaca

SEQ ID NO: 580446 - DNA, 759 bp, Homo sapiens
tttttttttttagtttccagaggtgagatctttattgacttatgtaatttttggcatacaaattacttaagtatatttacaattcttacataatgtacattttagaagataatgtactttgctccatttacaatgacaaactactgtaaaactacattcatggaattagatacaaatcctctacatactaataaaaagtcaatggactgttggttatacattctttaaaatataccttttcacaggtagccagaaatagtacatgtaataagtctttatgactggaatgatccagaaatatcacaaagcatgagtaaacacatatataaaagtagctcatcatttccaaaagttaacctttagcctttgtgtcaaataaatggtggccacaatctttataatgtgaccagctttccctgtgtaatatccaaaaaatggagggtggggaggttgaagaaaaatcagaaaagttagcaaataaagatagtgaaaagaacaatggcgaggtttatgtaatcaaatcttggtatgtgttcacattatcacattttaagggggataaatttatgtacaccgacaaagatgtccccaaaccatatctggtgcatgtcattggcagcctcagaaactgatagtatgtgtgattaaatactttataagatggcgtcatacgttgtttgcacctgttgatccaaattggttaacccattacctcaaataatcggtcacaatggctcgtacccacgaagagttccggcg

SEQ ID NO: 580447 - DNA, 1506 bp, Homo sapiens
gcatagatccactgtatcgcaccgataaagacaagaagtgagatcaaagtcacaaagtcgagcaatagtctcacaggcatggtgtttgatcacctagatcaggtggctgtctggtcggtaaggctcgtagtggtctatcttggaaaactaggatctattaagctcttgtctatctgttttactaagagatcgttgcacgtaagaagacactagacttggcatgtaggtagatatatagagcatagtggttgttaaaatggcttagtcattgatttatggtatgctgaggtttaaatatcatctaaatggcagggggtgtaacttaagttgatttttcactaaaaaggggattgggagaatatcatgttgaagctattaggctcatagatggtagagtaacggcatcgttttgggtcaaatactcgatattgggtgattggtgaaagggactagtgaagactttaatatgatgatgttaacgtagacgatgtccaatttaaaacgagaagccattgatggggcaactatgtacaaaacgtgcaacataaagttctgtaaaggcattgagattggtgtgccgatagtggcattttgatactagagagttatgatagcggcgtttgttgcattagggttgggatgggagtctccgttatcatagtcagagcgggattttgtggaatcatgtcaatcctccaagccacgtttacaattgaattcggcgtgcatgaaaggcatttcattcgtacaaggggttgtgctacgcgtagacgcatggtgggtacagagaggcgggctcatttgttgctagggaaaagtcttaagatgtcttctgaaaatttggtctatgtgggttgagtatgaagtccacatgagtgagttaaaatcgcctgaataggtgttagaggagatgggaatgggcaaatgtagagaagtcgatacactcgagtggagtgagttactaaatagagtcatgaaggtgggggtaattcagtggaggatcgaaacgttcatgtagaggaaaggatagggggcttgggtggctggtggagtggggaaacaggccaaataacgatataagacaagtgcatttcgcacagggtccgagtttggaccgctgggagagaaataacgggcgttgaagtttagaaaaacactttccctgtgggtcactcgcttgtagccactattcacacatgggtgtctcttgtgtggcccaaaggggactgaagcaaattggtggacgaactgtgcgcagacaaatagggcggcctgagtgtggagtcggctccatattcgacaccccttccaacacacactagactcttgtgcccaacccatacgcgaccccgtttagtaactatgtgtatgcccagcggtgacaacaacacctagaacagaggtactcacaaccactatactagaccgaggaggagagagacacaacgaccacatattggatgagcaatacacggcgtccacctcactagtaatgatccatacaaa

SEQ ID NO: 580448 - DNA, 1362 bp, Homo sapiens
taccggggcgtccctgagtttattgggggcacacccggacgagggcccggcacctagaaaaaaggtgtgttggggcctctgggtgggtgaagctgtggtcttgtggctgacggcgcaggacccgggggggcagcgggaacttgatctgggagtcgtggaactgcttgacagccggccgggggcacttgcgtggccgggatctccttccacctttcagtgactctgaagtggagtgtgggcctcgggcgcgggtgccgggacacccatgtgttcctcggatagcacgtgggtgtcaccaggcgccctgtggcgggtggtctcaggtctccgcggtgtatttccgcggtgtcacctgtgtgttgtgtgggtgtgccgactctcgcggggagtctcaataggcgccgagccgagattccgcgagagtttctttcaccgcggcgaggggggggaaattctcctcaaaaacacacctgtggccccacgagtgtgagacacaagaatcctccccctgtgagagagacacttctctttcactcttctctttataacgtggagaattcccaagagttccccgagaaaaggcgggaacttgtggggcgacgaacctgtggattagggcgcgcaaaaagattccgccattgcgggaaacaagggggcgggcgtagtggcgccattaggggggggggttggggcccagtgacaggagacccccatctacctctttggtaacctcctccgataagctgtgtggcccagaaggggcccttacaaggggcgggtgccccactcgccgggcgaatgtgggggggttcttaccaaagaagcggcctgaaatagtccccccaataatataagtaagaaaggagggttttaaattaacgcgttttcactgggagttatcacggcgcccctagatataagaactatttttcccaatctaatattggggtcccaagagtaccctggtagtatccccctttttccctaaaacacttcaccaaaagaaaaactacaaagttaatatatgtattaacactttttcttggaaagagcgcccgagaaaaatataaaaccgggcttgtaaaaaataatcgggcgggcaacaaaaaacaagagaaccccaaaagggcggcccccaacaccgacgagacgcctttaataataacaaacaacaaggcagaagaaacaccccctacagaaaaacacaagggagccgcccacgtgctgtgaaccaaaaaacgacgacagcggggagaagaaagacacagaagaggccagatattaaaacgacagaggagcagtggacacaaaatactcgatcccgccgaaaatataaaaaaggatagccgcgggcagaggcac

SEQ ID NO: 580449 - DNA, 101 bp, Homo sapiens
acccctctaggaaagaaattttatgaagttaaatacaagtcttgaataggacattttcccttctgtattcgaggggctctaaaaataaatattgctcccga

SEQ ID NO: 580450 - DNA, 812 bp, Homo sapiens
aataacaggctaggtacgatggctggggttaaaattcggacgaggggcacctgaacatttcttctgtgcacagtgtggagccttcttaggtcccgaagggttccacgagaaggacggcaaggacgtacatgtacgcaaggactacttcgacatgttcgcacccaagtgtggcaggctgcacccggagccatacctggagaactatatcatcagccctcaacacgctgtggcatccatgagtgctcttgtgtgccgggaatgcattcacgccatatcgatgaacggcaagcattcattcagagcacgacgggcagcacctactgtgagagtgcactaccacgagcggctgcaggactcgctgatgattcatggcctagccaatcaatgacacatcaaacggaaacgactgcactcaacgcgccacatggacccaaggaaagttccaacccacacaagacaccaatgttacagtaacaccgactgaaactggtcacatggcccaagacaccacccaaaaacatggacgccattccatcattccctctcaatatttaccagcaaatgacaacgaccaggagagggaccagggaaaatagagcagtagtaagagataatggcacgcgaggctcatactttcgaatcccattcaataccataccacaccgaaaacttaactagtactattgtctacatggtgcatttatataggggaagaaaaacacacggcctcaccctccagaaccaatggacagacattaaattccaatcccatccaaaagagcagaaaacccaaaagagagcaacagaaagct

SEQ ID NO: 580451 - DNA, 449 bp, Homo sapiens
  misc_feature (102)..(102): n is a, c, g, or t
  misc_feature (445)..(445): n is a, c, g, or t
aggcatcaagctatatcacccaacaataaccgtcagcgcatgattcccttgtcgcagcatacgtcgatacgcgctaatcagcttttccatatcaagcatgancgaggcaaagagttgcccctctaactcttctgaaaaggtcactcccggataaatctccatttcattgagtcgcttaatggaaaactgtttacgcagttcatttcgatccagtgattccagtcggtcgattgtcgcggctaactcctgattccaggtcaatccaaggaagccatctatgccatcttcgaggctgtgttcaccaagcacggcacgactcagcggatcattcttcgcgggacaaaagcagaggtgcctgcagccaaagtgtaaaaaatcccagcgtttatcaatatccagtcggcgtaatcctgaaagcgtgtcatgtatattatccatcaaaggntttt

SEQ ID NO: 580452 - DNA, 287 bp, Homo sapiens
cggaggccacatcaacagtcatgatgtgtggctgtttatcttccatctgcacacctggttcaaggtatcctctgtgcacaagggcaggtgaaggcacaagatgtgacttgtgcatgggcacactgctcgactatggtgtgttatacggtattaagcagatgcctaacgcgactgctatgaatccttcacaaacacctggacggacattatggctgtatcatacgctacctgcacgccagtggcgcctcaatatactatatctgtctcttgctacacatgcggcgagg

SEQ ID NO: 580453 - DNA, 447 bp, Homo sapiens
tgtctaataatagagtggtacatttgttacaactgatgaacctacattgacacattattatcacccaaagtccatagtttacgtgagggttcactcttggtgttgtacataatatgggttttgacaaatgtgtaatgacatttgtcaaccgttatagtattatacagaataatttcactgccttaaaaaatcctctgtgttttacttattcatccctccctctcctttaacccttagcaactgatcttttcactgtgtacatagttttgcttttaccagaatgtaatgtagttgaaatcatacagtacaccgctcgtcacccacgtcatacctttggaaaatggcatgatccaggcaagcaatctcgtctacgatcatttggtggtgttccagtaagcgtagcaggctcctctcatagtgtacactcgcttattattctctgataaa

SEQ ID NO: 580454 - DNA, 196 bp, Homo sapiens
ctgggtaatgtattgagaccctgtttctacaaaaaatttttaaaaattagccacatgtggtgatacatgcctggagtcctagctactcgggaagctgaagtgggaaaattgtttgagcgtgggacgttggggctgcaatgtgctctgatcgtgccactgcacttcagcctgggcaagagaatgagaccctgtctca

SEQ ID NO: 580455 - DNA, 132 bp, Homo sapiens
  misc_feature (25)..(25): n is a, c, g, or t
accttcttaagggccggcgtctttnttacaaagaaaccaaaataataatgtttgtgtggtaccgagacagtgttatccctgtagattcgagatgtatggtaaagaaaagatggacctgtcccggggtatttt

SEQ ID NO: 580456 - DNA, 321 bp, Homo sapiens
gctcggcacctcctgtgaatccagcagcgaaatggattgtgtccttgccttcgcctctgggctcagcgagacattcacctcaacagaagccagatcatggttcccagaccgtttgagcgtcaccgaaatatccgtaaagtcagtggccgacgagtaggagagacgggcgggctcgtctgatagggcaacatttacccaaagcaaaagaacgcagatgctccatttggtattcatggctgcctccagtcaaaagaggtagacactctcacgagtctccaaacttaagtgtaggaaacgtcgcaatcagcaatactccgtttc

SEQ ID NO: 580457 - DNA, 306 bp, Homo sapiens
  misc_feature (75)..(75): n is a, c, g, or t
ttccttttccatatttgtaactctctctgttgacagtgagaaacctgaccctcattatctgtaatgcatttgccntatttgaacaatactagaatatagtttcaaaatcctccatctcaaaaaaaaaaggaaaaagaaaatattttaaaaattagctgggcgatggtggcatgtgccttgtagtctcagctacttgagaggctgagttaggaggattgcttgagcctaggagttcaatactgcagtgagctatgaccgcaccattgcactccagcctgggcaacagagtgagaccctgtttctatt

SEQ ID NO: 580458 - DNA, 347 bp, Homo sapiens
actacagatggtgatttaaaagacgggtcaaaacaacacaatggtgtgaagtgagatacagtaatcatagtgttctttaacatccagaatcccaagagtgtttagtcttcctgaaaagaatactctctgacactgcacaagaaagagagtaagcgttatcacatatgttcaccttgtggccggaaactcggagaatgccgcaatatggccgtaagagcgctatgggcgagcggatcacccgtgtaaaatcagcacttggtaaggaaacaggtatataacagcgcacgcaaaggggtaagccccatttcggggcgccatattggggtaggggctgttctatacaaaaa

SEQ ID NO: 580459 - DNA, 341 bp, Homo sapiens
gcgtcgacttcctgtaaatccaaaactcacttaaaaatcattaaaattggcatgatgtcttgaaatttcaccaacatgttgtggtaaaaaaattgtccgattttgggacaagtgttggtataagcttcttgcaaaccggagcttctctcaagaagcatgatggtttcgatagggaatatgcacctttgtgggcgaaacgacatacgctgcctcttcatgccttaatttttcacggaggcaacatagaccaataggagtgtcgtgctaaaatttggacctattttgggtttgtttggcctgtcgacgcggccgcgaatttagtagtagtagtaggcggccgc

SEQ ID NO: 580460 - DNA, 555 bp, Homo sapiens
cggctggtacgcctggagtatgggatgtctggccctgcaatgtcaagggagggggctcacccaggctcctgtagctcaggggcaggcctgagccctgcacccgccccactgactgtccagcccctgactggggcaccccatcctgaggggctctgcattggccccacctgaggcaggcgatctgaccgacatctggagccctggctggatgttacaggcgtgcaaaatggaagggtttccccttctgtcccccctcgcatcagaagacctggatgccctatgacaccggatctataccaacggccaaacgcacgcagtattacgcccgtatctcagcagtgatgggcgaagagccgatagcggacccagattaacatgggaaccttcaccatcagctccaaaccaccggatgcaacaactcggagcgtccgtagaagcatatacgaccggcgagaaacagaccttcaccggggacgcatccaaagaatgcccttgcagccctcccgcgtagactttgtgagccacgcctcaatccggcccaccactgtgcaggcg

SEQ ID NO: 580461 - DNA, 108 bp, Homo sapiens
ttacgcagctcaggtcagctggtggaacacagctcgtatgactggatgtgtgaatgcccaagtcggacaggccttagagaacaatggattccattaagagactcagct

SEQ ID NO: 580462 - DNA, 115 bp, Homo sapiens
  misc_feature (3)..(3): n is a, c, g, or t
gcnaagcaattaatgtgttttgcttccttcgtacaaccaatatgaaaaaagcctagtaaatgggggtcggaggccgggcgttgagaggcccaccgtctagagattgctgcagccg

SEQ ID NO: 580463 - DNA, 945 bp, Homo sapiens
  misc_feature (265)..(265): n is a, c, g, or t
  misc_feature (282)..(282): n is a, c, g, or t
  misc_feature (287)..(287): n is a, c, g, or t
  misc_feature (300)..(300): n is a, c, g, or t
  misc_feature (302)..(302): n is a, c, g, or t
  misc_feature (310)..(310): n is a, c, g, or t
  misc_feature (324)..(324): n is a, c, g, or t
  misc_feature (329)..(329): n is a, c, g, or t
  misc_feature (339)..(339): n is a, c, g, or t
  misc_feature (350)..(351): n is a, c, g, or t
  misc_feature (367)..(367): n is a, c, g, or t
cgtgacgcgttgggggcgcatacaagtgcctggtgtgattggtgcacaacccgtgtaccagagtgtacatcctcccaaggagacacccatgacccttccaggcacggtgcctggaccaatgttgctgcagggatgaggcagcatttcagctgtgaggaatggtcattggattcatgtgtttatctgtaaaaatggttgtcttaacttcttaacctcatattggtagtgattgataaaaattggttggtgtttcatgacatgtggncttctttgaaatagcangtcanatgtggtgaccananttgtggangagatttctgtcanatggnaaatgtgtangttcgtctaanngctgatggttatgtangttgctcaggcactcagatgacagacagattctgggctgctgggagtgttctgtgcctcttacatgccctggaggcctcatggtctcagtgctgaggtcgggcacagctgtagcaaacacctggcggtaatgtgcggtctgggccgagtctacagaggaatttgtgttgtctaaggccaaagggggaagctagactgtgattgtaccacctaaaaattctgtaatttcaagccaaaatgtctgcggaaatcaccagttgatactctctgtgaatcagaacaggggggcaaggcctgggttgaaccgtgtctaagcagcactgtgggggaatccgacgtaccacgaacgtgggaatggacctttttattaacttttcctaactgctccaacaggcaaaggccttttttgacccctggtttcggtctttccacacaactggtttgcccctgggataagcgctcactcaacaaagggccctcttccatcggggacacacaacaaacgaaacacaaacaaaaaaagaggggcgcgcaagatacccgggcacgctgcacaccttatagggcacatgtatatag

SEQ ID NO: 580464 - DNA, 1430 bp, Homo sapiens
agcgggaggggcagtctcagggaacgtcctaggggtggtgggcagtctccacagcctccacaagggtagattaccaccttcccgccacttctagtgatacaaggtctcctgactctggcatgtattccacgacaacactacgtatgcaggtaatcggaaacgttggtgactctagctgcctgatctctttcacgcaggcatgccgctcggaagaggaaaaccagactcgcaaacagaccccggcatactcgcggtccgcggtacacactgtgggcacaagacagattaccacagcaaaggaacttctgatcgacgcacaacttattccctggaccaagctacaacggcgcctgcgacatatgaatccatctagcgaattcggtccgcttgcccatccctgggaacactctaataggagagtcccgcaaagaagggcccacgcaacacacaccacatacacaccacattagccctacgattggcgcggacacacgtggccttcaccttacacaaaggtgaccaaccttcaacgctggcgcaggcgccaacactaaccaccccatgggttaaacacccaactttatcatggcgactgggctctgccccaagcaagcacacacatgccctacgcattcggcacaaaccttcttctccccttccaattttcaagacttctattcccattgcaatcatttctccgtcggacagctagcacaatcacatcagctcgtgaacggcatatggaaaacgagctcccggcgcccgcatgagcggcctatggcgcacgttactcacaacgcatgagggcatggcacaaacataccatccacgacatatcgacctttgtacacaacttcctccaatgcgacacttcaccccaagcggctatagtcccaaaccgaacaatctgagtacacttgccgtctattctcaacggccccactcccccttggcaagctatacatgcgccttgggcaagccatcgttctacattcccacgggtacataccgtagcacacacacaagtcgtgccgactataaacgccccggagaaaccctcacaagatcttaccagtgggaaccacttatgtaagattaacgaatctacagtcaacaatatactctgatagtgcgacgtaatacacagctgggaaccacaatacgatagtacacgtggagatccataacgaagggctctatgctaccaatccattctgcccaacacacccgacgcgtcctttggaacactccccatcttatcatgagccgcataggtacattatccacaactcacacccataactgtctctacgtccgaccccagatatctcacaaaaaatacgacatatgaccatcaggtcgggcaaccatcaaccccagtaggcaccactctagcacactactcaaccatagctcgaacggcatcccct

SEQ ID NO: 580465 - DNA, 768 bp, Homo sapiens
  misc_feature (355)..(355): n is a, c, g, or t
  misc_feature (498)..(498): n is a, c, g, or t
  misc_feature (625)..(625): n is a, c, g, or t
  misc_feature (643)..(643): n is a, c, g, or t
tggaattgttaagccacctctgagcagtgtatgtcaggacttgttcattaggttggcagcagaggggcagaaggaattatacaggtagagatgtatgcacatgtgtccatatatgtccatatttacatttgatagccattgatgtatgcatctcttggctgtactataagaacacattaattcaatggaaatacactttgctaatattttaatggtatagatctgctaatgaattctcttaaaaacatactgtattctgttgctgtgtgtttcattttaaattgagcattaagggaatgcagcatttaaatcagaactctgccaatgcttttatctagaggcgtgttgccatttntgtcttatatgaaatttctgtcccaagaaaggcaggattacatctttttttttttttttagcagttggagtgggggtagggtatctgggttatcagaatactcatatagcttggggatttggaatgggtaaatattcatgatngtgtgaacaaatcagtgatacatacggtacagtctcagtcccataaaatgggatgttgtgcctacacacgaggatctagaagaatttgtcaaactataaacggctggtgattggtgaatgacttggntcttggctgtgggttttncaatttcctataagtgcacatactaacttttaaaaaataagggttattttaaaaggccaaaaaaaaacaacaagacaaacaaacaagagaaaaataaacaacaaaaaaaacacacacaggagggg

SEQ ID NO: 580466 - DNA, 359 bp, Homo sapiens
ctgctgagatgcatacctttaccagagcgtgtcatgcaacagctgtcagaagagcaacttcatggcttctagaaatcatgacataaccccacactgacacagccaatttgtctcttccattctccacagcttaccatagcattttttctttaagttgaaaggtactgcatctttaattcataccaggtaccgcagttttacaagggaccaaattccaagtcaagacagttaccaatctctaactcaatacgattaccaatagcacgacagaggattaactaaaaagccaacaaatcggtcagagaaaccacacgcaggagtcgggccatgcgctatgctaattgttggtaccaccaagc

SEQ ID NO: 580467 - DNA, 805 bp, Homo sapiens
  misc_feature (355)..(355): n is a, c, g, or t
  misc_feature (662)..(662): n is a, c, g, or t
  misc_feature (680)..(680): n is a, c, g, or t
tggaattgttaagccacctctgagcagtgtatgtcaggacttgttcattaggttggcagcagaggggcagaaggaattatacaggtagagatgtatgcacatgtgtccatatatgtccatatttacatttgatagccattgatgtatgcatctcttggctgtactataagaacacattaattcaatggaaatacactttgctaatattttaatggtatagatctgctaatgaattctcttaaaaacatactgtattctgttgctgtgtgtttcattttaaattgagcattaagggaatgcagcatttaaatcagaactctgccaatgcttttatctagaggcgtgttgccatttntgtcttatatgaaatttctgtcccaagaaaggcaggattacactcctctttcttcttttccttctctagccagtctggcacctgggcccgatagatgatatctcatgtggactcactcaagaactacctcatactagccttcgggacttcttgacatggcgcaaactactctcatgcatgtgctgaacaaatcagtgatacatacggtacagtctcagtcccataaaatgggatgttgtgcctacacacgaggatctagaagaatttgtcaaactataaacggctggtgattggtgaatgacttggntcttggctgtgggttttncaatttcctataagtgcacatactaacttttaaaaaataagggttattttaaaaggccaaaaaaaaacaacaagacaaacaaacaagagaaaaataaacaacaaaaaaaacacacacaggagggg

SEQ ID NO: 580468 - DNA, 203 bp, Homo sapiens
taaaaaaatttcctcacccattaaattacctaatgcccctgggccctaaaagaaaaggcccattttcactgcaaaattccaaaacctcctgccaaaccaacctcccaataccccaaattcaaggacacctgcccaatttgaagaaggggcccaccttctgctaaatacccccctgggctccacctatttcccaaaattttttt

SEQ ID NO: 580469 - DNA, 1426 bp, Homo sapiens
  misc_feature (491)..(491): n is a, c, g, or t
gggacagtgatgtcgtctggaaagcctggcgatggcgaatccctggatggctccggcgtgatgtgctagggaagacaggggaagctggaaggtgcggttaacttccttgatgagtcatccaaggtcattggaatgtattgatcctgtaggatgttgtcattcgtagggcagcagaacaagatgtggggctcgcatatgcgtgatgctggccaccagtcctgatatgtccgctttcgacgggcaaggctagctggtgctcgttgtggccggcatgaccaatgcattcccgtgcagggtctatcccagaggcgcacacctaggcacaataggaacctcgaccatcatcggcaatcacaatcttagcttgccttcaaattcatcgcggcgcgagcgacatggtacgggcactcttagtagtatcgacacgcaaggagcaggaagcataccacattggaaccatgtatggggccaccagtgtctccggctacggnacgcacagaggacatggggttggtcgccagacttgggcgttgaacgcctgtcgccatagggatacgacgcaataacgacacccatcgttggtctcaacagtacgaccttggtagtcccgaggaccccccaggtacacacactacgctttcgtcgctgtggtggcacgcagaccaggagacaaaacgctttccaagtctttggcccgagtgggatattttgacgcatgctaattcaaacgcgtagcggtacttcagcacctaacttcgcaaaggcggtgagtctaccgctactttttgcatattggtccccttggcaccgctttggatttgttggctaagaccatgtagtgccagagtaacctggtgtaaggcacgggcacacctggttgtgcgaaaggcgcgcaagagcggaggacgtcccggcacggtcgtgggcattcgaattcctaattggtcttccaacaacgcgagtacattcaaccgcccgtcgttataccttcaacgttgttgcggggcctttgtgaatcacttccacgaggtcgacaggcttgtttgcaagaacgaccaaatagggcgaacggccatttctgggaggcataaacacgcctttgagctggggtgacctcttgtactccttcgggcaacgccaaagtgttatacacgcaaccgtgggccaacgttatcttatccggacttgttacgcttatgttgccagtcggcggttgtctccctgtggcaaacgttgtgtgttgtcccacaacggttggccttgtggcggtcctggtcaagcgacattcgtggtgttaccctccgaacacttggggtctgcaagctcctcgggaaccacaccgagggtacatacagttccaaatccacgacagggtgttttacccacaactcgaaagcttagcgtggtgcaccctatgtggtttctg

SEQ ID NO: 580470 - DNA, 427 bp, Homo sapiens
gtttttggggactgtagaaaagaaaggagttgaggcctggtgcagtggctcatgcctttggtcccattactttgggaggctgaggctggaggatggtttgaggctggaagttcaagaccagcctgggcaacaaagcaagaccccttttctaagaaaaaaataaaataaaaaatggatgtgatggtgtgtgcctgtggtcctgggtagctaggaccataggcatgcaccacacacccagctaattttttattctttgtagagaaggagtcttgctatgttacccaggttagtatcaaactcttggactcaagcaatcctcctgccttgacctctcaaagtgttggcattacaggtgtgagccaccatggccagcctatgaactgtttaagtggatgaccagcctaggcaagaaagatgccatctctta

SEQ ID NO: 580471 - DNA, 127 bp, Homo sapiens
cacgagggccactcggacaacatcttctcacgccagtcatacctctggaacttcggagtcgacttgtacaagctcttcagctactgcgacaaacgctgtagccccacagacgtgagtctgattccca

SEQ ID NO: 580472 - DNA, 462 bp, Homo sapiens
  misc_feature (17)..(17): n is a, c, g, or t
ctgccattgaatttggntgcccttcaggcccacctggcccaggaaaaccgtgtggtggcctttttcagcctggctttactgcttgccccactggtggaaacgcttattttactggaccggctgctgtaccttcaggaacagggtttccatgctgaggtcctgcccattttcagtcctgaactttttcccaaaaacctggttttggtggccaccaaaatgcccctggggacaggctttttttgttttggaaactgaaaacagctgatgcagcctgaggagacatttcagaccccatcatttgaaagtgcccaaaaagcacagtggcaaagtacatttcatccaaaaaaacagcatcctgcatcctccaaagttctggttccttcagttttatcccctttttttccttccatggattatgtaaaacattgtaaagttttaattaattaaaaattggatatttga

SEQ ID NO: 580473 - DNA, 262 bp, Homo sapiens
ggaaaatctacctggttatcgccgtggaggggaatatcagaagtggaacggcacagcctggtgaaggatacggaagcagaaaaactgttccggatcccggggagggcggaaagaaaaaaccaaataaaaaaaaaaaggccctgaatgcaggtagcccagtgagcatattgcgccgctcaggatgctttgtgggcccccaaaaatggggaaaaaaaaattttttttcacgcacaaaaaaaataaataataatggagtaaaaaa

SEQ ID NO: 580474 - DNA, 113 bp, Homo sapiens
gtcgcaggagaaaaaagtcgtcacgtcatgcgagtgcgcagggggcgtggagagtagcagtagagcaacaaagtacatataggacagtgcagcgaggacaaggacttcccgca

SEQ ID NO: 580475 - DNA, 709 bp, Homo sapiens
ggagacacgtctacaaggacctgcggcagatcgagctggcctgtgatccctggaagacgtggacagctggaaggcctcgttcctccgagtctctgcgtctaccccgagaaggaccaggcagaaaactgaggatggggcccaggagaacgagcttctccatggacccccaattggagcggcaggtggagagcattcgcaacctggtggactcatacttggcgcatcatcatacaagtccatccgttgacctcatgccaaagaccatcatgcgcctcgatgatcaacaatacgaaggccttcatccacctagcgagctgcgtggcctacctatagctcctcggatagaccgagagcagcctcatggaggagtcggctgaccaggcacagcggcgggacgacatgctgcgcatgtaccatgccctcaaggaggcgctcaacgagtcatcggtgacatcaggcagccagtcactgtgtccacgcctgtagccccgcctgtcgatgacacctgggtccagagcggccaggaggcacagtcccagtccagagacgccggaggcggtgtccaggcaatagcaactaccacggtgtgacgagtgcccgaaggcagaagatggggggccaatgtccatgaagtgcactccatgattgccctcgcgagccgatgcagggccagggtccctcaaacccgtacgcacacgaatacccatag

SEQ ID NO: 580476 - DNA, 247 bp, Homo sapiens
atgagccaatgcctgcatgttctcactcaccaattttcccctaatctccctgccccatgcacaaaggctcactgctcacagcaggggagaacacggaaggcaggctagaagcaagaagcagctaagacacagcttgcacctataaagatgcggggccatccccacgagagaaagagcaactttgaccaagtaccaacttttttaggtgcttaagtcaaggacattaaaggacaatattgtgggcaaa

SEQ ID NO: 580477 - DNA, 145 bp, Homo sapiens
cgtagatcgtcaactgctgcgcgctgccggtgccggtgccactggcggtatccacggtcagcgtgttgccccaggcgctggctgcgggtggagtcgcgactacagatcgatatggggtaccgcagctcgaacttcgttaaatcat

SEQ ID NO: 580478 - DNA, 163 bp, Homo sapiens
cggagtatgtgtggatcacacgagccaggagatccagaccatcctgggcacatctgtagactccgtctctattatatttgtttgtatatatatatatttgtatgttattattgacatggagtttcagtcgtcacccagggcagaatgcaaatggtgccatctc

SEQ ID NO: 580479 - DNA, 1350 bp, Homo sapiens
gggggaaaagggggggaaagaaagaaagagaaaaaggagggcgagtggcgagcacgggcctcggccgccacccacacgcccctgaagctgtgctcgtccccctgctgcggggcttccctggcctgccgcccttctggccatctgtgcttgctcccctggtggccctagtgccttcgtgacttcctgctggcctggccctggctgcgggcccaaggctgcccttcaaggggatcgatggcccaaggtgtaggcaaggttgtccaacccttgcctttgttggaaggacagatgtcctttccttcaagcagaaccaaggtgattgcggtgcggtgaacaatttctcccttcggatgatcatttgccccttctgcagatttcccatttgttgttacacaggaaactttggggccaagagggttccaaaaggggccatagaaacgtttgggccctatttggcgatattccgggccaacggttggttaagcgaggacaaaacctactggaaccctagtttcggttctacttggtccgcgtgatcccggagagaaaccccatggaatcgaacgcaccgtgcattgtccgcaggcccttttaagtaggggatttaaattttgggcccccgagtgtcgcggcacccgcgggcgagacgtttatcatattccgcgacgcggaacacacacccgcagctatttcttgggggcccaaagagaaaacactataaacctgttggcttaaaccgacgcagaattcggattcacactatcaaacacgtggttattccgacgtaacttttcccgccatttttttcggaggcgtaaagttttattgccccgcccagaaaaatttccgctttccgaagtaaacaacgatgcgggcggacacatatccggggccaagaggcgtgcgcccaaagtgaagggaaaaagctcttttattcccccaaacgctgaggggcactataaacttttctcgtatccacactattttttccctattaaaagagggcggccgataaaatcttcccacacttttaagcgacggcgccccaacagtttttatccatgcttcccacgcgtatattaaagcggtaagcacacaagcgccggggaaatttcccccctttataagaagaccaagagccaaaattttccatttttcacccgtattgtgggcggacaaacttattatcccaagagggcgctgttttatttaacccccaaagaggcgatttataacaaccacgcgcgatcgccgttttgggggcattttttttacaacgccaactcctttttgcgggaccacaacaccacacatgatcgtcactaataataacagcaccatcacacgtca

SEQ ID NO: 580480 - DNA, 327 bp, Homo sapiens
gaacggcatggggaaggagggaaaagattgagaaaaggggggagagggcggggagaaagggggagaagaggaggggaaaggaagaaggcggggaaggaaggggagaagaagggtaggggagagaggggggagagacgcgaaaggggagaaagggaaagggggagaggggaagaggaaagggggaggagggggggagaaagaaggaaacggggaagtgagggagcgcccgaagaagagaagaaggaggaaggggacaggaagaggggcgaacagagagcagagcgaagagacaagaggcaaacggaggagaggaaaggggggcgggcg

SEQ ID NO: 580481 - DNA, 884 bp, Homo sapiens
cacctgctgcctgtcgcctgcctgccatttttgatgtgcatggacagagtcctggttcttgggaccagcttggacgacagtgtgtgtgtgacttgaaataactttaccaaatggaaatgctatttttgctgaactatcttctccatgcggacatggccaatgtgctttgtaacagagccagactggtttcctatctcccaggattttgctcttcagcgttacccacgggtggtcaatcccaaagccttttcagactgcagtgactcactcaggtctcggactgacgctctcactggctggctgcttgcccctccagcatacttctgcctccctcgcaaccagctgtgcgcccgcactcgcaacactactgggacccactcacctggcccaccctcccagaatcaccacgcgcaccccacgcctactcccggcccccccccctaccgctacacacgactcgtccacccttcccctgccgcacctgcctccccccccacctacaccaccactcccctgacaactactacaactccacaccacaccctcgccccttccacatcctctccctcacccctcccacacccccaccacaccaccacacccacgacaaacatcccccaaacacaaccccacccacacacatatgcaccaccccacccacacctacccccacacaccctcacacacctatcaacaacaactcccacacaactactaccaataaccctcacacccctccctatctcaactcacccacataaccacaacacacctcacccaactccctatcaataatcacacaccacaccccacacacccatccacacaaacacacacacccacaacaccctacaactaacacaaatacacacacaataaaccac

SEQ ID NO: 580482 - DNA, 260 bp, Homo sapiens
ggcccaaatacatttttaaaatgaccctggagcaggcacagtggatcacttgagcccaagagttcaaggccagcttgggcaatacgacgaaaccccgtctctactggaaaatacaaaaattagctgggcgcatgcctgtggttctagctgctggggaggccgaggtgggaggatcgcttgagctgaggaggttgaggctgcagtgagctgtgatcacacccctgcacttcagcctgggcggcagaccgagaccctgtctc

SEQ ID NO: 580483 - DNA, 286 bp, Homo sapiens
  misc_feature (36)..(36): n is a, c, g, or t
tgcccctagcctgggccccccccgacaaacttcaantgggtttctgtttttagaggtaccccaaaggttccccttaagggcagcatgtccaagccccttacccccaatttggccacaggaccctcgctcccctcccccggagtgtttgtgtggggaggggcttcccctgttccccaaggggtccttgggctccccctggcccatgttttgtgtttcagtaaaaaaagacctgttcccccctttgtgtgcttccctcctgcctttaaattcccccagtgtggcccca

SEQ ID NO: 580484 - DNA, 479 bp, Homo sapiens
aacctttccttgtcattcacgacttggctgtttggcacaagagacctagcattcagcctatctcagttttcaacatgccttcctcactaatcttaatcatttctagcttttgatttaatgtgagacctgcaactctttcacttgaacacttagaggccattgtagggttattaattggcctaattgaagatgtctggccagtgcagcagtcagaatacatgcagcatttatcaattaagttccttgtattatatgggttcagttcatgatgccccaaaacagttacgatagtaacatcaatgatcacagattacagatcaccataacagatataatcatagtgaaatagtttgatatattgctagaattaccaaaatgtgacacagagacacaaagtgagccacatgctgttggaaaaataacactgatagaattgcttgacacaggattacaacaaaccttccatttgtaaaaaaaaa

SEQ ID NO: 580485 - DNA, 239 bp, Homo sapiens
ttctgcttttacagtgaaggtgattattttattcaatagatttaggttttgttcaatgaatttagaacttactgggaggctttcacttgctcagaatagggtcagagtaggaaggttatctttgttggtgcctcagcctcctgagtagctggggactacaggcgtgcactggcacacctgggctaattttttttttgtatgtttagtaggagatggggggtttcactgtattggccagg

SEQ ID NO: 580486 - DNA, 1149 bp, Homo sapiens
gggtggaggcctgtctgtgtgtggcgcgggcgaggtggaggcccaggactctgaccctgcccctgccttcagcaatggcccccggacagctgcctggccactactgaactgccgtgggttgaaaaatataggccagtaaagctgaatgaaatttgtcgggaatgaagacacctgtgagcagagctagaggtctttgcaaggtgtaaggaaatgtgcccaacatcatcattgcgggccctccaggaaccggacaagaccacaagcaattctgtgcttggccctgggccctgcatgggcccagccactcaacgatgccatgtttggaactcaattgcttcaaatgacagggcgcattgacgttagtgaggcaataaacttcccaatgtcacgctcaacaaaaagtcacctcttcccaaaggccgacataaagatcatcattctggatgatcgcagaccagcatgaccgacggagcccagcaaggcttgcggcagaaccatggaaaatctactctacacgccactcggcttcggccattgcttgtcactgcttcgggataggatcaatcgagcccattcagtccccgctgagccagccctccggtaacaccacagctgaccgacgcccagatcctcacaaggctgactgacattgttactcgagcacggacgagggataacgctacacctgatgacgggccttagacagccatcctcttcaacggcaccaagagcaacatgaggccacgcgcttcgacccaccctgccgccaccccgttctacgggacctcggcttccatccacgcgggacgaaacggtgcatcaaagggacatgagtacgcagacccacacccaatgacatggtaaacgggagaatgtacccagaatgggcggcagtgccactagctggcgaacaccgaaacgaacactgacccaccatctgaccgctacgagggcaacaacacgaaggaattcctgcacaccctctccccccgttcacacgctccacatgagcaatccggaacgcgagtctccagggatgtgactccccccttagatccgaaagagaaccctccacagaggaccatcagcatgatcacacaccgccgcgcacacgacactcaacagccgcacgacacccgcatcgcaccc

SEQ ID NO: 580487 - DNA, 232 bp, Homo sapiens
aggagaattgcttgaacccgggaggcagaggttgcagtgagccaaatttacgccactgcactccagcctgggcaaccaaatgagactccatctcaaaaaaaaaaaaaaaaggaacccttaaaggaaagccctttaattttcatggttgggaagattaaattttgtggaaaataaatatggtaaatatcctcccaaaaataggctatagatcaaatataacccctataaaaat

SEQ ID NO: 580488 - DNA, 259 bp, Homo sapiens
  misc_feature (188)..(188): n is a, c, g, or t
agaggaaatgaggccgaaacccatcagggatagattctaggggccctgtaggccaaagtgaagactgaaatgtatcctaaaagtcatggacaaccacaggaaaacgtggaaagctggggatgacatgatggtatttacatttaaggcaattactgaggacaacagatgggtggacacgaccccacacngaagcaagactagagtcaggaggcaattcactagcagaggaaatagatcaacttgctgggtcatgatggag

SEQ ID NO: 580489 - DNA, 1478 bp, Homo sapiens
  misc_feature (237)..(237): n is a, c, g, or t
gcctggaggcttacggggaccctgcagcaggtcgatgacttctggagcacggccctgcaggcctggtcagtagctgtcaagaccacacggatttggcctcagttccctgtgagctaccgtgggtcactccagagtcagagaaggttcagcattcggcgtatagacatgggctgcgccaagacaacgtggactgctggtccactcgtacgcatgccacgaggatgctgcgaccatctnccgcgagtctagacggggcacaggggctagcaggcccgggacgcaaggaggaagctgtgcgcaggagcattggccgccgagctcccatggtcagctaccgggattcgagcgccagagacggtacgtctctggtttacatagttgtgccacacggacacgaccggaagacttctcttgctggcatcccccatcgaacgtgttcgtcacatcatcgctgcacaatcggcgccccattgcgttgggatcgaaatcgtagtcaatcggatccgagctgggttggcagactcgcggaattccccttcacttgcgtaatccgcccctgcgcagcgaacacgtctggatcctacctaacgaacaggggcaaaacaagctggtgggctgaagggcacgttcgatgcaatgtggcgggtccaatggtctacacacattgagcagtgattcctaggaattgttcgggagaaaccgctcctatctagtcactgcgctggactcttagatggggggccgaggggcgtccaacaagaggcagcagaagcatgcccggaacgcccctcacttcccttgatggaccctgtggtgttgacccagccgataagtcgtccccagttgggtgcctttccgtacccccgggggaacccaaggtgacccttttggccaaagggcggcttggccgggggaccagccgaaaagcaatagtacgggatgtcacaggaaaacggagggctttggtggggaacttgggtagtcgtctcacagtgtgcgccacttctggaaccggaaaccttgtgaatttgcttggaaaagcttgcgccattgggcaccatcccttcccacgcgagggggtggcccggcttccaagaactttgacgacgaaacttctcccaactactccttggagaggtaccctttgtgtggcacacagtatgtgggaaccctaaaagagtcgccgggggaactgggttccctgtgggaaaaaaacggtaatcacagcccctccttcgtgggcccattccagtatactggcgcacacgacttgggtggcgaccccccctactaaccaaactgtttgcttgggcgtctaccaaaacagcggtcttggtcccaaggcttcctacatgcacaaacaagaaaggggcgcgcagatgcggggcgtatacatctattaacaacgtgtggcacctactgacataagtctgttgtggtgttacctcctccacaaaaaagacagcgcccgaaggaga

SEQ ID NO: 580490 - DNA, 907 bp, Homo sapiens
  misc_feature (907)..(907): n is a, c, g, or t
gccaaggcgaggtgctacccacctactgcgatgtctctgaaatgtgaccaccaggactgattcatgaccctcttgatcaaggtgactcgtgccacgcggtcctcggtgcctcctctcgtcgaagcacgccgtgtgcccatccgatctgtcgtctcaattcacaattgctctgggtgacctacattgagccgtcactggtcctggtcgcttcgccagagacctgcgtgttttgctgacagccagcaagacaataaggggctgtccgctggtgggccgtctacgattgtgggctggtcgggttcctgcgtcggccgaagggagtgagtgatcatagaacacagatggatagccgccgttctcggggcccgtgaatcgagactgagggggcatggacccttagtctgccctcgccgcttggttaattgtagttgtcaccagtgacacgcaggccgactgtgggtcgagagtggactacagggctgaccaagagtcccaacgttgcaccaacgttgatccacaagaccaggtctaattgttttcaagtacatctaaatgtaaccattcatagcgcgaaggaggatcgaatcttcgcattgtttcgttagcacctggcccctcgcggacatcacaacaaccgagctacaagggatcgactcaactttggcaacgaggaaaagcctttcgagttgcgatgtaacagatgggccccctggatcgcgcatcgcaacctctgtccaatcgggaacggttgcgaatgaggggactccttttcttttgcccgtaattacacagaaggaggggatcgcagcagttcttatctagggcccgttaaccagccgatgtgtaacgaccctttggacgaagcggccaaaaaaccgaataatactccgcccgtgccagatggtan

SEQ ID NO: 580491 - DNA, 547 bp, Homo sapiens
gttgatgacataaactaaatataacctgaaaaaggttcaacattatgttttattttgacagtgctacccatgtgacttaacatgttaaatagtcctgtttacctctcttttgggtgcttcaagggcctctgtagtatcccaaatttagaggtcagaaaagacaattttgaagttgaaatttgatttagggaagcctattaaatatattaaaagtttaaacacttgatgttatgaaatagaattccaggtcaccgtaagtcattcatttacttaaaatcatgacttaaaaaagttttaacagggcaaaaatctttactcattgatagagggaagacatcttcacaaaccgatctgcctctagtctatcctcttccataaccataccaaggtagttaatttacaaaggcaaaccaaattgacattatttggtaatatttacctgaacatcatctttaaagagagaaagcccagatggtaccacattttcatccttatagaccctatttcttacttgatgaccatcagagggactttcccttctgttggg

SEQ ID NO: 580492 - DNA, 495 bp, Homo sapiens
ttgattgggtcggtatctaatgcgagtatgtacaggctagtataatacttaaaccccttatttggctatggtggttagatagagtattcctttgcaacttagtgctatgacttattacatggtcgtattcatgcttatgacagatgaagaattataagtgccagtgtaaaggattaagaataacatacaattcagtagggtatggcaggctgaattgtacatggtaatgtatcaggggagtgtgatttgggctaaaatatatccagatcctagtaagttatagatgtcgggttatgacgaggatactagtatccctagctatgattggtgcttatttggccctatataaggaatgttcatatttggataatcggagtccatgttataaacagaattgaccgatgcaagacaactgctaactgtgcaacattgacatgagaataaatagtagtgtgtcacggggacaaccctctgaatgtacctatgtgtcagtgg

SEQ ID NO: 580493 - DNA, 607 bp, Homo sapiens
gaataggtcagcggccaagcgaaatgcaaatcaaaatcacagtatcatctcacctcagttaaaacgatttttactgaaaagacaaatataatagctactggcaaggatgcagaggaaggggaatgcaggtacaccattgatgggaatgtaaattagtacaatgacaatggacgacaagtatggaggttccttaaaaaactaaaaatagaattactatatgatttcacaatgcccctgctgggtacatatccaaaaaaaaaaggaaatcagggtatcaaagtgatatctgcattccccagtttattgcagcactattcccaatagctaagatatgggatcaacctacttattaacaagtgaacagataaagtaaatgtggcacatatacacaatagaatattattcaaccataaaaaagaatgaaatcctgtcacttgcagcaacatggatggacattgagatcattttgtaaagtgaaatgagccaggcacaggaagacagacatcacatgctctcactcatatgtgggagctaaaaaaaaggggatctcatgggaagtagaaagttaatggtatttataggaggttgaaggacaggggggtggggc

SEQ ID NO: 580494 - DNA, 623 bp, Homo sapiens
agcgggggtgcgcactgcgagcaccgagcacagaccacagaacggggatgtctgtgcgttcggagtgaaagaggggtggagttcctggtgactggccgtcggtcccacgagtgggtggtagtggggtgctggtgagcgtgggcgagctctgctggtgcactgcgcggtccttcactgtgacccgagacgctgcagagctactcagccttcgttgcagtcgtcactcgcatctggctaccatgctccccgctgccctgcgctcggctgggctggcatcgggcccggggaaatgcggagcagtagttcggtgtagcactgtttgcggcgaggagaacggaaggagaggagaaaactgcactggatcaaggaggtcttcccataggcctgcagtagggctgtttaccagttggcacagcaacgggaacagagcgaggagcatcaatctagaagcatggagatctgcctgcatgtctgctgcagggcttaagatcactggaagcacagaaacaaagaggagattgctcctgatcagtatagactgggtgtactgccaagcagaagcaagaggggaggagggaactgcctccggatcattaccggtgtagatcccaagagcattccca

SEQ ID NO: 580495 - DNA, 290 bp, Homo sapiens
  misc_feature (33)..(33): n is a, c, g, or t
  misc_feature (81)..(82): n is a, c, g, or t
agaggtaccccatagcgacaccgtacaaacggnggatgtactcgttatttcgagcgtcaattttattacgaaggaagtaannggggggtccgcttctaccatttccatatcccttatcaatgaatcatctttatctgaagtagtggtaacagcgcttaacattaagcggaaagcagataacctgtcttatgcaagccagggtatcaaagccgataagctcaccactaccaggatccaggatgtgaacaatgccctggctggtaaaatctcaggtatccaggtacgctcgg

SEQ ID NO: 580496 - DNA, 231 bp, Homo sapiens
tctagaggatccctgtccagctgagtttcttttaaatagagaggggtctcactgtgttggtgaggctggtcttgaactcctgaccacaagtgatctgcctgcctcagtctcccaaagtgttgggattacaggcgtgagccactgtgcctggcttgttgctgttttaaaaacaggggctcgctctgttgcccaggctggagtgcagtgacacaatcagagctcactgtaaca

SEQ ID NO: 580497 - DNA, 217 bp, Homo sapiens
taaactctctcaccctaaaaccaataaaaactcttagtccataggagctagcactcctaaccaaaaaaaaaaaaaaatttgtccagaagcccctctcaggtttatactccaaaataaacttgtctttgactgtggagccacttttcatgtgtcttttctctttctttacttctaacatttggtgctgaaacctgggatgggtgtggggcgataacat

SEQ ID NO: 580498 - DNA, 653 bp, Homo sapiens
  misc_feature (360)..(360): n is a, c, g, or t
atttaatacaatttacaacacacctgctggcactttgatcttggacctccctgttgtctgaactaggtaacctgacctctccctttctgatgacagtaggtttactgccacctccagagaagctcactgccgaggtcctaggaatcatttgcattgtcctgatggatagttcttattcctttcctggagcagaacaattcttccccgaatacaagaacgcagaaagcacgtcattgtggccattgtcctgacaacagttgttattacattggtaaggaaagaagaacttgggaagagagtttgctggcctgtacttcgaagaactccagtctgctttctataaatttctggccagcattntaccttcctcatggattggtgtgtttcgtaacagcagtcatcatccatgggtgacaataaatggtttggctttcaaacatgctgaacttaactgtgcagtgctacaagtaaatcgacttaaatcagcccagtgtggatcttcaatgatatatcattgtaagcataagctttagaagtaaagcttcattttatatttcttaaatagaatatttggattgctaaatctaaaatgaatatgttattgctctatcaaaattctaatcaatattgaataggatgcccacattctaaag

SEQ ID NO: 580499 - DNA, 1494 bp, Homo sapiens
gatcaccttaaatgtaaatgggctaaatgctccaattaaaagacacagacatagcaaattggataaagagtcaagacccatcagtgtgctgtgttcaggagacccatctcacgtgcacgagacaccacatacggctcaaaataaccgggactggcggaagatctaccaagcaacatggaacaacaaaaacaaaaagcacggggttgcaatcctagtctctgataaaaccagactttaaaccaaccaacatcatccagcaagcagcacacaagacaggccatatacatcaactgggcaaagggacatccaattcgaacaagaaagcagctaactcatcgaaaatcatatcatgcacccgaatcatcaggcagcaccccagaatggactaaaagcaagtcctatagagacctacaaatgagacttagactacccacacacatcactagtggagagactttaacacgcccactgtcaaaccattagacagaaagttaacaaggatatccaggcttgaaactcagtactgcaaccaagcggaccctaatagacatctaacagaactctccaacaccaagatcaagcagaagtatacatacttctcatcaccacactccgacacttactacccaaaactaggcccacatcgtcgaccagtccacagcaactccatcagcccatgcgacaagaactagactcactaacaacacttggtctctcagcaccacagtgccctccaaccttagaacatcaagcatacaagcaacattcactccaaaaccgatccatggctgcacacatgcacaacaattggcctgactgaaccacgggcacatcactcgacatgcacgacacaaccaacgcagattctatgaacaccacttgaactagcaggccatacaccagcattggcgacatcttcccacagctgtatcgacacaattcggaacaagtccccagaactagcgacagctcagcaagacccaacccattgacacacgaacacgacaaccaactccccggcccacaccaacacgtcgaaccaccccacacacagagcgaacaaacacacaaagagacgcgttgatcctactggccttggagacggcggtgggagaagagcgagctacagagagaggagggagaggagaagcagaaagagacgacgaagaagcacggagagacggagacagaaacgacgcgcggcacgcaggacaggaggagaggagaagaagcgcggaagcaccacgaaacaaaaaacagaaagcagacgaataagacgaagcaaacgggagagcgcacgacaaggggccgccgacaggcaagcacagcaaagcgcgggccgaaaactacaccgacagacgagcgacagccaggcaacaaacaccgagacaaaagaagcaggagggagagaagagacacccacacaaacacgtgacagacagcagaggcacggccacaacagacgaacaccaacgacgagccgcaggaccgacc

SEQ ID NO: 580500 - DNA, 110 bp, Homo sapiens
atacacacacacacacacacaacacacaaccatgtactttctctattctttcactcaacaactatcaacacggaatatttttgtagttggtccagaagtgcgcctggtgt

SEQ ID NO: 580501 - DNA, 1441 bp, Homo sapiens
ctggttactagtgtgcttttgtattggtacttcttcatgtgtgggccggacacaattttttctgttgttcgttctgtacacactcgtggtctctggggtcatgtggctgtttgttgttccccccgttgtttcctcctattacgtgtgctctgcacgacggtgtgtgttgattgataacgcctcccgcttgtcttgtgggaatccccccctttgtcgtttgatgtttgcccaacgggcatccgacataagtgtgttttgcctactctggaaaacttgggctgtttaaaaaggtggttgttttgacaaccccgccgtttttggggccccctgatgatatgcttctgtgaataccttttaatttctggtttcccctggtattccatgttgggggatagtataatattcggcgataaatttaattcttttctgcgggggggtcctctacttctcacctggtgcctggtaagtataaagtcgcctctttctatggatgcatcttcttggttctcccacccttggtgaaatccccacgtgggagcccctgtctctttactacccctcctcaacatgtggtttcctaatttgggggccttctgttgagtctgttctgggccctgtttttaccaggggataatgcttgggggtgttcgtgaatttttgtggccccaataccatggggtctgtctgttaaggtgcttctttttggggtccttcgttttggttgtgtccctcctttgtgggcacatataatccccgtgtcccccacgaattcttgcgttcccttcgccccccttgcacacacggttggggattcctggcaaactacacggggggtctctggaaataagatacggtgctactatagtgggatgcactgtagtatgcgattttttgcgggggcacagaaggggaccacaggcgttcctctctgggggaaatacctctcccatgaggtctccttttatcccaaaggtattgttaatatatggagtgtcacacgtgtccttgtggcttcctcgattgatggagtaatatggggggccaccacactcgcgggttctatatgtgtgaacacatgccacagagccaccttccaactggcctactctggcacgttaactcgagagtttgtctggggtttccgaaagaagggtccctccctctttttgggggaaaggtcacagcccacgccccttcccaaaggtcttgaatgtttccactttcacccccagccccttccgctcttgcgtatagtgacccaccctatgatcttccccaagagggaactggggtttctggggtccacttctctgagtcacgtgggtaatttgaaaaatttgagttttcgatctttattttttctctgtaaacttccaagctggcttttcccatattcaattcactgtgatttatgccaataaagtttgcccatgattttcca

SEQ ID NO: 580502 - DNA, 776 bp, Homo sapiens
  misc_feature (105)..(105): n is a, c, g, or t
  misc_feature (124)..(124): n is a, c, g, or t
  misc_feature (194)..(195): n is a, c, g, or t
aagccaagcagcgctgggatgatcgtcattggtctcagaaaaagttagatgagatgacggacagggactggcggatcttccgtgaggactacagcatcaccaccnaaggtggcaagatccccantcccatccgatcctggaaagactcttctctgcccccacacatctggaggtcattgataagtgtggctaanngaaccaacacctatccagcgtcaggcaattcccattgggctacagaatcgtgacatcattggtgtggctgagactggcagtggcaagacagcagccttcctcatccctctgctggtctggatcaccacacttcccaaaattgacaggatcgaagagtcagaccaagggccttatgccatcatcctggctcccacccgtgagtgggctcaacagattgaggaagagaccatcatagtttgggaaaccgctaggtatccgcactgtggctgtcattggtggcatctccagagaagaccaggcttcaggctgcgcatgggttgtgagattgtgattgctacccctgggctgtttgattgagtgtgctggagaacccgctttgaccccccccccggttttttttttggggggggcggggggggttttttggggagcccttttttgggaaaggggccccgggcctttgtgcttaacccctaactgtggttctggcatgaggcagatcggatgattgacgatgggcttctgagccagatgtccagaagatcctgtagcacgatgcctgtctagcacacagaagccag

SEQ ID NO: 580503 - DNA, 107 bp, Homo sapiens
acctgttgtcgttaattcgccagaatgagctgtgtgcttctcttcactggctgtcctcatgaatggctgtgtatgcatgctgttgcgtgcgcattccctgtctctag

SEQ ID NO: 580504 - DNA, 655 bp, Homo sapiens
ggggagctgggactacaggcatacaccaccacacctggctaattttttgatttttaaaaaatgttttgtagagacggggtctcactgtgttgcccaggctggtcttgaactcctgagttcaagtgttcctctggtctcagcctcccaaaatgctgggattacagatgtgagccacctaacctggtctttttatttttttaaagagccaacatttaaataaggagatttcacatcacagtcgatttctggggcttggttgttgttgtttttttgttttttttttttttaattgggaaaagggatttggcccggtgttgcagacgtgggtctggaactcctaggctcaaatgatcccctccgggccggggcacgggggctcacgccggtaatcccagcacttggggaggcctaggggggccggatcacgaggtcaggagatcgagaccttccgggctaacaaggtgaaatccgggctctactaaaaatacaaaaaattagcgggaaaggggggcgggcgcctatagttccagctactcaagaggcggaggcaagagaagggatgagcccaggaggcagagctggcaggggggggagatccggccaggaatccagcctgggtgacagagcaagatccgtttcaaaaaaaaaagaacgc

SEQ ID NO: 580505 - DNA, 442 bp, Homo sapiens
ctagaggatccccctggcaccactgcatggattcattcttgcccttgacagctggctacgtgtgtttgtattttagtaggggtgctattgattggcacatattgtcccccctggagtttatcgggtggctagaaagcttttatagtacctaaaaagtatactttgatcatatggcctgacaacaatcagatattctaatctctataagcaaaagcaaggtaggattgcctccaaatgttgacaggtcttagaccatagccactgttactagatctaatgtgtgggctacttgcctggagaggccgaaccctcttggatgcttgtttgttgctccatgctgccgccgagtggcttgatgctccattacaccctccttggatccaaccttccattattgctgatcgctctcgagggcagattattccatatgtttgatctggtc

SEQ ID NO: 580506 - DNA, 184 bp, Homo sapiens
tccctcgtcaggtcagcgtatattactgttttctttttcttgttcttgtcttcttctgcgctgagtcaatgcctctcccatgaggtcactcttttcttcatcgggctctttcatatctaagggttcattttgagtgtctacatgtactatggacctgtacgcttccatgacagttgccctacag

SEQ ID NO: 580507 - DNA, 294 bp, Homo sapiens
ataggtaagctgtttctgagacttcttttcatttctttatatgtgtatatagtgaattcttattatttttaaaattttatttattcttttatttttatttttgctgaggagcccatagccttctcctcctcctcctcctcctctcgcctcatctgtctcccggcctgataccatatacaggttgttgaattcaccgtgggtagcaagctagtcataaattgcacagtgctttctctttttatgctttctgccattaacatcttacctttccggtgatcctttagagtccacctg

SEQ ID NO: 580508 - DNA, 1294 bp, Homo sapiens
taaagaatatatctggtattccttgggcgtggtttaaaaataaatttgtcctagcggaatatctcgaaaaagcggccctaaaaacaaagaccggtgagtgttaatatctttcccccacaattattagcggataaacgagatagcaccaaaaaaaaaaaaaaaaaaaaaaaaaaaaaaaaaaaaaaaaaaaaaaaaaaaaacaaaaaaaaaaaaaaaaaaaaaaaaaaaaaaaaaaaaaaagagggggggggccacaaaataaacaccccccgagaggggagaccacaaacaaaccacaacccacccatattttagaaaaaaagaggggcccacaatatgaggagcaaaactaataacaaaaacgaacagcaacggaggaaaactaaaaaacaccatccagtgtaaagaataaaaaaaacaacgctaaataggatgagtcaatcactagaagcagcaagcaaacccaaaaacaacacgggggcgggggagcacaacaaaataggtggcgagaacacaacacaccaaacaaaagaaatataacaacaccaccacaagccaggagacacaaataacaaaaaaagagaggaaaacaacgacgagtgggcaccaccaaaaagacagcgcacgaaaaatattagcgggaagagagagaaataaaatcttagacgcgacagaagaggtgcgtatataataaactaaagacgaaaaataatatatacaaagaggggggccgatcttttttatctatataaaataacaagcactagggacgaactagaacaaaaagtaggagaaaaagacaacgaaaaacgaaaacacacagaacagaagagaaagagtagctaagataagagaagaaaaaagagaccgcgaacacgaagcaagataacacaatgacacgacagcagacgaatagaagacgggggcggaaaaaaagaaagacagatagagagaacaacgaaaacgacaacacacaacacacaaacacaacaacgcaacaatcaaataagaaaccaacgaaaacaccaaaccgaacagcaggcacccacagcagcgacaacacaacacaacaacacaaccagagactgaacaacagagagaagcagcggtgaggagccaaaacaaacagcactagacaacaaagacaacccgcaaacaaaaaaaaaacaacacacaacaacacaaaaagaacgaaacagacacgaaaacacaacacaatacaaggaaaataaaaaaacaaaaagcaacaacaaacaacgaaggaacaaacgaggaaagagacagagaacacacg

SEQ ID NO: 580509 - DNA, 1444 bp, Homo sapiens
  misc_feature (215)..(215): n is a, c, g, or t
tcgctctgtggcttctctgtctgttctgtgttatttgttgttgtctcttctcttcttcttctcttctcttctgttttgttgttgctcgcttttgtcatttctcgccgtctcgcggttcgcgctgcctcttgtctgttctctgcttctgtcagtcttgtcgttatttccccgtggcgtggttttttcgccgtgctgtgtttgggtgaccctgttgngcttcctgttgttcctctcactggttgttgtttgactttccttggttgacccccggggtccgtttcctgtcctgcggtacttgtggccttggtcctcggctgtatctggaattactccatgttcaacctccaggtataccagtctattgacccaatttacgccctattttaaggttgaccaaccgattagtatacctatgtgtttggttactaattatatatcctatgtgctgtgctcacctgggttcctggaaattttcctcggggtaatatttctcttcgtaactcctaatcggcggttcccgggatcctggtcttccgggtgtttagacttcgttctagcgttgacggcgtaaggcatagggtgaatgagtcctcagtctctgataagggtaaatgtgtgcttggtgagcttctgctgtttgtctctttggtcttgcggctgttgtactccctggcgtttgtggtctggcggtaggttgctcttttcgtgctgtgttgtagccctgtatagtattttagtacttgtatagcatgaagggttgtatggagtaaaggcctatgtttgttccgtatagtaccttggttatttgacgaggttactttcgttctagtttgttatagtaccatgtagtccgtagatacttactttccagttttggtttcttgtatatagatgtcctctgatattcgttgttgcagctttatcttggttcgagttgggttcaggtatccttggttcttgtagactaggtggtataggtaatataatattccagttctacgaatattttcgtcttagctatacttatatgtagattgtggcgtattcagagggtattagtgtatagttttaccatactggtgtgtatgtcacgtctaataagtacttatctatggctactagtaatcatctagtattctcggtccaggtctcttatgagtacgtggcatatctaatatgtgttattaatggggttctcgaatttagtttggatagggataaatagactagtggtgatatatcatggtatatatataatatatgtgaggtcgacatagcaacgacacatcatagctgataatattatatttctgagtgacctagacgaaagagaaggagtagaaaggatgattcttctttggcctatcatttggtacagtctcatttccaagtcatgtatatctgttaccgcctccagtatcagagtactttcgtggttggtggt

SEQ ID NO: 580510 - DNA, 122 bp, Homo sapiens
ccctttgggaggtcaaggagggaggatcccttgggcccaggagttcaaggccagcctgggcaacatagcgggacgctgtctgtaccaaaaataatttttttaaataaacgatattatgagga

SEQ ID NO: 580511 - DNA, 475 bp, Homo sapiens
atcgaaccttttggatctctgtcagaaatgaatgtttatttctttcaagttttatcaagtattaatacgttttatttatattcttttaaatgttttattcagtagttctgtgaacttcagactttgttgttcagcctaatcgtatgcttctgtaacttctacacattttataagaactcattcaaagttgtagtcctaccatagtgtttcagggttccttgttgtgtacacttttactataatggcaaaatgtttcaaaatcattcagctttttaaagaaacttattatgcaaaagacactcttgaaatgctgtgcatttgagctgaagtgaaagaatttgtttcatgttgtactttgcattattttaagttttcacatctttaatatgcttttctatgctaattatattagaaatctataaatataagtggtttctttgtttaaactagtcattaaaaattaggttgaaaatga

SEQ ID NO: 580512 - DNA, 603 bp, Homo sapiens
ataataatgctgagtaaaagccacaccaataaaaaatttgttttttaagacggagtctcactctgttacccaggctggaatgcagtggcgtaatctcagctcactcactgcaacctccacctcccaggttcaagcgactctcctgcctcagcttcctgagtagctgtgaccacaggcacacaacaccatgcatggctaattttggtatttttagtacagatggggtttcaacatgttggccaggctggtctcgaactcctgacctcaggtgaactgcctgccttggcctcccaaagtgctggaattacaggcgtgtgttaccatgctctgccaaaaaaaaaaatttttttttggagagggtgtctggtcctggtggcccaggctgtattgcatgggctcattctcagctcattgcaacctccgccgaagaagctctcttttggtcttggcccttagctacagatagggcacccagggggcaagaaacttacggcgtatggaagagaaatcccagtttcctatccaggctccaggcagggcctaggtaatggccgggagccccttttgacttaagcctcagggtaaccgagctcgaaatcgaat

SEQ ID NO: 580513 - DNA, 505 bp, Homo sapiens
  misc_feature (36)..(36): n is a, c, g, or t
  misc_feature (355)..(355): n is a, c, g, or t
  misc_feature (504)..(504): n is a, c, g, or t
cggaaaaaatactgctggacgcacagcatgagtctnggacggagtagctccaagagctctcactgtgacagcccacctcgctcgcagacaccacaagataccaacagagcttctgaaacagatacccatagcattggagagaaaaacagctcacagtctgaggaagatgatattgaaagaaggaaagaagttgaaagcatcttgaagaaaaactcagattggatatgggattggtcaagtcggccaccctcagcatgaggaacacgagcgtcatgaagaaagggggcatattctctgcagaatttctgaaagttttccttccatctctgctgctctctcattttgctggccatcnggattggggatctatattgggaaggcgtctggacaacctcccaccaagcacctttttggatgaagaacttgggagtcttgacttgggttccgttagttggattacttcctgagccttggcaacatagcttcacttgaagagctggttana

SEQ ID NO: 580514 - DNA, 300 bp, Homo sapiens
taagcatgcactccagcctgggcaacagagatgaaacttcatctcaaaaaaaaaaaaaaaaattttatgttgggttggggcttaagggctcatgtctggtataccccaacattttgaagaggctagggcaggaggatggcttgaagggcaggaggatggtttgaagggggggatttggaaaacaagcccttcggcaacacaggtaacaaccttattctctacaagaaagattaaaaaatttggccgagtggtggtggcgcattgcctctagttcccagcctactcaggaaggcgtgaggc

SEQ ID NO: 580515 - DNA, 709 bp, Homo sapiens
gggacgtgattcctgactgatacagtgcgtatgacgggagggcagaggggctaagcctagctgtctgggggtgctgtggtggtggtagactggctacacaaagctggtctcaagaacgtgtcttggaaggggccgtcgaactgttgcagcgttagtccaagactatagttcagaaacccattcatagatcttggtccaacgtatgcttgttgaacacgggcaagagtcaaattcgcgtggacatgctctggagtacactcaaataaggctagtagtgagacccaggtcttcccggcaggattgtcgagtccagaccaactgtttgtccagagttcatcacatgtaaacatcatcgtgtacctacgcagcaaacattcagtcgcgggacgtggatctgatgttcgcaggtgacaggtaggtcatggctctgacttcctgtgggtaccacaagtaagagtcactaccaggtacgttacagccgagatgaggcagacgattggcagggaaatagtgcgctcggatccaggcagtggcatcctgataggatctctggtcaggaagtcggccggagacaggcagctattcgtaggtcagggggatcgacctaccgcggttgtactatgatcttaccagtcaatgacatgttatgctactaggggattcgaggtaccggcattctctggtagctgccaggcagagaaactagatc

SEQ ID NO: 580516 - DNA, 377 bp, Homo sapiens
tgggatatggtctctctctgtcacccaaatgggattgcaggggcgtgatctcagctcactgcagcctcgaccttcggggtcttaagcaatgctgtcacctcagccctgttggagtagctgggatgccaggtgcctacccctacaccgggctaattttttggtattttttggtacagactggcgtttggccatgtggcccaggctgtgtctccaactcctgatgttcaagcaattccctcggcctcggactgggccaaagcgcagggattaataggctgtagagccaccactcccagtctctggggtggggttctctgtgaatctgggacaccttccttgtagggaagcaaggaggaggcaggcccacgtgcaggcct

SEQ ID NO: 580517 - DNA, 197 bp, Homo sapiens
cacgaggatcttccacatgactgtggaaaccctaaaagaaagtcaatctgtattaacaaaatttcggaaaaattcattcacactacgcccgtcccaccgcgctgtcgacatcctccccgggaatgcaggcccgcgggccggcagagctcggtgcgtacgcagcgcggaaccgcgggcgcccgcgtggaccgcggccg

SEQ ID NO: 580518 - DNA, 880 bp, Homo sapiens
  misc_feature (146)..(146): n is a, c, g, or t
  misc_feature (296)..(296): n is a, c, g, or t
  misc_feature (299)..(299): n is a, c, g, or t
  misc_feature (323)..(323): n is a, c, g, or t
  misc_feature (503)..(503): n is a, c, g, or t
atgcgcgacgcttccatcaaaggacgtgcacagccttatgatcccaatttttacgatgaaacctatgattatggtggttttacaatgatgtttgatgaccgtcgcggacgcccagtgggatttcccatgcggggaagaggtggttntgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctcncanccacacacaactagagggggaganctcaatgggctatgacagaagagagggagacctggagaccgtttacgacggcatggttggtttcagtgctgatgaaacttgggactctgcaatagatacatggagcccatcagaatggcagatggcttatgaaccacagggtggctccggatatgattattcctatgcagggggtcgtgnctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacaggggtgaagccaggtatcctggagaaggttttcctaacgactagtgcacacactgaagcgggtctggctctttttaatctggctgcggttaaaaagcacaatctcctggcaaagggttcccccctagggtgggaacttgttgtccccata

SEQ ID NO: 580519 - DNA, 756 bp, Homo sapiens
  misc_feature (146)..(146): n is a, c, g, or t
  misc_feature (296)..(296): n is a, c, g, or t
  misc_feature (299)..(299): n is a, c, g, or t
  misc_feature (323)..(323): n is a, c, g, or t
  misc_feature (503)..(503): n is a, c, g, or t
atgcgcgacgcttccatcaaaggacgtgcacagccttatgatcccaatttttacgatgaaacctatgattatggtggttttacaatgatgtttgatgaccgtcgcggacgcccagtgggatttcccatgcggggaagaggtggttntgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctcncanccacacacaactagagggggaganctcaatgggctatgacagaagagagggagacctggagaccgtttacgacggcatggttggtttcagtgctgatgaaacttgggactctgcaatagatacatggagcccatcagaatggcagatggcttatgaaccacagggtggctccggatatgattattcctatgcagggggtcgtgnctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaccaccatgcctggctaattttttgtagtttttgtagaggtgggaggagatggaaggtccgccta

SEQ ID NO: 580520 - DNA, 1615 bp, Homo sapiens
  misc_feature (146)..(146): n is a, c, g, or t
  misc_feature (296)..(296): n is a, c, g, or t
  misc_feature (299)..(299): n is a, c, g, or t
  misc_feature (323)..(323): n is a, c, g, or t
  misc_feature (503)..(503): n is a, c, g, or t
  misc_feature (910)..(910): n is a, c, g, or t
  misc_feature (1300)..(1300): n is a, c, g, or t
atgcgcgacgcttccatcaaaggacgtgcacagccttatgatcccaatttttacgatgaaacctatgattatggtggttttacaatgatgtttgatgaccgtcgcggacgcccagtgggatttcccatgcggggaagaggtggttntgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctcncanccacacacaactagagggggaganctcaatgggctatgacagaagagagggagacctggagaccgtttacgacggcatggttggtttcagtgctgatgaaacttgggactctgcaatagatacatggagcccatcagaatggcagatggcttatgaaccacagggtggctccggatatgattattcctatgcagggggtcgtgnctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtatgcagatgtgaaggattctaatgcaagatattttttcttttttatagtgtgaagcagtattctggaaagtttttctaagactagtgaagaactgaaggagtcctgcatcttttttttttaatctgcttctgtttaaaaagccaacattcctctgcttcataggtgtnctgcattggaggtgtagtgaaatcttggctgttcaccagatgtaatgttttagttccttacaaacagggttgggggggggaagggcgtgcaaaaactaacattgaaattttgaaacagcagcagagtgagtggatttcatttccgtaatggtcggggggtttaaaaaattccccccatgtaattattggtgaacaccttgcttggtgggtcactgtaacattgggggggtgggacagggaggacaagtaccaatagtccacatgtccctggcatctgttcagagcagtgtgcagaatgtaatgctcttttgtaagaaacgtttatgattttcaaacataaattttagtgaacctatttcgggggccattttttttaaagacagccatttnaacatgggggtgaatttccaaccaccccaaattaaacactagtttaatttccagcctcctggtggaccatattagtgctccttgtgggcatggcaaaataatgggcaactcgtccggggatccgaaggctggaaccacatggggggagaaagcaaaaatatacgcgtaaaaagcgggaccgggggcggaatgtgccccttaaccactctgtgcgccacaggggccacacggggcgtacgctaaccaatcagcgcacttctacatagtcgggcagccactataatcagaacagcgagacagaagagcgcaacgatg

SEQ ID NO: 580521 - DNA, 1558 bp, Homo sapiens
  misc_feature (146)..(146): n is a, c, g, or t
  misc_feature (296)..(296): n is a, c, g, or t
  misc_feature (299)..(299): n is a, c, g, or t
  misc_feature (323)..(323): n is a, c, g, or t
  misc_feature (503)..(503): n is a, c, g, or t
  misc_feature (853)..(853): n is a, c, g, or t
  misc_feature (1243)..(1243): n is a, c, g, or t
atgcgcgacgcttccatcaaaggacgtgcacagccttatgatcccaatttttacgatgaaacctatgattatggtggttttacaatgatgtttgatgaccgtcgcggacgcccagtgggatttcccatgcggggaagaggtggttntgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctcncanccacacacaactagagggggaganctcaatgggctatgacagaagagagggagacctggagaccgtttacgacggcatggttggtttcagtgctgatgaaacttgggactctgcaatagatacatggagcccatcagaatggcagatggcttatgaaccacagggtggctccggatatgattattcctatgcagggggtcgtgnctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagagtgtgaagcagtattctggaaagtttttctaagactagtgaagaactgaaggagtcctgcatcttttttttttaatctgcttctgtttaaaaagccaacattcctctgcttcataggtgtnctgcattggaggtgtagtgaaatcttggctgttcaccagatgtaatgttttagttccttacaaacagggttgggggggggaagggcgtgcaaaaactaacattgaaattttgaaacagcagcagagtgagtggatttcatttccgtaatggtcggggggtttaaaaaattccccccatgtaattattggtgaacaccttgcttggtgggtcactgtaacattgggggggtgggacagggaggacaagtaccaatagtccacatgtccctggcatctgttcagagcagtgtgcagaatgtaatgctcttttgtaagaaacgtttatgattttcaaacataaattttagtgaacctatttcgggggccattttttttaaagacagccatttnaacatgggggtgaatttccaaccaccccaaattaaacactagtttaatttccagcctcctggtggaccatattagtgctccttgtgggcatggcaaaataatgggcaactcgtccggggatccgaaggctggaaccacatggggggagaaagcaaaaatatacgcgtaaaaagcgggaccgggggcggaatgtgccccttaaccactctgtgcgccacaggggccacacggggcgtacgctaaccaatcagcgcacttctacatagtcgggcagccactataatcagaacagcgagacagaagagcgcaacgatg

SEQ ID NO: 580522 - DNA, 685 bp, Homo sapiens
  misc_feature (610)..(610): n is a, c, g, or t
  misc_feature (681)..(681): n is a, c, g, or t
cccggaaattcggccattatggccggttgcaggggttaacgcctgaaatcccagaattttggaaggccaaggtggccggattacttgacggtaggagttgaagaccagcctggccaaaagggggaaaccccaactttactaaaattccaaataaatgggctgggtgtggtggtggccgcctgtaatcccagttattaaggaggctgaggcaggaggatcactggaacccggaaggcagaggttgcagggaactgagattgtgccattgcactcaagcctgggcaccagagcaggactccatctcaaaaaaccaaaaaccaaaaaaaaattattattaaaattaaaggaattaaaaattaaaggttttttaaaaaagcaatctaattgccatcacataacatttctgctctgtacagttaaagccagccaaaatcaggatggaaatctacaaaaatctaaggaaaggaaaccattgcaacccaccattactattcttaagtaatcaattttcccatggaaaaaaaattggaaacctgttccgacaggcaaggactttgaaggaatgccatctacattctcttcctaattgaaatgccccaataacttgaanataacccctctaaagattggaggaggccccgccagtgtggctcatgcctgtatttccatctttgggctttnagcc

SEQ ID NO: 580523 - DNA, 1636 bp, Homo sapiens
  misc_feature (146)..(146): n is a, c, g, or t
  misc_feature (296)..(296): n is a, c, g, or t
  misc_feature (299)..(299): n is a, c, g, or t
  misc_feature (323)..(323): n is a, c, g, or t
  misc_feature (503)..(503): n is a, c, g, or t
  misc_feature (853)..(853): n is a, c, g, or t
atgcgcgacgcttccatcaaaggacgtgcacagccttatgatcccaatttttacgatgaaacctatgattatggtggttttacaatgatgtttgatgaccgtcgcggacgcccagtgggatttcccatgcggggaagaggtggttntgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctcncanccacacacaactagagggggaganctcaatgggctatgacagaagagagggagacctggagaccgtttacgacggcatggttggtttcagtgctgatgaaacttgggactctgcaatagatacatggagcccatcagaatggcagatggcttatgaaccacagggtggctccggatatgattattcctatgcagggggtcgtgnctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagagtgtgaagcagtattctggaaagtttttctaagactagtgaagaactgaaggagtcctgcatcttttttttttaatctgcttctgtttaaaaagccaacattcctctgcttcataggtgtnctgcattggaggtgtagtgaaatcttggctgttcaccagatgtaatgttttagttccttacaaacagggttgggggggggaagggcgtgcaaaaactaacattgaaattttgaaacagcagcagagtgagtggattttgaaacagcagcagagtgagtggattttatttttcgttattgttggtggtttaaaaaattccccccatgtaattattggtgaacaccttgcttggtgggtcactgtaacattgggggggtgggacagggaggacaagtaccaatagtccacatgtccctggcatctgttcagagcagtgtgcagaatgtaatgctcttttgtaagaaacgtttatgattttcaaacataaattttagtgaacctaaaaaaaaaaaaaaaaaaaaaaaaaaaaaaaaaaaaaaagaaagaaaaaaaaaaaaaaaagaaaaaaggaaagagagcagaacgcagaagagaagaaacgacgagagggacaagagtgcagaaggaagagaagaaggaaaacaggaacacacagaaagaacggaagctaaacaaaaacaaaggggaaagacagagcaaaaagacagcaaagcagagaggcaaaaaaaacaaagagaagaatacaaagaagaagaaaaaacaaaacgagaggagagaaaacaacaaagaaccaagacaacgaacaaagacagagagagaaaagagacaaacgaaaagagcgagagagaaaaaaaaaagagaaagaggaagaaacaaacaaagagagcacaagaaacaagacgg

SEQ ID NO: 580524 - DNA, 249 bp, Homo sapiens
caggatcaaggtgaaagggagaaccccatgggggaacttcgcatccgcaaactctgtctcaacatctgtattgggggagagtggagacagactgacgcgagcagccaaggttttggggcacctcacagggcagacccctgtgttttccaagctagatacactgtcagatcctttggcatccggggaatggaaggattcctttcactgcacagtgcagggcccaggcacagaattttggggaggctttag

SEQ ID NO: 580525 - DNA, 415 bp, Homo sapiens
ggggcgactctagaggaccccaagctccaacaagaagaatataagattactgaaaaggaactgagaaacaagagaattacaaacactggttttgaaagactaaactgacagactgaaagagaaagagaacacaggtatgaaccccagacacagccgaaggtaaaaacaactaatctaatttccttccttccattaaaaaatggaaaaaacttaaatacctcaccactgcctgcgcattttaccagaacctcaaattcccagctcagctgatgatcacagacaaacagcaacctcagcacaaagctctgtgcaatcctcagcactgtgaggccaatggcttggaatccacaaaaactgagctccaggcacacttgcccatcctagtataaaatccagaggaggttactgccttctc

SEQ ID NO: 580526 - DNA, 257 bp, Homo sapiens
cattccactacttgagttgtccgatctgtagatccactaatgaatatttgtctactcatttgtagatgaccatactccatctgtatttcccactaatgttctcagacatttgcccgggactggagacccctcttggcaagtgtcgtcgtcagaaccactaactattcggttaccacagtaactgtaagcatgtgatcacgtcatcatcatgtccgttgcagcaccttaggagatttgagttctcctcgcctccagtt

SEQ ID NO: 580527 - DNA, 736 bp, Homo sapiens
tgcttagggtttgatttgctttcagatttatggatgcaaatccctgaatatttgtgaaaataggctatgaggcctgcattcagtagcaatagtaactgttttcaaaagatgcatacaatatgcaattacagagctgagggtacaggccatccttgcgttaggatttagcatagttttaacacgcagtcaacttttgagcaccaataatttttagctctctttgcttgtccttcggaattgggagaacactactatttttatcagtcaaaagacttttagcagtggtttattcaggaaaactatttatagggtagagagaagagactttctggtcatagtgcaatcgtgcagggcaagctatttctgtgttaaatttggctgtattatttgctgccactgactttgggacatcagcctggcatattctatcaaaaaagtagaattaacaaaatcagcagttgcaaactgtgatttagaaaaggggcttctattatacttcatccttatggcatgcacagactgagaaacatatgaccccaattctttttacaatcatgacaatttgtcaagtcacttcaaaaaagtttatagaaaaattgctgtaaatgcaggaagtgcacatctggagttgaatgccaggttacatttctgtgtggtgccaaatagcttgattaagaagcacataaacccagctgcactcagtgatccagatatttgagctgcatagacatgggaa

SEQ ID NO: 580528 - DNA, 232 bp, Homo sapiens
  misc_feature (180)..(180): n is a, c, g, or t
ctcatcaacacttacatctccgtgcccaaggagaacagcacgctcaactgcgccagcttcacggcgggcatcgtggaggcgtgctcacacacagcggcttccctgccaaggtcacggcgcactggcacaagggcaccacgctcatgatcaagttcgaggaggcagtcatcgctcgagatncccgctggagggccgctgacctgccggagataaaggatacagagagcccctc

SEQ ID NO: 580529 - DNA, 242 bp, Homo sapiens
caaggtgaggccccagctctgagtcagcctgcttgttggaaccgtccgggaccctacccgctaccgtgtccatttcatcgcggactgtgcggctgggggtggggggcgggactctcacggtgacatgtttacagctgggtgtgactcagtacagtggattttttttttatttttttttttttatctttttttttcccttttttttatttgtttttatttacaaaccaccggggtttccgggc

SEQ ID NO: 580530 - DNA, 1825 bp, Homo sapiens
taccaagtttagagttggggttctagagcgagtacgtagcgtttataggtttagctgtactatattcctatgtccctagctgcggggagcgtagaggcagatacggccggctttgctccaggcctacaggagtaggtgcaggttcgcagtccctagtacaatcattctccgatgtccggtcagtctgaaatctctgatttgttggtctctctgtggacatgtgtgttgtcgcttgtgtgctcctcatgactcttttctctcttttctcgttaatctccgctcggtaatgctgtgatgtcttttgtctttcttgtttggtccttgggtctttgtgattgtcggtgtgcttgtgtctggtttcgttgttggtcttgctctctttcctcgctgtacgtttcctcggtcatgtcgcgtttttgtcttttgtttgtctttctgtgctccttcacggctgtccgttggttcgtttgctggtctcctgttgtttgtgttgtctcctttcggcgtatcacttggtggtctcttgtgtgcttgtgcgcgcgtttgtgcctgtggctctgttctgctctctgttctgttgtgctctgctttgtcggttcgctacttttcatctctcccttcttcgtcgtgcctgctttttgtgtgttactgttttgtctcctgttggctttgtgcttgtttgtgtcttgcgtcttttcttgtcctgggcggcacgtgttccttatgtgtcgctcttgatgtttgctctttgtgtgtgctgtggcgtctactctgtgcgtttttcttgttctgtgttcctgtgttggtgcagtcttgcgcgcggcgttgttcccagctgtttggtgccttccgttcgcttgcgcgtacgtgctcggagctctctcgctccgtcttgtgtcgtctaccttggtccacttggttctttctctgagggacacgtttttctcggctagtttgtcaggtaccttctggtatgtcctttgtactctccagtctagtgctttggtctccgtcagtttgtgcatcgcctgtgtcattgctggtgtattttgtgcgttacgtcctagcggctgtgtgcgtttgctgtcgctgtgtcgcagcgtcgcccgcttcgtgtggccacgtggcagacgcgtctgcttatcggtcgtgcacgcgcttccgctcgtttggttccctagcgtcagcgtttcgtccgctgtggggctgcgctgctggtctcgctgcgtttgtctctcgcgtcggtacgtgtcgcgacgtctccgttgtcgttcctagggtcgctcgtcctctgtctgcgtccgtgcgtgcccgatgttcctagtggtccgttcacgtgctggcctcgtttcgttgtgtgtgcgctgcctcctctcagtgcttctcgtccgtcttcgcggacacagtggtgtctctctcctgtctgtcctgtcgtgctattatggtcttggcctccgttgtgcgcccgtacgtctactttctttggtcgttttccggttgcgtctctgcccgtttggctccccccgtttgtttagcgtcgtcgcttctccgcttcctcggtcgctctgttgctcgtagtgctgggggtgcccgtgctgcgcgtggcgggcgtctcaaggacgtccggtctctcattggagtctgtcggccgggtcgcttgcgctactcgtcgcgtgcccttgttgcgtcctgtctactgagtgtgccctgcctgtcgcctacggctgtctctctcagctgctcggtggcgcctagttgtcggtgcggtgtttattgcctcgcgttctctgttcgtcgtcgatgtctgctgttctgctgctgtgcc

SEQ ID NO: 580531 - DNA, 314 bp, Homo sapiens
aacgtcagcactccttggtggagaacaagaaagtcagctggtggtgattgcacacgacgtggatcccatcgagctggttgtcttcttgcctgcccagagtgtgaaagggggatcatacacctggcaatacacaccctcactggggaagctgaacgtccagatcacagaatgatttgaccttacctggagctgagagaaatttagagagctgagcaaaatactggggcaaaagaagcagtaggaagagccctgtgggaaatcttggtccccatggcagccatttctgactttgtctcacaaggaggtgctgacgg

SEQ ID NO: 580532 - DNA, 1225 bp, Homo sapiens
  misc_feature (750)..(750): n is a, c, g, or t
  misc_feature (922)..(922): n is a, c, g, or t
tggggggtaaagaaacagtttaattttggtttaaacgattttatttccaagaaccattggaccagggaacaatccctcccactattttttttgggctatggattatctattaaaggttccacaaatatccatggttcttggggaaatatacatctggggagaattcactggtattggacgcccatattcctggatatttcaatggggtgacacagagacacaaagaggtgctctggagagagaggggtctggaagatgtttcttacacgagggaagatgttagagtgcgggggagagtgtagaggccaggacacaacacctctatatatccctctgagagagtgtgttctgggcggcccaaacactcttgtgtttcaaaagcacgcaaccagcgcgcaaatatttactcgcggcggagcgccattatctctctacagacaggagtgtgtgtggtgtctccgctggaggagatctcaccacaaggagcacatctaccattggagcgcagactaccgcatgggctgatagaagagacgatctgtgatatcagcgcgcaaaaaaacagagggagcacacatttgagaaagggcggtttgttatctgcgctctgcccgctaataagatggtgggggggtactccccctagatgttgtggggggggggaggaccaaaaattttgttggtggcctactaacaacgacacacatccattattactacgccgagggggtgttgtgtagtctatacaanaaaattgttgactcctctttctgatattaaaacaccatggtggtgaggcaaaaatgctaccataaattatccttccccgccaaatatgctacagttgatcatcctagttgtaatatgcctccccttcgaatgatgaaggaaaacaactgctgcggcggagaatgaatgttgnccccttaattaagcggccacaaaaacagaagacagagcgcgccgctgtggtaatctaaataatgttggggcgataactatatagtgcagtcggccccatacataaggctaataagaatgatcagcacacatgttctccaagactggtgggcatgatgtggcagcctatacaaagagtgtgaaaaagaagaaaccaagaggggggagacgcggagacaaaagaaagctggggcaaaacaagagagggtgccgccaagacaacgaggcggtggaacagaggggggggataattctgcaccgacaa

SEQ ID NO: 580533 - DNA, 165 bp, Homo sapiens
accaagaaagagagctgagttttggtgtcacgtgcctgtggtcccagctccccgggagacttgaaggatcgcctgacgcctagagtttgaggctccagcgtgttatcatcacatctgtaaatagcccccacaaaaaaaaacaaacactgccctatatcctacaca

SEQ ID NO: 580534 - DNA, 295 bp, Homo sapiens
acggtgcccagcccataagtgaaacttaatttgagcctgtattaaagaaaaacagagctgaagctcagccagccaaagcagccaagaaacttacataactaaggcttctccgcgggacagaccgaagcaggcaacagtgtgactgtcaccaatccaagcttttctttggtttacttctgcatccttcttatcaaagccttcaccctgcattccctcaaccacttctggtttgcagctgctcaattcaagaatgtatttgctcaaataaactattttgccttttaaaaaaaaaaaa

SEQ ID NO: 580535 - DNA, 1227 bp, Homo sapiens
  misc_feature (161)..(161): n is a, c, g, or t
ggctgagtaggaacgtggatggaggcacgcaatgaagcatgccgctgtgtgtcatctcaagacttgaatttactcgcatatcgcacaagactaacgtgcagacgtcactagttacataggtaatcctatgcgtggcacggcaccgtccgcttactgactcnttacctggtctctaaaaataggggcgcgtgtactcttaacacaactcctctagaagagaggagggattagtcaacacgtggtgttgagctgaccgcgcgggcatgctgggcgtcctgtatctttagcaaaaccatccatccctatgaatgatgcacagagccctgaggggctgggctgggcgtgggctgagccacctggtcttctctacagttcacagaggtctttacagctcatttaatcccaggaaagcaggcatcaagagctagaatgtgaatataactttcgtggaccaatactaagcaataacaagaagcccagtggtgaggaaagtgcgttctcccagcactgcctcctgttatctccctctcatgtccctccagggaaaatgactttattgcttaatttctgcctttccccccgtacacacatgcacttatgggcctttaggttatagctggaaaaaacaaaatagctacctacaaacctggaatttacccaagaaacagaaatgaccacgtgaaattgcctctgtccaaacattccatccgtgctgtatgtgtactgtgtgtgagtgtgtgaagacgcaagtcatcttgaatatgggggtcgacaccacataaaggacagatagggacgcatccaacagagggcatgagcaccgggaacaaccctatcggctggaagagatacgcacatttgcatggaccagcaactcatcattctcaggagagacactacacgctaataaccagggaacacaaacacaaacgaaaacgaccgccgcgccccacagaatgcgcggggggagcccacgaagcgctaccctcgcgacagaggaggcccacagagggggaaataacaaaggcggccgacaaacgacgcgcgcacgaacgagctgcctgcagcaaaacacgcgcgaaactaacaacaaacacgacgacgacaaccaacagtgacaacggcagcgacagaatataacactaacgcagcagcaacaaccagcgagcgacaaagacaacaatctagcgacaccgcacactagcagcgaaggtgcgaagcgcgcca

SEQ ID NO: 580536 - DNA, 310 bp, Homo sapiens
  misc_feature (2)..(2): n is a, c, g, or t
angtcactgtgtatttttaagtgttgatacattaaaagtcgctttatggaagatgagtaaattttttaaatacttggaaattttattccttgttaacttctacagatcagggcatgcaaccaaaagcagcttaaatgaaatactttaaaataaaatatcaggaagctatttttagatttcctctggcttatgtttctactttaggaccctaattgttcttgtaataaaaacgttatttgccgtgaattcaatggctcagggtaaatttttgggctaaataatttaaaggtttcctccaattgacctatcc

SEQ ID NO: 580537 - DNA, 198 bp, Homo sapiens
gagcgcaatatgacggagtgcgcagcatcaggcaggaaactttattgaatattcttttctattggtggtagggaagttgagaacctaaagcgtatccaggttcagagaggagagagatccgacaggaagagatgagcacagagggcccaccatcaggagagagtcgatgacagggggtcctgagagcagagggactga

SEQ ID NO: 580538 - DNA, 151 bp, Homo sapiens
tttttttttttaaaaaaaaaatttttgggatcccggcccctcccgggggggggaaaaaaagatttttaaatttgggccaaggttaatttaattttaaatgttttaaggaaaaaaccgccttttttaaaaattaaaaaaaaggtttttttta

SEQ ID NO: 580539 - DNA, 230 bp, Homo sapiens
ttgtcacggttggctctcgtccacggttggctctcgtccatggttggctcgtcgtccagggttggctcctcgtccccgtgttggctactcgtccacggttggctactcgtccccggttggccactcgtccacggttggctcctcgtccacggttggctactcgtccacggttggctcctcgtccatggttgtgctactcagtccacggtttggcatcatcagtctcacgc

SEQ ID NO: 580540 - DNA, 282 bp, Homo sapiens
tctagaggatccctagtgtttggtttagggccgcttatgaatgattccccctagtttgtgtagaatgtcgtttcttggtaaacgcttgcgacagtgcgtgaatgaccaaaaaagagtgagggtgactccctgccaatgagcagtatagtggcagtgttttgtttcttatattgcccctcacgccaacagaaacggatgaatgttctaatgggccttcatattcagttaatactgatagtgctcgccccagtatccaaaagaaaggaagtataaagcgttgag

SEQ ID NO: 580541 - DNA, 382 bp, Homo sapiens
  misc_feature (37)..(37): n is a, c, g, or t
  misc_feature (59)..(59): n is a, c, g, or t
  misc_feature (78)..(78): n is a, c, g, or t
  misc_feature (110)..(110): n is a, c, g, or t
  misc_feature (170)..(170): n is a, c, g, or t
  misc_feature (347)..(347): n is a, c, g, or t
  misc_feature (358)..(358): n is a, c, g, or t
  misc_feature (368)..(368): n is a, c, g, or t
gggtccctctgcccccaccctgcccagggctccccancagcctgaggcccctaaggaanaacagccctcaatggtgantcctattggtgttatgagttgtgtccccaaanagatatatcagtgtcctgacccacagtacctcagaatgtgactgcatttggagatagggntcttccaggggtaaccaaggtagaatgaggtcgttagtgtgggccctaatccaatatgacggctatccttataaaaagaggaacatttaggctggatacagtgctcatgcctataatcccagcaccttgggaggctgaggcaggaggacttgcttgagctcaggagttcaagaccancctggggcaanatgtcgaaangctgtgtctaccaa

SEQ ID NO: 580542 - DNA, 252 bp, Homo sapiens
  misc_feature (6)..(6): n is a, c, g, or t
  misc_feature (61)..(61): n is a, c, g, or t
  misc_feature (116)..(117): n is a, c, g, or t
  misc_feature (218)..(218): n is a, c, g, or t
  misc_feature (235)..(235): n is a, c, g, or t
gaaaantgagcaacccttttttccttgcccccgttagtgaacctgtggaaagagataggcncatctctggagttgatcgttactatgtgtcaaagggtttggagaacattgattanngaagcattttcctgattgatgaaaaaataactccagttaatggccatctaccctgctagaagggttacagtgtattatgtagcatgcaatgtgttatgtangtgccttaactaaaatnaaattgaaaaaattgca

SEQ ID NO: 580543 - DNA, 129 bp, Homo sapiens
ggacccatagagtgatcactccaacccctaatggggttcagaagcttatataccatattgaggtgacaggaagaataggggcttagattgttgacaaaacaggttacaattgccaaaacaggttatggg

SEQ ID NO: 580544 - DNA, 314 bp, Homo sapiens
agcggcccctactcactactaaattggcgcgccggctcgacttccactctgcccgatctcattcctttcgattcccatccactacattccctcctcctccactcggctcgattccatcccattcccttccattccattccattccacttccattccattccattccattccgttccattccattctattccgtaccattccattccattccattccattccattccattccactcttgttgattccattcctttccattccgttcggtttgaaggcattccattccattcgatgatgattgcattcggtcgacg

SEQ ID NO: 580545 - DNA, 355 bp, Homo sapiens
  misc_feature (268)..(268): n is a, c, g, or t
  misc_feature (325)..(325): n is a, c, g, or t
ttgatcatggcacaccctttaatgggtttccatcaatcccaccagctcccatccagcgcgaagcctgcctgcgatccggcagggcaccatttccggcctcggtcccccacccttcaagatgccgttcaaggccacctgacaaccaagttgggggtaaaggggcacttcactgtccgctctcagcttggtgaatggacaagggtttgggaacggcacttggagggccctctagatatagagttaactttgaaaaacaacaagaacaagnaagcgcgcttagatatcctgaggccagctacgtaccagctttcattgtataaacgtngtggcatatagtctattacggattattcgg

SEQ ID NO: 580546 - DNA, 299 bp, Homo sapiens
  misc_feature (48)..(48): n is a, c, g, or t
  misc_feature (70)..(70): n is a, c, g, or t
  misc_feature (98)..(98): n is a, c, g, or t
  misc_feature (108)..(108): n is a, c, g, or t
tcgtgccctttttgcaccccacttggcgtgtatctcagggacactctnactctcatcatgccctcaccgntctattgtatacgcttcacccagttctnaattattttnccgtttttttctcaatttgtcttgcataatcatcagtatttttcctttttttcttcgaattagcattaaattttattaaatttccccttcccctagcgtaccgtctaccggtatcatcggtcattttcggttgttttttcttgtctccctgattcctttgacccccaaatcgtatgaatttgaaaatgttg

SEQ ID NO: 580547 - DNA, 740 bp, Homo sapiens
  misc_feature (10)..(10): n is a, c, g, or t
  misc_feature (13)..(13): n is a, c, g, or t
  misc_feature (389)..(389): n is a, c, g, or t
  misc_feature (584)..(584): n is a, c, g, or t
ggcattacantantggggtcgattacatttcttacagaaagtatggtgtaagaaaatggcatgggatttggaattggagcctatcctgggttcaagtttactttcccactgccgagaaagtctatcacacagcaatgtcactttctacaaattactctcagtctctgtttccctcagcttgttacgtggaattaaaggcaataagacgcacaaaagagctctatgagcagtaaatcactatacacatatttgttatctacagacagcaaagaacactcacatgtaacttgtctttgcaaataatggacatagtttatctttcagatcatgtatatcttgcttataatcccggcacctaacacagtgtctggctcacagtaggcactcanatatttactaagtgaggtaaatggatagtccccccttatccacagtttcaatttccatgttttcagttacccacagtacagtacataccttcaatatagtacaatattttgagagagagcaagacggtgtgtgcatgaaagagttcccaagcgcatattcacataacttttattatagcatactactatcattgntattaatctcttactgtgcctaatttataagttaaagttaatcatagttatgtataggaaaaaatatggtgtatataaggtttggtacaatctgcagtttctggcatccactgaggagcctgaaattatccccacaataagggagactacttgatt

SEQ ID NO: 580548 - DNA, 813 bp, Homo sapiens
actaccaggagccaacatgagtctcggggactgaactgctgtggcccggagcagcgctgctggtgctgttgggggtggcagccagtctgtgtgtgcgctgctcactgcccaggtgcaaagaggtcagtagaaaatctaccagcagagaagtctgcgtgaggaccaagcagagcttgtacggggtcccggtacctactccttgggtcggcgcaggcatggccaggaccgcctggtcggacatgggaccacactgaggatagggatcgaagctgttgcaattctaccccagcctggaggatccaagcatcttccaggtaccagaacttcagcagaggaagcagacacgggtcggaggaagcctacggtagaccccattgctcatggcatgtattacaactgggggcggttctcgaagcccctcagaagatgatgatgccaattcctacgagaatgtgctcattgtgcgagcagaaaagccacagagacaggtgcccaggaggagggcataggtggcctctgcagaggggacctcagctgtcactgggcctgaagactggtcgccacttctggtctctgtccctctgcctccccggaagcaagatgaggaatctgaggattatcagaactcagatcagccatcagtggcgcgagttcatggaaggtcatggggcaaactccgagagagaaggatcccctggccggtgggaagccagacgaagaggaggggaaccggatttcgtgatggggcaggggggggcgggaagcctagggcgaccaagaaaaagggcccgggcagagggccggggttgggca

SEQ ID NO: 580549 - DNA, 1077 bp, Homo sapiens
attcaaaatgatatttaaaagctcagtgagatacaagagaagacatattaacaacacaaaaaattgaaaatcaattcaagatatgaatgagaaattcaacaaagggataaatattataacatttaaaaataagcaaacagaaaccctggaattaaagaattcaataaatgcaaaatatacatttgatggcttcaaaattagactaaatcaactggaagaatgaattatagaacctgaagacagatcttttgaaattacacaccaaaaaaaactgaataaaacaataaatacaagcatatttgacctatggggcaccattacagttatccaatattccaattttgagatgtgtccccacgagtgtgacagagacggggcaggggtatagaagcagtctgtttaacaaaataatacctaaaaacttgtggaagtctacgaaatttatacagccatatataggaagctcagagatccccaaatagatacacctcaaaaagttttttttccaagtcaaactgtcaaaacgtcaaagaccgagatttctaaaaacagcaagataaatgcattctactcacactatcaccgggatcctcgtcagacaacactgtgaattttttcacggagaaaacccatgcagggtccacgaagcacactgcacattgacctattttaaacctggttgacacgacacagcaacaacaaacaacccctggacattcaggagaaattagaatggccctcaaacataaaggccttcaatacattccagaaacacataaatacatccacaaggaacacgccaaacattaggggggaatcatgattaacccaagctaaagccgggggcccccccaaccgaaaacgcgctacacggaacaatcccccaagccggtgcgacaacaacagcggaacacaccacaccaccgaaaaacacaccccgcgagactaaccacacgacgcggcgtaacaccgaccacgcatcccacgcagacgaggcacagcgagcgccgactccccacgagaccacacaagacaacacagcaagcaggcgcgcacgaccacgacagaaacacgaac

SEQ ID NO: 580550 - DNA, 92 bp, Homo sapiens
gggtgttgttaaacaaacccttaagtttatgtttgagggatggacggcaaaggaacccattttattattaaaaatgaatgattaaaattgga

SEQ ID NO: 580551 - DNA, 1222 bp, Homo sapiens
gcccagtgaggacaggaacagagagtagcatgtcctataataaaggggcttctgggcaggtgcctgggcacagatgtctgtacagacaggtgtgtgggcctagcaggagagagcagagcccagaaatgtctttggcaggcccacgtactgacttgaagctaacagtggcgcatgtcgccatggggttaggcccttgaaaagagtatcctaggtctccagtggcccctcaggacccagggtcccagctgctgctaggcagatgtgcacttgattgagccgcccggccttgccagtcctctcataccccttggaagaggaacacagtgcgctcctacaaagacactgggcgcattaacagcaatcaatggtgcacgagaggttagagaaactagcgggaagctacgcgagtcacgagcggcgtacactatttggttacctcaaaggagtaaatggaaactggcattcctcatataacccccctttttgctatataatcacacttggtaacggcaattcccccacctgttaacactctaaaaacttttgtgggtctggctaggatcgttaaccaaacaacacgaaacaaccaaatatcagtctagcaacaaacacacaatctttccgacacccgacgtagcagacccgccgaagacaccatacttcatgacaaacaccaagcgcacgaggagcccaccccagagccccacgaccacgcacacacgtgcacacgctgggtccaaagagagcggggccaccaaaaagaacaccacgggccacaatagaccatacacgggccggagactaccccccagaaaaaaaaaaacgcccccggataaaacagcgagcgaacatgaacaaaaaagcgacgaggagcgtaccgcgagaacaccgagggcacaatacaacacgggaagacccggggacgcgctaatacaaatacccccgccgcgagggggaccgcgaggaacaccgcagccaaacacgagaacgcaacgacaacaccccacagtagcgacgagcgaggagcgagggagagaaggcagaggagggagagggagacaggggggaggccagggtcgagggagagcagacggaagcgcgagcacgcgcaggggacgcggagagggtgagcagcaggcggagagcggcgtgaaggaccgatagcatacgaggtcgcagcaagaaaaggatcagtatgcgaagagaggagcgtgtggggggg

SEQ ID NO: 580552 - DNA, 307 bp, Homo sapiens
  misc_feature (221)..(221): n is a, c, g, or t
ggtaagagcggtctggtggaactgactaaacggtaccatacatctgtcctaggtagtttttgcaggtagggaatgaacattaatatccagatactcagattttatacccatattctcaactaaaagtggtcagtagttaaataaaactgtgagtagaccgctcttggaggaggggttcattttccaataaggatggctgttggtggcatcaagaacagatntcggagttcccgtcgtggcgcagtggttaacgaatccgactgtgaaccatgaggttgcgggttcggccctggcctgctcaggggtg

SEQ ID NO: 580553 - DNA, 144 bp, Homo sapiens
aatcagtcagcaaaaccttgccctctacttggtctgaccaagtgtaaacatcagcctagacaacttactaccaggtatgcagcttccaaacgagcagccatcactgaatacaatgattcagcaacagatatgcagcagcctatg

SEQ ID NO: 580554 - DNA, 619 bp, Homo sapiens
atttattatgctaagttaagtgggggagttttatttccttttttttgattgtttttggggtgtgggtaacaacttgaactcagggtctgaatcctagcttccatacatactaattatgtaacatttagggaagcacttaaccgctaacataataatcctacaatttttggggcgcgggcaattactatgcggatccattaaaaagaacgcccaacatgttcaccagtgcgcgacaccaaccctttcactataatcttacaaatcatgatcataaataaacaaatcaagtgagaggatcaatcccaagggccccacttaaccaacctctaaaaatatttagcacccataccaacatccgacctccctctcatctccccacgcaccattcatacccccataaaccccccccaatacgatcaaaacaattttaccacttcttcctcaccttttacgaaaaaaatcttctactctctcaccacacacatttatttacttaataaaataaacggaccccctcccccgataaccccctgtaacccctccacaaccgggtccatataaataccccacccacacacccccccaccacccgcccctctctatctcaataccaaaaaaa

SEQ ID NO: 580555 - DNA, 365 bp, Homo sapiens
tgctctgttactgactcagtgaacctggctgagcccatggaacagaatcctcctcagcaacaaagactagcactccacaatcccctgccaaaagccaagcctggcacacattttcctcagggaccatcttcaaggacgcacccagaacctttagctggccgacacttcaatctggcccctctaggccgacgaagagttcagtcccaatgggcctcctttaggtgtggcctttaaggagcgccccacagctatgcttgtttcctttaggaatcctttcctaccaaccctggtcatttcttagcctgacagcaaggaacaacatggggtactcacagggaatctagccctgcatacatctatcaccc

SEQ ID NO: 580556 - DNA, 425 bp, Homo sapiens
aagccgtatctacaaaaaaataaaaaaattagccaaacgtggtggcacgtacctgtagttccagctactggggagaccgaggttggaagagggggttgggggcatctcttggcctgggaggttgaggctgcagtgaaccataattgcaccactgcactccagcctggatgacagagtgagaccttgttaagaaaaaaaaaaaaaaaaaagggaaaaaaaaaaaaaaagagaaaaaattatacccagctcccatagtcccttctaaaatctgtgtcaccaaaaattggtagaccaactttggaaattgggcaattgttctccgtgggtgctccttttacaaaaattgtcaggaattgtgctctaaagtataaaagacccttctcctataggttggctcttgatttcatacaggaaattctggtgcc

SEQ ID NO: 580557 - DNA, 313 bp, Homo sapiens
aaaaatttgcagcccttttaatacccaaagcaaaaggtaataggctggatgggggaccaaccttaattcacatacagagcccaagtttagatccagactaattgggaaataagttaaagtttgcagggccttagggctgaaagccaaaaacactgtccttttggcagccatggaagcgaggatttccttttttggtttaagggcatgaaccccttcggttgctccatagcctggggggcctgcagcacggccactgccttgtttattttggcatggagggattctggaaactccaccatgagcaacagctccg

SEQ ID NO: 580558 - DNA, 958 bp, Homo sapiens
  misc_feature (321)..(321): n is a, c, g, or t
  misc_feature (348)..(348): n is a, c, g, or t
  misc_feature (395)..(396): n is a, c, g, or t
  misc_feature (417)..(417): n is a, c, g, or t
  misc_feature (443)..(443): n is a, c, g, or t
  misc_feature (474)..(474): n is a, c, g, or t
  misc_feature (479)..(480): n is a, c, g, or t
  misc_feature (486)..(486): n is a, c, g, or t
  misc_feature (507)..(507): n is a, c, g, or t
  misc_feature (544)..(545): n is a, c, g, or t
  misc_feature (547)..(551): n is a, c, g, or t
  misc_feature (555)..(556): n is a, c, g, or t
  misc_feature (560)..(560): n is a, c, g, or t
  misc_feature (563)..(563): n is a, c, g, or t
  misc_feature (573)..(574): n is a, c, g, or t
  misc_feature (577)..(577): n is a, c, g, or t
  misc_feature (579)..(580): n is a, c, g, or t
  misc_feature (583)..(583): n is a, c, g, or t
  misc_feature (588)..(588): n is a, c, g, or t
  misc_feature (591)..(591): n is a, c, g, or t
  misc_feature (596)..(596): n is a, c, g, or t
  misc_feature (607)..(607): n is a, c, g, or t
  misc_feature (615)..(615): n is a, c, g, or t
  misc_feature (623)..(623): n is a, c, g, or t
  misc_feature (625)..(625): n is a, c, g, or t
  misc_feature (632)..(632): n is a, c, g, or t
  misc_feature (644)..(644): n is a, c, g, or t
  misc_feature (654)..(654): n is a, c, g, or t
  misc_feature (660)..(660): n is a, c, g, or t
  misc_feature (662)..(662): n is a, c, g, or t
  misc_feature (666)..(666): n is a, c, g, or t
  misc_feature (671)..(671): n is a, c, g, or t
  misc_feature (683)..(683): n is a, c, g, or t
  misc_feature (732)..(732): n is a, c, g, or t
  misc_feature (763)..(763): n is a, c, g, or t
  misc_feature (813)..(813): n is a, c, g, or t
  misc_feature (907)..(907): n is a, c, g, or t
gtgagagccaggtgttctgttcctgctcctacgatgccaccacacactttgagacaacctgcaacgacatcaaagacatctacaaacgcatggctggcacggcctttgactttgagaacatgaagcgcaaacagaacgacgtctttggagaagctgagcagtgattgtggccgcccccagcccctgctgccccagcctgtgtctgttctcctcgagggctccagcatcctctgcttcccccaccacgttcccatcacccacctcattgatccactgaccaaatccttaaccctagcgatggcttgggagatggggggttcnatagcatcctctttcttggccctcccntatcctaggaaaagagggttcctctccttgtgtgtgtctcttcccannacccctaattcttctgctctntttgggaagacgtggaggaaaaggtnacttctgcccccaccgctcttacccccactntagtnncctttngagatgcccccacctccccanaaccaactctcgcgtgttggagagaaggggccctccnngnnnnnagtnncatnccnccccgataanntantnnaanttatnaantttgncccaccctttntgagcctncagccttncngtgtggnctgagggctgtngagtgagctnccccancncctnccagnccttggccagcntgggggagtggggaaggcttgggcatggccccgttggaggttgatttgntgttttgtttcttgtctttgtgttctgtggnacttgctgagagaaaagaaaagtgagccaagcagaaggaggtgggaaaanggacccaaaccccagtgtgccctgccccatgccctcctcttaggggtgggaaacccttatcttgcaaagtgaatgtgtccccttccccaccctntagtgtatttcacagaaaacgaggcctcccaataaaacggttgaaacatga

SEQ ID NO: 580559 - DNA, 712 bp, Homo sapiens
ggaagtagctacagttgtgtcccttcctgctttgtagcgtgtttcttatgcttattgtcgggacgtggtatctccaccattatctgtctgcacgaaagatgtcttgctgttcatcgctgaacattttgaaatgaaatgcagaattttatgtgactgctttttagcctcacagattatgctgtgaattttacaaaaatttatttgctttgtagataatttattgtaccaaagctgtggtgatagcagcatagagtgtctgtgaaccaaataatgtagcagttcatgcacatttgatcacatagggtgtacactagacgcattatttacaagtgtcagtggaacaagttatgtgcatgtacgtatgtgcttaagagcaaaacctggaactgtagtggaatccatatgccaatagcagttgtacagcaatctgtgtacttgaatcatagtaggattgacatctaattgcaagattacaacatgctgttaccattctaagtgtgtacaggcttctgaaggtaaagggacactggatacagaatctatggaaccagcagtggatgctgtattcctgattagacgtacttgtaaatttgaaagcaagatcttgagttgcagcaacaggtccagagtatgagtgcgagcaaaggagaactctcatgcgtgatctgagcagataggctggtatgtaaagaggtgcctcgtgtggagatga

SEQ ID NO: 580560 - DNA, 134 bp, Homo sapiens
tctgttgtactctgcacttttgcagctctgggccgtgctgctgcacctctatctgcgcgtacctgcagcagtggcttcaccttggtaaacagccgccaccacgtgccagtgtctcagctggagggggccgcgcg

SEQ ID NO: 580561 - DNA, 91 bp, Homo sapiens
ttttaatttaaaattatgagttttcatttttgtttaccttaagtgatgcttaaaagtggcatgtattaggcacattaggtttgttgaagca

SEQ ID NO: 580562 - DNA, 600 bp, Homo sapiens
  misc_feature (15)..(15): n is a, c, g, or t
  misc_feature (24)..(24): n is a, c, g, or t
  misc_feature (98)..(98): n is a, c, g, or t
  misc_feature (512)..(512): n is a, c, g, or t
gacgagtagtcgagntatacactntatttttcaatgtacaattatttttcactacagatcgtccgtgatgcaatatatcaaagtacaatccatatgtntctgagtcctgaatgaatacttaacaaaaatgttcatatttgtccttgaacatgcagtgtcttgtcctgcaaacacatacggacttttcattttcatccacatgaagttaaacatacaaatgcactgctccaaaaataaaccgttaggtgcaagaaaactacagagcaagcaatagtgcttgcgcgagagtctgcacccaccctccaaagaaaagatcaacattggaacaaagaagactctctcataaggtggacaattcactagaaatccagaaacccaaaacactgtgaaaccaaatccatatttctttggatttaattactgcaaaatccaattgttgagactctccccatgtaaattgttttcatctgttactcatattacagccacaattcacctgtttcttcccttgnttttactttattatttacgatgtgagctggtgagaaattataagaatgatttctataaaatttagtacaccaatttttagatgcaagt

SEQ ID NO: 580563 - DNA, 845 bp, Homo sapiens
ctaagcacagttctattggctccttatcgagccgagctgggtcagtcagagaaagcttctaggtaaggaccacatctacaacgtaatcgtcgacagcccatgcgagttgtaataatcttctctcatatggtacgtacccatcataatcggaggctgtggcatactgactagttcccgcataataagtcggtgcccccgatatgggcgtttccccgcataaacaagataagcttctgactcttacctccctctctcctactccgtgctcggcagtctgctatagtggaggccggagacaggaacaaggttgaacagatcataaccatccgcttagcagggaactagcatctgcacacctggagcctccgtagaccataaccagtccttgctccttacgactctatgcaaggtgtctccgtcgtatcgttgacggggccagtcagattgtcagtcgacaatcgaattatcaattataaaagacccccttgccatagacgccaaatagccaaagagccccgtcttccgtcgtgatccgtcctaagtcgacagcaagtccgtacgttctccgtatctctcccagtcctagctgctggcactcactatactactaagcagaccgcaacgctcaaacacgcaccttcgttcgatccccgtccggcaggtagggagagcccagttcctataccaagcatcgtattctgattttttcggtcacccgtgaaggtgtatatacgtgatcctaaccaggcttcggaaataatgtcccatattgtaacttaactactccgggaagaaaaaagaaacccttttggattccatagggtatgggtctggctatgatatgg

SEQ ID NO: 580564 - DNA, 107 bp, Homo sapiens
cctcctgtgctgtccctcctcagtgctgtccacctcctctgtgctgcctccgctgtgctgtccaccttctctgtgctgtccacccctctggccctcctctgtgctgt

SEQ ID NO: 580565 - DNA, 432 bp, Homo sapiens
  misc_feature (64)..(64): n is a, c, g, or t
atcatttttggcccagacctggggtgccccagccatcgccatccattgcattccaccgcaagantggtggtcctagtgatttggactcccctcggagggatttggggtggccacagtccctggacagtgatccaaacaactggccgccccccaaggggtttgtcacctttagggagacctatttcctccccccccccaaaaaccttttgtgtttttgcctagggccaggtggtcctggcagcccaaacgagtttttcatttttttttgtgggccaggtagttttgccccaaacgcaggattttgaggttgcaactggttttttgatgggggccttttgttcaacccaggaacccccgccttttggtttggtttaaaaccctacctggggaaagttttttccttattttccataaatggccggcctttttgga

SEQ ID NO: 580566 - DNA, 563 bp, Homo sapiens
acggactgacgaggcttacgggaacagacactctagatacgggtcgggcttccaggcacacaaagcttccgcctaaactaccatccagggtcttacagaattccttatccaccatcataatattccatatagcatggcttctggttaaggaactaacgttacagccaaagaagtgcagcaaggggcccaggctcagggaattcactgctctcaccaggttccccaccaccctgaaatagctggcttgaaagaatggtggaatggccttgggaagattcagttacagtgccaactaggttacaataccttgcagggctagggtaagattctccaggagtctgtatatactctgaatctgtatctaatatatggtgctgtttctcccacagccaggattcacagatccatgaatcaagggggggaaatcaaggggtccctatcaaccctagtgacccactagcaaaatttctcctccggttacagagatcttttggtctgctagcctagaggtttcagttccaaagggaggaatgcttccggcaggagacacaaggattccatgg

SEQ ID NO: 580567 - DNA, 132 bp, Homo sapiens
  misc_feature (5)..(5): n is a, c, g, or t
ggctntgtttcttaggagaactgacaaacgagtctatggctgagtgtggtgtctcatgcctgaagtcccagcgctttgggaggccaagacaggaggattgcttgaggccaggagttcaacatcacccggggc

SEQ ID NO: 580568 - DNA, 185 bp, Homo sapiens
tcaaagtaactgaacgagggccggtgtacgagcctttgcacagcctgatgcggcgtcccggagcagccagttcttgaacctgcatgagggaatcgtggcgtgcagcctggatgacgatgccggtgtcttcgtattcgctcagcaggtccatcacaatgcgatgcgagcggtcatggatgtcgggg

SEQ ID NO: 580569 - DNA, 354 bp, Homo sapiens
cttccactgatcgtcctcacttggtcattggcacccacttcctttcgccagctcatgtcatgaagttgttagaggctattcccagccaatactcttcccccactaccattgccactgctatgaacttatcagagaagattaataacgattggagtcgctgtaggcaactgtttaggatttgtggcgaatcgaatgttgaatccttactacaatcaggcatatttgcttgcagaagaaggcagctcaccataggaggtagatcaggtgctggaagagctcggatcttgggaccttgtacagtgcctgatcttgctgcgttggatgtggactgtgcccgaacatggagttaggggt

SEQ ID NO: 580570 - DNA, 682 bp, Homo sapiens
ggaaaagccaagaatcacttagtggaagaatgatgtcctgactgagacagggataagaaggaattgggtggagaagagctagcatagaggttgtggtagagttagaagggagatgagaagaaaacactgtatatatacaatagaatactattcagcctttaaaaagaaggaaactttgtcattgccacaacatgaggggacctggaaggcattatattaagtgaaaaaaaagccaagcacagaatgacaaatgctatgtgatctcacttatatgtggaatctaaaaaaagtcaaactcatagaagcagaaaatagaacagcagttaccagagatggggttgggaggaggggacaggattggcaagatgttggtcaaaggacacacaagtttggttagagaggagacataagctcaagagatctattgtccctcatgatgactataattaataacaatatattatatacctgaaaattgccagcctgggcaacatagtgagacctcgtctctataaaaaaaataaaaaaattagctgggtgtggtggcacacacctgtagtcccagctacttggtaggctgaggcgggaggattacttgagcccaggaggtcaaatctgcagtgagccatgatcataccactgcactccagcctgggtaacagggcaagaccctgcctcaaaa

SEQ ID NO: 580571 - DNA, 213 bp, Homo sapiens
aaagtttttaaaatatcccttaatctaccccaaatgtaccataattaccacttttattttaaaaatacctctatctagattgggggttcttctctgtcaatctggtttcctcttataaaacaagtcaattctcaacagcctacgattaataagggaaaatgtaattaaatgcagaagtagtctatttgccaacaggtccttccaggtacttcc

SEQ ID NO: 580572 - DNA, 722 bp, Homo sapiens
ccagacctttcaaaaggtggagttttgcccctcgcgggcattccctggaaaaaagtttgggaaacccttgtctcaacggtggttggggcccaatggaagtctctaaagccctttagtgtgcgccccaccccaaagcaagaaccctagggccccttccggtactttgtcgccatgacgagcgccaaacacatgttaacatcaccttctctggttaccttaaaaggaaaaaggattgagccaggcggctacccatatgcgagtccgaatttaaagaacatgaactgaacgatgctgcacaagctcactcaccactctgtcacgggctgcagcctgggaccggggaacctcctggcttctgggaccatcagcgggccggacccagaaaacttgggctccatgttggaactgtcgtgcaagggaacaaagcccatagccctggggaatggtcagtccaggaagtttattctgaacgggaatatagtcatcataacagggtactgccagggggatggttaccgcatcggctttggccagtgtgctgaaaaagtgctgcctgctctcctgccatcatgagattttctctgctcttatgcaaacaaagggctcaagcacccctttcaaccctgtgactggggtcctccctcggactgtaggcctggcccgccattcagtgacaaataaagccattgtgctttaaggcctgccctgcccaaattataaaa

SEQ ID NO: 580573 - DNA, 245 bp, Homo sapiens
tacgacgccaagcgtgacggtttcgccatcgccggcggtggcggcatggtggtggtcgaggagctggaacacgctctggcccgtggtgccaagatacacgcggaaatcgtcggctacggcgccacttccgatggctacgacacggtggctccaagcggcgaaggtgcaatccgctgcatggaaatggccatgtccactgtcgacacccctatcgactacctgaacacccacggcacttcgacccc

SEQ ID NO: 580574 - DNA, 615 bp, Homo sapiens
gaccgctctcttctaggagtgccccagcctctcccaatcacgcgggagtgctgtctgctcactctagtgtgcgcccagacccctgagagcctgtcgagggaaggttcgccggcccccctggagcctgagcctgcgcgctgctcagcccaaactcgctgtcatccatgaagcccggtttgccctagagcgccccatgggctctcctctgtcccagtcagccagtcttaatcaccgctccatgcggcatgctaccacaggccatcacagtcctgtcgacctacatctgtggccaccccattgaccacctcgacctcccagccacccgtcgtgcagacggttcatcgtcgtccaccatgatcctcacgcggtgtcggtcaccagtgtggccggactggccccagcgaacacgtacactgatctctggacaagctgctggctcaccccggcatgccgtgctgtacccttcctaaggcagaggcccaggagaatggagaccacagggaagtcacaacgtgaaacgtaaagcctatccccgccattggccacgccgacgctcgagctactgcacagccggatcatccagacggcacagaccaccccggtccagacggtgaa

SEQ ID NO: 580575 - DNA, 148 bp, Homo sapiens
tacgacggctgcgattgcagtcgtgatcgatttccgcagcgagggctcaagcctgagggtgcgggaaaaactcgaaaggctcggctttcatatcgaagctggggtgagatgccacgagcaattcctgctgtcggtgcggaggcagcat

SEQ ID NO: 580576 - DNA, 453 bp, Homo sapiens
aactcagcctggtcaggaacgtcagcgagcctctaccccgattgggagcagcaatgggccccgcctcactgcatctgaagtgcagcagataccctgctggatccggaggggtgtaagtcagtggtggtgtctgcaaaaatagccatcagtcagtggtcgatggcgagcgaaagctcagtacgaaatagaacaaacaccgaccacatagtatgcggttatgggatttactataatgaccacagagctcccatacaaccggaggggaccttctgggggttgcctttgccggctcatctgccttggtttatatccccatctttgtccctccccctgtgctctcaggcaatagatcattggctatttctttacctcctgttttagcctatttagccttttagtgcgctctctttactacctgatttgtcaggtctgagctacgttgcccgccccgtc

SEQ ID NO: 580577 - DNA, 339 bp, Homo sapiens
tcctagacccaggcatagtcaaagtagagggctgaggagttgtggcaaaggagcagactggacctgagaccctaaccctggaattttcaaatatagaataaccctcattctttgctgtggtgcctctagtacacagtttcggaagctgcttccaacaaatcatgtgtattgaccacctactccatgtcaggcactttaaagacacagccttgccgagcgtggtgacttacgcctgtaattcccgcactttgggaagccaaggcgggctgatcacttagggttaggagctcgagaccagcctggccatacacggtgaaaccccgtctctactaaaaatac

SEQ ID NO: 580578 - DNA, 403 bp, Homo sapiens
  misc_feature (71)..(72): n is a, c, g, or t
cacacggggaaagccacaaatgtcttgaatgtggggaagaagacaaagtacacaccttatccgacaccaannattcatcaaaataaagtgctgtcggctgggcgtggtgctcacgcctataatcccagcactttgggaggccaaggcaggcagatcatttgagatcaggagtttgaaaccagcctggccaacatggtaaatcctgtctctactaaaaatacaaaaatgagccgggcatggtggtgcatgcctgtaagcccagctattcgggaggctgaggtaggagaatcacttgaacccaggaggcggaagctgcagtgagctgagatcatgccactgcactccagcctgggcaacagagcgagactccatctcaaaaaagaaataaagtgctgtcatttcc

SEQ ID NO: 580579 - DNA, 326 bp, Homo sapiens
  misc_feature (12)..(12): n is a, c, g, or t
ggattcccgganccccaaggaagtccctgtattcccaggaattccccccatgggcccacgagcccagagacgggaacccaaagatggaagggggccttagaaataaattcacagagacagggaccagaagcaggagaagggtcagagagtggcggagaggcggagcggaggcaataatgtaacgttgcatctcggtgagcggggcggagcccaaggccggagggacagcggcggctctggaaaaggagcgcgacggagaatttgggacctggccggggtcaccggaactcagaacaaagggcacaaggaagcaggcgagggcctgt

SEQ ID NO: 580580 - DNA, 788 bp, Homo sapiens
gcacgaaagcttatagtgctcatggcagaacaagagcacggtaaacgtcagcgtttcctgcggcgttaccgtgaccacatcaaaaaggcggtagaagaggccgtcagccgccgctccatcaccgatatggagcatggcgaacaaatcagcattcccggacgggacatcgacgaaccggtgcttcaccatggccgcggcggcaaacagaccgtggtgcatcccggcaacaaggaattcaccaccggcgaacatatccagcgcccacaaggcggtggcggcggcaaaggtccgggcaaagccggcaactctggcgaaggcatggatgaattcgtattccagatcactcaggaagaattcctcgaattcatgttcgaagacctcgaactgcccaacctggtcaaacgcaacctgaccggcaccgataccttcaagaccgtacgcgcagggatcagcaacgagggcaacccgtcgcgcatcaacatcatccgcaccctgcgctcagcccatgcacggcgtatcgccctgtccggcagcagccgcgccaaactcaagcaggccaaggaagagttggcacgcttgaagcgcgaagaaccggacaacttcggcgatatccaggaaatagaggcggaaatcgaaaaactcagcgcgcgcatccaccgcgtgccgttcctcgatacctttgacttgaaatacaacctgctggtcaagcaacccaaccccagctccaggctgtgatgttctgcctgatgacgtttccggctccatgaccactataagctttcgtccac

SEQ ID NO: 580581 - DNA, 937 bp, Homo sapiens
aagtctggtgatgctgccatagtggatatggtacctggcacggcccatgtgtgtcgagagcttctcagactatccacctttgggtcgctttgcatgtcgtgatatgagacagacagcttgcggtgggtgtcatcacgagcagatggacaagaagggtgctgtagcgttggcgaggtcaccaagtctgcccacaaagctcatacaggctaaatgaatattgatcgcctaataccctgtccacaccacagtcttaatcaggtggtggaagagcggtattattagaaaggtgtatgtgtaaatattggacatgaaagttatagtagtacaagaactggtaaatgataagcgagatggatagtgaaaaccttcagagaggaaaggagaatgtatgtgagagcactgtgggttgcttttgtgcgtgtgggagtatgtaacgtatattagttgattgatgatcagtgctatagaaatggaaacaacgttgacgcaaggaaattgtctacagaagtttatgatgaagcactattaaaatagttatggaggaataaaaaaaaaaaaaaaggggggcgcaaaagatactgagggggcaagttaaggggtaaccaagtattgtaaaaagtggtccctataggtgaggtgataaaaggtaggcacgtgccgtggtttatcaaaacgctccgtgaatggggaaacgctgctagcttggaatctttgctgacgcgaaccattacttcgcgggggttgacatttaattggtacaagtcctaacgaaaatttaaactctaaggtacatgtaaatttacaggcataacggttaaccagactgatatgtgccgagaaaaatagtataggaggtgatatgcaacatttacaacgggataacagaaaatcatagagtgtaacaaagatataacgagagcaacgtacatataataac

SEQ ID NO: 580582 - DNA, 221 bp, Homo sapiens
atccatccatccatccacccattctactatccatccatccatccatccacccatcctaccatccatccatccatccatccacccatccatccacccatccatccatccatctatccacccatcctaccatccatccatccatccatccatccatccatccatacatccaatcagtcacgtgtccaaccatctatccatctatcttctatccatccatcgaa

SEQ ID NO: 580583 - DNA, 519 bp, Homo sapiens
tcccctttgaggacttcatacaaagctgggcattaagaaaaccacaatgcatggccgggcgtggtggcttacacctgtaatcccagcacttgggaggccgaggtgggtggatcacccgaggtcaggagttcgagaccagcctggccaacatggtgaaaccccatcactactaaaaatatgtaaattagtcgggcgtggtgtcacgtgcctgtaatcctagctgctcgggaggctgaggcaggagaatcacttgaacttgggaggtggaggttgcagtaagctgagattgtgccactgcactctagcctgagcaacaagagcaaaactcagtctcaaaaaaaaaaaaaaaagaaaaacaaaaaaacaacacaaaaagaggggcgagagcgccgcgaaacagagagagtctatctcgcccgcgagggaggcgaccaatggttaaccgaattacaccagggttccgtggacaaagggggggcctataaagggggcgagagataattaggctaaggaaccggg

SEQ ID NO: 580584 - DNA, 474 bp, Homo sapiens
tcgaatcgacggttctctaaagacagtacacaaatggtcagcaggccatacgcaaggtgtcctgacactaatcacccaggagaaggcaatcaaacccacggtgtgaaatcacctcaccacgtgctaagatgactatcgtctaaaaagaccagagataagtgctggtgaggatgtggcgaaaggggaacccttgtacactgttggtgggcatgtaaattgggacagccattatagaaaacagtatggaggttcctcaaaagcctaaaaatggagctaccatatgacccagcaatctcacttgtagttatagacccaaagcaactgaaatcagtatgttgatgagatacctgcacccatgtttcctgcagcactctatacaacaggcaaagcacagaagcaacctaagcatctatcaactgatgaatgggataaagaaaacagtagatattcgaaatggaatactgttcagctact

SEQ ID NO: 580585 - DNA, 164 bp, Homo sapiens
aagttgtgcagttctgcatggcactctcttcctccttcctctcagaggacacagaactgtgctgtcgctttgatgtgtactttctagagtccctgtgctggccagagacgattcctgtgtggcagccaccgatacacctatgtagggctcagcgaacataccat

SEQ ID NO: 580586 - DNA, 114 bp, Homo sapiens
caatggttgtgatgtggtggtggtgaagtcacagcgatgcattcttggtggacgtactgctggatgcctgtgaggctggaaggagataattttccttgtgtctaagaaccattt

SEQ ID NO: 580587 - DNA, 264 bp, Homo sapiens
gatagttcattcaggcatcatggcgtgtgcctgtagttccccactatctgggaagctgaggcgtgacgatcactttagcccaggatttcaagggtacagtgaactaatagatcatgccagccactgaactccagcctggggaacagtagctaagaccctgttttagggggacaaaaaatctatctaagctcctatgtgccatagatgttacaacactcatagtctggaggaatcaccaagtctttaagaaaatggagacaggtg

SEQ ID NO: 580588 - DNA, 132 bp, Homo sapiens
taaggagcccaagctgctcccagtccatgcttcctagtgcgctaagaaacccctgtgtgcttcccatcatgtgctggccgatcctcctcgatgactctaaggtggctcgctgcggtcggagcccaccgccaa

SEQ ID NO: 580589 - DNA, 425 bp, Homo sapiens
gctgccccctccatttacatgatcaacctggcagtctttgacctgctggtggtgctctccctcccaggacccaggaactgcatggctgtaaaaggaaggtccttggaggggatcagcagtctcagtgtgatgtgacaactatggacctgtgggtgtgccctggggacccctgacccatccccaaaccctgtggaaaaaagggccttttttccgtggggacccgtgtctgtgggaacgggcacaggtccatttttcaggcccctacggctgctcggcaggagggccgaaagtttggacccccataactgcaaccccagctggcccataatcaacagtggggccccccagcccaggaggggcgggcggttagctttggaaaaaatgacttgattaatttgattcgcccaataaataaattcctctga

SEQ ID NO: 580590 - DNA, 400 bp, Homo sapiens
cttatgtgtaaaagtagataataccagcactgctgcacacacagggcaatattttcttttttttttaaaaaaaaaaggcaataaatattggttaaaaaaattatacaggctgggtgcggtgtctcacacctgtaatcccagcactttgggaggccggggtgggcgtatcaaccgaggtcaggagttcaagactagcctggtcaacatggtgaaaccccatctctactaaaaatacaaaattagccgggcgtggtggtgcacacctgtggtcccagctacttgggaggctgaggcaggagaatcgcttgaacccaggagtcggaggctgcagtgagccaagatcacgcctccgcactccagcctgggggacaagagctagtctccatctcaaaaaaaaaaa

SEQ ID NO: 580591 - DNA, 496 bp, Homo sapiens
  misc_feature (242)..(242): n is a, c, g, or t
tttatcttttccttccctcaatgctacttttctaaagtcttcatattttcctctttaaatcctaagctattttaaattacggtttaaaactttacgcttagccatatcctagttacctattgacgatattttttaaataattgtaataatctcgtatctttcaaagaggaaaaatcttatctgcggtttcctcaagctccgcctgccccctcaagcagataggaagctcaacccactctggncaaccaacactgcaattgcaaggttggcaccttacttccctggggatccccagagttggtcccaaggagggagaatgggttctcaatacggtaccaaagatataatcaccttggtttacaaataatttttaggactcacgttaactcacaatttatacagcagaaatgctattttgtatgctgttaagtttttctatctgtgtacttttttttaagggaaagattttaatattaaccctggtgcttctcactca

SEQ ID NO: 580592 - DNA, 153 bp, Homo sapiens
tcatattagttatccacgagacaactactgtagcatctaacacatatgtccttctagatacgtgtgtgtgagatacatctgctcaaaaatgaaattacagttgtgttgcaggcttttattattaagtgccttttaagtacatgactgtgccag

SEQ ID NO: 580593 - DNA, 430 bp, Homo sapiens
  misc_feature (87)..(87): n is a, c, g, or t
  misc_feature (127)..(127): n is a, c, g, or t
ccctccccccagctgcccatcctgagcagcgtccatggggtaggtttgtcactgccagaccagcagtgacatctcattgtcccagcnagtgggcatggaggtccaggggagtcagggttgatccaanacgcccccgcaggggaaggtttgaaagggggcaagaaacccaccccttttggccccaaccttccattgaagttgggcaccttacttccctggggatccccagagttggtcccaaggagggagaatgggttctcaatacggtaccaaagatataatcaccttggtttacaaataatttttaggactcacgttaactcacaatttatacagcagaaatgctattttgtatgctgttaagtttttctatctgtgtacttttttttaagggaaagattttaatattaaccctggtgcttctcactca

SEQ ID NO: 580594 - DNA, 152 bp, Homo sapiens
ctccagcagcacttctcgttgttcagagagatgtcaggaaacatgactctgcggtcgaggtgctcggtagggctgctcgcccgatctccgcctgcagggttgaaggtgctgatgttgctgctgctgttgctgacgtccccgtccgcgggccg

SEQ ID NO: 580595 - DNA, 135 bp, Homo sapiens
gaggtggctagtcttcttctagacgacgaagagttggagaagaaactgaggctggggcaggaagagaaactggcaacaggaggaaaccaactgagtgaaagagcgcaaactgtgtgccttggatcatgggatcct

SEQ ID NO: 580596 - DNA, 299 bp, Homo sapiens
  misc_feature (58)..(58): n is a, c, g, or t
  misc_feature (106)..(106): n is a, c, g, or t
  misc_feature (185)..(185): n is a, c, g, or t
  misc_feature (252)..(252): n is a, c, g, or t
  misc_feature (282)..(282): n is a, c, g, or t
acagtattcatgactccacaagatccaggcagaatcaagtcaacttgccatcagcagngatcatttcaagaatgtactctggaattggctttcccttcttccctgnttccctctgactggtatgacactcctcttccctgaaaatatttctgtaatctacctgcctattagaaggtacagcttgnactttatttcaagatggtactttactatgacattctccctgatgatctcaatgggctcacttctttnttcttatctattgcagtaggtattttatgntatttttatttgcctct

SEQ ID NO: 580597 - DNA, 750 bp, Homo sapiens
aacccaccctttgagagtgcatcacacaacgagacctatcgccgcatcgtcaaggtggacctaaagttccccgcttctgtgcccacgggagcccaggacctcatctccaaactgctcaggcataacccctcggaacggctgcccctggcccaggtctcagccgttccgaggggttatgcctgagaactctcggagggtgctgcctccggtctgtccttcagtcggtcgccggatggtgccctgtcattcagtcgggtgcgtgtgtatgtatgtctgtgtatgtataggggaaagaagggatccctgactgttcccttatctgattatctaccttcctcgcttgttataatgaaggcgtgaagctgtatgtaaaaaaaaaaaaaaaaacaaaaaaaaaaaaaaaaaaaaaaaaaaaaaagaagagaagcgagagaagaaagacagagaagacagggagggagacagaggacagcgaccaaagacgaaaggcaaaagaaggagaggagcggggcacgagggagaaaggccggcagggggcagaaggagaagggacgagagcagagaggagagaagaaacaaggagcaacagaaaggcggggagacagggggggagagaggcgaccgcggcgacgaaggaggaggagagggagaggaagagaaggagagagagaaggaagcggaagaagaaggaagggagagagagggagggggagcagaggagagggagagagacgaggcggagggcggggc

SEQ ID NO: 580598 - DNA, 168 bp, Homo sapiens
gatctgtaacaagcattatcacaggcaggaatcaaaaataagtgaatacaaacaatgatacatttgattttcctctgaccatagtgttctcaactctatggaggatgcatatccagttaacaagattggagcgagacttgtaatgcagtccatcaaggaaggtgattt

SEQ ID NO: 580599 - DNA, 314 bp, Homo sapiens
taactctcactaaagacaatttagaactataattaaaaaatacgcctgtaatcccagcactttgggaggccgaggcgggcggatcacgaggtcaggagatcgagaccatcctggctaacacggtgaagccccgtctctactaaaaatacaaaaaattagccgggcgtggttgcgggcgcctgtagtcccagctactcgggaggctggggcaggtgaatggcgtgaacccgggaggcggagcttgcagtgagccgagatcgcgccactgcactccagcctgggcgacaggaggcggtccgtctcaaaaaaaaaaa

SEQ ID NO: 580600 - DNA, 743 bp, Homo sapiens
  misc_feature (19)..(19): n is a, c, g, or t
  misc_feature (115)..(115): n is a, c, g, or t
  misc_feature (124)..(124): n is a, c, g, or t
  misc_feature (127)..(127): n is a, c, g, or t
  misc_feature (159)..(159): n is a, c, g, or t
  misc_feature (182)..(182): n is a, c, g, or t
  misc_feature (186)..(186): n is a, c, g, or t
  misc_feature (197)..(197): n is a, c, g, or t
  misc_feature (205)..(205): n is a, c, g, or t
  misc_feature (216)..(216): n is a, c, g, or t
  misc_feature (242)..(242): n is a, c, g, or t
  misc_feature (247)..(247): n is a, c, g, or t
  misc_feature (251)..(251): n is a, c, g, or t
  misc_feature (289)..(289): n is a, c, g, or t
  misc_feature (339)..(339): n is a, c, g, or t
  misc_feature (373)..(373): n is a, c, g, or t
  misc_feature (377)..(378): n is a, c, g, or t
  misc_feature (382)..(382): n is a, c, g, or t
  misc_feature (386)..(386): n is a, c, g, or t
  misc_feature (741)..(741): n is a, c, g, or t
tgggttgtttttcagggtncatgttgtttctcttggctttgaaattcacccttgggtctcttagcagaggatctagtgttaaggcttgccagaggcagatgggttccttgacccntgggccggngangggcttgccgcaggcaggcgcgcgtgtggtgncggtcgttcgcgagaccattggntagncgtcgcagganaagccagntccttttaggngatacaggtaggtggctgtgattganagggnaggnaacatggttcctcagcttcctgctgatcgacacctctnggaggggctgctgggttgttgaggtcctttgtttcttcctgggagcaggngagaaatgggatctaagtttacctactaactaanattnncgcntgtnataccagagagctggagtgggtctgctcagatgttcaggaagagaaaggaatgacaaagcctttggctcagcaggactggagccttgacaggcactgaccaagaaagcctctaggtgggccagggaggtctgtgggaaagctttggatcaatggtactcaagggtgcacagtggcacagtggccttagttagaatttatgaagacgaaaagaacacaagtcagaatttagaactgaagtacctgcttcttataggcctgtagaggaaaagcgagatcatccttctggccaggactaggggagaccaaggcctgttctttcctaggggctgagtttgacagaactggattgcagcnga

SEQ ID NO: 580601 - DNA, 688 bp, Homo sapiens
tgcagtagctttcgcctgcaatcctttattatgatagacctaagcggtcgaatcacgagggcaggaaatggagaccatcctagataacacggtgaaacgacgtctgtactacaaatacatgaactaatctgagcatgtgggcaagcgccatgctagtgcaggtactagccaacaggaggtagctgaatgtctggaaaccgaaaggcacacgcttggacatagtcgacatggcatcattgcagcactgactgagagaacgagtgagactccagatatattcaggaacacaactgggtgacatggccagggcagccaactcgtcactgtcgaacatagaccatcactaggttaaaatggaacctaaattcttaggcactatgcacatattgctctatagtgatagagcccacatgtaagtgtgcagtgttcactaacatgaagactgtgaaacacagtgatataccgatctgagagaccttgctgcctgctattgcctaatagcctgaatacaataaaggccctaacggaccgcacttactatcggtcactcagcctgagagtacgaggtaccacgttagcgcaactatgcgttaaagctccgctaacattttggttaactaagtagtcttaacacagaggcctaatccgccaaatcatttttctgaaatggacgaacggcatgcgctct

SEQ ID NO: 580602 - DNA, 156 bp, Homo sapiens
cctcatcagcttatatcacatatcacggagcttagtgtctcacatatagggatggccctgccatcccatccagttcatcgagccagaccttgggcactgtcctcaccttcttcttgcccttcaccctgaaaaagccttggttccctaaagtcctgc

SEQ ID NO: 580603 - DNA, 387 bp, Homo sapiens
ataacgtcatgcgggacggtcataacactgcatattcttcgattgtccttgactccatcacactcctgctattcctcattctctgctgctgcagttgcaaacatcctgtggcgagaggaaggtaccaagcttcatagtttggcgtcatgcctgtgatcatgtatatatggttctatgatgggccgtcttaccatgatctgccaccagctttcccacacaaagcagccctatgggagcaggaagtcaatgtcaaattcaagtggcatatgcattgaatcaaatttacaatgtactcctgtctttaatgagaaatttttaaatgcaaagctttcattaaaagtggcttgtaacctctgctgaagcagaacagacggtaagggagatgag

SEQ ID NO: 580604 - DNA, 707 bp, Homo sapiens
tctccattgcttcatataaattagggtcacagcttatatcttgatattcccccataccctttaaaattagtttctcattatctcgcgtttttcttatctatatactttctacccatgtatgtgcaatgtccttaccccacgacaatcacagagtttatgaatatactttcgtgctgactattgaaaatctgcactgaatatgtatcgaggcctcaagtttctcacccctgttcatttctactccgtcccaacgtgtcatctttcgcacgacgtgtactccggtgctgctacataggtcatcgtcgatagagtgtcagatgcgtaaaaatagtcaagtccaatgcacactcctgcatgacacaaaaatgaccaaactagacatgtgtctaggtacggcctactactgctgcgtgccttgtcagagagggccaagaagactaaacttgcgctgcaatcattcgcatctgtgctttccaagtggtcacagctacattcctccagcatggataaaagccgagaacagtcaaatacctaccaagagaatcatcgaggaaggcagaaacgatgtttagcaacacgtattactgcactcggttcactgcttaagaaaacctgccttctggaatatttgtaaactgaaattcagtatgtgattaagagatgtttaaatatgtcttgggtctactcacggggttaaaaatatagcc

SEQ ID NO: 580605 - DNA, 655 bp, Homo sapiens
ggagaagccctctagcaggggctctggcctttcaagagtctctgtttcccccttttcttccttttacacccaataaaaccctgtcttactcatcattcaaatgtgtctgcgagcctgaattttcatagccgtggggaaaaaagacgcgcatctttagccgaactaggaaaagtcctgcaactattttagcgcccaacgtggaggtcgagaaacggccgtcaaactccaaatgttgatgcacttgaacctctgatgatggccccttctggcctgggaacccttaaaataggcctctgatgggagccctgattgccatttcccccaaatagaccaccttatccagcaggaatcagttaagatcagtcctcgtctaatccttcatctaaatggcagtaagattgtgcctctttagaggagggaatgaatctgtccttgtaagagtccctgttttccccctttgtctccctttttccacacaataaaacccttgtctttactcaccagaagaaaaaaaaaaaatcaatcacaacaaacatctttggggggccgcctcggcggcgctcaaaaagagttttacacacacccatccgttgtgggggcggggccccaaaagttagcgaacattggggcacacgcgggtcccaagaaacctcgc

SEQ ID NO: 580606 - DNA, 407 bp, Homo sapiens
  misc_feature (16)..(16): n is a, c, g, or t
ttcccccagggacccnttaaccccccgggccccttttgggggccccaaataccccgtttgtccaaaaaaccggggggggccgcgtccgaaatccccggaaatttgcccccccccggcgccccgaaaaaaaaacccggggaaaaaaaattaggggggctttccccccgggaacccccttccaaaatttgttatttttcccgggcccccccccaaaaaaaaccgggggttaaacccaaaaaaaaaaaaaaaaaaaaaaaaagggggccccccctcttttttttttttttttttttttttttttttttttttttttttttttttttttttttttttttttttttttttttttttaaggatgttgcatttcgtttttttaaaaaaaattttgtaataaaattatgtatatt

SEQ ID NO: 580607 - DNA, 741 bp, Homo sapiens
tacgccggtcagcgggtcggtgcccagtggggccctggatggccctgggataggggaaccgcggtggctatccgcggaggtttcggcagtggcatccggggccggtggtcgcggcctgtggacggggccggggccgaggccgcgtgagctacgctggagtgcaatggtcctggaggataaatggagtaggatagccctgtacacctaagtaatgggcctgctatggtacaagggacatagaatgatacaaagtaccctaggaggtatgatactaatactactatacataccacgtggccgtaatataagggggacatacgaggagaatcgatatagcatatatcgtataccatagggcgtgcgctcgtactacgaaggcatagcaggggttataagcaacggatataatagcgcgaaggtgccaggaagagccaggcacgcctgttggccggggcacgaagacgactaccacgaaggggctatacaacaggtggccaatataatgtatgggctagataacggagtgggcacctaaacaacttgggggcaccaacggattctagcggtaactaaggcgtgtaagtattaaagggtaggctaacacaaagggggaacgggtaggagcacaagcgcaggcgcctattacccggtgtggaggtgaccaattccaattaccctatggggcccaaacggccttactaccacattacaggtacacaccccgttggccggccaggaatg

SEQ ID NO: 580608 - DNA, 295 bp, Homo sapiens
ttttttgggaaaaaattcccccgggatttttggggcccggttggtggggggggtggtttttgggattttccggggggaattttcacagggcctggggaaaaccccccgggaatggatttttttaccaaaagggggtgggccttttttttaaggggggggggtttgccctttttttgtttaggctttgcttttttttgcggggggtttttaggtggggtttggggcccccccccggtggttttggtttacccctaattttttggggggaggggggggttttaagccgggccccgga

SEQ ID NO: 580609 - DNA, 336 bp, Homo sapiens
tactcagcaatggggataccttcgtgagaaatgcatcagggaggagaagttccagtagtgacatggtctgacttgttgaaaatcactttgcttatattatgcaccagtgaaaatgagaaaatcggccaggggcagtggttaacgcctgtaatcccaggactttgggaggccgaggcaggcggatcagggtcgggagttcaagaccagcgtgggctacatggagtaacaccatctctactaaaaatacaaaaaacttagcgggacgtgttgacgggcgccatgtggttccagctactcgggaggctgaggcaggaggatggcatgaacctgggaggt

SEQ ID NO: 580610 - DNA, 783 bp, Homo sapiens
cgcgtgtcttttccatttgtggttgtgcccctctgtggtttttattcagggaccgggtatagtcttccccgtccccttgaggggtggtctttcccccatgtttttagagggcggtgttctttttgaaggtatcgcttgggttccccctttggaaaggggcttcccccgtttgtctttacttttagggtaaacacactccccctccgtctttgcttttttcatttccctgctccatgtttcccccaagtctaatgggggtttgaaatttgatgctccccttgtatgtttgcctattaatggcagggccctttcctttgtggttccccctcctatttccagtgcttgggagaaagtttgccctagagtggttgctccccctttgttcaatgagtggggggcatgacgcgccattaaccatattgggatgttgccacacgaggtaattagcaatcccgatgcctagtgccccaggttgtgaaaaagggagggggcttttgttaattgcagtcgataaatttgactccatggatgagcccgcaggagcagtattagttttctgcacaggtgtgaaggaggcccctagtgtgtctgggtgaggttcgccccccagtttttgtggaagagcaatcttgttttagagtttatcaaacattttttggggtgcgtgtgtagtcccctctaggacctttaaccagcacaaatggtgactacctttgaagggatgtgctgtgaaaagtgtcactgtgataaaaacaaaagtcacaaacaaaaaaggtaccaaaa

SEQ ID NO: 580611 - DNA, 278 bp, Homo sapiens
ctggtatcgcagcctgctctgattcactgtgtcacaaggctgtgacgccttcatgggagacaattattgtgatgccatcaacaagcgagccttttgcaactattacggtggggattgctgcaccttcacagtgaagaccaaaaaggtcacccattccctatgttctgtgatctacaaggtgactgtgcttgtcggcgaccccaggcccaagaacacaggcggaaagaactccggggatacaggcatggctacaggaaggaccagaagttggccaagga

SEQ ID NO: 580612 - DNA, 190 bp, Homo sapiens
agatattacaccaggtgcacacagtgacgttaagccaacaggatttaatgcccttattcgtgctaagtcatgattatctgaacagagatgattttataccctctaggatctgtcccgattggctagggtgtaacgcccagcattggcgggaaaaatatacctaggaatgggtaatcacagacggagatcc

SEQ ID NO: 580613 - DNA, 108 bp, Homo sapiens
atgctgtggaaaacacgctgcagagtctgagctggctgagtcagctgtcagagtccctgctgactccatcacacactcccccagcttcactgggcatgaaggaccttt

SEQ ID NO: 580614 - DNA, 173 bp, Homo sapiens
atctgattcccgatcgatgtgttcctgtgatccccaaccaagtttccagtatctgagaagttgaagcgcaggacaggctgccttggggccgagcactgaatctgcccagaggatgccatgcgctggtcccagcagaatttttatgggatcatccttcctggcacatcactgcg

SEQ ID NO: 580615 - DNA, 648 bp, Homo sapiens
agatcatctacacagaaaatcaaagaaacatcaaacttaaccttcactatagagcaaatggacccaatagacatttacagaacattttatttaacagctgctgaatacacattcttctcttcacacatggttcattttcagggataagaccatatgttatgttacaaagcaagtctcaaaaattcaagaaatgaaatcatataaagcgtcttttctgactgtaatgaaataaaactagaaatcaataagaagaggaacttggaaactatacaaacacatgaaaattaaataatatgctcctgaacaatcactgatcaatgaaaaaactgaaaagaaaattttaaaatttcttgaaataaatgaaaatagaaacacaatataccaaacatatgagacacagcaaaagcagtattaagagagctcacagcaataaatacctacatcaaaaaagtagaacaacttcaaataaacaacaatgcctctgaaaacactagaaaagcaagagcaaaaaaactaaaatgggtagaagtaaggaaagaaattctctcacattcagggcctcctaggggaacctcaaaataaataatatctggccttaaagattacaacaagtttgtggcagaatctgatgatgggagttctttgagg

SEQ ID NO: 580616 - DNA, 220 bp, Homo sapiens
  misc_feature (10)..(10): n is a, c, g, or t
  misc_feature (19)..(20): n is a, c, g, or t
  misc_feature (131)..(131): n is a, c, g, or t
  misc_feature (170)..(170): n is a, c, g, or t
  misc_feature (173)..(173): n is a, c, g, or t
tcggcacggngtacatggnnatgtgtgagcttcaaataatggcattgtcaaacgcatgctattaatatcgtgagccttcaagtcaaaatgtaaactctttctgctatgcaatacactttcctactgatgtntatgagaatgatgcttagccagtagtacatttgtcaagnttncttcctaggcatagtctcaacagcaatttttgaaagtaaatatttgg

SEQ ID NO: 580617 - DNA, 827 bp, Homo sapiens
tgtcaccttgacaatattaagtttgctagctcctgaacacataatgtctttctatttatttaggtctttaaaaaatttctggctgggtgcagtaatcccacacctgtggtcctagcactttgggaggccgaggcaggtggatcacgaggtcaggagatcgagaccatcctggctagcacggtgaaacccgtctctactaaaaatgcaaaggattagcttggcgtggtggcgggcgcctgtggtctcagcctcccgagtggctggagttacaggcgtgcgccacacacccagctaattttgtgtttttagtagagacggggcttcgccgggttggccgggctggtctcgaactcctgagctcaagcaatccagccaccttggctcccaaatgctgagattacaggcgtgagccaccgtgcccagccccagcaatgtttgtagttttcatgttcatgttttgatgcttccttggttaaatttattccagagaggaataatgaagtatctgttgtcttattatagatggttttcttaatttccttttcagatgtgtcatggccagtatatagaacatacaagggagtgtggtataaatagctggaactgggctaactgcattggacagctccagtggtggcgaagcgagtcacaggggtcacggctaggaggcgcaccggcccgcagaaggcggccgtaaccgcacctggggcgacaggcgacgctggcaacgaaacgcgggacagggaaggggaacacgcgagaagaaccggcgggggggccaccagggggaggcgcaagcacccggaggacaccggaatcttggacac

SEQ ID NO: 580618 - DNA, 1109 bp, Homo sapiens
cggacgcgtgggttacaaaataatgaagcaattagctatgtggatctgagagttattgtctggggatgtgtgttgtggttttgcttttaattgttgatagactgtattaataaacatacaacacaagcgggccttgtgttgctggtccctattcagtagtttcctggtggaatcggtttgcttctggtaaggtaaaacagcgttcgtgacccatagctcagctatgtctgaagttccagaggtcacatcagcagtcttactgctcttgaaaagctcgtcacgaggcgtgtggcgtgcgttcaacttaggatagcacgtcgacgacagcataacgttggagtggttcacgatttgtcacatgcctgtaccatcgtactttatacttagaagcagataaaggcatcagacacgagaacggtgctcatctattctgaggtagcattgactgcaatggttgctcttgaagcggttaagagcaagacgtgtgtgtacagggttaaagaactggctggaataataattatgaagcgtattttaagggccgtttagttactagttcttagttattgaagctatacatgagcggttaacaacgagtgtgattaacgtaaaaaatctggctggtgaattatcatggacacttgactggttgctagcagttaaatggggtcccaaaggggggagtattgatacgagtcaactatgtggggattggcaataaagtctttgggactgatgcgctcctttatccaatgtcttagactacaagggtttatataactcacgtataatactactgcaagatcaggagaacaccagacaagacagaaatgacaaagaaaagaaaaagcaaaaaaagaaaacaaaccaaaaagaaaaacaaagcgaagaaacaaaaaagacagaaaaaacaaacaacggaacagagaaacaaaacacacaaaagacaataaacaccagaaaaaacaaaccaacaccgaaagcgcacctgcagaacaaagggaataaaacaagaaaattagaacgaccgaagagcacatgccctgtcgaccgcgccacgccaacacaaaatagagagaacgagcaacagcaccactaaaagggataaa

SEQ ID NO: 580619 - DNA, 140 bp, Homo sapiens
tccaagccagcctgagtgacaagcaagactccatctcaaacaaacaaacaaaaaagtatgctgaagcagaatccatctactcccagtgccagctattaaccaaacacatagttctagtgtaacactccagttattctatt

SEQ ID NO: 580620 - DNA, 90 bp, Homo sapiens
catggatttgctggtgcagtacaactaggcttaatagggacatgccattgcactccagcccgggcgacaagagcaaaactctgtcccaaa

SEQ ID NO: 580621 - DNA, 239 bp, Homo sapiens
taaatgggaacccaaaccccccctttttccaaaaaatggggcttttttttttctgtaagcccccggggggcccttttccctgggctttttaatttagcctttagggagggttcccttggaaatgatcttttggggatttttggcccttgggttcaaaaagttccccaatggggcccccgcccccctgcctgggggggggaaaaatgggaaataaattccctataaatagttttgaaata

SEQ ID NO: 580622 - DNA, 508 bp, Homo sapiens
cgtccacattacctcgctgtccgtcctcatactcctcatcctcatcttagtgctcatcatactcttgtactctgccatcctcctcctcttgacgtggctagtatatacattcctcctccttaagcctctgctcctcgatcctagttagtccttgatttgtgactatgctggctctgtaacgcccctacgtctcgattgcccaaacctcctcagcgtatgccatacatcgtggtgtgatgaggaatttgtcaaagatggtgcctgacttggaactgccagaggtcacaggcccagtcacgcaaaagttatcataggcatagatatctgggtatcgggagaatactacgagagagatgtcaatgtatctcggcgtgaatccaagtgtccttgtaatctgggttgtcgatctgccggggcttccactcacccttgtactcagggttctgaatcactgggggttcccactctccgtccatctcttcatcccagtcctcgggcttcttagcat

SEQ ID NO: 580623 - DNA, 471 bp, Homo sapiens
  misc_feature (371)..(371): n is a, c, g, or t
  misc_feature (391)..(391): n is a, c, g, or t
  misc_feature (398)..(398): n is a, c, g, or t
  misc_feature (426)..(426): n is a, c, g, or t
  misc_feature (448)..(448): n is a, c, g, or t
acacctggctgattttttaattttggtagagacgagggcttgcatgttgcttaggctggttttgaacccgtggtctcaagcaatccttccgccccagccttccaaggtctagacagttctcacaaaacccttcttgttatccttagctttattaacaagccttgcctcattatggggctgttacttttcttttagggttaggagccaccactcttttttttaactatggccttctgttttttgtacgtgtttgtgagtgggccttttaacatctgtactcaaggaatggcttttcgattgtggctaggtctcttcaggattgttccctttttaaatttggaaataggccagagtgggtggggcttacaccngtaaatcccaggcatttttngggaggntgagggagggcagatccgcttgaaactnagggagttaaggagacccagcnttggggcaacatgggtgaaacct

SEQ ID NO: 580624 - DNA, 239 bp, Homo sapiens
  misc_feature (77)..(77): n is a, c, g, or t
aggtggggtttcaccatgttgcccaggctggtcttaaactgagctctagcaatctgccggcctcagcctcaaagtgntgggattataggcgtgagcccatgccctggccctaaaatttctttataggctaggtacagtggctcatgcttataatcccaacacttagggaggccaaggcagtagaatctcttcagaccagcctgggcaacgtggcaagaccctatctctacaacaaaatt

SEQ ID NO: 580625 - DNA, 1551 bp, Homo sapiens
  misc_feature (36)..(36): n is a, c, g, or t
  misc_feature (80)..(80): n is a, c, g, or t
  misc_feature (107)..(107): n is a, c, g, or t
  misc_feature (120)..(120): n is a, c, g, or t
  misc_feature (128)..(128): n is a, c, g, or t
  misc_feature (132)..(132): n is a, c, g, or t
  misc_feature (139)..(139): n is a, c, g, or t
  misc_feature (151)..(151): n is a, c, g, or t
  misc_feature (181)..(181): n is a, c, g, or t
  misc_feature (211)..(211): n is a, c, g, or t
  misc_feature (215)..(215): n is a, c, g, or t
  misc_feature (339)..(339): n is a, c, g, or t
  misc_feature (355)..(355): n is a, c, g, or t
  misc_feature (436)..(436): n is a, c, g, or t
  misc_feature (924)..(924): n is a, c, g, or t
  misc_feature (945)..(945): n is a, c, g, or t
  misc_feature (996)..(996): n is a, c, g, or t
  misc_feature (998)..(998): n is a, c, g, or t
tcgctcggaagggtctttgttccctgcagccctccnacgggaatgacaatggataaaagtgagctggtacagaaagccanactcgctgagcaggctgagcgatatgntgatatgctgcanccatgaangcantcacagnacaggggcatgnactctccaacgaagagagaaatctgctctntgttgcctacaagaatgtggtaggcgcccnccgntcttcctggcgtgtcatctccagcattgagcgagaaaacagagaggaatgagaagaagcagcagatgggcaaagagtaccgtgagaagatagaggcagtactgcaggacatctgcaatgatgtnctggagctgttggacnaatatcttattcccaatgctacacaaccagaaagtaaggtgttctacttgaaaatgaaaggagattattttaggtatcttnctgaagtggcatctggagacaacaaacaaaccactgtgtcgaactcccagcaggcttaccaggaagcatttgaaattagtaagaaagaaatgcagcctacacacccaattcgtcttggtgctggcactaaatttctcagtcttttatctatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaagaaaatcgtacgtcgactttcgatttttcacagcctcagcctaggaaaangggtccatggggataaacagntgggtatttggtttctaaaactcagatggggtcacataaattgccagggantnccgaagtttggatttggattaacattggacgggattactggggtgttcaaattttttaaaaactggaaccactggtgattatgggggtttgggtaatttacgcagaaactccttacggggtagaaaaaaataggacctgaattatggttgtaaccttttggggaagggtttaatctgatatcaaaataatctttgaaatacaattccttgtaagttggaccgaaagtttagagattatttgtgatggggtggaacttgggttgggacccccattattgtggtcttgacgttgatggtattcccagtaatgcgggcggtggtcggaagttaaagaccttgactgtgtgggcgggggcgcgtaaagtttgagccaatggtccaggggttcccttgggaacgaatccggagggaacttctgggagaacggttaaacctgaatttggtgttaaaccccaggagccttctagaaatttgatgacatgaggtgaagaggtcgtacaggaaactacgtgtaatatcgtgagtaaaaaaaggggggcaccatcagagagcg

SEQ ID NO: 580626 - DNA, 424 bp, Homo sapiens
  misc_feature (24)..(24): n is a, c, g, or t
  misc_feature (48)..(48): n is a, c, g, or t
  misc_feature (54)..(54): n is a, c, g, or t
aggctggggacccaaaatgccaanggccccgggtgctaagcgccccancattanttcatgcaactgaaagtcaagccagataggagagttgtaaaacttgtctacaatgagaataagcaaggaaagaattaagggtcatttcacatttaaaaattcagcttacccacttgaagctgtcagtgctttgtgtgtagaactttcaaataattaacatttctcaaacatcaaaacacagctagaggtgtgcataaataaagaggcacaggtcccaaaatactatttttactttttgaactggtaggactaatagaaaaataaatgaatacaattgtttagattaactagttcttatggaaaagaagcacgggagaaagtagttgttaaccaatacttgattatttgttaatcactactacataagata

SEQ ID NO: 580627 - DNA, 634 bp, Homo sapiens
  misc_feature (238)..(238): n is a, c, g, or t
  misc_feature (380)..(380): n is a, c, g, or t
  misc_feature (388)..(388): n is a, c, g, or t
  misc_feature (392)..(392): n is a, c, g, or t
  misc_feature (394)..(394): n is a, c, g, or t
caacaaaactggacggaacgcctcgatccacaccctgctggatgccttggagaggatggaagagagacatgcaaaagagaagattcaggacctcttggtggactctggaaagttcatctacttagaagatggcacaggctctgccgtgtccttggagtgaaagactctttttaccagaggtttcctcttaggtgttaggagttaatacatattaggttttttttttttttaacatgtntacaaagtaaattcttagccaggtgtagtggctcatgcctgtaatcccagcactttgggaggctgaggcgggtggatcacttgaggtcagaagttcaagaccagcctgaccaacatcgtgaaatgccgtctttacaaaaaantacaaaanttancnggatgtgatggtgtgtgcatatattctcggctactcgggaggctgaggcaggagaatcacttgaacccacgaggcagtgacgctgagattgcaccacgtgactccagccggggacacagagcaagactctgtctcaagataaaactaaaataaccttgaaagaattattggcccgactgaggtcacatgccaaaggaaaatctggttctcccctgagctggcctccgggtgttcccttat

SEQ ID NO: 580628 - DNA, 506 bp, Homo sapiens
atacatttgtagaatttatttttccgtcagtcatgtaaaataaacatactcttcttcctcccctgaagattgccaccaacaatcttcagggaagcctctttttattttttaaatatcccaatagaaaaaaaatggcgggcttttttaaagactgggtagatcaaaaaaattaatcatactcagagtatgtctccaaatgaaatgaatggttggtagaacataggacactgggaaaatctcctacctctttcttcacagatattgtgaatagagacgcacagacaaaacgcactgctgaccaaattgatgaagaaaatcctggccaaaatagttcacactcaattggagtgagaaaaagccccatagtgaacttcctgcttgtccaccacaatttatactattatccagagagaaaaacacacaattcagatccacttcatatttctcctgtatagtactacttgctgacaagtaggggaaaaatctctaaagccctgacgatggtg

SEQ ID NO: 580629 - DNA, 916 bp, Homo sapiens
gatagaaaggagaggagcgaacatggctacgcgtgggaggtttgggagtgtctctgtgaccatgttgatggcgctgctacatctgttcgggactgtaccctcagtgcttcgtgccaccaagaatggaggggacatggtgttatctagaacaatggttactcaagttgaatggacattggtcgtaacatacatgacctgtgaataaggaatgcctggagacgagagttccggacgcgcttgtgagagccccgactcgagtaaatgagtccgttgatcgtcatgttcacttgctcatccatatttggcatagacagtagtgtcatggaggacgcgagctcgagtgcaagaattacctacgatcctgatctaatactcctgggcagatactaccacgtgtcgattcatcaacacgtgatattgttttgccaatggtaggagtacagatgaaggctctgactgtattgctgatgctagtgcatgatttcagctccaagctttcatcaacttacctgccaaaggtaaaccccagacggggtgataccgtatgagtcacaggtagcggggtttatcagttgtgcatgattgcccggtgtgatccgccgactgacttgttgtccttattagagggatttagacgcacctaatttagtgctggtgcccgttatgtaggggatgggggatggctcgaccaatgggtggaactagtagctatctcacgaagaacgtaatatggggaatttctcttataatttataactagggatgggacttcaagcagtcgagtgtgctcatgtgctatgtaatgacaattctggcgcaggtgtggacacgcacccttagaaggagcactcatatgttccatagaaattccactccggggacaatgtgaattatattccatggaagcgtcaggccc

SEQ ID NO: 580630 - DNA, 561 bp, Homo sapiens
  misc_feature (238)..(238): n is a, c, g, or t
  misc_feature (380)..(380): n is a, c, g, or t
  misc_feature (388)..(388): n is a, c, g, or t
  misc_feature (392)..(392): n is a, c, g, or t
  misc_feature (394)..(394): n is a, c, g, or t
caacaaaactggacggaacgcctcgatccacaccctgctggatgccttggagaggatggaagagagacatgcaaaagagaagattcaggacctcttggtggactctggaaagttcatctacttagaagatggcacaggctctgccgtgtccttggagtgaaagactctttttaccagaggtttcctcttaggtgttaggagttaatacatattaggttttttttttttttaacatgtntacaaagtaaattcttagccaggtgtagtggctcatgcctgtaatcccagcactttgggaggctgaggcgggtggatcacttgaggtcagaagttcaagaccagcctgaccaacatcgtgaaatgccgtctttacaaaaaantacaaaanttancnggatgtgatggtgtgtgcatatattctcggctactcgggaggctgaggcaggagaatcacttgaacctgggaggtggaggttgcagtgaaccgagattgcgccactagactccagcctgagagacgagcaaaactgtctcaaaaaaataaaatgaaatacataaata

SEQ ID NO: 580631 - DNA, 291 bp, Homo sapiens
accttatagtgtttcacgggacgctccctaggaccagtttgacagaagacgaaaaaatacaggtttgttctaccaacggatccatacggtatggtggcatgaaccataaatagttgctacactagtgactcacacctgtaatcccagcaccttgggaggccgaggcggggagatcacctgaggtcaggaattcaagactagcctggccaacactatctctgctaaaaatacaaaaatttgccctgctgtggccagcgccagtaatcccagctacttgggaggccaagaatt

SEQ ID NO: 580632 - DNA, 155 bp, Homo sapiens
  misc_feature (52)..(52): n is a, c, g, or t
  misc_feature (117)..(117): n is a, c, g, or t
cctcccacctcagcttgaaagccaggaggcagaggtgcagcgagccgagatnacgccactgcactccagcctgggcaacagggcgagaccctattcccaaagagggggaaaaaaatntcaaaggaaattttgtttgaaaatggaagtggagattt

SEQ ID NO: 580633 - DNA, 721 bp, Homo sapiens
tcatacggaactgtaagtccattaaacctctttctttgtaaatgcccagtcttgggtatgtctttatcagcagcatgaaaatggactaatacagtaaatggtaccaggagtggggcgttgctgaaaagatacccgaaaatgtggaagctactttggaactgggtaacaggcagaggttggaacagttggagggctcagaagaagacaggaaaatgtgggaaatttagaacttcctagagacttgttgaatggctttgactaaaatgctgatagtgatatgaacaataaggtccaggctgatgtgttctcaaatggagatgaggaacttgttgagaactgaagtaaaggtgactcttgttatgttaaagagactggcggcattttgcccctgccttagagatttgtgaaactttgaacttgagagagatgatttagggtatctggtggaagaaatttctaagcagcaaagcattcaacaggtgacttgggtgctgttaaaggcattcagtttcaaaagggaaacactatacaaaatttgaggggtgcattaaagtttggaaaatttgcagctgacaatgcaatagaaaagaaaatcccattttctgaggtgacttgggtgctgttaaaggcattcagtttcacaaggggaatactgtaacaaatttgaggagtgcttaacgttgcgaaatttgcacctggcatgcatagaaaaaaatccagc

SEQ ID NO: 580634 - DNA, 657 bp, Homo sapiens
gacagagtctaatccctttctatgtagccaccagcatgatagcacccagcaactttctgtgcaggtgctcgtggttggtgccttcgccaaaaggtctatgcacatcatgctgatttcctactcgttgggcatttccgagaagaggagccacaggatattggtcccacttctattcaggtttctgttttgcacaggtatatgccgtgaagtggcgtctggggtgtggggagcaagaatattctcgaaccgtgacactagcgtacaggaaggccgttatgctgggacagcctgagctctggtatggccacttgagaagtttcgccagagtcctgggaacctcgatattctgacattgggaaaaacacatttaatttatctcctgtgtttcattgctgattattcagtatactgttgagttcgtcatttgcgaaataggatataatacgcgtgagagtgctgtgaaaaagcttaagggtgtgtggatgggacaggatcaataatgcctgaggctgattgacgacatctacattacagtgcttattccctaagcgtgtagaaagttacgctttactgtgtgctagagccacagaagtctaatatcgaaatataatatgatattgtcaggtcttatcatttcagatgttgtatggaaaggga

SEQ ID NO: 580635 - DNA, 248 bp, Homo sapiens
tgggtgtgtggatgaccagccagatcgccagttatgcatgaccggtgatagatccaaaatactagccacatttgttcccatttttccatttctaaaacatccttaaagaaaatcatatatggggtcacaccatcctcacggtagtccaatagagcaaacatgccatctggattcatgtattcacccacaaaagaactggtagttttagaaattaagcaaggatgatgcttgatttgtactggcgcccc

SEQ ID NO: 580636 - DNA, 316 bp, Homo sapiens
gcatacctgggtgtcgcactcggaccgtactgtgcctgcgtccaggcgttctggctggttgcctcctcgggtgactgactcgccccggtggggactacgatgtggtttcgacacgacgactatcccactactgacttcgttctgtggctgtgacactgttctacttcacggacgactttgtacgggagacttcgtctagacgacggtagagtttttttcgtgatagtggttcactggcataagtggcgttggcttgccatgattgtgaggggtaggcgtcaggtagttagtataaggcggggggtagtaaggaggg

SEQ ID NO: 580637 - DNA, 103 bp, Homo sapiens
gcacctactgggatgtagacctgttggattcaaaagtgatcgaattctggacagccaactgaatttaccagtctgtccaaactgtatggcactcatactgctc

SEQ ID NO: 580638 - DNA, 551 bp, Homo sapiens
  misc_feature (506)..(506): n is a, c, g, or t
cccctttgcttcatctcgttctggttcattggctcgggagttgcacctcggcggaggacgtctcatgcagacttccccatatacagggagtgttgcattgaaggtctccgctggaccttctcgtccagaaggtgattttcaaaacgcgagcaatgctgccaatgcagctggtttctcttgacagattgagaagtccagcttcaaaagttacctgccatttaagcaaggtgtttgtcaagcagcatcatggttcattttatggaaaagactttaaggagtcgtcaggatttatccatagattgctgagaacaatggcaatcatttttatttttcacagcagtttgcacttctgatttcaggttaaacgctgacttgtttttagtctgcttaggggatcgtgacttggaaatttttatcattctgatgagcttttttgtagtgtccacaatgtataaaatatttcctaggtgagatctattttctccatttattgatgcattgcaggncaatttgagtgatgtgtttcaggaaaattcttcctcagtttaata

SEQ ID NO: 580639 - DNA, 101 bp, Homo sapiens
  misc_feature (91)..(91): n is a, c, g, or t
gcagtggtcgcttcttctccttgacggagtcggtttgtcactcaggctggactgcagtgctcgttgcaacctccgcctgccgggttcaagncattctcgtg

SEQ ID NO: 580640 - DNA, 428 bp, Homo sapiens
  misc_feature (8)..(8): n is a, c, g, or t
cacagagntggctatcatgaaacaaaagaactgcactggcattttgcaagcttatatttgaatcccagcttcattgagtgttttttgtgtggcactgggaagtcacttagcttctctgggcacctgtattagtctgagttctccatagatacagaaccaacagaatgggtgtgtgtgtgtgtgcgcatgtgcaaagtgatttactataaggagttggctcccacagttacagaagatgagaagtcccaagatctccagtgagcaagctggagatccagccaggagggttaatggtatagttcttgtctgagttcaggcctgaaaaccaggaaagccaatggtgtaagttccaattcaactccaggaaaagaccaatgttccagctcaaagaccatcacacagagagagtgaattctctcttactcagc

SEQ ID NO: 580641 - DNA, 1064 bp, Homo sapiens
taaaaatccctcaaaaacggtttattatacaagtgagtttggagtcccgaggggctaatcggaaggattccggggtaccgaagcgcgggccaccgaggggcccccaaacactttgtgggcacctcgcagcgaacgagagggctcagctcacccaggcgagggtctccggctcaacacgggagtgcagagagtgctctttgagaacacctcctctcgtgggaaacgcctcaatcacaaatatttctcgtggataactgaggcccaccgaggggctttgggaagaagtggacgtgacggaatagcatataaatcgtgggcccaggtgtgaaccacccaccctttatacagggcaccacggggtgttcttacacccagcaaaattcgcctcctgtgtgcccgaagaaaaggcagaacacgtggtcctcccaagacaagctgtggcacacgtggcagcgagtgcggcgggatctcaaaatcaatctctccgagggggccgcgcccgaataccaccttgtggagtggaacaccaaatgtgcccgcgaattgtgcaagggtgcggccccacagagctgtgctacgacgagatcatatcagtaggagggatcccggaaaagaacgcgtgtccacaaagaactgggcaaggcgggcgcccccttggggcagtgggcaagtgtgacctcccgagaggtgtgtgggcacttcagaaaaaacgctctcaacgcacgcgccgggaggcagtgaaaaacctcctatagaacgcggccgtgtataaaaggggaccaatgtgggagacagtgagaaacgcaaccaaagtgttgagacccacggagggagacgccgattaaatcccccccttggatgatggagcagcaagacggggagttgtaaacctccacaaaaaaaccccagaatatgagccccgcggacaagtctatcacaaataacactcctcccggggggaaccccgaggggaacgccgagagaaaagcagcggggtgcccccagagaacaagtaacaaacccggggatggggggaaactaacccgtgccgggaggaaaaatcg

SEQ ID NO: 580642 - DNA, 662 bp, Homo sapiens
  misc_feature (43)..(43): n is a, c, g, or t
  misc_feature (51)..(51): n is a, c, g, or t
  misc_feature (58)..(58): n is a, c, g, or t
  misc_feature (114)..(114): n is a, c, g, or t
  misc_feature (136)..(136): n is a, c, g, or t
  misc_feature (144)..(144): n is a, c, g, or t
  misc_feature (222)..(222): n is a, c, g, or t
  misc_feature (233)..(233): n is a, c, g, or t
  misc_feature (249)..(249): n is a, c, g, or t
  misc_feature (327)..(327): n is a, c, g, or t
  misc_feature (442)..(442): n is a, c, g, or t
  misc_feature (457)..(457): n is a, c, g, or t
  misc_feature (473)..(473): n is a, c, g, or t
  misc_feature (497)..(497): n is a, c, g, or t
  misc_feature (516)..(516): n is a, c, g, or t
  misc_feature (553)..(553): n is a, c, g, or t
  misc_feature (556)..(556): n is a, c, g, or t
  misc_feature (567)..(567): n is a, c, g, or t
  misc_feature (581)..(581): n is a, c, g, or t
aggcagtaggatcacttgaggtcaggagttttgagcccagtcngagcaacntggcaanatcccgtctctatgataaaaaattagctggacatggtggcacatgtctgtagtccnagctacttgggagactgaagtnagagaacngcttgagcccaggagtttgaggctacagtgaaccatgatcatgtcactgtactgtagcctgagcaacagagcaagacnctgtctctganaaggaaagaaaacaantgcaagtttttatcactttgtgagtgtagccaagttggaggagaaatagacaataataaaagagcactgaataatgangctgagtggctggttaggctcagttgctagctaaatggcttctaaaaaattcaataaagttacagctctggggacagtcatgtagtcaaagaatgaatgctaaattcattacaantgcccatggtctttntttacatgccttctantgaaaaattcctaagtgcctaaanagcaagtctgcaatgatancagctgtttattaaagactacaaaaaagaaatggagnccnggcgtggttgntcacatctgtactncttgcatttagggaggctgaggcgggtggatcacctgtggtcacgagttcgagaccaacctagccaacatggtgaaacccc

SEQ ID NO: 580643 - DNA, 324 bp, Homo sapiens
acaacgctgagtgcccacacacacacacacacacacacacacacacacacacagtatctgtatcctgtctacacttctcgtgtaggactgagcagtcccaatcacgacactggttcaccgttggagacaacgctgtacgagagtagagggactcggagacgttctcttccagtggagaaatgtacacaaatatgagcatcttagcactcccacccagagagcttctgcacgatgtatgtcagtgggctgtcccggataacgcacgtggtgtgtgggccctcggtgtgtgcaagaaggtccacagagagcgacacgcactgtgcc

SEQ ID NO: 580644 - DNA, 436 bp, Homo sapiens
gtcaacattagacagatcagtgagtcagaaaatcaacaaagatacccaggaattgaactcagctcttcaccaagcggacctaatagacatctacagaactctccaccccaaatcaacagaatatacattttttttcagcaccacaccacacctattccaaaattgaccacatagttggaagtaaagctctcctcagcaaatgtgaaagaacagaaattataacaaactatctctcagaccacagtgcagtcaaactagaactcaggattaagaatctcactcaaaaccgctcaactacatggaaactgaacaacctgctcctgaatgactactgggtacataacgaaatgaaggcagaaataaagacgttctttgaaaccaacgagaacaaagtaatagttgacttaaaaaattttagcacactgtcactatgatg

SEQ ID NO: 580645 - DNA, 430 bp, Homo sapiens
gggtttcgattaattctacacctatcaaggacatcctcatgtgaatttggatggagttgagtcatagaaaaatccatttaaattaataactaaggccagtcttcaaaggaaaaaaaattaggcgggaggttcttgtttttgaaaaaaaggatttaaattccccttccaggacagagggttattatgggtaattgtatttaaacggccctcagccccaccttgtctgcctgcctactcccatctgtgctaagacctctgaggttatgagggaaatccattcaccaagccctagaggcagctccattagctctctgacatggtagcctttcacttcctccattacctagctttgagcaaaaggtttcctctattatgttttgtaggggatatggttgaggataattctatagtgatttggtcctgagattag

SEQ ID NO: 580646 - DNA, 375 bp, Homo sapiens
agcggggctttggaatgagacatggctgttactactgagagctatgttgcttactgaagagatattcaatgagcgattatatattctgtgatgccgtagacagactggagcgtgttatgattatgcctcatagggatattacaacgaaggggtatgctatgtggtaatggtcagggggattgagaattagtggtgaggcgtatatataccattagccgcctatttttacaaagtactgcggcaatgtactattgacccagcatttggtggcctcaggcatgtcctaagtggagtcctgtaaagaggtatcttaactataaaagctattgtgtaagctagtcatattaagttgttggctcaggaagtttgatagtt

SEQ ID NO: 580647 - DNA, 304 bp, Homo sapiens
cagggcaaactgctcgggtttatggctaaataagatagctacaaagataacaacctacatccctccctcaccattggcccgcgagaaaactccttagggaaaaaggacagatacaattcaaagtcatcccttggaggctcacttgagacaaatgcataactgatggcttcctcggccctatggttcacgtaaaaatgtaggttcacggagccagacacaatggtgtattcatcggaaggctgatcaaggactcaaaagaatgcaagttttggtctcttatctacttcgggccgggaaaccccct

SEQ ID NO: 580648 - DNA, 208 bp, Homo sapiens
cacctggtgatcggtcacttgttctcggctctacttgttctcggtctacttgtctctcggtctacttgttctcggctctaccttgtctctcgagtctaccatgtctctcggtactaccttgtctactcggctctaccttgtactctctggtctaccttgtctctcggctctaccttgtatctcggctcctaacttgtctctctggctc

SEQ ID NO: 580649 - DNA, 892 bp, Homo sapiens
gataccattgacctttcaaaggttctccagcagtatttaactgatgcaaaaggaacacacttgcaaattttctactttgacatgacagaccctcctcttagttcaccacaatgttcaaaaggcacaagtccctcgcttcggaacgcaagagagcattgacctttcccaaagagctacacggttcatactgaaggatgatatgagaaatttctcacttttggtcaaacacttgtactctccaggggccctctaagaccaactccagcagtcaaaacattcaaaaacgactcacttttgagcatgaaatcaattggatgctcaacaccaagggcaaaccagatcatgtattctggataaggtgacacaatcatctactattcatgatgttaagccaacaagtttcacaatcgcatgtccatactgtggtacccttctcgagtttggtctgcagctagaatgtggcgggccttttttgaacggactacattaccattcaaagtatttgcacgcttcctcccatggtcacaactgtatgctacagacctaggtcaccaagtccagtttggaccacaagtgttttggtgaatacacaaggacctctgttaatataactctcttgttatttgaggatcccatgtatctattgcgcaccagagagtgtagaagaattacggccaccagtgtacattggctgtcctgcatgtatactacatcgataactgtggaacttatgtccccacgtttgcgggaccgacttgcaattgaaagagggcctacgggatatttggatgcgaacataacaccaattccaccattggacaggacagcttggcacttctggaacggcactacaggggttccaacaaacgccggaaaccggggtccatcagaa

SEQ ID NO: 580650 - DNA, 752 bp, Homo sapiens
gatgtgattattatgcattgtattcctgtatcaaaatatcttatgcaccccataagcatatacactatgtacccaagaaagttaaaaatttaaaattcaaagcaacaaaggtgcaatgaggtattaacccagatgtagctgattagtattaaaaaagacaaacacacagctgtcatcaagtaacttcattcatacaaaaaatgcatattctcaatcccatagattcatatcaattatctgataaatgattcttagttatacaagttcagtgtataggtatgcagatagagcctaaacaggtaatgaaataagagacttgcattaagcgttcttacaagtgagacatatgtccaagaaagaaatagagagtatggtataggttagtacgagctagcttaatatgatataatagggtaaaggaaaataataaacatcactactgcattgaggtcaggacttagatatgaaaagggaaccaacaaagaggcgtatcacaaagataagatcacctctatggaggcaaccacacactgaaaaaaaagtacaacacacaaaacacctaatgctccaatgactaagggaaagaacctataaaggaacatagaccagtatatagcaatctacgagacaaagggagcagataacaacaacaaaaatcggatccagggaaaacaagatagaatgacaggaaaagaaagaaaagaacaacaggacaaaaagaacaagaaaaaggatggacaaacaaaaaccaa

SEQ ID NO: 580651 - DNA, 548 bp, Homo sapiens
  misc_feature (495)..(495): n is a, c, g, or t
aggaggaagagctcagatagaaatggagggagctgctctcacgctgcatgcagtgacagtgcccagggctctgatgccactatcacagcttgtaaagtgttagacaggtgtcttgtgtgcgactgagaggcaagagttgatcctgcccttccctttgcgactaggcgaaccctgactttgtttctgcaaaggcacctgcatgtgtttgagttcaggttggcataatgtgaggaggtggggagatcacttaacacacatgtccatcgtgatcgtactacaccacaggcccgaggttgctgctcacttaccctttgtgctaccaataggagcggttgaggccattatatgactcgttaaacatcagagtgcactatgctgaggctacatcctacgctatacatacgacaacctgcgtataactatcatattcctggacgctactcggactgtcccgcttcatacaccacaagaaacatcctatcatgtgtcggtgtntgcgattcttgtaacaagagtacttttaaatagtttcgaggatttgagacgct

SEQ ID NO: 580652 - DNA, 1136 bp, Homo sapiens
  misc_feature (452)..(452): n is a, c, g, or t
  misc_feature (459)..(459): n is a, c, g, or t
  misc_feature (499)..(499): n is a, c, g, or t
  misc_feature (586)..(586): n is a, c, g, or t
  misc_feature (630)..(630): n is a, c, g, or t
  misc_feature (637)..(637): n is a, c, g, or t
  misc_feature (688)..(689): n is a, c, g, or t
  misc_feature (708)..(708): n is a, c, g, or t
  misc_feature (711)..(711): n is a, c, g, or t
  misc_feature (732)..(732): n is a, c, g, or t
  misc_feature (744)..(744): n is a, c, g, or t
  misc_feature (789)..(789): n is a, c, g, or t
  misc_feature (791)..(791): n is a, c, g, or t
  misc_feature (819)..(819): n is a, c, g, or t
  misc_feature (822)..(822): n is a, c, g, or t
  misc_feature (889)..(889): n is a, c, g, or t
  misc_feature (892)..(892): n is a, c, g, or t
  misc_feature (900)..(900): n is a, c, g, or t
  misc_feature (908)..(908): n is a, c, g, or t
  misc_feature (914)..(914): n is a, c, g, or t
  misc_feature (927)..(927): n is a, c, g, or t
  misc_feature (1049)..(1049): n is a, c, g, or t
  misc_feature (1051)..(1051): n is a, c, g, or t
  misc_feature (1105)..(1105): n is a, c, g, or t
  misc_feature (1129)..(1129): n is a, c, g, or t
gtaatcctttatgaccctcaatctcgttcgattcattacttatgtcccgcatctgagtcactagaaacttcatctgggtcgttattacatgattcaattacctataattccgcgctactagtgtgcactcccacaaagcgtacctttagtattgctacaatactaagcgaaacgcgaagatgatattgtagcgccaatcgcgagaccacaatagaccttgatactatacaactgatgctcatcaagacactatacattggtactagaggctactacctatcagaacaatctgatagagagcactgaaagcactagatcatactatcataacataagctaatctctgtaattcaattattagtttcgccattatacttctactgtctcatcgagaacatcctgatcatctttacagtatactgcaagtcatccaattttatactatgtaaaantcgtagnctcgatggtctacactaccccatataatgcatgacggcgncgtgcatgttgtatatatactggagacatgtacgtgcatcatatatgtattataaaccaaactgtgcacgcctaggtcacctatgcntatggctgtaactacatataaggagaacatcaactcttagacanctactanttacatgcctcattactaattcttaaagattgtattcttagttactagttnntacaacgcaatattacaanagnacaccttgaacccctgcatantatatcttatantcatcacaatatatcaaagcgcaacctcggtggtgctccccagtntnaaccagttcactcatataattcctcggncantttaatttctacttatttattcactctgttcttatagtgttcctcgactctcctttaacttttcttnatntgaactantctcattntataantttttatgaaganacaaaggtctcttgttccacctcttcacaaccattgtataccaaaactttaatttctaattcaccttaattataaaaaaacctcttatgcacacaattaacattaatcatggctttattttntnacccaatacatgattctaatttaagtatcttccattataataaacacttgatcnattgctattcctaagtggcacatnacagtaa

SEQ ID NO: 580653 - DNA, 275 bp, Homo sapiens
cgttcactatttatttagaatgacttagcagcccttttaatttttcccagagggctcaaccccccttggagtgactccctagcactggccatggtcagggttgttggaacattttaccttgtccttccagaacccaggagtcaagttttaaatccggcccaacagaccggctttgagggcatttagtctcagaaaaaaaaaatgtagaaggatttcggaattagaattttgtgtattgtatctgtagttttgtaataaactaacgaaaaataaaa

SEQ ID NO: 580654 - DNA, 480 bp, Homo sapiens
aacaccgtgggccccttgctggcggctgcaactggtgccccagcccctttgtacctcgggggcctgccttagcccatggccgtgcaaccctggccccccgcctacttcgggtgcattaggaggctggcggtgaaccggtcccccgtccccattactcgctttgtggaggtccccggggcagtgggggccagtggctgcccaaccgcctaggacacaaccaaccccggcccctggtcagggccctgcaattgcctcacaccgccccttgtgctcgcctcataggtgtttatttggactttaagctctacgggggacagatcttgtttttgaaaatggtttaagttatagcttttttaacgaaaaaataaaatactgcaaaatgtttttatatttggcccctccccccctttttaattgtgaaagatttgtccccaatcatccctggttcccccttaaaaattaaaaagtaacttctgggta

SEQ ID NO: 580655 - DNA, 107 bp, Homo sapiens
  misc_feature (28)..(28): n is a, c, g, or t
  misc_feature (88)..(88): n is a, c, g, or t
  misc_feature (104)..(104): n is a, c, g, or t
gtgactgtggccctggcatctcctcatnatggtggtgagcactttaaaggcgagaaggtgttccgtgttaacgttgaagatgaaaatnacattaacataatccncga

SEQ ID NO: 580656 - DNA, 243 bp, Homo sapiens
tgtcctcaaagttacacttctttaaaaataatgttcttggccgggtgcgctggctcacgcctgtaatcccagcacttcgggaggccaaggcgggcagatcacgaggacaggagatcgaaaccatcctggctaacgcggtgaaaccccgtctctactaaaaatacaaaaattggccagcgcggcggcaggcacctgtaatcccagctactcaggaggattacgtgaactcaggatgcttcttga

SEQ ID NO: 580657 - DNA, 563 bp, Homo sapiens
gatctctcgacgacgcatcaaaatcagtcaggcaaccttggaattatgcgtatttgtcacttcattaggaatgtacagtccttgcgagtaccagatcttgtgcgaagtggtgagggttccggaatgataaaacactggctactcctactgggattaccattttaaggcaggacccaaattatggcataatggaatccatggataggaaggcggtgggagggctttaagaacaccggtccgaaggagctattaatttttccgggtagaacgggagtgttttaagaagagctggaatttggcccaggtctttggtaaaattttggcaggtaaggtgccgaagtgtaattccggcccagaagataaccagagaaaaacttgggagcgaaaaaaaaccaataaaaatccccccaacaaaatacagttgttcgtgtgattccatataatttcttaaaaatagtttagtgtgaccaaatatacagtgctggagtagaaaaaagaaggctagttgagacccgattttaaggcgcttgtatgacttgatgaatgcgtacgggtaccgagct

SEQ ID NO: 580658 - DNA, 194 bp, Homo sapiens
cacgtaacgccttccgcggccacgctacccctacacgagtaggagtagcactgccgctagccttggagtctaggcctcgggcgcgggtccagccgccgccgccgcagatgctgatgttggtggcagatgttcaaactcgaactttgactttcgaagccgagaaggcgatacctgtgcgtaccgagatcgagctc

SEQ ID NO: 580659 - DNA, 190 bp, Homo sapiens
  misc_feature (189)..(189): n is a, c, g, or t
atttttggccgcacgctccttctcctgactaccgctgttcgctctcgccgaggaacaagtcggtaaggaagcccgcgcgcagagccaatggcttttaaggataccggaaaaacacccgtggagccggagtggcaattcaccgaattcgaatcacctaacaaggccgcacgtaaattcttggaaaaggtnt

SEQ ID NO: 580660 - DNA, 142 bp, Homo sapiens
cctgggatagcattcgacagttcgccattaacttttgccctgtgtggctgcaaaggaaagagccagtccatcatcaaaatgaagccaatcacgtctctcgtctttgcttgcaaattattacgagtgatacgatgtaatcaca

SEQ ID NO: 580661 - DNA, 795 bp, Homo sapiens
gagtctcgtccggagactggcagcggcggcggggcggggcggagctcgagccccagcggtgagggcgggcgggcgggcgcgggggagggaggggggccggtcctgcgacgactccccggacggcgttctcctccgagcggcgccggtatcgcgcttggcgggggggcggggtacagcccatccatgaccatgggcgacaagaaagagccccgacaaggccaaaaaagacaagcggaaacctgccgcagcacgaaggcgtaggggatagtagcgtctgcacccttcagaaacagtgctgacgcccttttacatgcagcaatctgcgatgtgagcgaaaggcacctccaccagaaaaacctcggatcaattctcagctggtggcacacacacagtggcacacactagtatgccaccccaacaccccctagaaaggacgacagcagcgaccaaacgttgccaccgcaggacaacagacaaagccctgcaggaacaggaccaagcgcaaaaattcagctccctagctggttaaccaaaccagtagtagcagcaagccaagacccagccgacacacaacctgcttcagcgacgggctctcgaccactcgaaacaacttttctgaaaacaactacgtgggggccgcggcccacaagtgcaaaagcaccgtgggccatacgtgtacacaataggaccctgccgaagcaacggatcggaaccccagcagaagaacccccggtgagcaccgacgtcggaccacctcaaggggtgaggcaacacgccctaaaagagccaaggcaa

SEQ ID NO: 580662 - DNA, 1104 bp, Homo sapiens
  misc_feature (814)..(814): n is a, c, g, or t
  misc_feature (839)..(839): n is a, c, g, or t
  misc_feature (844)..(844): n is a, c, g, or t
  misc_feature (852)..(852): n is a, c, g, or t
  misc_feature (857)..(857): n is a, c, g, or t
  misc_feature (861)..(861): n is a, c, g, or t
  misc_feature (888)..(888): n is a, c, g, or t
  misc_feature (925)..(925): n is a, c, g, or t
  misc_feature (1002)..(1002): n is a, c, g, or t
  misc_feature (1005)..(1005): n is a, c, g, or t
gttgagaaactacacattatgttattatctatgatggggttgtctctccggtctcacagtaaacaacggctgtgtcgtgttttcccatgatttgtgtatccaccctttgggcactaatacttgatcaggctttaaacacaggaatcttgggaacaagtatgtcatgacttcatcctgtttgatccagtcgcgttatctccccgaggggttaccaagccgccccccctgggtatcgacgcggttaactggaaaggggacaaaaggggccctcccccgtggcctgcacttgtcccatgggcctccctggacgcgcagccccctgtgcgggttcacccggtgccagccggggcagctgacacacagctaaggagcccttatagcctggcgggggctggcagagccacacccccaaggtgcctgtggcccacgagggcttcagtcagccgctcaactcctccacagggcaacttttaggaaagggtttttagctagtggtttttcctcgcgttttaaatggcctcagccccgcctgcaagtggctaagaaagcccagcacaggtgcccacatggtgctatctgaacacaagtgcctcaagcttctcccccggcaccgggtcacaggccctgggagaccccgctattattctgcgtttcttctgccacaaagagactctcgtgggggccaattcaacaacctggccctgtggcacagcggaagccggagccacgggttcttgtggtgcctacacactctacggtttgcttgtccccctcgtgcccacactgctgtatgatttgggggccccccccctgngccggtggcctttgggctgcccccnctggngtgagggnggggntggngctcatggcccttcctccttgctcccncccctggcagcagggaaagggctttgcctgacaacancccacgctttatgtaaatattctgcacgttgttacttaggaagcctggggagggcaggggtgcccccatggctcccncgnactctgtttgtgccgagtgtattataaaatcgtgggggagatgcccggcctgggatgctgtttggagacggaataaatgttttttcattcaaaaaaaaa

SEQ ID NO: 580663 - DNA, 325 bp, Homo sapiens
ggctatggcacacacacagagtaaatactacttcacacccactagaatggctatcataaaaaagataatcactggcaagaatgtagagaaatcggaatggtgatatattgctagtgggaatgcaaaacggtgcagctgattttaaaaataatttgggcccgtgcagtggctcacgcctgtaatcccagcacattggtaggccgaggcaggtggatcacctgaggtcaggagttcgagaccaggcgtgggggcacacacctgtaaacccagctacttgggaggctgaggcaggagaattgcttgaacccggaaagaggagagtggg

SEQ ID NO: 580664 - DNA, 133 bp, Homo sapiens
tgctgacagatgtgagatgctcgggcgtagtgtgcacgtgctctggatactccagtctctcttcaggataaaaggtccaacccagtgtcttcaaaatgccagtggagcacactaggaaggagaaacggtgacc

SEQ ID NO: 580665 - DNA, 226 bp, Homo sapiens
agactaagtccctgtcacttctctggctctcctctcctgctaatcttggtatcctaattaatatcttctgccattgcgatacgctacagcggctgaaagtaagcgccatagaccaccttggctctcgtggttttgcaaagtattggtctccaccgccataagggccagagcttctgcctcctacatgtcctcccttcatcggttccaaatttgaagactgattgtt

SEQ ID NO: 580666 - DNA, 563 bp, Homo sapiens
ggagtcccccagtcgcttgttggacacgtcatctaggcgttttaagagttccaagcttgtcccgctagcaaacatctatgggcccggacaggatcctccgaggcctcctgctggcgcggtcgactatggaagtacacagagtggcactggctattgtgtttttacgatggtcactccctggatggcctgcaggtccacttttgtaccagtttagggttcctttcatgcacgactaagccaggcagaatcggctcacgctggcctgtctgctgttcatgtttgtgtctgtctgtcctgggaggcctggatgtctgtgctcccaactcaggacatccttccttccccaccaaggaggccatgattcatccaacacttcaccctgggaagcccagagctggcactaataggcaaggggcctctcaaggaaccttttgtagtgaaaataaacagggggccgtggcccggatgcccaaatgcgctcagatgcccaaacgcgtgcagcctttccgccagctcctgtattacaaagtgagtgaattcccaacaagcgcctgtgggtaccg

SEQ ID NO: 580667 - DNA, 192 bp, Homo sapiens
agtactaaatactttgcaaggcctcagaagctctgctatccacaggcaggtgagatattaccttccctaccacctggcagtcatagtctatgatgcgattcagctttgtggaagtgcttctgtaaagaacttcccccaacttaagatgatcttaatttgcttacttgtttactgtcccgctgaggagaaaat

SEQ ID NO: 580668 - DNA, 292 bp, Homo sapiens
  misc_feature (288)..(288): n is a, c, g, or t
acctagaggactcccttattccttctttattgactctaagtcactgtgacacagggaaaaatgaatttgaagaactgtgacataaaaacttgagaaattcattattacacagtgaaaccccatctctactataaacacaaaaaactagccgggcatggtggcgggcacccgcagtcccagctactcaggaggctcaggcaggagaatggcgtgaacctgggaggcggagcgtgcagtgagccgagatcgcgccactgaactgaagcccgggcgacacagcaagactcngctc

SEQ ID NO: 580669 - DNA, 1133 bp, Homo sapiens
  misc_feature (151)..(151): n is a, c, g, or t
  misc_feature (492)..(492): n is a, c, g, or t
  misc_feature (522)..(522): n is a, c, g, or t
  misc_feature (718)..(718): n is a, c, g, or t
  misc_feature (801)..(801): n is a, c, g, or t
tttttgttggctgttgcttggggccggcggtgacggtgtggttgcagtggcagaggcggcacagcgagggcgaggcgagtagtgctcctgggtgtgcagaatgctatctgtacggtgtgcgagtgcttgctgccgtcagctgtgctgcccntgtggaaccgaccccgtcgggtcgccgccagttttttatgcctctaattggcgcttcttcccccgcaccccgggccaggtctttgggcgagtccccccgcacatctctgctgtgcagccccttatcaggtctccctttgctcggcctccgccacaatcaccccgggttttcccctctcgccgacgcaatacggtgccacggcccacattcttaagcgcacacggaggggcctgttggtggtggaacacacgaggacaccacgtgttggggccacgccggcgtccctctccctccatatttgggggagcacgcgcgccgtttcccccgaggagctcccacgncgggggcacgaaacaagggttgtgtggcgnccctctctagggggggaccccttgtggatggggggcctttcttttatcccctccacccggggcccgaccggtgccccgcggttagagtgttcgtaagaccacgggcattctatctctcgccgagtatcacttctcgtgcgagccccactctactggtcgccacgagttgctccaggattactcaatgcgcgcgccnatcattattggtgaggcgacgagtgtgataagatgcctttctccaagaagcccgcgtttgtcttcgccaacaacacaatgagnagccgccgggtatacctcccagcaattatggggggagagatgtattattaagcactcctaccatcgtgctatataaccacgaagaatctccctctttatggcaagcaccgcccaccacaggcatccgtttcaaaggcaagcggtggaaccccctctccccaagatggctcccctgttgcacaaagagaaatgatctgcggtatgactcccaatgaaggcaccatgtctctccgggcgactcggagccgcgcttctaggtagtcaaacacccacccatttttaggagtttttcagaaaaaacaaaaacaaactttgggcccgcggacataaca

SEQ ID NO: 580670 - DNA, 261 bp, Homo sapiens
cagcgtatgcacattcactttacatacgtgtactatcatcatatttttttgagatagggtctcactgtgttgctcaggctggagtggaatggcactgatcttgtgctcactgcaacttccacttcccagtgctcaggcaattctcctgccccagcctcccaagtagctgcgactataggtgtgccccactgtacttggctaattttttttttttttttttgggtagagagggggtttggccattgttgccaagtctgggtc

SEQ ID NO: 580671 - DNA, 85 bp, Homo sapiens
attcggcacaggaacagaatttcatagcccaggctgccgtgttgtttgactcagaaggcccttctacttcagttttgaatccaca

SEQ ID NO: 580672 - DNA, 89 bp, Homo sapiens
ccttaagactccgggctggggcccccctccgagggcagcttccggccttgccggccccattaagggcttcagaagtgaaaaaaaaaaaa

SEQ ID NO: 580673 - DNA, 325 bp, Homo sapiens
ttcagaatcagccatgaagctttgtgtcaacttggaattcaaatcaaattttgccaaatccagtttgctttccctttgaattgctagatgtcgcaggtctattatgtgacaacaacttgaaaaagacttctatcccgtaacatctctgtagagaattgcacaggtaactatcttcatcaagactttgatggcaccataccatcactactcataaagctacatagtgagagagttgtgtgttgtgatcaatcccatagtgtctgacctctcaagcgctcgtcatcaagcgctaagactcagtcatcagtagtgtctcacactaagc

SEQ ID NO: 580674 - DNA, 85 bp, Homo sapiens
  misc_feature (79)..(80): n is a, c, g, or t
gccgccccagcggaattgtagaattcggctcccctagtgcccgtgggccttgtttccaaacaggctggtcgggaaccgnnagatc

SEQ ID NO: 580675 - DNA, 205 bp, Homo sapiens
tctacctcgcgggtgctctacctcgggtccaaagtgcgggattacaggcgtgagccactgtgcctggccgaaacagggtatttttgggtcgcccaggctggagtgcagtggtacaatcacgggtcattgcagtcccgacctcttgggcttaaacagtcctcccagcttaacctcccaagtagctgggaccacaggcacccgcgag

SEQ ID NO: 580676 - DNA, 305 bp, Homo sapiens
cccctcccgtacacagcaattatcacctgtattatatttagccacgacacacgacagcagatgtcatgtgtgcgacacacctccctgggcaaggagatttttgtttaaattagagatggggtctcgctatgctacccacattggtctccaattcccgagctcaagcaatcctcccatatcagtctcccaagtagctgggaccacaggtccccaccaccgtgaccagctccaatatttttttaattgtggttaaaaaaaatatcaaataaaatttgccattctaaccttttttttttttttttttt

SEQ ID NO: 580677 - DNA, 108 bp, Homo sapiens
ctagaggatcccaatgctctggaacaggggggactcagtgttctggatgattctgcagtggaactcatgcccgctccaacggacttgcttggctgtgcacaccctgag

SEQ ID NO: 580678 - DNA, 180 bp, Homo sapiens
gtacactagtatgccatcatctaagccactgaatcaagtgtatatcaggcttatttcaacattccaatagccctggttttcctgctatgaatctagtatacgtggtcaaaggttatgggggacatttgtagaccctaggaacataccccagaagtgaaaagatgggagctagggccacaa

SEQ ID NO: 580679 - DNA, 365 bp, Homo sapiens
gatggccaaagtgggcttccagaagcttctttttcccctaattgcgggcctcccccatttgcatgcaatgactattttgtaggacccatttaagcagaagggaaaaaagtaggcagaaatgagcagttcgctcctccctgataaaagttgtcccaaagggttgcttaaggaatttgccccccagcttcccccataaaaggatttcatgagcagatcagggcccttagcaaatgtaaaaataaaatttaactttcatttggcaagcaaagaaaaaaaagtttaataccagataagcttttgatttttgtattgtttgcatccccctgcccccaataaataaagtttttttttagttcccaatttga

SEQ ID NO: 580680 - DNA, 435 bp, Homo sapiens
acctgactccaaacaggacagagagtagtaccattgttcattttcaccacgaggatttcatctcaagaaaacattttctttgctcatccataagaagcaactcttcatcaattcaagttttatgatgagattgcagtattcagacacatcttcaggataattctagttctcttgctatttctacatctgcaggtatttcctctactgaagttttggatccctcaaagtcacccatgaaggttggaatcaacttcttccaaactcctgttcgtgttgatatttgaccccctctcatgaatcatgaatgttcttaatggaatttagaatggtggatccttttcagaaggttttcaatttactttgcccaggtctatcagagaaatcactatccatgacagctatagccttattaaatcttatttcttaaataataaa

SEQ ID NO: 580681 - DNA, 647 bp, Homo sapiens
  misc_feature (196)..(196): n is a, c, g, or t
  misc_feature (526)..(527): n is a, c, g, or t
  misc_feature (537)..(537): n is a, c, g, or t
  misc_feature (568)..(568): n is a, c, g, or t
gctgtccctcactcgccgccgacgacctgtctcgccgagcgcacgccttgctgccgccccgcagaaatgcttcggttacccacagtctttcgccagatgagaccggtgtccagggtactggctcctcatctcacccgggcttatgccaaagatgtaaaattttggtgcagatgcccgagccttaatgcttcaaggntgtagaccttttagccgatgctgtggccgttacaatggggccaaagggaagaacagtgattattgagcagagttggggaagtcccaaagtaacaaaagatggtgtgactgttgcaaagtcaattgacttaaaagataaatacaagaacattggagctaaacttgttcaagatgttgccaataacacaaatgaagaagctggggatggcactaccactgctactgtactggcacgctctatagccaaggaaggcttcgagaagattagcaaaggtgctaatccagtggaaaatcaggagaggtgtgatgttagctgttgatgctgtaattnntgaattaaanagcagtctaaactgtgacaccctgaagaatngcacaggttgctacgatttctgcaaggagaaaaagaattggatatcatctctgattgatgaaaaagtgggagaaaggtt

SEQ ID NO: 580682 - DNA, 322 bp, Homo sapiens
ccagggggccctccaaaagcttttttatgtccccctgggacctgtgtcctgttcaaaattggaaaaggggggggccggggtcagctccctttgtttgggggtcagcacccgcccccccagttgaggggctggccttgggggtttgctggcccggggggggatagtataggaagtaaaaggggaaggggggttaaataaaaaatttttaataggcgggggttgggggagagccccaattttggggggggggggagggtagggaaaaggatcccctgggggaatcccccctttcagaaccaataaaataaaattgcccttttta

SEQ ID NO: 580683 - DNA, 123 bp, Homo sapiens
atgggacagatgtcattacccacattgaggtagagctcactctcccaggtcagaagagccacatatatactgcagtcagaatccactgagtaagcagctcctattcagcataaaggcacaggg

SEQ ID NO: 580684 - DNA, 427 bp, Homo sapiens
tcctaactcagcaatcctctggctcagcctcacaagtagctaggataacaggcgcaggccatcatgaccaacaaaaagaaatttttaatatggatggcatgatgaattatttggattatatggagttaaatagatttcctcattggttaattggtgcggtttcctctttatggtggctataagaaaattaacaattaactatatgggtcactttggtgacctccatggtattcctatggggcaaggcggtgctagactcaccagaaggtatacttattttaatttttaggacggatgtatacggggccctggtatacatgtgtatacctagggcagttaactgattactcttttaagagggagaagatcctcaaaattcgggattttaggctggacactttaaagccggaaacagctactaaaggtg

SEQ ID NO: 580685 - DNA, 255 bp, Homo sapiens
ctcctagaggatcccttccaaagtgctgggattaaggcgtgagcaccctgcctgccttttcttcatgtattgttattatgtttttttttggagacagagtcttactttgtcacccaggctggagtgcagtggcgcaatctcatctcactgcaacctccgcctcccgggttcaagctattctcctgcctcagcctcctcagtagctgagatgacaggcccacgccaccacgccccgctaattttggtgtaattagt

SEQ ID NO: 580686 - DNA, 120 bp, Homo sapiens
tctagcaggatcctcttatttccttctttatgaaatactttttgttaatagggacaaccaaagaaaaatacacaattttatatgtgtagatcatataaatacaataaagaaggaaaataa

SEQ ID NO: 580687 - DNA, 833 bp, Homo sapiens
gccggagtcccgaggataaagcttggggttcatcctccttccctggatcactccacagctcctcaggtcttccccaatcctagggactcggctgccgggaccgctgctatgtgacgacattttcactcagatgccgggagggcaacctgcagttcgtcgcgattcgcactgctggctggacaactgcggagcaacgacctcaaccacagggggcacgatcatggcttctacctcccttgccggctgggccgtgcacgagagggccgcgtctgtctgttggttgatgagtgttgattcatgcggggggcatcggatctaatgtaatgaactctgtggggatgactaccccccttgcatcttggctgccagtcatggacaccgatgaatatgtgtacagaagctaattgcatgttcaacggcaagacatcacagtgcagtgaactgaacacggtaattgtgcccctgcactagtggcctcgttattatggaggccgaatgcatcaaggtgagcagagtgaccctgtggtgtgcgaatactggaggccccttgtcgagctagtctgtagacacacgtatgcgacgcaagatgcccttgtgttgcacagagagccaaagggtctaccccgtgcagcagatgcttctccgagagcggtgcgagagaaagatgggccagaatctcaaccgtattccattcatggacacattctggaaggggaccacctcgcactcggccccgtgagtcagcacgtgtgggaagaagggttgtccatcggaaaataatcctggcctcttggggctgggttagggtgaagctgggtacctgaccttgccaa

SEQ ID NO: 580688 - DNA, 85 bp, Homo sapiens
aaaaaaaaaacaatacaaacaacaccaacaacaactaaacaacacgccacaaaaaacaaatagagctagctataggcctggtgtt

SEQ ID NO: 580689 - DNA, 269 bp, Homo sapiens
ctagaggatcccgtgctccagttcatcgcgttttcagcacgccgtaatcctcagacagcgtctggtcacgtcagcaagcaggggatgtcagggggcccaagcctccctctttccggggggtgttgatccaagaccaggtgggtgaactgagagtccaccgagtacgcccgagcatttcacagaccgcagcttgcgcgaaggtccatctgcgacgtgttagctgatacgcgattgaagatggagagcacggcgtaccgagtctacgaatt

SEQ ID NO: 580690 - DNA, 131 bp, Homo sapiens
acaccttgcaccgtgtatctctctattctttcacctagcctgtagatttgtgtgcttgacgcccggtgtcaccgtggctgacacctcaagagacatatggctatgtacatgaatgtgtctccgtgtagtgt

SEQ ID NO: 580691 - DNA, 1019 bp, Homo sapiens
gggagaagctgtccctgcggtagaatgagcgggtgcccctcactgcgcctgctctaatcaaagcctgcggatagcgccgaggtcccggcatgtgatggacacgagagcactggagaaggaggttcaggctcttcgggcccaggtggatggcgtggcgtttccaaggggaggctcctcacaattgcactgagatcccacggaggtatgggcacattcccccgggctacatcgtcacaggtagtgctgtgtgatgcagcatgcgcgtgtgggatgatcattcggagtcctcgcagccaaggccaggtgactggaggagcttgcatgtctggttctcacacctgaggcggtggtcagcttgcagctgcgcatgcaagtcaggcagaatggattgtggctcctgggccttgatgggatgactcgtaagccaacgggcttcagccaattgaagccattgaagaaggcctactcatggaaatagcgtgagtccgaaaaggtgtatgcaacacagcacggtgctcctccatgaagggcccgggcatgggccgtccgggaaggcagccagccggtcagcatgtggtagggcacctgaaagcgagtagctgtgggtgctatcgagaagcagtactcggcaggaagtgcgctggatgatgggggcatctcatgcgggccggcctgaggacgccgcgaggtacgcttgtgccctcctgtctagccacggattggccatgatgcttgcttgagcctagaagcaaggaatcttgatggccgcctgtcaggaggagatagaccaggttgcgcggtttcatttgcttcgcagggtcattgggcaattgcttggtcggcgccacacgagcggcgtccctgggacgtagaggtgcggttcgggtaagggaaacgactcagtactaaagaaggagggtgccggctccggaagaagtcagatatccaggagcaggtcctctggaatcccgacgctttggtgggcaaaaaaggtgtgcggtaacactaggacctttctg

SEQ ID NO: 580692 - DNA, 1152 bp, Homo sapiens
  misc_feature (1)..(1): n is a, c, g, or t
  misc_feature (783)..(783): n is a, c, g, or t
ntaccccttttgtatctactgtctccctgtggggggttcctacacccgaatttccaaggggggcgctgctccgccccaccccaaaatttgtgtgatatgggtaactcacacggctggtcctacgccctaggtcctctcgtcctcgccacacgagggtttggatagtgaacccccttcctcacagagccccaaccgcgtttgttttctccacagtcgaatttctcccatctgcttcctttgtttccccctggggacgcaccctgggtccccacaaccagagccactgtttgctgtggcgccgcctcacagaagaccccgcgtgtgagcacgcttgtttcggcccacggccgccctccgcccgaggggccacccccggggaaacacacacacatgggtgtggagaaatatattggtggggcccacacgagaacacacaccgctcggtgcacacgctgggcctccctctggggagaccacctgttggccccccctcgggagaatctcactctcgagaggataaagtcccccccgcgaggggagtgataagaactgttataggcgggtgatgactggatagaggggaatctttcaccgcgggggtcccctgctgtctgtctatatatattggccacgccctcgtgtgtctctctcggagagttcgctccacacacccgcggggtctcacatgttttcacaaactctaatttgttctagagaccacactgttcttcgccacgccttctttctcgtggctcgttccacctctgtggggaagtctaaagntgcttctcacacaacacgggcacttcacacccacgtgtgagacccacttcttctcacgcccttcttctgagggctctggagagaaaggcctcgtttctgagagcctcacccctattcacgtcacgtaagaggaagaagaatgtccacgagaaaaaatattctcttcacggagaaagttctcccctgcacgaattttttttccctgttaaaatatcacggaaatatatggccgggtgcggtggctcaccacccctgtaaatcccacgcacctttgggagaggctgaaggcgggcggaaacaccctgaggtcacggtgttcgagaccagcccggcccacatggtgaaaccccgtctttacttaaaatacca

SEQ ID NO: 580693 - DNA, 518 bp, Homo sapiens
ggggcgtatgagagtaggggatggcttaggtttaggcttgggtgttcacaggttagatataaagaggtgtcatgacatgatggactcacgaggccaagagaacagacagaaaaagaggccctctaagtggctaggtcttcagggctggtgcccagaagaaaaaacccgagttgtagaaagacctggggagtaggcccagagaatgtcctgaagatggggagatcactctggaagcctgcacaaggatggtaggtaggacacttaagagttaggcagagaaaagatcatataacttggtgagcataaattctttgttacccaacagaaaccaaaaaaaaaaaaactggctttttttcccaagagggtgcagggggcagggaccccaattggtgttggtacgcccttttgtattacctgcaagtggggaccggtttaattcccctctgtggtgttccactattgccggttggaattccatgtggtaatccattaatgacagttggaattaggtgtgggta

SEQ ID NO: 580694 - DNA, 197 bp, Homo sapiens
  misc_feature (104)..(104): n is a, c, g, or t
gtgatctagaggaccctcacactagtcaagtgcattaaagtgctttgttatcactcaagttggttttagaggagacgaatgactactccaatctctggcttacncagtaaaggactacaagccctttgggcactttgcatggatgccatccacttgagtgaaccaagattcacataatgaaagccaccagaagaggt

SEQ ID NO: 580695 - DNA, 361 bp, Homo sapiens
tgctatgtatatttcatttccataacgtttttgaaatgacaaatctagaaatgaagagttgattagtggttgtcaggagttatggagggggtgggagcaggaagtcacgggttgtggctataaaatggcaagatgagggaactttatggtaacgaaaatgttctgtatcttgacagtatcaatgtctatatcctgattataacattgtgctattatatgctgttaccattggaaaaaaaatgggtaaacggtacacaggatcttgattatttcttacaactacatatggatctacaattatctcaaaattaaaagttaatttttaaaaacaaattcaggccatacacatacaaaactaaat

SEQ ID NO: 580696 - DNA, 98 bp, Homo sapiens
gcggccgcctactactactactgctcgaattcaagcttctaacgatgccggggacatggaaataaagcaccccatcggccctgggcccctgcaaaaaa

SEQ ID NO: 580697 - DNA, 112 bp, Homo sapiens
agttagagaggtggcagcacagacgaggtggacagccagaggagggttgacaccttcctctaccagctgccaggaacagtccagccatgctcctcagcctcctctgtgctgt

SEQ ID NO: 580698 - DNA, 329 bp, Homo sapiens
  misc_feature (329)..(329): n is a, c, g, or t
ccccgttcactttctacacacgttactttgaagtcaccataaacttcagtatcatcaggccaatatttatagcatttaacccggccaacctcaactaaatttgtaaccatcacaatgcaagcagattgttcttgccaaatcatcctccagaaatcatacactgtttcatgaacgggaccttgggttgcaatgtaatgacttggtctctggtagccatcaatatagttggcattaatataatctgaggaaggatcatcctctacgggttgcaaaatcactctggagtgatcatatgctatgcgtacgacagtgaccgggatactcatagn

SEQ ID NO: 580699 - DNA, 662 bp, Homo sapiens
gcaggagttcaagaccaggctgggcaacatagcgagaccctatctctaaaattaaaaaaaaaaaattctctttttttgagacggagtcttgctctgttgcccaggctggagtgcagtggagcaatcttggctcactgcggcctctgcctccagagttccagtgattctcctgcctcagcctcctgggtagctgggattacaagcgcatgccaccacgcctggctaatttttgtattagagtagagacggggtttcaccatgttggccaggactggatctccaaatcctgacctcaggtgatccacccacactcagcctcccaaagttctgggattacaggcgtgagccaccacgcccggccaaaaaatttatagtattaaattggctgggcatggtggtgtgcacctgtagtcccagactacttggacactgaggtgagaggactgctagagcctaggaggacgaggtagcacgcgaaccgcgagcataccgacgcaacagcaaacaccgtgatgacagagcaacgagatcgcaacacaagacaaacaagaaaaacaaaaaaccatacgctagaggaaagacataacgcggaccaagcacaaatgaagaaaacgagagccaccaaaggtacgcaacaagcacagcgaaacagagacgaacca

SEQ ID NO: 580700 - DNA, 87 bp, Homo sapiens
ttttttttttttggttggttatttatttacttgatacacttcattttttagagtagctttagggttacagaaagttgagcaaaaagt

SEQ ID NO: 580701 - DNA, 154 bp, Homo sapiens
  misc_feature (19)..(20): n is a, c, g, or t
  misc_feature (26)..(26): n is a, c, g, or t
  misc_feature (106)..(107): n is a, c, g, or t
agtgcaggatgtacattcnntcccantgttatgcagacatacagacggtatcggcatacgttatagactgtatactcagtgcagagatctatgagactgcatttannctcagaggggccaagtgttaatgccccatgccccttccgtttaaggg

SEQ ID NO: 580702 - DNA, 241 bp, Homo sapiens
acctgggaggcagaggctgaggtgagctgagatcacaccaaatgcactccagcccaggcaacagagagactctgtctcaaaaaaaaaaaaaaaaaagcacaaatggtattctgtatctgaaaattgtttggattaacttttgattcttgcctggttaaagaattacaattcttacctcagatcatgcttaaactatcttatttcttctcatcacaataaaataaattagtgtcatttttat

SEQ ID NO: 580703 - DNA, 132 bp, Homo sapiens
gcgactctccggagtatacatgagccaagcatggatcggtgcgtatgatcgacgtgtatacacgagtgcggtacatgcctccgtgtacaagtgcgtcgacacagtgagcaccgtgctcgagctccaaatata

SEQ ID NO: 580704 - DNA, 361 bp, Homo sapiens
taagatctatcagctattcaaaaactaaaagtctggttagcttacaatcttatgaatatggtacgcgtcagattatcgtttgtgtgactctcctattagtgtatccgaatacctgctgcttgacttcctcaagagctcttacccagtctcgcacagggagaacccgctcgcgagtgctgtaacactccagagaatttgcctgccattttctaattacggacaaaaacgggaagcaggtgtgggacacaagctctttcacagaagtaagcagaaggcttccagtactgatataattcattcacactcacgagtcccttgatctccccaactgtcctaggtggtagggataattacccccatt

SEQ ID NO: 580705 - DNA, 145 bp, Homo sapiens
gttaactatgccgtggtgcaaaactgtagaacgttgcttattcactgtgccttggtggcattgcatgtctgcgtctcgagtgtcctgttccctcctcatgcaacatcgtgcattttcaatacactctactgtcctccagcacctt

SEQ ID NO: 580706 - DNA, 335 bp, Homo sapiens
  misc_feature (73)..(73): n is a, c, g, or t
ttcttgatatttatccaagggaaaaaaatatacatatataaagatttaaagtccgggtgtggtggctcacacntgtaatcccagtactttgggaggctgaggcaggcagatccctgagatcaggagtttgagaccagcctgaccagcatggtgaaactcggtctatactaaaactataaaaattagatgggcatggtggtgcttgcgtgtatgcccagttactcgggaggctgagtcaggaaaattgcttgaacctgggaggcagaggttgcagtgagctgagatcgtgccattgcactccagcctgggccacaagaatgaaattccataaaaaa

SEQ ID NO: 580707 - DNA, 383 bp, Homo sapiens
atgtcagaatctcttttgtttttaaggctgaatagtattctattgtgtatataaaccacattttctttattcatctgttaaacgcttaggttgatttcataacttagctattgtgaataatgctgcaatgaacatgagactacagacatcccttcaacaaactgatttcagatgtttggggtaaatacccagaagtgggattgctggatcatatggcaattatatttgtagtttttttgaggaacctctatactgttttccataatggctgtaccaatttacattcctaccaatggtgtgcaagggttcccttttctccacatccttggtaacacttatctttcatcttcttgataaaagatattcagacaaatgagaaatga

SEQ ID NO: 580708 - DNA, 405 bp, Homo sapiens
tctggatgcaagtgtctccgttaccaattgctataatctgttggctgacactcccatgaatttgccaagcaatcaggttgaaacacaacagaaaatcacagagagcacttccagaccacaacgcaaattcttagattttggttttagttccagacaaaaatgttcacttcaaatactctttaggggatccaagaatgtctgaattgtagaaaatttagaaaacacagtttgcagaaaggaactgcatttgtatttgcttctggtatgaggagcctgtgtctctaatcagtccgggggcttgcaggaggggagagtggggctgagccagggctctggaagtacaaggataagaggtgatcttaatcgctaccagctgctttgtaactgggtgggacccagactgtg

SEQ ID NO: 580709 - DNA, 355 bp, Homo sapiens
atgtggatgttgctgtgttagttattacagatcctgcagaatatccgccatatcgtcgggcgtgttcttcttcctgagccaggatgtcttcgaagatgcgacgggtagtcgggtctttgtcaccgatgtactggattatctcgcggtagctgtctaccgcgatccgctcggccaccaggtcttcgtataccatttccttcaaagtgttgcccgccacgttattgcgcatgggagtttttcgacagcaggtcggggttgaactccggctcgccgcccagttgcacgatacgctcggccagtttgtcggcgtgctcggcttcctgggtcgcatgttccaggaactcatcggcagcca

SEQ ID NO: 580710 - DNA, 414 bp, Homo sapiens
gctcggcaccctaatattacgcatgaggtcgtcaggacgttcgcaactggacaggatgggggacagagcgtcaacaagatccctctccccgttagtaaggcgggcagcgcacacctgaccaaacagatcgggcttcgatccgaagttggagtacaccgcccccttggtgaatccggcatccgtggcaatgcgtcgcagactggcgccgacatagccgtcccgttcaaagttgtgggcggctacggcaagtattctgcttctcacctcatcgcggtgaggtcgttctactgcggcaggcatcacaagttgtcgtctttcgaggaatccagaactagatcggtggcggtaccaccggtatcggataccaatggtatccgtctctagggtccagcccaaatcggtcggctagggtag

SEQ ID NO: 580711 - DNA, 112 bp, Homo sapiens
agtagagtattgctgacttatccttcttctgggaactttgtcccagaggggcacctgccgtgtattatggtgatcacgtgggcccctcactgggaaagtatctcccagatat

SEQ ID NO: 580712 - DNA, 343 bp, Homo sapiens
tggagtagtcaaaaaaattagcatggtgacatgcacctgtagtcccagctactcaggaggctgagtcaggagaatcacttgaacccgggaggcagaggttgcagtgagccgagatcgtgcccccactgcactccagcctggcaacaaagtgagactccatctcaaaaaaaaaaaaaaaaagttacacgaaaaaaaaaacaagggcagaaagtgcaatcacttttggcaccaccctaacagaaaatgacataaccgggctggggagcgggttgctcacacctgtattcccaacacttggggaggccgaggcgagtggatggctagaggtcaggagtccaaaacc

SEQ ID NO: 580713 - DNA, 669 bp, Homo sapiens
taaaagccgggatggtaaccagaattttcttttttcccccttctcagctgtaaatatgatatctcctttacagggccccagcttaagggcaaagtgagttattgtgtaaacaaaggcgagggacaaaagagagttaacatcttagaacaggtggaaaaagccaggggtggtggtggtttcgtgggaaaccaccaacacttgcgaggtttagctttttctcccagggtttggactacaagaaaagaaaaaccagtgcttttgtgcaagaattaaaaagtggtggttgaggtgtgccttaaatttaaccattccccactttttattcatatttccaccactcacttcgagggcttttaagaagtcaggtgctcaccggggcggagcgggtagtacattctggcttcttaaaaagctaagtccggggtcccgtctgatttagcgtcccaggaacttccgtgagaaacacccgatcgcagagggtaatttctcgggagttggttggcaggaataccggggagtatggccacccggttccacaatgcggtaatgaatccagcaggaaggtaaggtctcagggtcccaggaggggcagcaggggatgtgcacaggggccaaaaaagggttgtgcgcagatctgccgaaggactgaaggtgggcagagggggtcca

SEQ ID NO: 580714 - DNA, 261 bp, Homo sapiens
cgacgatgactgtgccttcacaggcaaattactcttcgggtccgaaggtttggatttaacgcgctccattgccccggcgtggcacgccattcgaagcccttccgggctggaactggtgtcgtaggagcctggggtgtatcgtactccctgctgtcggtgtctcctcactcttctgagctcttattactaatcaagccctgcttcaagttaactaatatagactgaatgattaacaactgatgcccaataaacctaactgca

SEQ ID NO: 580715 - DNA, 443 bp, Homo sapiens
tcgaatcgacggtttctccacgatacacaggcttccatctaaagtcacgcttactaaaagggaaaaaaatgaaccagcaaagtatatagagtagcgtgacatttgcttattttctagactttacatttggctaccgaaaccttttaattcccttgtgtaattttacctgttagtccaaagagggaccgctctttgggcactaaggaaaaaaccttgttgagattggaattattatttaaaaattcaggcaaacagaattcttggactggaaaattactttggccaaacagaaaaattgcactaagagggcttcttaacagcagaatgggttaaggtgggggaataattaggtgagcttggaagaccgggttaattaaaaatatgggccataggagaaaaaaggagaatggcaagggatggcccttattctaccagatatagaa

SEQ ID NO: 580716 - DNA, 216 bp, Homo sapiens
tgtattttgagtcaggtctagctctgtcacccttggctggacgcactggtgtgatcacggctcactgcagccttgacctccctggctcaagcaatcctcccagctcagcctcctgagtcgttgggactacaggcacgtgccaccacgcctgacacattttttaaatttttgtagagacagtgtttcaccatgttgcccaggcaggtctcaaactcc

SEQ ID NO: 580717 - DNA, 1194 bp, Homo sapiens
  misc_feature (298)..(298): n is a, c, g, or t
agcgggaggacaaactggctggtaaaccagcagggaccaggtcaatatgaggctcaccactctggccacgcaacgggcctgcggatggacgatcgtcacagattcacgaagagctctcaaggattggaagggaggacccttgaagaattgtcactctagtgttgcaagtgctgtggtcccgcgtgtaaccgtaatgtccgtggtactaatagaagtatgccctgcaacaatgaatgggggctaatcacctcagtcattggagagtgcgttcgccggactgagtgggagacacctacantctacccgtccatgggggacgcgactgaaacatctattcacatgaggttgtgatgctgtacctgatgcataaaataccctccgtctctattctctatgtagtccgtaaactcttggtgtgtgtacaatgatgtgaaagagacgaagatgccccgggagctggggtacattcgctttcttcatgggcatccaggcccgtcaatccgcttgttgaacaggagcacggcaaggtcaagctcgtatctactcgaaggagagacaagtggatgccggttgtctgtggccgataggcagagcaggacggcgacacgaccttgattcgcgaacgagaaaggatcgtaggttgtagatgtctggggtgctctcgtccacgtggggggaatcctatatcgtcgttagagggggggcagggggagcgcaaccgtggggggaaaggaatgcccaaaagaaattgctggccttcagggaaagaaaataaactttggaacacgttgcggttggaccctttccgtgtgcgtgcaataaggtaggccaggaaagggttgaccatcccgtgggccaacgactaacggaaagcaaattgtaaagaaacccaactcgcttggaattggacgaagtggcttaaaagcctttcgcggatgccatggtcggggagagaaacatttgttctgaaccactaagtcctaggggaatttgcggtacgttgctatggcttcgaaggcattccccagggagggaagatacgaacggggtggtaccataaaatttacagggaagagccaacactctcgcaaatgtgctcaatacacccagcgttgtaaataatggtaattaactataagtttcccgaaagaacaagaagggggttcgaatacacacgcaaggtgggactaggaa

SEQ ID NO: 580718 - DNA, 356 bp, Homo sapiens
ccggaacccaagatggctgcgctgctgctgagacacgttggtcgtcattgcctgcgagcccacttcagccctcagctctgcatcagaaatgctgtgcctttgggaaccacggccaaagaagagatggcgcgggtctggaataagaatatagggtcccgtgctctggctgcccacattactatctacagttggtctcttaccatggcgatgtccatctgccaccgcggcactggtattgctgtgagtgcagatgtgggacctacgtactgtgatggactgtatggggctggcagccatgtgaagcggaggctgccaggatgatctcactacacattattacattgaccctctttgtg

SEQ ID NO: 580719 - DNA, 749 bp, Homo sapiens
  misc_feature (47)..(47): n is a, c, g, or t
  misc_feature (219)..(219): n is a, c, g, or t
  misc_feature (224)..(224): n is a, c, g, or t
ttggagcgagtgtgaggctatcggatgatctctcattcccagccaanatgtgatgtgcagtagagcaggagacgaaacacagtccatccattccagacccatcgatgtcacagtagagagagaattgctggttagctttcagaggtatgaaacagagaagctcgctctgttgagctccactatcggcgacgacacgacaatctatctcagtgatatcangagtntgctccgtgtctctgtcaggctacgggcagagtgcataaagctgggtcttcttactagtcccgcgctcacaaatataaggagtatttgaaatagagagatcccgcacatacggaattctgagccatgtgttacagtcgatgcatcatatagctatgatatcttcatcacactatggtgagtatcagtgcagcagcagtgcagcatatagatatggaatcagtcatgagtataaacgagagtagtagtcattctagcatcctgatcgccttctggtgcttgcagtaaacctgatagtaagatgtctgccacagagtgtagatcctagtgagctgtcgtcctctaaggagccagggtgtctgcaataccacaggtagctggctgatacctactccatgtttcaagtagaatacgtcagtagtctctggacggtacatatcctagccgtgtgtaagagagatcatgaggcagcacagaagtcgaggcatgctcttcgggagtgccaggaacgactcattctgtttcag

SEQ ID NO: 580720 - DNA, 323 bp, Homo sapiens
  misc_feature (2)..(2): n is a, c, g, or t
  misc_feature (68)..(68): n is a, c, g, or t
gngccattgtggaaagcagtataaagttttctaaagttatttaaaatagaactacgactgggcgcggnggcgcgtgcttgtaatccaaacacggcgggcccatcactgaggttaggagtttgagaccagcttggccaacatgacgaaaccccgcctctattaaaaatacaaaaattaaccaggcagggtagtgcacacctgtaaccccagctactcaggaggctgagacacaagaatcgtttgaactcgggaggcggaggttgcagtgagttgagaacacaccgctgtactccagcctgagcaacagagcgagattctgtctt

SEQ ID NO: 580721 - DNA, 386 bp, Homo sapiens
  misc_feature (297)..(297): n is a, c, g, or t
  misc_feature (355)..(355): n is a, c, g, or t
tgtcctgcctgccagggtccaaaacgcggaagatcattaccccaccaagaaccccttcacgtggcttttcctgctggtgtcctgccccaactacacctacaaggtggggtcctggatcggtttcgccatcatgacgcagtgtttcccagtggccctgttttccctggtgggcttcacccagatgaccatttgggccaagggcaagccccgcagctacctgaaggagttccgggactacccgcccctgggcatgcccatcatccccttcctgctttgagcgctcacccctgctgaggntcagcccctcaacccggtggcattttgggggaggagtggggcccccagctttccagcncccggaataaagcccgcctgccccagtcgga

SEQ ID NO: 580722 - DNA, 925 bp, Homo sapiens
gaacagaaggccaccgaaaagcagcacatcacgttagccttggagaaacaataagctggaatgaaagagcgggtcattctgactctgcagtagctaaagagcattagaacatcacagaagtgaaatactcggctgaacagggacatgaaagatagaagtaagtcgagagatgcccatggaaaatgacaatgagaaccctagcttcgccgacaggcagctgcaccacactgatcatcttgcgcagatgtccttcagcggtacaacgaacgaggaattgaatgctctgaatttgatgctagcaacggctgctctgagaaacatctctgaacgaaggaaagttacaagtttcgtcgtcgtcagacaagaggcgaagttgacaactttactctggcatataaatactgcctatgccagcactccagcaggaagtcgaaggcgaggctgctatcaggagccatgcagttgcgtcgagagatggaagcccacgcatagaagcctcgactcgaacttcttggcgtttcgagtggcagggcattcaacagctacacgctgatgaaagacgcttcatcatgcgtgacacacgaccgtacttatctcgcgctgtggtagttgcacgttgaggccatcaagagccaacatgtctctgatcatgaaggttcacccaagacgtttatagccgctagctatgccctccagagtccctgaccccgtggggtgtacagtgaggagacgccttagagcccggtatcctaatgcgtgttcagaaactggtcgcgaagggtagcagatgatttgatgaaaacgagacaaagagcgttgtaccaggtacttacctcatcgtacgtaacagtagcctggtcctattcccaagctcaggaaacgtgataggccgccgcgaagagctcgtgcccctgaggcattttac

SEQ ID NO: 580723 - DNA, 453 bp, Homo sapiens
  misc_feature (120)..(120): n is a, c, g, or t
  misc_feature (134)..(134): n is a, c, g, or t
  misc_feature (153)..(153): n is a, c, g, or t
  misc_feature (160)..(161): n is a, c, g, or t
  misc_feature (182)..(182): n is a, c, g, or t
  misc_feature (232)..(232): n is a, c, g, or t
  misc_feature (249)..(249): n is a, c, g, or t
  misc_feature (265)..(265): n is a, c, g, or t
  misc_feature (333)..(333): n is a, c, g, or t
  misc_feature (380)..(380): n is a, c, g, or t
  misc_feature (386)..(386): n is a, c, g, or t
  misc_feature (428)..(428): n is a, c, g, or t
  misc_feature (445)..(445): n is a, c, g, or t
ttttttagagttaaagatagagctttatttccaactctgctctaccacactagcgtttcccaccaactctgggggcagagaccttcacaggcttcacaatcttttgtttaggtgctgccnttgtgggggccttngcagcaagcattgctgtcntctttgnngcctgcttagccttttttgcntccttggcagccctgatagcctggtctcggtgggctttctaacctctggnttctgattcctcttggncattatatcagcaagngatgcaccagtgatggctcgttggaatttgacttcacggcgggttctttccttttgaatttcttccgnattgccctttcttgggtttccttctgtagaggaaagtccagtttaantgccgnggattccttttggaaaggaatgctgaccaaattttgcattangaaactggaaaaccttnccgtcggc

SEQ ID NO: 580724 - DNA, 136 bp, Homo sapiens
gcggccgcctactactactactactactgctcgaattcaagcttctaacgatgtacggggacatgctgtaggaaaaatgatgcttatagacttgctcacagcaagattgccacaaaccttcagtttgtccaaaaaa

SEQ ID NO: 580725 - DNA, 397 bp, Homo sapiens
gagtcgagctcggtcccaagtttattagaaaaaaaagacttgaggtgtgagaatgtgatgagacttcagagatcaatagtccaactctcggccgggcgcagtggctcacgtctgtaatcccagcactttgggaggccaaggcaagtggatcacctgaggttaagagttcaagaccagcctggccaacatggcaaaaccccgtctctactaaaaatacaaaaattagctgggtgtggtggtgcgggcctgtattcccagtttctcaggaggctaaaggaggagaaccacttgaaccaggtaggcagaggttgcaatgagccgagatggcgccatcacactccagcctaggcaacagcagagtaagactctgtctcaaaaaaacaaaaacctttttata

SEQ ID NO: 580726 - DNA, 108 bp, Homo sapiens
aagaactctctttttcttatctcttcctccccagtttttggagtgacctccctgcttgtagctgcatctggtactcgtttaggtgacttccacagtgacgttcctcat

SEQ ID NO: 580727 - DNA, 131 bp, Homo sapiens
tattactggcattctcccactggctgtcatatggcactgtgaaaaggtcacattccaggctgacatactgaccacatttgtgtgggagatctcaacaaaagaatatttgtttctgggaggctgacatcccc

SEQ ID NO: 580728 - DNA, 338 bp, Homo sapiens
atagaatttgcttaggatgttgttttgcaaagtatttttatgaattacaagagagaaaaactggccgggagctgtgtctcatgcctgtaatcccagcattttgggatgccgaggctgatggatcacctgaggtcaggagattgagaccagcctggtcaacatggtaaaactccatctctactaaaaataccagtaaaagataaaaaattagccgggcctggtggcaggcacctgtaattccagctacttgcgaggctgaggcgggagaatcacttgaacccaggaggcagaggttgcagtgagctgagatcacactactgcactccagcctgggcaac

SEQ ID NO: 580729 - DNA, 692 bp, Homo sapiens
  misc_feature (473)..(473): n is a, c, g, or t
  misc_feature (477)..(477): n is a, c, g, or t
tactcaccagctcaaaacctgactcatctcccgtcaccccacccacagacccagccgatgactcctcttcctttgaccccgtggattttctccctcctcgacagcatcatgatcctccaccagagcatcatgatcctccaccgtatgtccctgctccggctctacccctctcccccactctctccaaccaacccacttctgactctgagacctctctgcctcctcccctcacccgctctcgggcccaatgtgctcagcaaccagctcccttgcttcctctccgggaagtagcgggagttgaggggatcgtccatgtccacgtccctttctccttctacgatctcttacagattgaagaacgtctcgggtccttctcctccgatcctgatacttacatcaaagaatttaaatatcttactcaatcttatgaactcacttggcatgatctctactttatcctctcttctaccctncttncagaagagaaggaaagagtgtggctcgcagcacaggcatatgccgacgaccttcatcagcaggatcctactaagcccgtaggagctgctgctgatccctgggaagagccttcctgggaataccaacccacagaacctggccaagtgtactgtagccatatgattacttgcctcattgcaggccttaacaaagctgcccataggctgtaaattttg

SEQ ID NO: 580730 - DNA, 146 bp, Homo sapiens
  misc_feature (74)..(74): n is a, c, g, or t
gctttgggtcctcctgccctcctcacgcatgtcaattttggcaatcggaatcaactcaaccctggcaccaatantggaggccaagccccaccctaactacacacggcgtttttcttccgcccttggcaagcggggcgtttacaatc

SEQ ID NO: 580731 - DNA, 85 bp, Homo sapiens
ggggaagggagaaggatgacaagagggtagaaggggggaaaaaaaaaggaggggggctaaggaagaaaagaaatagagagagatt

SEQ ID NO: 580732 - DNA, 1322 bp, Homo sapiens
gtaccgtacctcatccctatgctctaacatcacagagaataggcgacaactgctgattgggaactgcagacaaacttgccgagacggagcaacgccctgtcgggaatgccgattagagctgcctgtggtcctttccttacggtccatgactttgctacgactagtatgtgtgccacacagacgtagtcctctcgtacccatatcatccatcgacaggagatggtacaagacgtctggccaatatgactaatccatgatttactacttagcgtagtgatctcagcgttgcctcggctgctctacgacagcggaacaaaggtgttgaatcgaacgactctggaggcgtgccctatgttccatgacgctgagccagagacctccaacgcgttctcgtagttcgaatagaaggcgtaccaagcaatgaaggtgactagctggggtggtgcgacgtgacacgcgagcacatcgaagcaaggttccaacccccaagtgatagctcgaccctggacttgctagtcgtggggagtccctaaccagcccttgggggcaccgagaagcattctacggcgcgagtttcgtaaacgcataaacctcacccaggctttccattgtaggttacccgtcgtcccccgactttcctcgccgttgggtttggcggtggcgtccccgctggcacttcggctccacgccattgtgcgccgaacttgtcactgctgcttccaacccattgttttaggatgcggtaggttcgtccgttggctttcccatccttgtggggggggacccccctttgggtgcacgttaagctgaggagaggccaagggtgcgccaacagtgcgttcgcaccgcgcgtttggtgcccctttctatccccggcttggaagaggaagtccacaggtgcagtacaatggaacaccttaggttctgttcgccgaccatcttgcacatctggacgaacgcccccactactgtgctttggcccccaagaaggacaaccgatactccttaggacgccatacggcggaccccattttgccgtctcgcggttaccccacgagttcggatcgccaatggttggaacccgggtggtttgccacttgccgttgcggaggacccccatcgagtggataccgtccatctcgcctgggttgtattggccctcccggatccccttgtgtcccggtccaatgggcggcctcgcgcatttccccgtgcggccattccccgttcgggcgccattgcggccctatccctttagcccggccgatgcaaggagttctgggcgtcggtaacgcctttgtcccctttggtgggacaccgcc

SEQ ID NO: 580733 - DNA, 380 bp, Homo sapiens
  misc_feature (295)..(295): n is a, c, g, or t
cacccattgccgttttaataatctgataacccagctcattgataaacccgatatcttcagcaatggtaatgaacttcagcggtgaaatgatcccccgctccgcagacacccaacggcacaacgcctccgcgcccagaatggcgggtgttaatatcaacgatcggttgatagacgaggaatagttcgccaatttccattgcatggcgaatattacgcgcaatccagatattctcttctatttcgttgagtttcgcgtcatcacagaaaataaactctgagaacatatggtcacggntactggaaatcgccagtttcagttttttctgcgtaactccaggggttttccccctggcaaaggtttcacaattggcaggcttttt

SEQ ID NO: 580734 - DNA, 123 bp, Homo sapiens
tcaagtaaccccctttctctcgctagtcctttctactaaccggatcctcccaaatggcacgtactaaaagtcggtttacccatgaagtcctctatttcctcattacgaatatttgccttcccg

SEQ ID NO: 580735 - DNA, 128 bp, Homo sapiens
gactctcgaggatctccaacggaactttatccagtgcaaacattggatgtcaagagtggcctgtggtacttggagacaaggaatatcaagtaattgacgtgttacttgtcttgtcagattttaagaat

SEQ ID NO: 580736 - DNA, 254 bp, Homo sapiens
ccctgatatcccagcttacgaggcacctgacattatgtgaaaccccatctctatttaaaaaaaaaaaaaaaaattagccaggtgtggtggcgtgtgcctgtagtcccagctacttgggagtctgagacaggagaatcgcttgaacccaagaaggcagaggttgcagtgagccggagatcacaccacttgtactctaagcctgggcacacagggataagcactccatctcacaaaacaataaaaaagcataattc

SEQ ID NO: 580737 - DNA, 497 bp, Homo sapiens
caacgatggtcctcagctggtagccccaaaatagtgggtagggacttgtggtcatttagttccagtatttaagacaaatttgtgtttgagagaggatttcgctactgttgcgccaggtctggagtacaatggtgtgatcatggctcactgcagtctcaaatgcctgggctcaagccattctcctgctacagcctcctgagtagctgagactgccgggacataccaccacgatccagccgattttaaaattattaaaaaatttttactttggtttatttcttgctggagacagagtctcgcttggtcatccaggctggggtgcagggggacaatcatggctcagtgcagccttgaactcctgggttcaagtgatccctccacctcaggctgcccaagtagctgggactacaggtgtatgctattacagctggctacttgaggtatatgtcgtagagactgggttttgacatgtggcccaggctggtttggaactccca

SEQ ID NO: 580738 - DNA, 148 bp, Homo sapiens
agtctacgcgtgaggacaagatgctgtggcttcactgtgatctgaggtacaaacaaactactgtggtgggtaatggtcgagctccgggtcagtcccatgtgcagttgtccaatggcacttgacctcaatctactcagtgtcaaacgga

SEQ ID NO: 580739 - DNA, 191 bp, Homo sapiens
ttagataaatacaaaattatcaatatagaggcgcataaaaaacgtgcccattatacatgctgaccgataaggcaaattataaccaaatagcatgtagtataagcagccctcatattataataaaacaaggagtctgcctcatccatttccaaaagataaatttccgactgatcgggataaccaaacttaca

SEQ ID NO: 580740 - DNA, 1151 bp, Homo sapiens
cttttttctttgcggaatcaccatggcggctgagtaccctgtgacactgtatcctgcaaaacttgggagtggcctttcaaggctctctatcgtctgctcagtcacagcggggctcagagtccgcagtgctctccgctaccaccccacttccatatttggccaaaccaaccgcatcccctggaatttctaccggcaaatttcctgaccgggccaaggtcccagcagtttagagcggtgatggatggcgattctcgtgtgtttgagagtcaacgccattgcctacttatgtgtagcaatgaggaagctcgcgggagacaggtactcccatgtaggtcaaggcaggccacaaggatggttgcaagtcgagagttgatggcttttggacttggattttcctcggactcactatatgtgaccactcacaaggacgcaaggttaacgcttggagggatagtgtacaccgcaacggcttcgcggtgcattctattggcaactccatcgaactaaataacctaagtgcctccgagcttgggagcacacttgggccaacaggcaacggcaacacggttggcacggtcggacactgtcttagagggggctctgccttgcgggattggcttttcacctcttgcagattggacgcggcatggggcacatttgatcgtgcgggtcggagggccgtaaaccaggatgttggagcatttggggcttgggaccattcagccagtggttccgcttcgttagcgagccctcggtggtttgggatagcggcttcattatttacacggccaagtggtatcccctaaagaaaagccccctgtaccatttatgccctaggcccactgtgggcctttcttttacacccaaaaattgaggccgaaaactccggaacgttggggttttccccgttccagacccttgagccagttttaagaatccgcaaaggacaccagccgcaaagtatgttagccacccggtgtgaacattggattactttgggggagacccgacactaaggcttgaacaacaaccgtgggttgctttggcacgacacacgcgcactctcgcgcccgccaacggattcttggtgacttgggccctagagacaacgaaacaggttatatgtgggcacaggaaagggaaaaccacgc

SEQ ID NO: 580741 - DNA, 140 bp, Homo sapiens
cctaccccagacagaaatactatatttcttctctgggatcttatcttatcagtgaatcttatgctggtttagtagaagtcctaatattcatgtggatcactttgtacttgtctgttttctttggacgtggggtaggaggt

SEQ ID NO: 580742 - DNA, 147 bp, Homo sapiens
agtcgaaacctgtacaacaaggttgagatggggcaaaagagagccagtgaagatacaacttcagtgttcatcatccaagaaatcttcagtcaggaccaaaagagagatgccaggcatgatttataatccctccctggtggaaaagta

SEQ ID NO: 580743 - DNA, 111 bp, Homo sapiens
tctctacgtgactacgtgcacgatacgacacttacgacactttgtagaacgactgactaacgatgtacgacggtgacacggttacacttgcgtttgactactttgctacgt

SEQ ID NO: 580744 - DNA, 1948 bp, Homo sapiens
ggacgagagcacaaggagatccaccagcagaggcaggaggacgaggaggataaacccaggcaggtggaggtgcatcaagagcccggggcagcggtgcccagaggccaggaggcccctgaaggcaaggccagggagacggtggagaatctgcctcccctgcctttggaccctgtcctcagagctcctgggggccgccctgctccatcccaggaccttaaccagcgctccctggagcactctgaggggcctgtgggcagagaccctgctggccctcctgacggcggccctgacacagagcctcgggcagcccagggcaagctgagagatggccagaaggatgccgcccccagggcagctggcactgtgaaggagctctgaggacagggtcctcagagctcctgggggccgccctgctccatcccaggaccttaaccagcgctccctggagcactctgaggggcctgtgggcagagaccctgctggccctcctgacggcggccctgacacagagcctcgggcagcccagggcaagctgagagatggccagaaggatgccgcccccagggcagctggcactgtgaaggagctccccaagggcccggagcaggtgcccgtgccagaccccgccagggaagccgggggcccagaggagcgcctcgcagaggaattccctgggcaaagtcaggacgttactggcggttcccaagacaggaaaaaacctgggaaggaggtggcagccactggcaccagcattctgaaggaagccaactggctcgtggcagggccaggagcagagacgggggaccctcgcatgaagcccaagcaagtgagccgagacctgggccttgcagcggacctgcccggtggggcggaaggagcagctgcacagccccaggctgtgttacgccagccggaactgcgggtcatctctgatggcgagcagggtggacagcagggccaccggctggaccatggcggtcacctggagatgagaaaggcccgcgggggggaccatgtgcctgtgtcccacgagcagccgagaggcggggaggacgctgctgtccaggagcccaggcagaggccagagccagagctggggctcaaacgagctgtcccggggggccagaggccggacaatgccaagcccaaccgggacctgaaactgcaggctggctccgacctccggaggcgacggcgggaccttggccctcatgcagagggtcagctggccccgagggatggggtcattggccttaaccccctgcctgatgtccaggtgaacgacctccgtggcgccctggatgcccagctccgccaggctgcggggggagctctgcaggtggtccacagccggcagcttagacaggcgcctgggcctccagaggagtcctagcacctgctggccatgagggccacgccagccactgccctcctcggccagcagcaggtctgtctcagccgcatcccagccaaactctggaggtcacactcgcctctccccagggtttcatgtctgaggccctcaccaagtgtgagtgacagtataaaagattcactgtggcatcgtttccagaatgttcttgctgtcgttctgttgcagctcttagtctgaggtcctctgacctctagactctgagctcactccagcctgtgaggagaaacggcctccgctgcgagctggctggtgcactcccaggctcaggctggggagctgctgcgtctgtggtcaggcctcctgctcctgccagggagcacgcgtggtcttcgggttgagctcgcccgtgcgtggaggtgcgcatggctgctcatggtcccaacacaggctactgtgagagccagcatccaaccccacgcttgcagtgactcagaatgataattattatgactgtttatcgatgcttcccccagtgtggtagaaagtcttgaataaacacttttgccttcaccc

SEQ ID NO: 580745 - DNA, 329 bp, Homo sapiens
ctcatttgagttccgtcagtcattagcgacactgtaaatggaagaccagccactggctctgaaaaaaataaacctcgcagttgtggattccagcattcatggcttttacgtgtttgcatagagaggggtggcccgccagtcccggggcagcctggggccagggtcggtgggaggaaagcaaggctgtaaacactggagtctgtaccggctcccagtccgtcctcacaccatgttatgggagaagggtcacaaggtgtaactcaagcaacttaacacatgaaagtctaaagtccactcttgacatgtaagtctgtgcgtgcgttaactga

SEQ ID NO: 580746 - DNA, 164 bp, Homo sapiens
gcccgagggtcagccccctgggcagaagggtggccagtgggcccaggcccctgggaggggatattcccccccccattgtcaggcccctcaagctcctggagacaaccacgtggtcgcctgtactgcgctaactcctgattaatacaatggaagtttctgggcaa

SEQ ID NO: 580747 - DNA, 191 bp, Homo sapiens
cctgctgaagcttcccattacgaggagaaaaggcaccactgtgcccagccttccttgccctgacattgggactcttcccttggtacgaccacgtctgtgctcattctccttcccaccaacacccatccgtccttctcagacaaaccactcactgggtaccccacctcctctctcatatgcccatacacgcg

SEQ ID NO: 580748 - DNA, 123 bp, Homo sapiens
tatctgttcatctgcttttgcattttccactctatttcattgatctgtgtatgtcccccatgctgatgaatatatttgtcttgcataactactagctatatccataatgctttgaagatcagt

SEQ ID NO: 580749 - DNA, 308 bp, Homo sapiens
  misc_feature (9)..(10): n is a, c, g, or t
aaaaaaagnnagcgacccacaaataacaaatttggtgtagtctattaatgttgtgcattataaaggatgcacctctatgtttgagcagtttcttggttatcttttatcctcagcttgatatatcctgggacatctgaaaagagctgcttgcaccacactagcttgcaggcatattgtggcacttttatccctggattccctgactgttgtccgtatgacacagtcaactgtgagtgcttccatccctacgcaggtagtcttggcctatatatgaaatcttgctgtgcattgtgccaatgaatgaacca

SEQ ID NO: 580750 - DNA, 421 bp, Homo sapiens
attcacacgggtgctgcggagggggagttataagagatttttttgtacactggaaaaattagaatatggactgtggccagatgtggtggctcacacctgtaatcccaacactttgggaggcccaggcggggggatcacttgaggtcaggagttcgagaccagcctggccaacatggtgaaaccccatctttactaaaaatacaaaaaaaaattagccgggtgtggtggtgggcacctgcaaatttcagctacttgggacgctgaggcaggagagttgcttgcaaccggtaggcggaggttgcagtgagccaagatcgcgccactgcactccagcctgggtgaaagagcaagactccgtctcggggaaaaaaaaaaattttgaaatgcatatgggatataactgaataagtgtaaagttttt

SEQ ID NO: 580751 - DNA, 238 bp, Homo sapiens
ggccctgtttcaaaaaaataaaaaataaaaaataaatttcctataatcttcagatatattcattcctttacatattgtctgtggttgttttccccctttaggtcaaaagtaaccggcaaccttttcccagtatttacccctgttatagacatctttaaatatggtttacttttgcctgtttttggactttataaaaatgaagtaataaagtattgtctgtcttgcattttttgctcca

SEQ ID NO: 580752 - DNA, 305 bp, Homo sapiens
  misc_feature (21)..(21): n is a, c, g, or t
ggggccaaagccccccttttntgcccccccccccggcctgtggggagcccctaaacccttccgggcctagacccccccctttgtgggatgggggccaaaccccccccccccccggggggttgtgagggctgagaagaaccatgtccaatgttttttatactccgatgggggggcggcccccatgaaatttggtctggatgaaagctcccccaaaatgggccgccctttgggttattgggcccgaaacctaaaatggttggtccgaaaagccttttttcccccccgaaatatggctttttttttga

SEQ ID NO: 580753 - DNA, 296 bp, Homo sapiens
gactgattaagagaacactagcatcaaaggcctggggaaagagtgggtatgaacaagagaaactccgagtacagagataaaatagtctggcaaattcaattaaataaactaggcccaaaatatttgtagaagtagtagggccaacgtagttgcgacattggtatacttaaggcttgtattagttcattcttgcatttctataaagaaatacctaagatggggtaatttataaagaaaagaggtttaattggctcatgtttctacaggctgtacaggaagcatgatgctggcattaa

SEQ ID NO: 580754 - DNA, 310 bp, Homo sapiens
ggtgtgggagcaggatattccctcgcggtgccccggactggaggctatgtggggggggactttcgtacacgagtagatccgaggctcgaagggaggtgaggtgcccgtagggggatgggggcgataggaatgtttagcgggctgggcgggcggttgtgattcctccctagccgtacccaggtcgctcccgattgtgggcggggtctgaatatagaggggcgattcgggaatagcatgggtatggtgggggctggctggtttggcggctgaggttatggtagggcgatttgcagtgatgggtcatgcagca

SEQ ID NO: 580755 - DNA, 272 bp, Homo sapiens
gtctgaagataaggctttaactgctgtcattgtttaagatttagcaagacttggtgttctttttatatccaggagtcaacgccctgtaacttaaaggcacaaggactttaaaagcaagaaagttacgtggatatagtaaccttgatctaaaagaaaaatctaacctcagtcttcttctaagcaaattaaaacctaataccaacggcataggacttatcttgataaaatgtaaaactcgtcagaccagcttaccaaaacgcaacaaaaaaaaa

SEQ ID NO: 580756 - DNA, 427 bp, Homo sapiens
  misc_feature (52)..(52): n is a, c, g, or t
  misc_feature (61)..(62): n is a, c, g, or t
  misc_feature (69)..(70): n is a, c, g, or t
  misc_feature (80)..(80): n is a, c, g, or t
  misc_feature (90)..(90): n is a, c, g, or t
  misc_feature (92)..(92): n is a, c, g, or t
  misc_feature (95)..(95): n is a, c, g, or t
  misc_feature (98)..(98): n is a, c, g, or t
  misc_feature (112)..(112): n is a, c, g, or t
  misc_feature (114)..(114): n is a, c, g, or t
  misc_feature (116)..(116): n is a, c, g, or t
  misc_feature (118)..(118): n is a, c, g, or t
  misc_feature (120)..(120): n is a, c, g, or t
  misc_feature (133)..(134): n is a, c, g, or t
  misc_feature (138)..(138): n is a, c, g, or t
  misc_feature (142)..(142): n is a, c, g, or t
  misc_feature (151)..(151): n is a, c, g, or t
  misc_feature (159)..(159): n is a, c, g, or t
  misc_feature (161)..(161): n is a, c, g, or t
  misc_feature (163)..(163): n is a, c, g, or t
  misc_feature (184)..(184): n is a, c, g, or t
  misc_feature (198)..(198): n is a, c, g, or t
  misc_feature (203)..(203): n is a, c, g, or t
  misc_feature (213)..(213): n is a, c, g, or t
  misc_feature (235)..(235): n is a, c, g, or t
  misc_feature (250)..(250): n is a, c, g, or t
  misc_feature (259)..(259): n is a, c, g, or t
  misc_feature (269)..(269): n is a, c, g, or t
  misc_feature (289)..(289): n is a, c, g, or t
  misc_feature (299)..(299): n is a, c, g, or t
  misc_feature (344)..(345): n is a, c, g, or t
  misc_feature (370)..(370): n is a, c, g, or t
  misc_feature (403)..(403): n is a, c, g, or t
gttaatattcgccttggacggccccgggaataaggcttgcggcttggtcagncctttccanncccaaannaagcatgggnagttgtcccncnggntgnaagcctggcagtgncncnantnagcccaagtggannacancaangaatatttntccaaacncnantaggctggctaacggatagtnagcttgtgcccctncctangtgcctgtgntgggtgtccacctgtgcccccncctgggtgccctatnttgacccangaaaggccanacctgcccctccaaactccncagtatgggnccctggaggggtaggccaaggccttttcatgcctccccctaaaanntgaatagtgacgccctcccccaagnccacccaaccgcacacaggcctaaaggtaaccnataaagtattagggaaaggtgtga

SEQ ID NO: 580757 - DNA, 1048 bp, Homo sapiens
agcggctctatgtagacaggaactgaatgtatcaacttcgtgttgtatcccaatcacctagcacaaaggaaaaccactatcctacttagagaaggcgtttctgaatttcttaaaactgtggtcactaactgcatactttttgccaaacttttcttttgtcaggctaacactagtcacaggagcagctaacgatcaaagatgctaagatgttcctgatatccactagctgacactgaactaagctaaccaacggtctccactgagcacctgcatttaccaccataaaagctgacttgcggctacttgcgctagcaactacagctctggttaagtacatgtcaatcacacacactgataccacgtaactgcctaactggcctggcaccctcttgctcgcgggtccacgcaaggtgccatgctagcgaaacactagcctctagcacgcaactgacgcacacgactcccgcctgcataccctctctctcgctcgactctgctccgctctctactccgctacccacgcaacactaacatactccacttccctgttcaccgtaggaaaactactgcgcgaagccctaacaactctgctaccaaaaaaccaatcccttgcatctggctaaccgaacaacacgctgcccctcttactggctctacgactaccaagtaactcctgagcgactctcaatccctcctggcataccccttctgatactcctcttacaacacactgctcaactactctgaacctcgtgatgaaactttcccacgcctacgctcgcgccctacctccccccttaaacaattcccactctccactcccccactccccacctcccgacatctcccacccacgcacgcaaccgaggacacttcatcgcactcacatgaatccgccacaagcgccctggcaaaccctggacacacccgagccacccgcacctcactccgcgcctccacccttggcacaacccccacacacgaccacgtccccacgcgggcacccaacacacccgaacaaccccatacacaggacaccatccacacc

SEQ ID NO: 580758 - DNA, 434 bp, Homo sapiens
tggaccaacccgggttttggggtgcacagcgccaggttaacgtttaagcctgcccccctgagcccaggaaccgggaggcctgcgggtttacccaaaatccgatcaagcccctgtcctcatgccaccggctttgggtggggttggtttaaaacccgcacccggcagttctttgttaaaaatttgagggaccccccagtcctggggggtccccgccggcagccttttccaagccctgggtccagcgagggtcccagcccaccctgcaaaaacggagttgggctccaactgggggtggcatggactttcctttcaaagattcggtttttaaaaaaaggcatccctaatgggttcttttttttttccaatgatttggaaaaacccttttatggcgggaaacttttttggccacccccccaataaaccttttgttttta

SEQ ID NO: 580759 - DNA, 244 bp, Homo sapiens
tattaccagatcagttgcactctttcccgattctcccagttactgtggcactctaccacggttcccgcagtgctgatgggtactctggctcaaggcccaccggaagtcatccatagtaactgctagagagtactgacctcgggatcaatggtctcatcctctaggtcaaagagatccatcttcttgcggatggcttgcaaagcagcctctgagcacagggctgctaagtcagcacccacatgcc

SEQ ID NO: 580760 - DNA, 387 bp, Homo sapiens
gtgtattgagtggcatgtgatctagcaattccacttctggatctatatcccaaagaagtgaaagcaaggtcttgaagagatattgcatgtgcacattcatagtagcattattcacaatagatgaaaggtggaaaccacccataatgtccaagaaatggataaactggataaataaatgtgtggtacattcatacaactggaatatttatctattcaccctataaaaaggaaattctggctgggcaaggtggctcatgcctgtaacaccagcactttgggaggccaaggcagaccagatcacctgaggtcaggagttcgagaccagcctggccaacatggtaaaaccccatctctactgaacataccaaaactacgctgggcatggcg

SEQ ID NO: 580761 - DNA, 824 bp, Homo sapiens
  misc_feature (68)..(68): n is a, c, g, or t
  misc_feature (71)..(71): n is a, c, g, or t
  misc_feature (80)..(80): n is a, c, g, or t
  misc_feature (99)..(99): n is a, c, g, or t
  misc_feature (102)..(102): n is a, c, g, or t
  misc_feature (251)..(251): n is a, c, g, or t
  misc_feature (624)..(624): n is a, c, g, or t
tgctttattggatttggaggagatgtgatcaggcggcaagtcaagggtggcgccgaatggggtatcanctnagtttgtangggggggggggaaaaccanaanaataacatccattgtgatacagctccaaacaacttcagatgagtttttacaagttacacagattgatactgtgttggttacaattgcctattacaacttgctatagaaagtggggacagatgagtctggactgggggggggaactacantgagggatcctcaaaagaaggtttgggatgttttaactggagttccagtattatatgatcactatcgatttcctggagagggttggaatctgaattctttatgtatattcctagctatatttcatacaaaggggtttaagagggggagaggaattaaacacctttactcttaggagtatagattcgggagccttcagtgaatattggtttttttccctttggaatggcaataaaagtgtatccatggggtgagagaaaaaaaaatcggggctcgtgtggcgctcaggcggtgggaagctctgggggcggtttccctttagggggggggtaatttcatgatccctcggtcacctgactcggcttggctcgggcngttcgggtggggggaagggggggtcaggtcacttgaagggggggggtacgggtgtgccacaaaagcgggggattacgcgggagaagacatgtgagcagaagggcccgcgaaggggcaggagccgggcgagggggcgcgtgcgtggggggttgtcctaatggtgccgccctcctggcgaggcataaaaaagatgtgaacgt

SEQ ID NO: 580762 - DNA, 120 bp, Homo sapiens
gtaatacggcgctatttcatgaagcttacttcatcacagtcaaccaggcactgtaactggtgggtaacaaacagaactgtcttggacttgagatgtatccggatagcactatatgcagat

SEQ ID NO: 580763 - DNA, 1153 bp, Homo sapiens
  misc_feature (49)..(49): n is a, c, g, or t
  misc_feature (109)..(109): n is a, c, g, or t
  misc_feature (1053)..(1053): n is a, c, g, or t
tccttttgggtgccgctgccgtcgcgacccagggaagtgggcagcagantgtggggagtgtctgcccttcgaggaagctgggaaatgagggtggtcccggcgccgtggncgtggagcgccgtgccgtccctgcagtgacaccgaggtgctcctagccgtctgcaccagcgacttcgccgttcgaggctccatccagcaagttacccacgagcctgagcggcaggactcagccatccacctgcgcgtgagcagactctatcggcagaaaagcagggtcttcgagccggtgcccgagggtgacggccactggcaggggcgcgtcaggacgctgctggagtgtggcgtgcggccggggcatggcgacttcctcttcactggccccacgcttcaaggacttccagaggatgtacagggatgcccaggagagggggctgaacccttgtgaggttggcacggactgactccgtgggccgctgcccttcctctcctgatgagtcacaggctgcggtgggcgctgcggtcctggtggggccgtgcggtgagggccgcgcgctgggagccgcatgccctgggcccaggcctgaccctggtaccgaagctgtggacgttctcgccacactcaaccccatgagcttccagccaaggatgccctggccgattggaaatgctgtaaaatgcaaactaagttattatatttttttttggtaaaaaagaaatgtccataggaaacaaattcccgtgtcttaaaacgccttggtgtgccgtctgatactgttctctaaagacgttaggagtcacggcatctggcctgcggttgggtgaagcactggccgttgggcacagtggatgtgtgaaaaggtgccattcagagttgttattctcatgacggaagttttggagccaaataatacgttttttattttcattttatttttaaaggatgagctttggtccttttcaggccgccggttgtttccgttcccgagaataaagacgaggatccgaccagccagaagccggagtctgtctttcgccaggtccggtgcccacgcnccgtgttcagggcctcgctggacgtaccccaggcgccacctgcctcggcagacacgcttgtcccccggcgacttccctcagccctctgctgcatttccac

SEQ ID NO: 580764 - DNA, 1740 bp, Homo sapiens
  misc_feature (1640)..(1640): n is a, c, g, or t
gacgtgaccacccggactcgaagcccgccccgcccccgcccggctcgccggctccggggtctgctccgggggtcgcggacgcggggccgggcggcggagccggcgccagagcatgcggggcgcggcgcgggcggcatgggggcgcgcggggcagccgtggccgcgaccccccgccccgggcccgcccccgccgccgctcccgctgctgctcctgctcctggccgggctgctgggcggcgcgggcgcgcagtactccagcgaccggtgcagctggaaggggagcgggctgacgcacgaggcacacaggaaggaggtggagcaggtgtatctgcgctgtgcggcgggtgccgtggagtggatgtacccaacaggtgctctcatcgttaacctgcggcccaacaccttctcgcctgcccggcacctgaccgtgtgcatcaggtccttcacggactcctcgggggccaatatttatttggaaaaaactggagaactgagactgctggtaccggacggggacggcaggcccggccgggtgcagtgttttggcctggagcagggcggcctgttcgtggaggccacgccgcagcaggatatcggccggaggaccacaggcttccagtacgagctggttaggaggcacagggcgtcggacctgcacgagctgtctgcgccgtgccgtccctgcagtgacaccgaggtgctcctagccgtctgcaccagcgacttcgccgttcgaggctccatccagcaagttacccacgagcctgagcggcaggactcagccatccacctgcgcgtgagcagactctatcggcagaaaagcagggtcttcgagccggtgcccgagggtgacggccactggcaggggcgcgtcaggacgctgctggagtgtggcgtgcggccggggcatggcgacttcctcttcactggccacatgcacttcggggaggcgcggctcggctgtgccccacgcttcaaggacttccagaggatgtacagggatgcccaggagagggggctgaacccttgtgaggttggcacggactgactccgtgggccgctgcccttcctctcctgatgagtcacaggctgcggtgggcgctgcggtcctggtggggccgtgcggtgagggccgcgcgctgggagccgcatgccctgggcccaggcctgaccctggtaccgaagctgtggacgttctcgccacactcaaccccatgagcttccagccaaggatgccctggccgattggaaatgctgtaaaatgcaaactaagttattatatttttttttggtaaaaaagaaatgtccataggaaacaaattcccgtgtcttaaaacgccttggtgtgccgtctgatactgttctctaaagacgttaggagtcacggcatctggcctgcggttgggtgaagcactggccgttgggcacagtggatgtgtgaaaaggtgccattcagagttgttattctcatgacggaagttttggagccaaataatacgttttttattttcattttatttttaaaggatgagctttggtccttttcaggccgccggttgtttccgttcccgagaataaagacgaggatccgaccagccagaagccggagtctgtctttcgccaggtccggtgcccacgcnccgtgttcagggcctcgctggacgtaccccaggcgccacctgcctcggcagacacgcttgtcccccggcgacttccctcagccctctgctgcatttccac

SEQ ID NO: 580765 - DNA, 1854 bp, Homo sapiens
gacgtgaccacccggactcgaagcccgccccgcccccgcccggctcgccggctccggggtctgctccgggggtcgcggacgcggggccgggcggcggagccggcgccagagcatgcggggcgcggcgcgggcggcatgggggcgcgcggggcagccgtggccgcgaccccccgccccgggcccgcccccgccgccgctcccgctgctgctcctgctcctggccgggctgctgggcggcgcgggcgcgcagtactccagcgaccggtgcagctggaaggggagcgggctgacgcacgaggcacacaggaaggaggtggagcaggtgtatctgcgctgtgcggcgggtgccgtggagtggatgtacccaacaggtgctctcatcgttaacctgcggcccaacaccttctcgcctgcccggcacctgaccgtgtgcatcaggtccttcacggactcctcgggggccaatatttatttggaaaaaactggagaactgagactgctggtaccggacggggacggcaggcccggccgggtgcagtgttttggcctggagcagggcggcctgttcgtggaggccacgccgcagcaggatatcggccggaggaccacaggcttccagtacgagctggttaggaggcacagggcgtcggacctgcacgagctgtctgcgccgtgccgtccctgcagtgacaccgaggtgctcctagccgtctgcaccagcgacttcgccgttcgaggctccatccagcaagttacccacgagcctgagcggcaggactcagccatccacctgcgcgtgagcagactctatcggcagaaaagcagggtcttcgagccggtgcccgagggtgacggccactggcaggggcgcgtcaggacgctgctggagtgtggcgtgcggccggggcatggcgacttcctcttcactggccacatgcacttcggggaggcgcggctcggctgtgccccacgcttcaaggacttccagaggatgtacagggatgcccaggagagggggctgaacccttgtgaggttggcacggactgactccgtgggccgctgcccttcctctcctgatgagtcacaggctgcggtgggcgctgcggtcctggtggggccgtgcggtgagggccgcgcgctgggagccgcatgccctgggcccaggcctgaccctggtaccgaagctgtggacgttctcgccacactcaaccccatgagcttccagccaaggatgccctggccgattggaaatgctgtaaaatgcaaactaagttattatatttttttttggtaaaaaagaaatgtccataggaaacaaaaaaaaaaaaaaaaaaaaaaaaaaaaaaaaaaaaaaaaaaaaaaaaaaaaaaaaaaaaaaaaaaaaaagaaaaaaaagaaaaaaaaagaaacaacgaacacataaagacgcaacgaaaaaccacacagagagaacagaagcggaggcgagagggcgacgccacatgacagcacacgcggaccgacggagagcacaacggagagcacaggacacagcgagagcggcagacagaagaagcatagcgacagccaggtaggacggcgagggcaccaacagaggggggcagggaggcgcgcaagcaagacaaagaacagagacgccacggaggagagaggcacacaccccagagacaaaggaggcagaaagggacgggacagggagagcagaccaaccacgcgggtggaggaaagggagagagaagaagaggaccgaggaaacagaggaggaagaaagaagacggcacaaaaagcgccgagcggcagagaggggaaagcaaatagcacaagccagaggaaagccaccagccaaagcgcac

SEQ ID NO: 580766 - DNA, 1705 bp, Homo sapiens
  misc_feature (1605)..(1605): n is a, c, g, or t
gacgtgaccacccggactcgaagcccgccccgcccccgcccggctcgccggctccggggtctgctccgggggtcgcggacgcggggccgggcggcggagccggcgccagagcatgcggggcgcggcgcgggcggcatgggggcgcgcggggcagccgtggccgcgaccccccgccccgggcccgcccccgccgccgctcccgctgctgctcctgctcctggccgggctgctgggcggcgcgggcgcgcagtactccagcgaccggtgcagctggaaggggagcgggctgacgcacgaggcacacaggaaggaggtggagcaggtgtatctgcgctgtgcggcgggtgccgtggagtggatgtacccaacaggtgctctcatcgttaacctgcggcccaacaccttctcgcctgcccggcacctgaccgtgtgcatcaggtccttcacggactcctcgggggccaatatttatttggaaaaaactggagaactgagactgctggtaccggacggggacggcaggcccggccgggtgcagtgttttggcctggagcagggcggcctgttcgtggaggccacgccgcagcaggatatcggccggaggaccacaggcttccagtacgagctggttaggaggcacagggcgtcggacctgcacgagctgtctgcgccgtgccgtccctgcagtgacaccgaggtgctcctagccgtctgcaccagcgacttcgccgttcgaggctccatccagcaagttacccacgagcctgagcggcaggactcagccatccacctgcgcgtgagcagactctatcggcagaaaagcagggtcttcgagccggtgcccgagggtgacggccactggcaggggcgcgtcaggacgctgctggagtgtggcgtgcggccggggcatggcgacttcctcttcactggccccacgcttcaaggacttccagaggatgtacagggatgcccaggagagggggctgaacccttgtgaggttggcacggactgactccgtgggccgctgcccttcctctcctgatgagtcacaggctgcggtgggcgctgcggtcctggtggggccgtgcggtgagggccgcgcgctgggagccgcatgccctgggcccaggcctgaccctggtaccgaagctgtggacgttctcgccacactcaaccccatgagcttccagccaaggatgccctggccgattggaaatgctgtaaaatgcaaactaagttattatatttttttttggtaaaaaagaaatgtccataggaaacaaattcccgtgtcttaaaacgccttggtgtgccgtctgatactgttctctaaagacgttaggagtcacggcatctggcctgcggttgggtgaagcactggccgttgggcacagtggatgtgtgaaaaggtgccattcagagttgttattctcatgacggaagttttggagccaaataatacgttttttattttcattttatttttaaaggatgagctttggtccttttcaggccgccggttgtttccgttcccgagaataaagacgaggatccgaccagccagaagccggagtctgtctttcgccaggtccggtgcccacgcnccgtgttcagggcctcgctggacgtaccccaggcgccacctgcctcggcagacacgcttgtcccccggcgacttccctcagccctctgctgcatttccac

SEQ ID NO: 580767 - DNA, 396 bp, Homo sapiens
  misc_feature (5)..(5): n is a, c, g, or t
ctgcnaatgaacctattcccaaataggcccccattttgaggtccccggggaacatgaactttatttattattattatttgagacagtctcactctgtcaccctagctggagtgcagtggtgccatctcagcttactgcaactttggcctcctgggttcaagcaattctcctgcctcagcttcccgagtagctgggattacaggcatgtgtcactatgcctggctaatttttgtgtttttattagagacagggtttcaccatgttggccaggctggtctcgaactcctgacctcatgtgtgatcctcccacctcggcatcccaaagtgctgggattacaggcatgagccaccgcacctggctgggacatgaactttagggcacacactatttaaccc

SEQ ID NO: 580768 - DNA, 899 bp, Homo sapiens
agaggaaggtgctctcagactgatagattagaggagacagactaactcgtaatccttgtgggacttgaacgagagtggctaggggaagggctgttaaaagataagggaccagtatagaaaatccattctaaataggtagtctcttgtaggaggaacaattcaactgtcttgaggggataaattagagggtaccaagtttatgttctggaatgtacccttggggatgggcgctgtccatagtgtataggtaccgagaggagtgaataaggtggtgctctcgagtcaggctgcttattcccagagagagctgggtgccggaggggcatcgtggtctgtgcatattcagggaaatgaattaggttctcccaggtgctctgttgatgaaggcatggaagcggaagctatcatttgaagaacacaaggcaaacacagttggaacgagttcgttgggatatgaaccgtgacaatagatctaaagagatgccgtggttaaacagtttgcctttatagtaccagttcacgaataaatatggttactttagagaaatcctgtgtaactgtgtgagcatcccacagaaagcaagcaaaatttatttcctatcaaaaactgaggggataaataaccgaagtccagagttcacagtccgttctcaataatgaagcgttccgaaaagcaaaaagcaggggaccattatgagcacagaagaaaggcaaaggttgtgtcagtgatcttataaatttagacatggtaagatcctgggtttaggaaaaaataaccgaggggggaccagggagggaaatggtgagaagattggcatggacggtaaaaagggttggggtcttggggtatatgagaaagcgataggtgttaagggaaagtgggggaaaaggggatttga

SEQ ID NO: 580769 - DNA, 185 bp, Homo sapiens
tcatgtggcgagtgggtgcttaagggtgtttggcttactggtataattgtctgggtcgcctaggacgtctgttagagaatagtgttactgtccttaaggcgagaacgacgagaagttacgccgagggttgtctattgatttgtagtagtcactgtggtggacactgtgattcttctcgtgaatgg

SEQ ID NO: 580770 - DNA, 326 bp, Homo sapiens
cgttctgagatggagtctagcccttgtcgcccaggctggagtgcaatggtgcgattctcagcctcacctgcaaccttccacctccccaggttcaagcgattctcctgcttcagcctcccaagtagcttgaattacaggtcatgtgccaccaatggccggcctaatttttgttatttttagtagtagtacagagttttcacccatgtttggtccaggtatggtcccaatctcttgtaccttgttgtatccggtcccgtccctttgtgcctccccaaaagttgtctggtacttacgagtgttgttgtagtgcacccctagtgtcacag

SEQ ID NO: 580771 - DNA, 875 bp, Homo sapiens
tccgtcatctaggactgcatgggctgaagcagaacttggagtatatatcctggagcatgtcagtcgttcaatagtatgtaaaatgacctcgcttaaagcctgctccagaatggtatctcttatagatggttcatgtcctgttgaggatttaggtctggagcacacaacgcttgtggcgattcctagccaagtgacgcgtgttagcgtatatgcctgaatcaaagtatgctgttgtgaaatgtactaagtctggagacctctacgtacatggcggcagataaagtagcatctgttgcgttctacgtttggaagacaactagtttgagactatttcaacactttcaggtgtagattaggaaaatggtacttgcagtcatccattaattccgtgataaagccgtctccatcttttaactgcaaatcagtgtgagcgatggcgaaaggaacgggactggtggcacacagcccgagctcatggtatggagagactacggtgtagcgtcgtcagacaagctgccatggattgtctagtggacgaagatggcgtttcacagatgttgcacggtcctgaagttcaaaattaaggctgtccttgaagagggaactgatgtggtataaagatgttcagactggaaaggaatttgtcggaagaggaggaattggggcataggtattcgttagtgatggggggcaaaggaaactgtgggtaaatagtggcaagaagggaggggttaaaagcattcgcggatttaagaatgccgtcaggaatgggaaaacaggggcaaattatcctgggtatggcggaggggatggtggaaatgttgggacagcggggaaagggggttctcagggcgaaaatgggggatgcacacacg

SEQ ID NO: 580772 - DNA, 86 bp, Homo sapiens
tttgcttttttaaaaaaaaaaatccccttccccgcttttttgtgccaccaccctttggcccttccaacccccccagggttttttta

SEQ ID NO: 580773 - DNA, 422 bp, Homo sapiens
  misc_feature (21)..(21): n is a, c, g, or t
ttttccacagggttttttaanttcctactaaaatccacccaccatgagaacatagcaagcatgtggatgcagggctgtgtgaggaacttggggcaaccatccaatcaaccatgcccagccactgaccttaaagacctccccctggcctggatagagaaagcaatgcatcaggaatagttgcaacacaacatgattttgccccaatcactgaagttatttgggatccagagtattttctagcctgaaagatacctgtatgtatctcagggaaggacacctgttccctgatatatgtgttctataaattaaactgggcaagagctgtcactcacttaacaggtggaatataagggacttggagggataaaggggttaacccaagctacattcaactgccttcattattatttgcacctggtgaa

SEQ ID NO: 580774 - DNA, 165 bp, Homo sapiens
tggatcacgattgtgatctgtggagtagctgagttgatctgattcagactgggtccctgcttaaaaccccgtaactccatcacttcctggccaagtccaaacatggcacaaaaggcccagtgtggctgggtcacgaagggtgatctgtggctgagataacaaatt

SEQ ID NO: 580775 - DNA, 111 bp, Homo sapiens
  misc_feature (21)..(21): n is a, c, g, or t
tagaggatccccctcatggantccactctcggaactcctggtctcgagtgatctgcctgctcggcttcccaaagtgctgggattaaagtgccctgagttagagagtgggat

SEQ ID NO: 580776 - DNA, 223 bp, Homo sapiens
ctgatcttgaaactgtttcatcttctcacacagattactattatttccaagacagcccggaactggggctggttaatgcaggtgaggaaccagcggttggtattgggaaaggcctggctgtaagaaggcttttgtgcctgctaatagagccacaacagggtgcagacaactgtgatgtcagccaatgacactcgtttgatcatcagaaaagcattcgtctata

SEQ ID NO: 580777 - DNA, 90 bp, Homo sapiens
tgagctgaacattctttattaggctgaagccatacccttgaagtaggcattgtgttcccaagttcaaaatattgaatctagggaaatagg

SEQ ID NO: 580778 - DNA, 172 bp, Homo sapiens
  misc_feature (170)..(170): n is a, c, g, or t
ttttttgtatttttagtagagacggggtttcaccatgttagccaggatggtctcgatctcctgacctcgtgatccgcccgcctcggcctcccaaagtcctgggattacaggcgtgacagctggcgcctggccaggctcagaactttcaatcagctttttttttttctggntg

SEQ ID NO: 580779 - DNA, 186 bp, Homo sapiens
ccgacgatcaggcgactccacctttgggggtagggcataactgataaaggcagcagaaacttctgcagacttaaacatccctatctgacggctctgaagacagcagtggttctcccagcacaatgtttgagctctgagaacagacagactgcctcctcaagtgggtccctgacccccgtgtagcca

SEQ ID NO: 580780 - DNA, 275 bp, Homo sapiens
  misc_feature (15)..(15): n is a, c, g, or t
  misc_feature (23)..(23): n is a, c, g, or t
  misc_feature (31)..(31): n is a, c, g, or t
  misc_feature (80)..(80): n is a, c, g, or t
  misc_feature (157)..(157): n is a, c, g, or t
  misc_feature (176)..(176): n is a, c, g, or t
  misc_feature (202)..(202): n is a, c, g, or t
  misc_feature (224)..(224): n is a, c, g, or t
  misc_feature (254)..(254): n is a, c, g, or t
tcagagttaaacctngagtgccngcgtccgngagaattcagcatggaatgtctctactatttcccgggatttctgctccnggctgcaagattgccacttgatgccgccaaacgatttcatgatgtgctgggcaatgaaagaccttctgcttacacgngggagcacaatcaattaancggctggtcttctgatgaaaatgacnggaatgaaaaactctacccagngtggaagcggggagacatgaggtggaaaanctcctggaagggaggccgttt

SEQ ID NO: 580781 - DNA, 408 bp, Homo sapiens
tttctggaagacggcagagttgccgccatcctgcgggaagaggaggctctggacctgcagcgctgcttctcttgcctagactctaggaactatccgcgctccactcgccacaacatactcaaaggaacggcgagaaccgggacccccctgccgggacccggcactgacccgacaggatgctctctgatgactttgacacagcgatcgaggccatgcctgtaagctccctatatcgacgagcatgagcaacacagccaagacgcctaacaaggatcatcctagtaccacccaccaggctcaccaccaccccgcgctaccgcgaccagccttacgcagcactatcctcttccgacacggacgccgtaacaggaccctcagccctccccacgcaccctcggcccgccctgc

SEQ ID NO: 580782 - DNA, 696 bp, Homo sapiens
  misc_feature (1)..(1): n is a, c, g, or t
  misc_feature (70)..(70): n is a, c, g, or t
  misc_feature (78)..(78): n is a, c, g, or t
  misc_feature (116)..(117): n is a, c, g, or t
  misc_feature (124)..(124): n is a, c, g, or t
  misc_feature (127)..(127): n is a, c, g, or t
  misc_feature (129)..(129): n is a, c, g, or t
  misc_feature (140)..(140): n is a, c, g, or t
  misc_feature (182)..(182): n is a, c, g, or t
  misc_feature (188)..(188): n is a, c, g, or t
  misc_feature (192)..(192): n is a, c, g, or t
  misc_feature (194)..(195): n is a, c, g, or t
  misc_feature (200)..(200): n is a, c, g, or t
  misc_feature (207)..(207): n is a, c, g, or t
  misc_feature (232)..(232): n is a, c, g, or t
  misc_feature (236)..(236): n is a, c, g, or t
  misc_feature (245)..(245): n is a, c, g, or t
  misc_feature (249)..(249): n is a, c, g, or t
  misc_feature (254)..(255): n is a, c, g, or t
  misc_feature (295)..(295): n is a, c, g, or t
  misc_feature (301)..(301): n is a, c, g, or t
  misc_feature (324)..(324): n is a, c, g, or t
  misc_feature (328)..(328): n is a, c, g, or t
  misc_feature (346)..(346): n is a, c, g, or t
  misc_feature (369)..(369): n is a, c, g, or t
  misc_feature (379)..(379): n is a, c, g, or t
  misc_feature (422)..(422): n is a, c, g, or t
  misc_feature (517)..(518): n is a, c, g, or t
  misc_feature (521)..(521): n is a, c, g, or t
  misc_feature (523)..(523): n is a, c, g, or t
ngtgtcaagcagcagcagggcggtgggaacagctgcacctgcactgtggcagctcggagggctccctgangtccaggnggaggctttctcaagtgtgggtgcgttgggtgcgaggnnggggggnctngncagctcccgtngtgtgggggggggcccaggatggttcctcaccaccgggtggngatgtnctgngnncctgngcactgngccctaacattactgactctaaacnagancccagtgcncacnctgtnntcaacgtcctcaccccacggcattctgagtgagggaggcncagggncacccactccctggactcacttntgtncccccgagagaccttgcncgggacatgtacccacctatgcnctctactgcncacctcagccctgtgggacccagtggtgttgtggggagtcctnacggccagctaaggacaggatggtgatgagggggaggggaacgaggggcacctggttttggttcatgatgcttccaaatttttcagggcctcctnngancntggataccgctgcatggtagggtgggtgtagcttgctagctacatgttctctgctccatccctcgctggaaatgcctgtcccgatatggcccacgggtcctgctgttgcccctcaccatgctccctgatgtgtccaggctggcctgggggtcgtgctacctgaggcggcagag

SEQ ID NO: 580783 - DNA, 471 bp, Homo sapiens
aagcagctgcttttgttaaaaaaaaaaaaaacagcagagattaaatataccgatctataagactagatttttctcaaatctgaaagaacagtctagaactgccaatgagattaaggattaacacagtcaagactgcagtagattttcttaaaccggttttgttttattgagtttacaattttaaccttttaatggtcaggataaaaaaaaaacacccgattactgaagatttcagttttctttttagtttgcatacacttaacgtatagtgagggcaaaccatcattgctatgttgtaaatctcattttattttaaacagtcatttatttttttttacctgttttttatacagtagtaaaaacaaatatctacaatctaaggctacagtagatcttataaagttattttgcttgtaaactattacacaataataaccacttaagtagcaaaaacagcctactggagattta

SEQ ID NO: 580784 - DNA, 144 bp, Homo sapiens
aggaagagaaggcagctgtgactgaggcagtgcgggccctgctggcaaaccaggacagtggtgaagtgcagcaggaccccaagtaccagggtctgcgggcacgtggccgggagatccggaaggagcttgttcacctgtacccca

SEQ ID NO: 580785 - DNA, 218 bp, Homo sapiens
tgttcgtggggccttagcctatgaatgtatgatatttagaaaattaacatggtctgaatgaatatataaaaggcttagcactttaagaatcaagagccggcggggatagtggctcacgcccagaaaagacgtatggtctcaagaagtgaaaggccaagggtcacttcaccaggctttttctgaacttccatctccattaacatcctgacctgaagaac

SEQ ID NO: 580786 - DNA, 977 bp, Homo sapiens
  misc_feature (273)..(273): n is a, c, g, or t
tcccccttaaacctttttaatgtggggcctccaaaatcctggggccacccttttggggccaggtgtgtcccctctaaaaaatgtcctggttttaaaaactctaaatactcttaaaagcggccccccccaaaaaaaaaaccccaaaggggccccacaaacaatattcctccttatccctttcgtgaagaggttcaccgaaacggccagttgtttttactcattttcaccccagctctttatacacctcactcaacactatagaggtgtgcgccnccatgtggtacacacaacacacgagtctcgtgaaagacaccagatctcttctcccacccagcgtgttattacagaaaggggcggtgtgggcagagtgatttataagagagcgagataaatagtataatcctatctaagacagcccctcttcggtgaaacactaatctctgtggaggacgagaaactttgtggtgagacaacttgatgcccagagacctccccgcaacagacacccatctcgtgtgtcccccccaacgcgggcctttgtgattatgagcaccaccccccacaccggaagacacgtgttccgtgctccctcaatatatatccaccgagaaacagggacaaagcggcagccccccccacagagggtgtgcgcaactactctcagtgagagagaggcctctctcacaacacgccacactctgtgggtgcttctgtgcccccgagaggaaaccccctcatatatacacacccagagtggtggtcgaagtatgataacccaccccagaagaacatctgccagaagaaaaattattgaaggggggcccccatttcttataccaccagcgatgtatctattaacaccccccgaacagagcgggggcggacatccaaacagacctatttgactcctcgtacgacgaccatccagcagacaaaaccttgtgtggcttgtcgacctcgtgtgttgaacacccccc

SEQ ID NO: 580787 - DNA, 652 bp, Homo sapiens
agcggaggactgggtgcgcctgcagggatcggaagccggttggggtgtgagaggttttctctgctctagcgaatagcgggttttggcagcaagttgttgcatatggattatataaacgtgaagagcaggggaaatactagaaagtagtccattcatctgatccacatgcgtgtggcagcccaaggcttagtccgtaggagcaatgactgttggtatgggctattccatgtatcgggaattcgtgggcaaaaccgtaagccttagaagaagagatgctgtctgtggtctgtgttggaggagcttgcttataggttagatgtcgttattattaaagttaccatattattgttggaaataaactaatttgtatgggttaagatggtaacatggcgattttgaatattggcttcctttcttgcaggcgttgatttgcttggtgaccgaattactagtgactagtattactaactaggtcattcaaggaagtcaagttaacttaaacgatgtcgacctaaatgcacttgatggtgttgaaatgtccaccttcttaaatctctaaggatgaacttagttctaacagaagataacaggccaatcctgaacggtactccctgatatgctgcagaatgtcagatatttgggatgttgctaa

SEQ ID NO: 580788 - DNA, 358 bp, Homo sapiens
ctggtctgactctagaggtatcccctgcagcacacaacagcaggaggttctagagaggaggaaaagcctgcaaagagggggccgtactgtcggccgaggccgccctatgccagcatgtggtctgcagtgcggtacgggggcctgaggccgtcgccgtaggtctcgatagggtagtctccatccatttccatgtgcatctccagcgtgtcaaggggcatcatcgctggactacatagggcggtaggtggcatccaagtcatctccgaggacaagaacccagattaccggaagcgcgtgtccgtgccgctcacgaactccctcttcaagcatgacccggctgcctgggacgctggccaga

SEQ ID NO: 580789 - DNA, 364 bp, Homo sapiens
  misc_feature (82)..(82): n is a, c, g, or t
  misc_feature (86)..(86): n is a, c, g, or t
gtcttaaataggattttacacacacacacacagaatttaaaattataaatcaaaggcaatcattctaaatgtactatgatancgtnttaaagatgcaagtaagcgtgtagaactaactaatatgaacagcactactcattacctaggagaaaggtgactggttttcacacaaagctaagcctgtaacagtcatcctaatcacaatggcttataaaagcatcaggtttccagtagagaaactattctaggaaagtcagtaaatctcttgaaagtttcacatctggaaaaccaggataaggctacaactattttgaaatctgaacaaggtatcagatgaaagagtaagattcccagccataatgta

SEQ ID NO: 580790 - DNA, 250 bp, Homo sapiens
aatggcaagtgtacgagctgttcccaaccctgaaatcaaccactaccagacagcacctccttcaggttatttcatggcagctaaccgacagactcagaaccgtgctgcatactatcctcctagcccaataggtcaagtatggccaagtcctcggtggactgctcagggtgccagaccgcatccattccactgtgtgcccggtgctttccgcccagctgctcctagatcaccctccgctttcgaggggatc

SEQ ID NO: 580791 - DNA, 895 bp, Homo sapiens
atcaaaaaatgaaaagaagttattagaagtgaagcgaaggtagtgtcttttccccagaaccccattttttggcttgctttgtagccacagtgcgtattccggaatctataggcgcgctctaggccttacttgcccgccacatgttgggacccgttaattccggtctggaaagtctataaggcggttcaaactttgcaggcatcctgaaaactttggcctgtggaacttgttaaaggaaatgtccattgtccaatatggccctatgcccctggggaccatggggtcttcccacggtgcagcccggaagtcccggccgcaagggctccctgataaaccgcggctgcaggcgccgagaccccgcgtgtccccccccccccgtgcaacgaaagggagtgccacctattatcggaaagaggcggccttcaagtacaaacaaaaaatggaggctcccctcttaaaattaggcaaagggcgcagttccaacactaggacacgccccgaagctcttctagcgcccccaaagcactgagggcacgacaacaccattaacagatggtatggtaccccacaacactccctcaggggagttgctcccaacatcattgtgtgaaaacctgataaccctcgccctctcatctctttgtggtgccctcttattccccctaagtagttcacggcgagtcccacagccatcactcgtgcccgttataatggcactctcggagtagtagcccaccaccacaccctgtcatggggtggccacacagcaacctgggataaaagcgcgccaccagtcatgttatggggcgccacgctctaaggtttgaagaccaccccgccatgccgctcgcgaatccccaagacagtttcccctaccctttttcgcccccataaa

SEQ ID NO: 580792 - DNA, 1198 bp, Homo sapiens
ctggtgcaggccgtctcggggaagcctcacaggacatggctcgagcctcaggtcgatttggagaggacttcagactaccttcctggaagctggtgtggagatggcagagccaggctccgagaccaggaggtaccgagcccaatgttgtgtaccaacttgaagggcatctccagtgtcttcaagcaaacttcttctggctgccaaggtccctgtaccacggaccctgcatgcccctaacctcaagagtcagctggcatgcagcatgccagggcaagataacatgacagacatcaatcagctcatcacgtatgatgcacccagacaggacacccggaccaagaaggcagcgtgataacggcccgtgcgggcaataggagcacggtccgggcaactccactaggagaacccagaccagcccaatcacatgacatagtccgatacatacaggataggcctgcgacacggagatacatgcgagaacgtcaaaagagtagcatgggaagaagggccactgcaatggaccattcaacccaaaacatgccacagcacacggcaccacctgcacagaacgctcaggacgatgcgcaaaacccacccagaccatacaacaagaggcaacataagctgcgaacaaccacccggaagggaacaggactggcaacaaagacatagcacatactcgcgagctcggccgcgaccaacagaagccccgaaatagcccaacgactgggagacagcaaccggagcataagatgggaaggcgcgaacaacagaaaaggcccagagggaccaacaccaagaggcacacctgcagcatgacgccatgcaccagaagtaaggggacgagccactgagcatgaacgcccaggggcccccaggagggagcaacaggagagacgccacaccaggtacgacgcacaacacaagccgaacgtaggcacaaacggcgggaaaaaacacggcctcggcctcggccaaaggaagatacagtcggcgaagagaaccaaccgcgaagagccataacgggccaaagaaagcaacggaaccctcccagagacagacaaaaaacgaagaggaggggcactaacagcaacaacagagaaacaatagaagaagacaacactcaagaggagccacacaggggcagcgaaaagagagacgaacaaggaacaaacgcagaacggaagaagcagctagg

SEQ ID NO: 580793 - DNA, 612 bp, Homo sapiens
  misc_feature (32)..(32): n is a, c, g, or t
  misc_feature (78)..(78): n is a, c, g, or t
  misc_feature (87)..(87): n is a, c, g, or t
  misc_feature (93)..(93): n is a, c, g, or t
  misc_feature (107)..(107): n is a, c, g, or t
  misc_feature (123)..(123): n is a, c, g, or t
  misc_feature (131)..(131): n is a, c, g, or t
  misc_feature (217)..(217): n is a, c, g, or t
  misc_feature (220)..(221): n is a, c, g, or t
  misc_feature (232)..(232): n is a, c, g, or t
  misc_feature (239)..(239): n is a, c, g, or t
  misc_feature (241)..(241): n is a, c, g, or t
  misc_feature (244)..(245): n is a, c, g, or t
  misc_feature (257)..(257): n is a, c, g, or t
  misc_feature (307)..(307): n is a, c, g, or t
  misc_feature (338)..(338): n is a, c, g, or t
  misc_feature (340)..(340): n is a, c, g, or t
  misc_feature (358)..(358): n is a, c, g, or t
  misc_feature (364)..(364): n is a, c, g, or t
  misc_feature (377)..(377): n is a, c, g, or t
  misc_feature (388)..(388): n is a, c, g, or t
  misc_feature (397)..(397): n is a, c, g, or t
  misc_feature (400)..(400): n is a, c, g, or t
  misc_feature (412)..(412): n is a, c, g, or t
  misc_feature (438)..(438): n is a, c, g, or t
  misc_feature (446)..(446): n is a, c, g, or t
  misc_feature (453)..(453): n is a, c, g, or t
  misc_feature (487)..(487): n is a, c, g, or t
  misc_feature (493)..(493): n is a, c, g, or t
  misc_feature (523)..(523): n is a, c, g, or t
  misc_feature (525)..(525): n is a, c, g, or t
  misc_feature (531)..(531): n is a, c, g, or t
  misc_feature (560)..(560): n is a, c, g, or t
tgggaagggatttcttgtaacaacgcatcttntatttggaatgactattaaaaaaacaacaatgtgcaatcaaagtcntcgggcatnttgtgnactttgggggatgntcgctccaaccgagtnttgttatnttcaccgttccagtttttaaatcctgagtcaagccaaaaaaaaaaaaaaaaaccaaaacaaaacaaaaaaaacaaataaagttttnggnntgttttttttnttttttntnttnnttgtgtgttttnttttttttgggttttttttttttttttttttttccgcctagaagcatttncggtggacgatggaggggggggggttgtcanantcggtggttgggggtccncatctnctggaaggtgganagcgaggccangatggagcngcngatccacacggngtacttgcgctcaggaggagcaatgntcttgatnttcattntgctgggtgccagggcagtgatctccttctgcancctgtnggcaatgccagggtacatggtggtgccgcnanacagcnctgtgttggcgtacaggtctttgcggatntccacgtcacacttcatgatggagttgaaggtagtttcgtgggatgccaagg

SEQ ID NO: 580794 - DNA, 120 bp, Homo sapiens
taagggcacccggttcaaagaccttgacacctggtggagtcacagaatcatagaccctgggaagaactttttatagcgttatttatttaaagctttacaattgtttaccctgctcaggga

SEQ ID NO: 580795 - DNA, 152 bp, Homo sapiens
actggtgactggaatgaggcggaacagattgcctgcatggaggcccgcccaacatctgcctagcatcggctagacaactggatcccgtcattagcagaatctcaacttcagacccgtcaacacattaagaaactggaagaggtcagcgtagt

SEQ ID NO: 580796 - DNA, 845 bp, Homo sapiens
  misc_feature (830)..(830): n is a, c, g, or t
attgtgtagctatacctagcaggaataaatactaagtctgtgtcagtattcttccccttggtttcagttatctattgctgtgtaaaaaaccatcccaactttgttgcttgaagcacccaggattcattgtttctcataagaattttctgctggtctcatgcggacttgctcgtgtcctagctgggatggctggattgttcatcttgcagttggtgctggacaatggtgggctctctctcagtggctttcatgcacaaggaggctcacacaggcttcttgatacagcagcctcagagcatcagaagggcaagagtggatgctgtctggtctttgaagtctcactcagaagtcacctgttgtcacttctgtgttctattagtgcaactgagtcctgaggcttgcccaggtttgcactgaggaaatcgattccacctcttgctgagaggagcagcaaagaatttatcgccacttttaacccactacaacctcaatttcaactgattgtctctaatgacttcttctgtaagcatccaaaacatcccttgattgaaactatctcaaggtgacctatcttccttcaacaatattttgtggttcgaaactatgtcattaagagagtgactttgaaaacctatataaggacccagatgtgaggtgactgcctagtctgaggaataatgactttaagttatatttgtagagaagtggtaaagccacgaagcagacccatggagaaatgcaaatctgtcatcagccttgaaggatgggacaaatttggtggtgccctggttaaggaggaaccagccctggggcttgctggcaaagcctangagactaatttgtaa

SEQ ID NO: 580797 - DNA, 1283 bp, Homo sapiens
ggaagtagtgcctcccgctgctgctatgggagatggcaccccgtgacaagcaggagtagactgtgccttgctgttaccatgacatgctgcagtacagtcgttctcccagaggtgcttgtgactgcggcgtgcggggaacacgcctgttgagtgtatcacttgatgataactactgactcccctgcgtagggtgttgtcccgcatatgtcgtcaagcaaacctgccaattctgcttgtgtggggtacgtgagagccctcgcgcactgggcaatctgtgaaccactgcgcgctaattacatcactgtgcctcgtgataacctaccaagctagactatgagcgactgaagggagttgttcacccgctaggtagagacgctcaacttgcagggacactcttgagaggggttttctatctaagattctagctcgtgtcacttcactcgctaccacgggactgggactcccccttcacggatcaattcaagatgggctcatccacattgcttgtcagtatgtgcggccgaagctgtacttctcacgatatcgcctgaggggagcttgttcggaaatactgacagtcgaattgacgtgggaatgccaccttgttatttgctccaccatgggtgaaccacgtggcctgcgcggccttaattccacttgctgaaccccctcggctcccattagtgtccctcatttcccttaacaagatgcccctcttcttagaatacaattccataagggcaacttggtatggcccctaccgccgaaactggccctttttttccatttacgcccacccgaacgcaatcattggagggaacctcccacactgtggtcgcccctgtgaagccaactcttccccctatcgaacactaccggctgaaacggcactcgccttgtgttaactaaagggggagttgaattaaccttcaccaaacttttccccccatgctgtcaactctaggtcaagcgtcggttccctggaccatactttacacacaacacggaggagaacctaattccctcttatggcgctctgtggctttccttcctctccgaaactacattacctacggcagagttctgggactggcatacaacagggcacttcccactacccctttattgcataccccactatacgccccctttcccactcgtgctctatattccacatctgcgtctttgttctgtcgacgctcctccccagattaatcgggttacccaacaactctctaattcacaatacgtctctccaccaagctttggctcacgtcagaacc

SEQ ID NO: 580798 - DNA, 501 bp, Homo sapiens
  misc_feature (28)..(28): n is a, c, g, or t
actcaatgaggcacactctcttgtggcnctccatatttttgggagcactttgataaggacggctggtccctgtggtactcagagtatcgcttccctgaagaactccctcagaccttcatgagctgcaatttcatccctggaatgttccagcgactggcacagctgaggaagaatgccttcgccagtgtcatcctttttggaacccacaataacagctccatttttggagtttgggttttccgaggccaggagcttgcctttcccctgagtccagattggcaggtgggcttcgagtcatacacatggcggaaactggattctggcaacgaggagacccaaacgctggttcgaaagtactttttctgggagggggccttccagcatgtgggcaaagccttccatcagggcaagattttcaagtgaacatttcttgccctcccctaactgcctgcccctgcccttcagggagatgggggtccttaaagggaactggacctttta

SEQ ID NO: 580799 - DNA, 154 bp, Homo sapiens
gcatcatcactctatccattccaatgcactgcactccattctttcctcaccattccattccactccattccaatccactccattccattccattccactccactccgttccattccactcaactccattccattccattctattccattccgtt

SEQ ID NO: 580800 - DNA, 416 bp, Homo sapiens
tataccacagggccagtatttccctggtaccaaaaccagacaaagacgcaacaaaaaaagaaaactacaggccagtatctttgaacagagatgcaaaatccttaaaccaaattcaactacatatttaaaagatcattcattgtaatcaagtgggattcatcccagggatgcaaggatggttcaacatactctgatatggtttgtgtttgtgtccctgcccaaatcttacatttagttgtaatccccagtgttggaggaggggcctggtggaacgtgattggatcataggagtggagttctcatgaatggtttagccccatctccccttgctactatatagttagtgagttctcatgagatctgattgtttaaacctccctgctctctgtctctctcctactctggccatgtgtgtt

SEQ ID NO: 580801 - DNA, 341 bp, Homo sapiens
attattagataatgtacagatacggactcggtatcaccacttgttaatactgacatccttcaaatgaacaaggtatgtacctaattagtctttacgtattcctcccaattaatggataattgtcaagcccagggaatctttcctttactttgacttcccgagttgtcatcatccattgacaataaacttatctgattgaaatctctcgatccctcacaaaccgagtatctgcaggtatattcaagatcgatcctcatcaaaggattgtgataagtggctaatcctcatataatctcatcgtttccaagcactggaggactcattatcttattccttcttca

SEQ ID NO: 580802 - DNA, 248 bp, Homo sapiens
gtagcatttctattgcctgttctgtacatcatgcatctgggtagcactcgctgctctggagggcggggctgggggtagggccctactgactctgccacacttggagatgtgcacgccctgctctgtagcattaagccccaggatggagaagacaccacgaagccagccaagaagctggtccccactgttgattaagagcaaggatgatggcgtccttgtagcagtttgttattgaaccggatagcttg

SEQ ID NO: 580803 - DNA, 105 bp, Homo sapiens
aggatcaacggtgagagtataatttactatcatctttttcagctgtagattcctttgctagtatcttcttcttcatctgttcccacatccatttacttacatctt

SEQ ID NO: 580804 - DNA, 144 bp, Homo sapiens
  misc_feature (84)..(84): n is a, c, g, or t
cgtagcacactgcagcacaataccagtctggaatgacaaagtgccctcctcttacgaagggctgtcttcctaactaggcagggncgggaacataaccaagaaggatgtcatctttgcaatagacaagcaagtagataagtaaag

SEQ ID NO: 580805 - DNA, 132 bp, Homo sapiens
tattttttaatttttctgtagagacaggctctgctgtgtgcccaggcaaatctcaaatcactggactcaagtgattctcgtgcctcaggctcccgagtagctgggattacaggcgcccactaccacgccaac

SEQ ID NO: 580806 - DNA, 216 bp, Homo sapiens
acttgttctcttttttacacatcttctttgttatacactaattcgttttttttcttcttttttatctttcttctttttccttttcttatctctcttattctttactatttctactcatcttgtcttacgtttttctcttccctttcttctttttcctatctttctattctttatttttttctcttttctttttttttcttcctttactcttttctt

SEQ ID NO: 580807 - DNA, 464 bp, Homo sapiens
tcttaccgtcctagctcgccagtggctgagttactgaacagagcagcattgagcccacgtatgctgttgttagttataagggggatagagagctttggtcctgatagcagaaactgcccataaattgtacaagaatatttgtgcccgtggggtaagactcggcgagagccggacaagtagaggttttctcgctgagacggtaataggtgaatgaagggtaaatgctggggaggtcttggaccatagaggacattcagggtgactgggtcattgtgcatgccaccatctcggtcccgtatttcaccttcatagggtcctgtttcatttctcgtgacagtgggtagaatgaggatcctgttttcaatgggtctgcttgaccctggtaatgacagtgaggctctgaccaatttagccagcacaggtcggtgtagcactcactcttaggttcacaggcgaggctagga

SEQ ID NO: 580808 - DNA, 292 bp, Homo sapiens
  misc_feature (280)..(280): n is a, c, g, or t
taggtggttgtgggtagcacagtcaagagaaggactctgagaccccaagatccggcaggttgccgcagaatgggggcaggagtcgggggacagagagccctgggcacagaggcaagaatcagatggatggcagttccgagccctcctgcctcctgacctcaccggcccactggtctgagctgggggaggtccacaggcctccaggagcctcaggaaggacgcaaacttgcagcagaaggtggtgttggcgcaggggctgctggccccagagccttccagngatgaggagaga

SEQ ID NO: 580809 - DNA, 331 bp, Homo sapiens
catactcttgaccaatggtgcgcttcgggtctgataccaaaggaatgtccatgggtcacagtcctccttgtttcttaggtgtattgacccatgctagatgacaagagtgagaatccacagaagcccatatcacttgacagttgagtttcttaaattcttctgccctatcactgaaaccaatgatctccccttggtagtcagacaggttgatatctttaacctgaccatgtggcataacagctgtggctttgaagttgggggcagggtgcacaattttagcatctcctgaacacatcttcctatcaacagtcaccacacgagtcgcagaacc

SEQ ID NO: 580810 - DNA, 1005 bp, Homo sapiens
  misc_feature (219)..(219): n is a, c, g, or t
  misc_feature (918)..(918): n is a, c, g, or t
atgaccccaatacgcaaaattaagcccgctaataaacttaaattgatacacgtgtacattcgatcgacacgtctcgccaccctcatgccaatcactcgtccgacagtgatggaagacttcgggtctctactccattggagccatggcctggagtcgcgtccaacagtacgacgctacatggactcattctctagaccgagtgctacttagatcgatccnagtaacgtcgcgtctaatcacgcactttatgtgcagtcaatacggcgcacgacaatgcatcttcgcagaatcgatcagacacttcagtgcgctggacatccatcacgctttaccctgtcaacggccaaagtggcagcccatcaacatattccttctatactggcctccttcccatacagcgatcgagagcgaaggcccatagtagttcacggaatcagttatcatcatacattcaggaaagccctgaaaacaatcggcagttaatccctccttgcattgcaaagcgtactagccaagcaagccctttcacttaggcttatgtccctccccgtgaagggccaaagatattcaattcattgcaggggggccacaaggtaacattacacaagcgttaccgtacttcgcggccatcaccgagttatcattttgggcggcaagaacctaagtttcaaattgaactcttgaagggaagggcataacgtacaaggtaacgaacaaggatacccgcgaacacacttcacgaacagaaatagtcattgttgtacccgttgtcaaacgtttatccgaagtcgttttggcccaccctagtcacgtctactatggggcaagaccccaagtaaggcgaagacgaacgttcccaaagccattcacacatacttttgccatatggccgacggaaaaacacggggggaattcaanaagcaaaagcgcccccagttaaagggaaagatcacaaccattccacgaatttccgggaagtgaaacaagatcaagacgatgtcccac

SEQ ID NO: 580811 - DNA, 850 bp, Homo sapiens
  misc_feature (89)..(89): n is a, c, g, or t
tatgtcaactctgcgtatgatctccgctgcattctgtttatgtgggcgtaatactgcgtgtgtttacccccggccacaccggggtgtgngttagatttcggtttgtgagagtcgcccacaacacttggcgttggccgcacccttgtgcgtggaccttgggtttcgcctcgccaaatgctggggatctttcgcccacttctgtgttaacgccgtccagcgttaacggccaccctggggatggttcaaacaagtgcggcccctgggggtgaataattaacaccaaggtgtaaagcacacttcgtcgcaaaattctgggggcagcccctatgggaatctcaaccggggcccccccgagcaccctcgagcagctagccgccatattactgctgaggtggacgccctcccaatgaggctaaagggtcatctcatcgggagatcaattaggaggagccaacatgggctgccccccctcctaaagtttcccggccccccccggcccaaaaaagtgtcccgggaggagaacacaaagtgaaaacaacggctttttacccacgggcgtcacagtccgctttttaacaggagcattgtggagaatggtatgaaatgttcaatcaccgaggtcaccgaattggaggagcaagcctgtggcggtcatatatgttaccccgggcaccctctttagataccttcgaatcccctcgggaccccctggtgttgcgccccgctcactcaacaaccaatcttgtgaaggacgtggatggtcttgtagaaaaactaacaatgaatatccgagaaaacgggggttacaaaggaaaattaacaaggggggtttcccctcaaaaaacataac

SEQ ID NO: 580812 - DNA, 489 bp, Homo sapiens
  misc_feature (375)..(375): n is a, c, g, or t
  misc_feature (440)..(440): n is a, c, g, or t
  misc_feature (479)..(479): n is a, c, g, or t
  misc_feature (482)..(482): n is a, c, g, or t
gtacatcaacaaagacagtaagcatgaagagctaatgctaggagatccttgccttaaagatctgaaaaaaggagacatcatacaactgcagaggagagggttcttcatatgcgaccagccatacgaacctgtcagcccatatagttgcagagaagctccatgcatcctgatatacatacctgatgggcacacaaaggaaatgccaacatccggatcaaaggaaaagaccaaagtggaaatctcaaaaaaggagacaagctctgctcctaaagaaagaccagcacctgctgtgagttctacttgtgctacagctgaggattcctccgtcctctacagcagagtggcggtgcagggggatgtggttcgtgaattganagccaagaaagcgccaaaggaagatatagacgcagctgtgaagcagcttttgactttgaagctgnatatagagagaaactgggcaggagtataaacctgggaanccntctgctg

SEQ ID NO: 580813 - DNA, 430 bp, Homo sapiens
catgtgcctgtagtctcagcttctcaggaggctgaagtggggaggatcgcctgagcccgggggtttgaggctgcagtgagctgtgattgttccactgcactccagtctggggtgatacagcaacactctgtctctaaaaaaaaaaaaaaattaggctgaatgcagaggctcccacctgtgatcccagcattttgggaggccaaggtgggaggatcacttgaagtcaggtgttcaaccccaacctcggcaacagagcatgacccaggctctacaaaaatgaaaataaaagccagatgtggtgcatgtgcctgtagtctcagctatttgaagctgaggcaggaggattgcttgagccaaggagtttgaggcctcagtgaactaggatcatgccactgaactctagcctggcaacagagaccatgtctttagc

SEQ ID NO: 580814 - DNA, 202 bp, Homo sapiens
tagctctgtcagacttacacacacatactttctaccttatcaatacgagtaattaaggtattttttagtcttgcataattttggtcctcttgatgttgaatgaactaaaacacatgacttaaataattaagatgctgtgttttctatattttttcttgtttcccctatagctcttctctgtgaatgctattgaaacttctaa

SEQ ID NO: 580815 - DNA, 212 bp, Homo sapiens
  misc_feature (18)..(18): n is a, c, g, or t
  misc_feature (23)..(23): n is a, c, g, or t
  misc_feature (32)..(32): n is a, c, g, or t
  misc_feature (48)..(48): n is a, c, g, or t
  misc_feature (54)..(54): n is a, c, g, or t
  misc_feature (65)..(65): n is a, c, g, or t
  misc_feature (69)..(69): n is a, c, g, or t
  misc_feature (82)..(82): n is a, c, g, or t
  misc_feature (86)..(86): n is a, c, g, or t
  misc_feature (96)..(96): n is a, c, g, or t
  misc_feature (116)..(117): n is a, c, g, or t
  misc_feature (127)..(127): n is a, c, g, or t
  misc_feature (129)..(130): n is a, c, g, or t
  misc_feature (141)..(141): n is a, c, g, or t
  misc_feature (154)..(155): n is a, c, g, or t
  misc_feature (157)..(157): n is a, c, g, or t
  misc_feature (174)..(175): n is a, c, g, or t
  misc_feature (177)..(177): n is a, c, g, or t
  misc_feature (187)..(187): n is a, c, g, or t
  misc_feature (200)..(200): n is a, c, g, or t
  misc_feature (205)..(205): n is a, c, g, or t
  misc_feature (210)..(210): n is a, c, g, or t
ggaagatgcgttagaaanaaccnatgtgcccngtcgaaagacactgcnggaggnggtgatggagnccgnggggatcaagganaccnggaaatacgngaaggtctattggtattganncctggggcanannagctcctcccnaacttctgtcccnncngtgaaggctgaggcacnncnttttcagatncgggtaaagagcncgttntgagngg

SEQ ID NO: 580816 - DNA, 269 bp, Homo sapiens
ggtttggcattttttcggacttcctatagggcattttggccccttgggccccaattgcccacaagtaggctcgaggccccttttttgcctgtttttcaataggagtttggagggttttggtctggccaagcctttccccgcctcccccaagaagcaagttggtttcctttggtttccttaggcgtccatcggaggcaaaaaaacgtggatttccttggttcttttgtttcaggtcaaagaagggccatgaaggatccccaataaatcca

SEQ ID NO: 580817 - DNA, 232 bp, Homo sapiens
tcttcaagtaatcagaatcttcccgagcagtacgcgcctggattttcttacagcttcaagtagcgatgaagccccaatcataagcaattcagaaagggttgtttcatctacaaagaccgatttcaacgaatcttctcgacaagtgaaggtaggcgtgacaactgaggtagattgcctgtcacgcgatagctttctgagcatgtcatcgtatcttttgttttcgacgaaggat

SEQ ID NO: 580818 - DNA, 283 bp, Homo sapiens
atcccccaattatcggacgcccacagttcttggcagcgtggcgactcctctccgtatactggctcagcaatgggaccaatctgtggtcacccttgtcaccctagacctggccattgtcggccgccagcatcgtgatgtcgatcatcggcctggtcggcagctactggatcgggcgctgggtgccgcacggcaaacgctaattgacgccgtcctcgcccacccgctgtcctaactaccgactaggctgtgatgccgtgaaagacatgctggtgtggatcgattg

SEQ ID NO: 580819 - DNA, 1254 bp, Homo sapiens
  misc_feature (323)..(323): n is a, c, g, or t
  misc_feature (563)..(563): n is a, c, g, or t
cggaacgcctaggctcaagtggatctgtccacctcagtctccctaagtgctgggattacatgacgtgaaccatgtgggaccgatgcccaaacccttcaccttctaatgggcactggtcatgattcagaccgattcggccttgaagaaggttggcacatacagcgtgtgtgctgggcctagtgcttactacaagtgaagctggctacctaaatatatgctgttgttgacctgagattccagcgacaagcacttatctacacataccccagagtactcatgactcacgatacacctgtcttagacagaaacagtgggctctgctntcggaacatgttctcattgacgtctagcctgcatgccgacagacattatatggcttcatgattaagacccttctcacatccttgattcatctaaagacgtgtattcatcacgtggtcaagcaagaactgtaactaggtggtcactacttctcgtgtgccagttgtagagagtgctgaagattgttgccttcatttagatcggtgaagtttctagaaaacatatctatgtctaaattgatntcttctctggttccactactcgatctgtaaagccccatatggcaacatcatgggaagaatagacattatcgtatgtcgatgacgcgtagacgcttttaataaactttacatgattcctcccgtatgaaaggggcgctccaaaggctcaccaaaagcctagaagtagagccgtttgtgccatgataccagacactttgtggcaacttaaaattcaggcgttggttgaaaaccatacttcgggtattggaaggtatgtttgctttcggcttcttggtaagacaaaccgagggaacttcgaattacccgtgaaacgacgggcaaaccacgtttttctttgtcccttacagtatatcaagttcatatcgggccgtttgttcgtcagaacattttataggcatatattaagtttttgtgcattataacagtgtccttataagagttacttataccccgactccaattattcgtgccctcattgcacaccggaccacaattcccattggcaagccaattccaaagaggggttcccccctctgaagttaactttccttgggcaccaggctttccttgaggacaccaaagttttcctttccttatatgggagaccttgtaaagttccgttgtggggcaaagacagtggtttgtgtttggcccatgtaaggggtaaaatatgtgggtttacgccccttta

SEQ ID NO: 580820 - DNA, 148 bp, Homo sapiens
actctttaccctaacaccacaggcaggcacagtggcttacacctgttatcccatgcactttgggaggccaaggcgtggcagactgcttgagcccaggagtttggtatcagcctgggcaatgtggcaagaccttgtttctacaaaaact

SEQ ID NO: 580821 - DNA, 379 bp, Homo sapiens
tccctagaagtcgacgagaactatcatctgacccaggaatctcacttatgggtatacacccaaagaaaatgaaaacaccacctcataaagacgtctgtattatcccattttcagtgcagcattagccaagatatggaaacaaacaaagtgtcaacagttgaatggacaaaactgtggcacatataagactggtacttattcatccttataaaaggagatcctgacatttaccacaacggggaggaacctggaggactgtatgctgcgtgaagcaagccagacagaaaccgacaaaccgtcgcctgatctcacttattttggaatctaaacaacgacagtggaacactccggagaccgcaaataaaaccctgattactgg

SEQ ID NO: 580822 - DNA, 521 bp, Homo sapiens
ccgaaaaaaaacttggcagtcctagacgacgaaaaatatggaacggatggactcaaacaatatgcaaatacttcagtgcctgctctcaaaactgctttactcagtgattccttcctaggcctccaaccatatggccgacagccaacctggtgctactcaaagtatatagaagccttagaacaggagagaattcttcttaagatccaagaagaactagaaaaaaagttgtttgcaggcttgcaacctctcacaaattttaaggctagctcttcaactatgtctttgaaaaagaatatgtctgcccacagcagccagaagtgacagcattcttgtgaatgtttacatcctgctgctgataggttcaaggaattctttaaaccagattctgctgacatgagaagctccagtgatttgtttttttgaaggtctgtatcagagcaagcctaacatctaaataaagtttgattctggattttccaggtgggaaataaataaagaaaatttggcttgtcttaaaaaaa

SEQ ID NO: 580823 - DNA, 343 bp, Homo sapiens
  misc_feature (228)..(228): n is a, c, g, or t
tttgcaggagacaccctatgagttttgatccgacgggttacaccctcgcccatgagcatctgcatattgatctctccggctttaaaaacaacgtggactgccgccttgatcagtatgcgttcatttgccaggagatgaacgacctgatgacccggggcgtgcgtaatgtgatctgagatgaccaaccgttacatggggcgcaatgcgcaatttatgcttgatgtaatngcgcgagacggggatcaacgtggtggcctgtaccggttattaccaggacgcgtttttcccggaacatgtggcgacccgcagcgtgcaggaactggcgcaggagatggtcgatgaa

SEQ ID NO: 580824 - DNA, 436 bp, Homo sapiens
  misc_feature (164)..(164): n is a, c, g, or t
caggtttgttctctttctccctctcgggggggagtgttcccaaaaccggggccccttccctcgtttggtaaagggtttttttcccccccctttccccgggggggggggggacatgggggggcgggggaaaaatataaaaccccccccccccgggtggggtccgngggggcttttttttttttttaaaggccccccggggggcaagggggggggggccggggggggtttttttttttttcctttggggggggggggttggccccccccccccccccgaagggccttttccttttcccgggggttttgggggggggggggggggcccccccccccccgggtttttttggttgggggggggggttttggggggcccccctttttttttttttccggggccccggggggggttttgggcccccccccccccctgggggga

SEQ ID NO: 580825 - DNA, 261 bp, Homo sapiens
cggagctttacgtgggtacgtctacacctcattacagatgcagatctttaacccactgtgccaggccagggatcaacacctgagtcctggccctgcagagacaccactgatcctgttgcaagcagtggaaactcctccacacatatttactaagcactttcaacttagagcttacactgctatcgaacaacggctaacaccaacaggggctaccggagctcgcaattcgctaactcatggctcactagcctgctcctcctg

SEQ ID NO: 580826 - DNA, 120 bp, Homo sapiens
caccagctcggaagccaccgcgcagaacttcgtcaaggaacagggcggcgaataccgctacttcaagaaagtcctcaacggcaagccgctgtatgtgatcacctacggcaacttcgcaag

SEQ ID NO: 580827 - DNA, 1049 bp, Homo sapiens
  misc_feature (831)..(831): n is a, c, g, or t
aggggaaggggggaggtgcggagttgctgctgcgccggctgcttctcccacccccatgcctttgccctaagggggctggatggtcaaggcggcgcgatggctcgagctcgggcggtggcggtggtggccgtgaggctgcgtgtgtcttctcctcctcgccccgggcgccggcggtgatcctagcgagcggcgcggccccgatgagactgctggcgggctggttgtgcctgagcctggcgtccgtgtggctggcgcggaggatgtggacgctgcgagagcccgctcgaccccgcatccctgttaacgtgaacatgattagctggcctccggtggtgggctcggttctggctggtcgtggtggcggtatgtgaaggagaaccgaccagtgtgtatgtgtgcaacagagagaaattatgcgaatcacttccaggctgtctttggtactagaagttacccttgatccaaggaacacagatccttcttaaacaacagcattgagggaaatcgggctggcgtatttatccaattatatcattcttttgtgtcggatctgtttttagcctgtttatgtctagaacatctatcaatgggttgctaggaagaggctcaatgtttgtgttttcaccagatcgagtttcagagactgcttaaaattaatccagagtggaaaacccaagacttcttgattaaggtgctggagatggagaagtcacaaaaattaatgagccctcattttgtaagagattattgccatgatgctttatggaaactatgatttgggcggcttcagaacacagaaatacggagctccttggctaatagtgaagggcncgataggggtccgcattatggtctagggggcggaactgctggaggtgtgaacggcccgcttgttaaggtatgcaggtttgtgggcacagaggggctcttgccttctcctttcccttggagatgtgggggggaacgatgtgtaggaggcgacgattttgttagggtgtgaccaattggactatagcggtcacggaggggctggagaaataaattatgct

SEQ ID NO: 580828 - DNA, 960 bp, Homo sapiens
  misc_feature (41)..(41): n is a, c, g, or t
  misc_feature (63)..(63): n is a, c, g, or t
  misc_feature (67)..(67): n is a, c, g, or t
  misc_feature (73)..(73): n is a, c, g, or t
  misc_feature (77)..(77): n is a, c, g, or t
  misc_feature (97)..(97): n is a, c, g, or t
  misc_feature (125)..(125): n is a, c, g, or t
tcacacgcacacacataccaacacaacgctaccacacacancacagcacccctcattgcaacncccnatcctnaacnacccacgaccaccatcgacnacccatgcaacgcaccgagccaaatcanacaacccaacaagacgccaacaactctcacatgacaaccaacaacaacataaataccacggggacaacccaataccaaacgccaccacgacaaacgatccaaacctaatcacagcagccctacttctcctatctctcccagtcctagctgctggcatcactatactactaacagaccgaaacctcaacaccacacatactcaaccacaccaacccaccaaccaacacaaaacccaaaaacccaacccccacacaacaaccccccaccaccaaccacacacaacacacctaacacacaccaaaccaaccacacaccaaccaccaccaccacaacaacaccccaccacaacaccaccaaacaaacccaccaacacaacacaacaacaacaaacacaacacccccaaactaaccctaacaaaccacacaaccccaaccgacccctaccaccacccaaatacaccccaataacccacaccccacgccccaacaactactaacacacacccacacaccaacacacacccaaacccacatcacacaccaaccccacaccacacctacaaacaccccccaaaccacccaccacctcaacacacacaacaccccacaccacacacaacccacacaaaccacactcccacacacaaccaacaccacacaaccacacatcaacaacttacaccacaacacaaacaatcaccacaccacacccaccacaacaacccaaaacaacccaacaacacacacaccaatcacaaccccaccatcacacaacacacataccacatcacatacaccaccacacctcacacaacacacactcatcccaccaccg

SEQ ID NO: 580829 - DNA, 403 bp, Homo sapiens
gccccttacccctcagtagtggggctgccgaggtagtaagacaggatgccccagttaagtttgaatttccagatagaaaataattttaagaataaatatgttcctatcctaatacatgggacagatgttatttttagagataggatcttgctctgttgcccaggctggagtgtagtggtatgatcatagctcaccacaaccttgaactcccaggctcaagcgatcctcccgccttgactgcctgagtagctgggactacaggcatgcaccaccacgcccagctaatttttcttattttttgtggagacagggtctcactgtgttgcctcacttgagctcaggagtcctaaaccagcctgggcaacatagtgataccttgtctctaccaaaagttaaaaaaaaa

SEQ ID NO: 580830 - DNA, 109 bp, Homo sapiens
aggtggaagttacatcgtctttaaaccctgcgtggcaatccctgacgcaccgtcgtcatgtccagggaagacaggctcgacctggaaggtccaacttacttccttaaga

SEQ ID NO: 580831 - DNA, 210 bp, Homo sapiens
ttaggaaggaggcttagggcatgggaggaggggaaaaaatggcccctttgggccatttacacttgaaaatgtgctccctccccgattatttcagcaacctgcccctttaggggtccccgggaacaatggggggaggcagcagtgcaggaacccccccaaaacagggggggtcagcccctgaacaataaatggccttttatggtagcctta

SEQ ID NO: 580832 - DNA, 292 bp, Homo sapiens
  misc_feature (240)..(240): n is a, c, g, or t
agagatccagttctggtccccactgaaaagaaaagtaaccttcgcagggcggtggtcacgctgtaatcccaacactttggaggctgaggcgggcggatcacttaaggtcaggagtacaagaccagcctggcaacatggtgaaacccgtctctatcaaaaattagccgggcatggtggcacgtgcctgtaatcccagctacttgggaggctgaggcacgagaattgcttgaacccaggagnctgaggctgcagtgagccaagattgtgccactgcattcaagcctgtgtgaga

SEQ ID NO: 580833 - DNA, 1242 bp, Homo sapiens
  misc_feature (15)..(15): n is a, c, g, or t
  misc_feature (200)..(200): n is a, c, g, or t
  misc_feature (231)..(231): n is a, c, g, or t
  misc_feature (364)..(364): n is a, c, g, or t
  misc_feature (379)..(379): n is a, c, g, or t
  misc_feature (390)..(390): n is a, c, g, or t
  misc_feature (397)..(397): n is a, c, g, or t
  misc_feature (409)..(409): n is a, c, g, or t
  misc_feature (421)..(421): n is a, c, g, or t
  misc_feature (444)..(444): n is a, c, g, or t
  misc_feature (448)..(448): n is a, c, g, or t
  misc_feature (492)..(492): n is a, c, g, or t
  misc_feature (628)..(628): n is a, c, g, or t
  misc_feature (675)..(675): n is a, c, g, or t
  misc_feature (791)..(791): n is a, c, g, or t
  misc_feature (801)..(801): n is a, c, g, or t
  misc_feature (871)..(871): n is a, c, g, or t
  misc_feature (874)..(874): n is a, c, g, or t
  misc_feature (922)..(922): n is a, c, g, or t
  misc_feature (976)..(976): n is a, c, g, or t
  misc_feature (981)..(981): n is a, c, g, or t
  misc_feature (1003)..(1003): n is a, c, g, or t
  misc_feature (1070)..(1070): n is a, c, g, or t
  misc_feature (1086)..(1086): n is a, c, g, or t
  misc_feature (1134)..(1134): n is a, c, g, or t
  misc_feature (1151)..(1151): n is a, c, g, or t
  misc_feature (1178)..(1178): n is a, c, g, or t
cttctctgctttctntttctgctcccgttgttgctctggatctgagtgttgtatgtgttgcatatgtctccgtgcctgctatatttattgagcggataatcgaccgtacacaatcgcgcaaggcacgcagaccagcgcgagacgagccaacatgatacaccgctcgcactaccagccttctctaagtgccagccagtacnacagtaaacaccagttgattacatctactcnacatacaagagctgcgaaagagataggtatagtgaaacaaaagaaacgagtcacgagcaagaagtaccagaaccacgcaataaaagataatggcgatttacgcattaccacggactggatgtcgcatcgcgcntcttatggcccgttntcgtgtgtttnatctatngcgtttcaatancttttcatatanataacatgataaagcacaaaatntagnctaataaatatatatagaatatgatcataccacgcaataatatntaaccaccacgtcgacagaccacgatataatcgtatcgaagagaacgatagctatcacgatatagcagatgtcaacatcattgataactcacagacacacgacacctcacctcatgatccgtccttatttatatantcctcatacaatcattaccaataccgtgactatacttagaatacgtntcgtacctcccctatacttgcacacaccacatcactctcctctaagccagctctactctcacgctctcgactctttactactcgtctcacacttgtacacatccacacattactcnactcacatancgactccacacatctatcattcacggtccgccgacccgacgagtcaccgaccatccaacggtgtggtgangangttgtggtcgttctataatatattctgcaaatccacctcatagcatanagtacaacgaaagctcacacacacacagcagatgtcagatagcgactcggtacntctanggatacagaggcgatgtcgcgntagacgatagagctcgcacgggatgcggctgatgaggctgacggagtagagccatcagtgtgagctntagagagagagaggcncgtatctatctgattcaggttatatcacgtatgaaacacacatagacnacattacgtcgcgaggngcgtcgcgtagcgcgagagagtatatntcgtacgcgatgcacgttatctgctagctcactctcgcgcggtgtctggtgtgagtgtcactcg

SEQ ID NO: 580834 - DNA, 1118 bp, Homo sapiens
gacgccttcagcagacccgaacgctcttggctccttcgttacacatcacaccccgtcaacgagcctccaactggcgtcagacgggacccagataagccgagtcatccagcaccccgagtgaagcgacccaagggcgagcatgccgagacaaggcgggagggagtccgacgctgggcgcgggcggggagcgtgcgtccgttcgcacgaggcagtcgggaaggaagggagcggctgctgaatccatggtcctgggtgacatgcggatgcatgacacctgcacgaaccaccagcagcccacacggcagtgcgagcccttccttatagagcagtcagcagggggaacatgctagcggcaagtcttccagtgtgtgctaagatcgtgcagactcctggggcagaatgaggtggactatcgaccagaagcaggtggtcatcctgagccaggatagcttctaccgatgtccttacctcgagagcagcaaggccaaagccctgaagggccagttcaactttgaacacccggatgcctttgacaatgaactcattctcaaaacactcaaagaaatcactgaagggaaaacagtccagatccccgtgtatgactttgtctcccattcccggaaggaggagacagttactgtctatcccgacagacgtggtgcatctttgcagggatcctggcacttctactcccaggaggtacgagacctgttccagatgaagccttttagtgggatacagaatgaggaaacacggatcttacgcagaggtattagggacataggaaaagaagaaggatatgagagatataatctcagaaaataagttcggcagacagcatgaagatccgatgaaaaaaaagatgagagtgaatatccctaaagatacaaaaatgagtagaataaaccatgggcaaaatccagcatacaaagggaaggctccaacgaacacaggacagaaaggataccaagacaaaagacgatgtacaaaccagaacgttccaacacaggaccacctagaacaggacaggataataacgagcgaaaaaaaaagaaacagaatcgagacaacaagaaaaagccggtaaaaaaacgaccagacatgaagaaacacgagga

SEQ ID NO: 580835 - DNA, 360 bp, Homo sapiens
actaaccatagctggcacgtcgtcattggcaaaaccctcatgactaaaacaccaaaagcaatggcaacaaaagccaaaattgacaaatgggatctgattaaactaacagagcttctgcacagcaaaagaaactaccatcagagtgaacaggcaacctacagaatggaagaaaatttttgcaatctatccatcttacaaagagctaatatccagaatttaaaggaacttaaacaaatttacaaaaaaaaaaaatcaaacaaccccttcaaaaagtgggcgaaggatatgaacacacacttctcaaaaaaaataagatatttatgcttccatttctttagaggtgattgaccaaggttcgca

SEQ ID NO: 580836 - DNA, 202 bp, Homo sapiens
cccccccccccttcccccccccttcctcgaggggtggaggggtccccgcccctgggtgggcaggggccgcccctccccggagctccttaggaagaagacaggttggttcattgaatgcccccttttttatttttggtgaggatgcatgcgtggggctgatggtgtttagagtgggggcaacccaataaatcaataaaactca

SEQ ID NO: 580837 - DNA, 99 bp, Homo sapiens
atcgactcacggtgtagcacgggcacaagacgagggcggcgggcggggtggattagaggtcactctcgcccgtacagcgccgtggagaaggacatgtag

SEQ ID NO: 580838 - DNA, 295 bp, Homo sapiens
aaaaatcctaccttcattccattcaaaagggatgaagaggctggatgcagtggctcacacataatcccagcactttgggaggccaagatgggaggatcacttgaggccaggagttcgaaaccagcctggccaacacggtaaaacccggtctctactaaaaacacaaaaattagctgggcatggtggtggatgcctgtaactccagctactctggaggccaaggcaggagaattgcttgaacccgggagacagacgttgcagtgagcccaaatcacacccactgttctccaggctg

SEQ ID NO: 580839 - DNA, 338 bp, Homo sapiens
tcgttgagtaggcatttaacctttctgaagcttcagtctccccatctgaaaaaagaggataataagagtcttccaggctgagtgcagtggctcatgcctgtaatctcagcactttggaaggccaaggtgggcagatcacttgagatcaggagtccacgaccagcctggccaacatggcgaaaccctgtctctactaaaattacaaaaattaaccaggtatggtggctggcgcctgtaatcccagctactccggaggctgaggcaggagaatcgcttcaacctgggaggtggaggtttcagtaagccaagattgtgtgtgaccaagtgcggggatcctc

SEQ ID NO: 580840 - DNA, 538 bp, Homo sapiens
gtgagttctttattaagcctgttcgttcttttaacctttggtctttattatctatagattaggtcctaatgctttggtaatattttgagagccactgctttatatattattgttagtacttggcagtactccttctacaaaggtcctttcattatcctctacaatgcatttctatattacagttttccttctatgaaagtccttacgtgatatgatacaagcactgtgttttgtgcttaaactcttcagcggggtagcatcaaagcttcttggggaacggatcgtatatgtgggtcccttccctagaagaactggttgatgatatggctactgcttctacatcttgagttttttaattatactgtattgtattacagcgtgtagtcacttgagcactgctcctgacttcaagtctggtgctttagccagatgtattaatttccataaatgctctctgtaagagtttggttaaaatgaagattcacttgggaaaacactgcagctttagtctgtgtaactatcttgttatgagtatgta

SEQ ID NO: 580841 - DNA, 265 bp, Homo sapiens
  misc_feature (65)..(65): n is a, c, g, or t
  misc_feature (161)..(161): n is a, c, g, or t
  misc_feature (176)..(176): n is a, c, g, or t
  misc_feature (181)..(181): n is a, c, g, or t
  misc_feature (196)..(196): n is a, c, g, or t
tgtgggtggggggagaaagtttgtggtttttgttcgagggggtgtttggggttttttggtttttnaagtttttttttgttttattggggtggggttttgttgatgtttgtagttgggggagaggtgttttctttttctttgagaagggactttttgaaaanttgttttttataaangaggnaaaagcatttaattnccacccccccaccccccgctcccttctgctccttcaataaaccgaaagatgggttttttttttcaaaaa

SEQ ID NO: 580842 - DNA, 939 bp, Homo sapiens
gagtgcttcccgcagaggtgctggtggtgtggagcggagtgtggtcggtgcgtgtggccgatccgggccgtgggccgtgtggggtgccgggcggcggccgggccggcggacggcgggatgggctgcaccgtgagcgcctgaggacaaggcggcggccgagcgctctaagatgatcgacaagaacctgcgggatggacggacgagaacggcggcgcgggacgtgaagttgctgctgttgggtgctggggacgtcagggaagagcaccatcgtcaatgcacgactgatagatcatccacgaggatggctactccgaggagcgaatgcccggcagtaccgcggcggttgtcttacagcaacaccatccagtccatcaatggccatttgtccacagccactgggcaaccttgcacatcgacttcgcccgacccctccagagcgcacgacgcccaggcagcctatttgcactgtcctgcaccgccgacgcaggcacggcggtgctccacctgcatcgaaccctgttccgcgccgctcaatgccgcacgcgctcctgggccctgacccatggcgtcgtggcacggccctgccatatggccccgctcaagcgcacactacccagcttccacagcacttccagcctgcccctaaggtatccctggaacacgcaagctggcacgccggtactccggcccaacgaaggtgaacctcagcgtccccccagccaccaccccgtccgatgtcgcactaccgttggtaacccccagccgctttgaccagccagccatcgggcgcgcacatccgtctggctgcagacatcaaaaaccattcagcccccttctccacgcgtacaccttagcacaccctatcacacagcaaggcctatcacgaacaccgctaccgagtcttggcgttcacacaccgccgtccgtgtactgtctgcc

SEQ ID NO: 580843 - DNA, 887 bp, Homo sapiens
ctgaaattgagctgcccgtgaagaggcgggcataacacaggcaagacgagaagaccctatggagctttgatatattaatgcaaattcagtacctaatgctaccagatgctgcattaaaaatttcggttggggcgacctcggatgcgagaacccaacctccgagcagtgacatgctagagagttcatcagtcaaagcgaactactatactcaattgatccaataacttgaccagcggaacagagttatcctagggataacagcgcatagtccttattctagagtccgatatcaacaatagggttaacgagctcgatgtttggattcaggacatcccaatgtgtgcacgcgcgctgattaaacggttcgttgtgttcaagcgagttaaagtcctacgtgatctgagttcagaccggagtaatccaggtcggtttctatctacttcaaattcgctccctgtacgaagaggacaagagaagatgaaggcctatcttcagcaaagcgccttcccccgtgaaatgatatcatctcaacttagtattatacccacacccagccaagaacagggttgttaagatggcagagcccggtaatcgcataagaacttgaaagtttaacagatcagaggttcaattcctcttcttaacaacatagaccatgggcaacctctctactcctcattgtagcccattctaatcgcgaagtggacattcctaatggcttaccgaacgagaaattctaggtatataacaagtacggcgaaaggcgcccaacgttgtaggcccctaggggtaatacaaacccttggtgaggcataagaatcttcacaaagaggccctaaaaccgggaatgtagcaataccttaaattacgggcgattaatctacatg

SEQ ID NO: 580844 - DNA, 1064 bp, Homo sapiens
tggaacccggcgctcgttccccacacccggccggccgcccatagccagtcctccgttcacctcttcacacgcaccctcgtgacttgccccaaggacccccgccgacggtccagtcgcctgcgacagaccaccgaccagcacgccgccgcgctactccttagtacgccgcacatgacggacctgcgtccaccttcgcaggctgctgccagaacttaccactcaggacctcagagcgccgcctatcaaccagccacgatcaagcctgcgagctcttacgccctccttacgatttaccgtgtacccatgctcctcaacacagcatctctgaccggccgcactgcactgctgcgcatctcggcaacgcacccatatcgcccaaacaatcacctatctcctatcaacccaactactcaactgacgcgcacgacgcgcgcacaccacatggcactgcacgcacaacgcatcgcactcgacacgccctgccccgccaccccaaaccacgcacgcgctgggccacggaacacctccataaccccatctacaaggcgcagatactccacacgcaccaaccgccccaccgcaccctagccgccacacgcaccactcggcgccaacacccaccgaccggcggaccacccggcacaactgcacacaacctgccgccacacgcccggcctagaccacccacaacacaccttccgctcgccccacaccaccacgagcacactggcccgcacacctacaacgcccaccacccaacaaccacgcgcgaccaacccaacggccacgccaccccaaccccgggccacccccacaccattcggcacaccaacaacaaacgaagtagcgtagcctcaccgcccaacgcttcgagcgaccccggcctcggcaccacttctcccaacatataggaaccgataaactccgaacccaacgtcataacacccccttgggcaaccattgcacaaccccacgccgcatttgcaaacacaccgacccccaaacatccaaaacgcacacccttttgcgcacgtatcgcatccccccagcgggcaaggcaaacc

SEQ ID NO: 580845 - DNA, 366 bp, Homo sapiens
tcggataagccaatagtaattaaaacagcatggtgctgctacaaaaacagacgcatagagtcaatggagcagaattgagaacccagaaagtaaagccacaaatctacagaccaactgtatttttgacaaagttgatagaaataaaaacaacggggaaagaacatcctattctattctataaatggtggtgggaaaatttgctagccaatgcagatgaatgaaactggaacccgtgtatctcaccatatacgaaagttaagccaagatgaattaaagacttaaatgtaagacctaaaactataaaaatactacaagaaaacctaggaaaattgtttctggtttggccttatcgagggggatcctcta

SEQ ID NO: 580846 - DNA, 158 bp, Homo sapiens
atcagaactgaccttccgagttactggtcgggacggaggggggaacccaaaaataccaagtaaaacactacatcatcttcagcttggtcctcttcagcaagcagcacggtaacaacacaatcaccatataagggagcgggcggtggattaagtttgat

SEQ ID NO: 580847 - DNA, 391 bp, Homo sapiens
  misc_feature (108)..(108): n is a, c, g, or t
  misc_feature (117)..(117): n is a, c, g, or t
agtagagatggggtttcaccatgttggccaagctggtctcgaactcctaacctcaggtgatccacctgccttgtcctcccaaagtgttgggattacaggcgtgacacntgcgcccanctagaggaaactttttgagacaagattttgctgtgtcacccaggctggagtgcagtggctcagtctcagctcactgcaacatctgcctcccaggccaagtgattctcgtgcctcagcctcccaagtagctgggacttcagtcacgcaccaccacgcccagctgatttttgtatttttccgtagagacggggtttcaccatgttgcccaggctggtgcctgtaagtcccaactactccgggaagctgaggcaggagaatggcgggaacctgggaa

SEQ ID NO: 580848 - DNA, 989 bp, Homo sapiens
  misc_feature (985)..(985): n is a, c, g, or t
ctttgcaccctggtgagaggattatgggtcaggtcctccacgataggtgattcctgatgtgaggctcaggaaacgccggaatacagctctttgatggcttatcctgtgtggaagtgcaatgagtacgtcttcctgtgctgtcaatgcacctctgtaagccatggtaatcgaatcttgctgggagagaggtcaggaacagtaaagaagaggtctcgataaccagtctgtggtaggatttgcatgaccgtactccattctcccatagtgagtaagcggatgagtcccacagtttgttactggggtataaggaacaagctctgtgatactagtgacatacggtcactgagggtttgactgttcctacgaagcttcatgctcttcttgtcccaagggcacctataagataaggcgtcgacgagattacttgagagagtgctgtagctccggggggtctcatccaccagatcaagtatccatacactctattttatttgactatcctgggaggagtagaacgaccataagttagccgtctatgccattgtattttatcttcagtagagtatagagggaatcctctaggcgaaaatagtcggcttccttttacacagttgtcgtgctttactttcgctcgtaaatagggggaaacgattagtggggtcagttcgcactgtcctatccataaggtgagtctcgcatgtcaccggtgtaccggtgcccgggtctattctaaaagtacttcttatctattattcctttccccctactttcttttttgcacactcgttgttttggccattggtcattcctgtggtaagtccttgaacctgctctgattatttcgtcttcccgggaacgggtgagggtgggtccgaagttttggttcggcgattcgcattctaccccgcggggtggcggacactgtctgtgggccctcaacacttcgttgttcttcaaacctctctcctccttctctcatctccgngggc

SEQ ID NO: 580849 - DNA, 605 bp, Homo sapiens
  misc_feature (3)..(3): n is a, c, g, or t
  misc_feature (5)..(5): n is a, c, g, or t
  misc_feature (559)..(559): n is a, c, g, or t
  misc_feature (577)..(577): n is a, c, g, or t
  misc_feature (602)..(602): n is a, c, g, or t
cgntntcagctgttaataaatatgtgggtaaatatctgtttggggctctcagctctgaagactgtgagacccccaatttcccacttcacacctctatatttctgtgtgtgtgtctttaattcctctagcaccactgggttagagtctctctgactgacctggtcttggcaagtggtgtccatttgtgggggctcatatccaggtcgaagggtcaccagagcaatggttggaatgggaaactagctggaggacacccgagtactcttaaagcaatccctgtcgtgcgtaagaacggggagctcggaagtgtcagggtaacaatgggacaggtatgggggtctggttcatttcaccttggaactttttcacactgggtaattgaggaggaacaagagtatagcgaagtaacagaagaggttacagagcatgtttattttgccagctaaagctaaaagcagcaaaggaaggaagagattcatccctacccttcttgcaccccctcccttattaattttgatgaagatgaccccccaaaatctttcctttcctggaggacacnggggccaaaagtaattgnccccagttgactgtttcgagcaacncct

SEQ ID NO: 580850 - DNA, 215 bp, Homo sapiens
ccccccttttgggggggggcagggtgcccccttcccctttgacacctgctcccgggaatgccaatgagactcctggaaactgggtgggaattggttcaccccacattgagccggggttcggccccgggccccttcccggggcgggaaggggaggggaaaaaaattctccgtctttgggccccggcctcccaaaataaccctttttttggccttta

SEQ ID NO: 580851 - DNA, 1179 bp, Homo sapiens
ctgtgtttgcaatgtgctcgtgtgacgtccttgtctttgtttctgctgtgctgttcgtttgtttcctctcgtgtgtctcttgttttgtcgtctgcagcttgttttggttttgccctttccggtctcttctcttttttcccttgttactccgtcttctcctccagttttcgtttcctggggcgataccttcccgggtcgtgtttcccctaggcctctttgtgacccccttgtacgtgttgtgtcaaatgcggcgtccgtccggatctcggaatcttctaccaagcgtcgattttatttgtagtcttgtatttacttacctctgtcaattgtagaaatttaggctattgcccagatttcagtattgtaaataatgcctgtgatgaccattttgtgaataaatggtttttatgtatttcagattattcccttaggataggtctctcagtgccaagttgtccatacatctctattttgcttatcttcctgctctcttgctgccttagggggtagtaaactgaaacataaagtttacatgcatactaatataaaacatttacctttataagcaacctgatggtaataggtgaaacgtggtaacctgttttaactttgaattcttgccgggcgcggtggctcacgcctgtaatcccagcactttgggaggctgaggcgggtggatcacgaggtcaggagttcaaaaccagcctggccaagatggtgaaatcccgtctctactaaaaatactaaaattagccgggcgtggtggcgggcgcctgtaatcccagctacttgggaggctgaggcagagaattgcttgaacccaggaggccggaggttgcagtgagccaagatcgcgcacatctgcactgccagcctgggtgacagagcgagacctctcgtcgtcacaataataaaaccaacataagatagacaaaataataagcttagacaacttcgtttgctctggattacgtgaccttgatcactggttctctttgtacgagtagcttgggcatctgtatttccactctgtgatgaatttgcctttaaattttggttatgggtttcaccttttaaaataatcaaacatatttatcttttcctgtgtgataggtttttattctgtatcttttcctgttaaacacacagacataccccccaatctgacagtgatatctc

SEQ ID NO: 580852 - DNA, 198 bp, Homo sapiens
attaaaatccccccggtcctttaaaagaattttgaacaatgctgagccggccgctgaaaatttaactcataatttttggtgtagagaaaaagaattccctcttttttttgttttgccccagggaatccttttaataaaattaataactgcccggggtttttgccaggttttaaataaaagtttattttttgcccccca

SEQ ID NO: 580853 - DNA, 869 bp, Homo sapiens
agggcttgggcccacgggcaaaaaagagtgtggcagcagcacgaacacaagcggtagcaagtggacgcagcaagggcccatagacttcccgtgattaaagggccgcaagagacccgcggggatatcctcaagaggactgtgatccatgaacagtcgtgaacaagagttcgtgcgaagagacccccacggggagtccaccccctcaggagtgtcacacgagtcggtcgccccacacggagaatcttggtgaacggacgcccccctgacgaagaactcccgtcgcgcccgcgtaacaacatatgtggatgaccgaggaaagtacccgggtcagaaaaggactcctcggggagctattaccaccacgtggtgtcaaaaaaacagggggaaacaaacacaaagggtgagtaacgaaccctcgcggcgttcttcatagatagaagaaatactgtccacagaaaaagaggcgtggtacaggcagacatatatcccccaccagcgagcgcccccataggggctacatcaggcggcggcaccaccattacagggactaacaccaggagagaaaacaccacaaaagatactggtcccgccgatagcccccctaagttcatcagatttgtggtgcccgggggccccctccgtgcagaccagccccccttgttgtttttcatcctctagaagggcccccaaaaacaggcctcttctttaatacagtagtctattatcttccaccacagtcttaaatacgtcatccaggtagtatcgtgtgccccgcctgcgttgttatcgaataaccacggaaaatctttaaccgcctaggtcagtcaaaacgaagcctttaaaaaaacaggttaaaaaaaacaataaca

SEQ ID NO: 580854 - DNA, 106 bp, Homo sapiens
cagcgaaattgatgcttcttggtattgcgcgtttctcttccttgctgaccctccgaatggccatggtctcgtcgctttaggcccgcctgtttcccggtctcgctat

SEQ ID NO: 580855 - DNA, 648 bp, Homo sapiens
  misc_feature (25)..(25): n is a, c, g, or t
  misc_feature (82)..(82): n is a, c, g, or t
  misc_feature (84)..(84): n is a, c, g, or t
  misc_feature (120)..(120): n is a, c, g, or t
  misc_feature (132)..(132): n is a, c, g, or t
  misc_feature (162)..(162): n is a, c, g, or t
  misc_feature (168)..(168): n is a, c, g, or t
  misc_feature (170)..(170): n is a, c, g, or t
  misc_feature (179)..(179): n is a, c, g, or t
  misc_feature (184)..(184): n is a, c, g, or t
  misc_feature (226)..(226): n is a, c, g, or t
  misc_feature (232)..(232): n is a, c, g, or t
  misc_feature (238)..(238): n is a, c, g, or t
  misc_feature (264)..(264): n is a, c, g, or t
  misc_feature (270)..(270): n is a, c, g, or t
  misc_feature (280)..(280): n is a, c, g, or t
  misc_feature (361)..(361): n is a, c, g, or t
  misc_feature (371)..(372): n is a, c, g, or t
  misc_feature (381)..(381): n is a, c, g, or t
  misc_feature (405)..(405): n is a, c, g, or t
  misc_feature (478)..(478): n is a, c, g, or t
  misc_feature (525)..(525): n is a, c, g, or t
  misc_feature (529)..(529): n is a, c, g, or t
  misc_feature (533)..(533): n is a, c, g, or t
  misc_feature (552)..(552): n is a, c, g, or t
  misc_feature (573)..(573): n is a, c, g, or t
  misc_feature (587)..(587): n is a, c, g, or t
  misc_feature (636)..(636): n is a, c, g, or t
attccccctatatacaggtagtcanctgctggcgtctaaaagtgatgtcggtctgactatagcctatctttattcatctcantntcccagtaacatgtgaagagaaagacttacctgganatctctttaacnagctgatgagagatgatccttcaaccgttnatggtncngaagttttnatgtntgggagaatctgctgactttaccatagaattttgggaatatntttttnggaganaccttttccagttatatcagcgttcntaatgntagcaatcangttgtaaaagcacatattagataaaagctgatcttcagataagttctcagcgtttaaatctttcagcctccaatgctgcantggctgaacnnaaaccggantgttgtattgaagaagtcatacancaagaagtcaaagaaattggaacacacaacatggaaagagctgtgagttatataactcaggctggagaaaaantgtatttcagaaaattcttcaaatttcaggttctcaaaccatttgtntgtntaanccaaattttacaatgcagntactgatgaagtatttctggnagcccagattctgnatattacaacctcacctatgtttattgagaaggtttcactggagccatntattatgtacaa

SEQ ID NO: 580856 - DNA, 232 bp, Homo sapiens
  misc_feature (23)..(23): n is a, c, g, or t
  misc_feature (51)..(51): n is a, c, g, or t
  misc_feature (82)..(82): n is a, c, g, or t
  misc_feature (129)..(129): n is a, c, g, or t
  misc_feature (163)..(163): n is a, c, g, or t
ggaccctgcagaagcagagctcngtatatggcgggaagtccaccatccgcnaccgctcctcgggcacggcctccagcgtggncttcaccccactccagggcctggagattgtgaacccacaggcggcanagaagaaggtggctgaggcaaccagaagtatttntccagcatggctgaattcctcaaggtcaagggcgagaagagtggccttatgtccaccttgaatgactgc

SEQ ID NO: 580857 - DNA, 1222 bp, Homo sapiens
gcgccgtccacgccgctcttgacagtccgaggatcagaaggactgtacatggtgaatggaccaccacattttacagaaagcacagtgtttccaagggaatctgggaagaattgcaaagtctgtatctttagtaaggatgggaccttgtttgcctgggcaatggagaaaagtaaatattatcagtgtcactaacaagggactactgcactccttcgacctcctgaaggcagtttgccttgaattctcaccccagctcctttgtgtggcaccctgatgagtatttaaagcccgtttgaaatgccaaaaaaaaaaaaaaaaaaaaaaaaaaaaaaaaaaaaaaaaaaaaaaaaaaaaaaaaaaaaaaaaaaaaaaaaaaaaaaagaaaaaagaaaagaaaaaaaagagcaagaaatacaagcaagagcgagaagaaatacgagtatcgtcgaagacacaggtaaaaagagaagaaagaagagagagggagagagaacagcaagaaacagaaacgaaaaacgaggaagacaagcaaacagcaaggaaacgagcagcaaaaaggagcggacatcagggagcgacagagagcagaggaggaatgaaacaagaggaaggcagaacaaagaaagagaaaagagaacgaaaggaggagcaacaaaagaaggaggagaaacaagagaaagatggaagagaaggaaaagaacagggaagaaaaagagagaagcgagagagggcgaaaaaaaaaaggaaacaagagcgaaaaagagaagaggcgacgaggcgacgagaagacagagacgaggaagaacgagaacggaaagaaaaaaagagcagaggacaacgagataaaaaagaggagaaaaggaagaaacaaagaaggaagaaagaaggatcagaagagaggaagaagaaacagaaaagcaacgacaacaaagagaaacgaacggagagacaaaagaaagagaaagaagaaaagaaagaacgacagaagacagacaccgagagagagagaagaacgaaagaaaaaagagaacgaacagcacagacagaatagaaaagagaacgcagacaaacaaagcagagacacaaagagaagcataggaaagagagaagagagcagaacagaagcaacagccgaggagcgcataacaagaagaggagagagagataccgaagaatagggcgcgacatccagacgacacgaaggactcacgacagacactgt

SEQ ID NO: 580858 - DNA, 354 bp, Homo sapiens
gcgccgtccacgccgctcttgacagtccgaggatcagaaggactgtacatggtgaatggaccaccacattttacagaaagcacagtgtttccaagggaatctgggaagaattgcaaagtctgtatctttagtaaggatgggaccttgtttgcctgggcaatggagaaaagtaaatattatcagtgtcactaacaagggactactgcactccttcgacctcctgaaggcagtttgccttgaattctcacccaaaaatactgtcctggcaacgtggcagccttacactacttctaaagatggcacacctggtatacccaacctacacctttatgatgtgaaactggggacatgttt

SEQ ID NO: 580859 - DNA, 821 bp, Homo sapiens
  misc_feature (229)..(229): n is a, c, g, or t
  misc_feature (247)..(247): n is a, c, g, or t
  misc_feature (257)..(257): n is a, c, g, or t
  misc_feature (260)..(260): n is a, c, g, or t
  misc_feature (309)..(309): n is a, c, g, or t
  misc_feature (317)..(317): n is a, c, g, or t
  misc_feature (320)..(320): n is a, c, g, or t
  misc_feature (329)..(329): n is a, c, g, or t
aagtaggctagtaggaggccggtgattaatcggccgagggcagctggcggcggcgtgaagtggccggcgagcccggtccccgccggcgaccatgcttcccttgtcactgctgaagacggctcagaatcaccccatgttggtggagctgaaaaatggggagacgtacaatggacacctggtgagctgcgacaactggatgaacattaacctgcgagaagtcatctgcacngtccagggactggggacnaagttctggncgngatgccctgaagtgctacatccagcggcatgcaccatcaagtacctgcncatccccnacnagatcatcnacatggtcaaggaggaggtggtggccaatggtgcctgctggcctgcgtgagtgccattgcatgcatgcatgaatgcatgcatgaaatgtgcctgctgtgcatgtgtgctgtgctgcttggccagatggtgttgttttggttggcctggggccgatggtgggatcccggtgcacaagagcaggatggccaagccatggagaatgaatgcctggtcagacctggcgggctaaacatgtgagctgcctcacctcagacctgggctgctgcgccccctccttgccagggtggcgattcctgctccaccagatctcgggactggatctgctcatgaacaggcaagatggcagtgcgccaggggtggaacccccattcgtgatattgtgacccctcccttttcaggtgaaggccctatacattgcttaaaatctggcactctccggctagaaatgttactggggtttaaggggatgggaaacggctgccaagctggtg

SEQ ID NO: 580860 - DNA, 512 bp, Homo sapiens
gcgccgtccacgccgctcttgacagtccgaggatcagaaggactgtacatggtgaatggaccaccacattttacagaaagcacagtgtttccaagggaatctgggaagaattgcaaagtctgtatctttagtaaggatgggaccttgtttgcctgggcaatggagaaaagtaaatattatcagtgtcactaacaagggactactgcactccttcgacctcctgaaggcagtttgccttgaattctcacccaaaaatactgtcctggcaacgtggcagccttacagtagtaagtattttctcagtgtcagaatactctgacacgatcaattacgtttagtgggggggataagttattaactttataacctcataagaaagtaatttagtctttatgatagtatatagtgtttgtgaatagcttgtgatctacagtgaatcttgtactctccataggatacaatgtattgaacagtacatttgcaaggtatgtgggaagttaatgtaagagcgc

SEQ ID NO: 580861 - DNA, 699 bp, Homo sapiens
  misc_feature (229)..(229): n is a, c, g, or t
  misc_feature (247)..(247): n is a, c, g, or t
  misc_feature (257)..(257): n is a, c, g, or t
  misc_feature (260)..(260): n is a, c, g, or t
  misc_feature (309)..(309): n is a, c, g, or t
  misc_feature (317)..(317): n is a, c, g, or t
  misc_feature (320)..(320): n is a, c, g, or t
  misc_feature (329)..(329): n is a, c, g, or t
  misc_feature (659)..(659): n is a, c, g, or t
aagtaggctagtaggaggccggtgattaatcggccgagggcagctggcggcggcgtgaagtggccggcgagcccggtccccgccggcgaccatgcttcccttgtcactgctgaagacggctcagaatcaccccatgttggtggagctgaaaaatggggagacgtacaatggacacctggtgagctgcgacaactggatgaacattaacctgcgagaagtcatctgcacngtccagggactggggacnaagttctggncgngatgccctgaagtgctacatccagcggcatgcaccatcaagtacctgcncatccccnacnagatcatcnacatggtcaaggaggaggtggtggccaatggccgctgccgcagaggcctgcagcatcataagcatcataaaggccacagcatgggcggcactggccgaggtgtgtttggtggccggtgccaatgtgggatcccagacacatgcatatgccatccatataataatcctggcatacatgctgacaaacagtgagcgcccacccatacccgctgctgcaccccctcctaccaaggtggctaattccactccacaatctcagacagatctactcataaaggaagatgcatgcaccatggggaacccccttcataatttatgacccttcctttangttaaaccctttttcttactaactacccttccatatctgc

SEQ ID NO: 580862 - DNA, 810 bp, Homo sapiens
  misc_feature (741)..(741): n is a, c, g, or t
agcggagggggcatgagtgtatgtttgcattcacatgaaggaattgcttatcacaccagaaattcagacttagtcaatgttggctgaattccttaaagtccaggaagaagcctggacgtagggtccttagcttcgggaatagaaggctacacagataggcacactgtattttgagagcgttgacaacgagctctcgcctttaccctggacttcagcgccaagttccgtctttggtcttggtggataaacagcacagtgtggagatcccgactggtactggcgagtcttacgggatgtttggtagggacgaacgctccctccatgccttcaggagttaggagtgagaatgatcagaaggcaagtatgtcaggtgatggagggcagagtgtcattgctaacccttccaggtctactccagcgctgagatttggtggttctgcatgtgtgatgaatctcgtttcacacgaaatagacgagaggatatttagggctagatgagcccagatttcttcctccctccatctctcaggggagacataagaacctccttcctggaccaaggcaggtgctgccaagttttctagcccgagtgcacatacccagtccttaatgcagacattggtagtgcccatgccctgagtcccactcctgcctcatcccacccttgtccctggccattagctggtggtctagaaacactttagaacttgaagtagtgaacagcctacctacggtcatatngtagagagatgctcaggtgttacaactggaaacactacaaacacatacacagacagcgattttctcttg

SEQ ID NO: 580863 - DNA, 113 bp, Homo sapiens
  misc_feature (71)..(71): n is a, c, g, or t
gacgtagcccactgtacatagtaaagaaatccagtaccccaagagactttacttcagagccccggcttatngttattagatcttttgatgtcaacaaacctggctgtgaaggt

SEQ ID NO: 580864 - DNA, 268 bp, Homo sapiens
ttcttccaacacctcaaacacacttttgcttgagatcatcatggtgctgagaggtacacagcaccgtgtgcacctgtgtctgctctgcaatccaggtcatcagaagcttgtgtgtgtctgataaaggcccttcttgaatttatgttagtctcattgccttcaatgaagcagatgctttaacagcttctgtcactttgttcttgttcttcaagatcatagctatggtaaaatgggacaagcctgactggcaagaaataaccatcacacc

SEQ ID NO: 580865 - DNA, 381 bp, Homo sapiens
cccccgggcccccccggtttgggcccggggtggtggggggccccccctggggggggaatggaggtgtccccccctccccggggggccccgggaaaccccggggccccccccggccccggattgccggcccccggggggggcccccccgggggttcccccccgtttcgggcctttttggttcccgggggccccgggggtcggggggtttttgtcccccggggggggtttttatttttttttttttttttttttttttttttggttttttttttttttcccttttttgttctttttttttttttttttctttttttgtcctttccccgggtttttcagggttggggggggccggggtttggggaagtgttggggagggcccca

SEQ ID NO: 580866 - DNA, 337 bp, Homo sapiens
cagtttgagcaacccaaatctgaaaacttgaaatctgaaatctgaaagagtccaatgagcatttcctttgagtactatgtcagcactcaaaaagttctgaattttggagcaaattgattacagatttctgaattcggaatgttcaactggcaagtgtaagcataatgcaaatattccaaaatcctaaaaaatctggcatccaaaaaacttctgatctcaggcatttttgataagtgatattcaactggtattactatacaaacacaccaaccaaaaaagatagaaaaattctaacagccacatgctattgactgccactcccgtaccaggcctaccg

SEQ ID NO: 580867 - DNA, 648 bp, Homo sapiens
  misc_feature (94)..(94): n is a, c, g, or t
gctaattatcaagcttaaagggtaactttgggaggactcctcccttcactcctagtctcccttggaagagcagtccaggctcagggaagggaanggataggatgacacagtaagtacagaaactgaagctgtcaatagtgaaggaaaaaggggaatcttcgttgctttggcattgacacataagtactttgattaaaaaaaaaaaaaaaattaggggttcaaccatttcaagggattcaattctatagcttttggcagcaagatgatcagttatggcgtgggtaactggcagattctacagaaaagcattttcaaagttctggttggggccatgattgacccctgggaagggaggaaagcaccagtaacaagtggaaactaaagtcctattatcaatggtggactttctggtgcagaatttctggagaactttatagtcagttgggaaaatagccattaaattctttaaagattagactcttcaacagtagctacacattacaaaggcagtatttcaagtgcctgatgctgctgggagtatgcttaatcataatggcttaaagggcatgatcacaaattaaaatggggtaatgagttggccatatgatccatctgaagtccataaacattgagactttaaacggggaa

SEQ ID NO: 580868 - DNA, 114 bp, Homo sapiens
cgcgctgtgttgtaccagtcacctcgactcaggaaacctttcattcctccagtcatgtgcggccgtacaggttggtgaaaatccggtcttcatcctccacgagccccccaagag

SEQ ID NO: 580869 - DNA, 204 bp, Homo sapiens
actatgcacacaaatttcttaaacagtcacctaaagagaaaaatgccagatgtatggtggaaaaaactgtatctaacacctgaaactactacaggactccatcaaatgagtccaccttttagtgataaaaaactactgtactgggcaaacttggcagtcctaaacccacatctactctaacaagtctggaatggtgcataagta

SEQ ID NO: 580870 - DNA, 324 bp, Homo sapiens
gctcgatagacccgagccctaggggcagcattcccctaacagagttaaaaccgacagctctccagtgcctattagatatgggacaaatgtgaagaacggactctgagctgaatgagatcacacttctgagaaccaggctctgcgggctgatcctggcctgccactgaaaccacaccactccccgttctgaaaaatactctgattcccctttctcaactcccttgcttctcagtatacggccgccattgagagagagctacacacccgggcacgtgaccacaccgcctggttgcaacatttctccctatctcagctctgccaagg

SEQ ID NO: 580871 - DNA, 109 bp, Homo sapiens
agttctgggtcccccactcccaactgggctctagactggtactcttaagcttggagaaattttcacatggatgactattttaaaatcaaataaaactattttactgggt

SEQ ID NO: 580872 - DNA, 391 bp, Homo sapiens
aggaccctgtatcgaaacctggtgaaacctgtctctactaaaactacaaaactagccagacatggtggcgggcgctgtaatcccagctactcgggaggctgaggcaggagaatcgcttgaacccgggaggcggaggttgcagtgagctgagatcgcgccattgcattacagcctgggtgataagggtttgatgaccggtcatcgaaaccctctcgctgcgatctattgaaagtcagccctcgacacaagggtttgatgagggtttgatgacagggtttgatgaagtcatcgaaaccctcatcaaaccctgtcatcaaaccctgtcatcgaaaccctaggctaaataccggcacgagaacgatagtcaacaagtaccgtaagggtttgatga

SEQ ID NO: 580873 - DNA, 105 bp, Homo sapiens
agcggagtctgtccttcgggtcctcagcacagccgtgccggcaccggtggccgagctccgtgaccatgaaggtcaaggtcatccccgtgctcgaggacaactaca

SEQ ID NO: 580874 - DNA, 788 bp, Homo sapiens
  misc_feature (495)..(495): n is a, c, g, or t
ggctgatatagtgttcctccactcatctgcgtcccttctccatccgatgaaacccagactgttggtctagacggaaatgaagaccacctgggtgggttagacacggatcacagattcacttctgggcgcagcctagtgcgccctgctgcatctgcgtgctgagcacagagtcctagccatgaagaagtcttgctcgctaacgcgagtagatcgactgaactgctgtgcatattgggaggctgacgcacaagcctaggatgggtgtaccactagtgaccctgcgcaactgcgcttacactacgagtgtgccttgtgtgccatgttgtacgcgtgagtgacggtggatcgccaggatgatgcacaaaatgcatgacacattgcccatgcagttagaaacgcagagacgcaagcggatcacagatgtggatgggcactctgagatagccgctcatacatagagtcttcaaggcgttattgtggcattcaaatcctaanacaacgccttcgcctacgagttgagttgaccgttggatgagaggaaccatgtgtcccacagggtaccagaagacgcgtgtgttgctatgtgcttgaagcaaaatactacaggtcattgatgagggtctggggtcgcctgggaactgaagtttgaccgtggatgtatgtccgaaggcgtgacctttgttcattggtacgtgggatgaggggatggagggaagggcgaggtttgcaggaggtgccgattaagatatgggtgaccttgagaaggatgatgaggaggttggagtgga

SEQ ID NO: 580875 - DNA, 109 bp, Homo sapiens
tttttagttttgtttgggttatttttttttgggcttaactcaggattataaaaactggaacggtaaaggtaacagcagtcggttggagcgagcttcccccaaagtttca

SEQ ID NO: 580876 - DNA, 262 bp, Homo sapiens
gatgttctcctggaccctcagctggtcccaggggttgggccttccgagatgctgtgccaatgctttgaaagaaaattcaaggcatgactcgtgtggacactggcatacaggctgttgccaggccctagaggtcattcctcgtacctgatcagactgtgggcagacatcgtctacttactccttcggcagacaccagagactgtagactgggtgtaatgtagcggtactttgtgcatgaggactggcatatggacattgctgt

SEQ ID NO: 580877 - DNA, 177 bp, Homo sapiens
gatcgccatcatgaacgacaccgtaactatccgcactagaaagttcatgaccaaccgactacttcagaggaaacaaatggtcattgatgtcttcaccccggaaggcgacagtcctaagacagaaattcgggaaaactagccaaatgtcaagacccaaccgatgtcatcttgtattgg

SEQ ID NO: 580878 - DNA, 190 bp, Homo sapiens
tcggtcctccgtacgtggcttcaaattcctggcttcaatgtgaatcctcgcctagcctcccaaagtgctgagactacaggtgtgagccaatgtactgatcttttttttttttttttttttacctttttggactctttggtattaacacttaccttaaaacacatttggtttacagctgtccacaaaatgg

SEQ ID NO: 580879 - DNA, 327 bp, Homo sapiens
  misc_feature (9)..(9): n is a, c, g, or t
cgaggccgntgaagaacatggagaagctgatgttgtagacggttgttgggccgcaccttcccaagccccgccacgaagcccgtttccggccgcgcgatgatgtcaatgaagcccaggatggtgagcaggaaggcggccttggtgtcgggcacgcccaggtccttggcgtagctcaccatgaacacgggcggtacgaagagccccagcaccatgaccgaggcggccacggcgtaaagcacaaagccgcggtcccggaagacgctcaggtctagcaggcgccgggagggtcgcgttggccccgagcccgtgtgagccgtgaccaccagg

SEQ ID NO: 580880 - DNA, 487 bp, Homo sapiens
  misc_feature (2)..(2): n is a, c, g, or t
  misc_feature (4)..(4): n is a, c, g, or t
  misc_feature (7)..(7): n is a, c, g, or t
  misc_feature (11)..(11): n is a, c, g, or t
  misc_feature (13)..(13): n is a, c, g, or t
  misc_feature (15)..(15): n is a, c, g, or t
  misc_feature (239)..(239): n is a, c, g, or t
  misc_feature (243)..(243): n is a, c, g, or t
  misc_feature (260)..(260): n is a, c, g, or t
  misc_feature (416)..(416): n is a, c, g, or t
angnttngcancntngtatccccaaactgccactctaaactcttgaagtaaataaataatctttgccggcaggactatgctgaatctccttaggcactctctaattagatggcctaggtcctcccaattcttagtccttttatacctgtttttcgccttctcatattccatttagtttttcaattcatacaaaaccccaggccatcaccaatcattctatatgacaaatgtttcttctnacanccccacaatatcacccnttaccacaagacctcccttcagcttaatctctcccactctaggttcccacgctgcccctaatcccacttgaagcagccctgagaaacatcgcccattctctctccctaccacccctcaaaaattttcaccaccccaacacttcaacactattttgntttatttttcttattaatataagaaggcaggaatgtcaggcctctgagcccaagccaagccatcgcattcc

SEQ ID NO: 580881 - DNA, 201 bp, Homo sapiens
gtgctcttctatatctacatgagtaagcccagtgctgtgtagaggtagtcgacacgcatgtctgtcaggtggactgattgtatacccaaaatggaaagtggctcgctcgtgtgattgtcagcatgacgtgtaccgcactaagcttcactagcttccttacgctactgtacccaagtggagaggtcattgacgacgctgtag

SEQ ID NO: 580882 - DNA, 1245 bp, Homo sapiens
  misc_feature (1245)..(1245): n is a, c, g, or t
gtcttgtggtgggggagtcgcggtaagtctgtagcccctgctcgcatcgtgtcaacgtcacctacagtgacactgtcatgactccctgaggagaccccgggtcccaccgccggtctccaccctgtgcggtcgccgcctgccagttcctcgccacgtgtctccatcgctctctcatccctgggacccctaaggcggccgatgggcgaagatccctccttcaccgcacgtggtcggccttgtgcgtgtactgtttttcccaccccagagaatcccgtgcgtccccagaccttgtcactcccgtccagcatgctaaagacgcgtatttggcaagctgttgcctaggcttgtctagggacggtggtgtcactccagctagcatccgcgatagatgacgatcggatagcttcttctctatcgctaggttgaaggaattcgatgctgcccatatcgcatatgcgcctactaccttgactatgctcgaacactcacaaaaggctctcgggcggaaaaagcgatagccattgcaatttccagttctgtgtggcggcggggcaagtcactgtgagtaggacgtttgctacccttgtggctgtgcgcatgcgattgagcttgcacagatgacagcccttcacttccccggtttgagcacgctcctctgtttgtgctccccaagaaggtcggggtacggagggactccttagagccagcaattgggagattcggtcccaagtcctcgaaaattcctcctttccctaggtaccgccccattcgtttcccccgctccggcttccgcggcagcggctatatttgcggctcccccatatgttgcggtgctcctatacttgtccggttaggtccggttccacaggacagaacggccaattttggaacacacgccaatgtgagcgcagtatggggtgtgggcgcgctcgcacagaaggcggcattacatatgctatgacgctgttgttcggatgttccggacagattatgccgacagaaccattgctattcgtaggaagatgtggcttcatttactcattgaaagctgcgcttccgaattttccacgcatgcctaagctgttatgacaccttttgccccgttcccagtatgaagctcccccccatatcgtgggggggccccaccccctgcgaacccgagaacacaacacgcggcttcctttccccctttttacgcgaatgtgccggcattgataccaccgattaataggttataaaggaccn

SEQ ID NO: 580883 - DNA, 106 bp, Homo sapiens
ggagctcaaaaagtggggatgagtttgaagatattttagaagagaggaggcatgtcagtaacttgaaatttccaatgaaatgctacacacctataatctataaggg

SEQ ID NO: 580884 - DNA, 975 bp, Homo sapiens
  misc_feature (721)..(721): n is a, c, g, or t
  misc_feature (742)..(742): n is a, c, g, or t
  misc_feature (782)..(782): n is a, c, g, or t
  misc_feature (843)..(843): n is a, c, g, or t
  misc_feature (865)..(865): n is a, c, g, or t
  misc_feature (867)..(868): n is a, c, g, or t
  misc_feature (883)..(886): n is a, c, g, or t
  misc_feature (888)..(890): n is a, c, g, or t
  misc_feature (913)..(913): n is a, c, g, or t
  misc_feature (920)..(920): n is a, c, g, or t
  misc_feature (930)..(930): n is a, c, g, or t
  misc_feature (950)..(950): n is a, c, g, or t
  misc_feature (954)..(954): n is a, c, g, or t
catgtacaccaggacctacggacttatctggacaaggcacccccaccaggcttgccagtcgaaacgatcaaggatctgatgcgccactcttctaacaggcctagatttccttcatgccacattgcctccgtgtcaccgagcatctgcaagccacgaggaacattcctggtgacaagctggtggtaactagtcaacgctggcgtgacgtttggccttggccaggtaagtctacaggcttaccagactggcagcttacagcaccgtgagttagttagcacttgctggatacgcgacgcatccccgaagttcttctgcagtccacatatgcaacacctgtgtgcacatgtggagtgttggctgtatctttgcacagatgtatcgtcgaaagcctctcttctgtggaaactctgaagccgaccagttgggcaaaatctttgacctgattgggctgcctccagaggactgactggcctcgagatgtatccctgtcccgtggagcctttccccccagagggccccgcccagtgcagtcggtggtacctgaccatggtaggagtcgggcagcacagttgctgctggcaaatgctgacttttaacccacacaagcgaatctctgcctttcgagctctgcagcactcttatctacataaggatgaaggtaatcccggagtgagcaatggagtggctgccatggaaggaagaaaagctgccatttcccttntggacactgagagggcaatcnttgcctttatctctgaggctatggagggtcctcctccatntttctacagagattactttgctgccttaatgacattcccctcccacctctccttttgaggnttctccttttccttcccaattntnnacactaaggggtatnnnncnnntgtccctttccccacctttaaanttggggnccttttttanacaggaaaaacaaaacaaanaaanaatgtcttttttttttaaaaa

SEQ ID NO: 580885 - DNA, 318 bp, Homo sapiens
acgtggaagccctgggtgggcgtcccctggctggcctggcttttgggttcaagtctgtatgtatggagtgggttggggcccccaagctttgctgctattgatttgtccccgacagcaggcaaagcctcccattgccctccattttccccccttcatttgaagggcccgtttttcatgggacctgtcttgatctttttcatagggttccaatctgtatttttgtatgtaaagggaaataattttttcccccctaatcgttaataactattgtatttaattgtcctgaaggaacctgtttaataaatggacgggtaagga

SEQ ID NO: 580886 - DNA, 233 bp, Homo sapiens
tgccatcacagtagctcgtacaccgcgttccgtccgtatgccccagtttgctccatatgcctcaattttctccgtacgctccactagtttcctccatatgccccaaagtttcctccatatgcctcaatttcctccgtacgcccgacagtttcctccgtatgccccagtatcctccatacgcccaggtatcctccatacaccccacagtttcctccatacgcccaggtagagca

SEQ ID NO: 580887 - DNA, 942 bp, Homo sapiens
agggccgcctgggggcgtcgatgagtggccggcgggtgcacgcccgctgttgtctcgcagaggggggtcgcgccgggggttgtgtctccgcggggccgcgggtcgcgcagcggtggtctgtgttgccccgagtagttcgtggcgtggttactcatccgaccctggttcgctatgatggccgctggcccctcttcacggcgtatagcgtgctgccccgcgcatactgtggccctttaacatgcgtccgctggggccgcgcctcttcggcgcggattgggggcccggttcacattgcccccgtgcttagcagggcctgaatcatggcgattgtaaggaagcgcgtttgggtgcacgaattgatcctgtgctgaccgccctgtagtgcatatgacccccgggcggtgctacaaagcaggagggcctttccttctgagaggtgcagtttaccaatgggcgggatctccccccaagcgtcagagttataagttgctgggtcctgcccgcgtgctacgccacgggcgattacctcgccttctctgtcctagtgcgtttcgaaaacagagtggaaccttttctcataatggaggcgagttcaccaccggcgaggatccctttctataattgtagccccccactcttcatgagtccattaacaatagaaagcccccccccccactatgtcacccatgtatttatgtcatcctatggacgcagacaatatgggcagtgggatgaatacaccccccaccaaagtcaatttgtaagggattttttttctataagcatattcatgtcatacaattcatatagggaggcacaattgtattgatcacaaaacttatctgatgtatcccccatggctccaaaaaacacaaccaatacttagttgtttttctttgggaaagatccctgaaaccattcattgttactgaaacaaagaaa

SEQ ID NO: 580888 - DNA, 799 bp, Homo sapiens
  misc_feature (378)..(378): n is a, c, g, or t
  misc_feature (414)..(414): n is a, c, g, or t
gcgaattcgataaacgggtataccatgggcggggggttcattaacaagggcatcaacaggtggcacacttcttcccttgtgcaaccccggaagacaagggagcaaggccaacacgatgaatcaaaagagaactttctgaggcctggatagtcacggcataattggcgaatcctgggaatgaagcctctggtatcactctgggtcacgggaaggtacgtgggtatggcaagaaagccccgggagggctaattctaattcacaaggctggtagaagaattgagggaagcacaaaccacaaccggggcttcctaagaaggggactgggaggctgaataggtcacggcacgggttcaatccctggaaaaccacaagaacaantgacgaatcttaaccctgtgtctgggtccgggaacnttccaatcccctgtgagaatgggctgaatgaaagaactcttcggccctttcctgcgttcattcattaaacctgggtcccacatggcgttacagccagggggattccaccatttaaaatctgacccaattatctccaagcgtccctgtgaagatgggcggaatctattccagaacgaaccaacatggcttaaggcccacaattcccatttccagtctaaatttctgaggaaagggtcctttaatgaatctcggtccaattgggaagcgttcttttaaggtgggaatctccttttgaaattcacagggtggggtggtaccagggcgtcctcttttaaagcattacgggggtcccttttaagagcttttcaatctttcaggattcttg

SEQ ID NO: 580889 - DNA, 945 bp, Homo sapiens
  misc_feature (10)..(10): n is a, c, g, or t
  misc_feature (30)..(30): n is a, c, g, or t
  misc_feature (35)..(35): n is a, c, g, or t
  misc_feature (37)..(37): n is a, c, g, or t
  misc_feature (51)..(52): n is a, c, g, or t
  misc_feature (75)..(75): n is a, c, g, or t
  misc_feature (121)..(121): n is a, c, g, or t
  misc_feature (123)..(123): n is a, c, g, or t
  misc_feature (132)..(132): n is a, c, g, or t
  misc_feature (141)..(141): n is a, c, g, or t
  misc_feature (144)..(144): n is a, c, g, or t
  misc_feature (147)..(147): n is a, c, g, or t
  misc_feature (153)..(153): n is a, c, g, or t
  misc_feature (156)..(156): n is a, c, g, or t
  misc_feature (194)..(194): n is a, c, g, or t
  misc_feature (205)..(205): n is a, c, g, or t
  misc_feature (209)..(209): n is a, c, g, or t
  misc_feature (218)..(218): n is a, c, g, or t
  misc_feature (254)..(254): n is a, c, g, or t
  misc_feature (259)..(259): n is a, c, g, or t
  misc_feature (267)..(267): n is a, c, g, or t
  misc_feature (282)..(282): n is a, c, g, or t
  misc_feature (284)..(284): n is a, c, g, or t
  misc_feature (288)..(289): n is a, c, g, or t
  misc_feature (297)..(297): n is a, c, g, or t
  misc_feature (317)..(317): n is a, c, g, or t
  misc_feature (320)..(320): n is a, c, g, or t
  misc_feature (327)..(327): n is a, c, g, or t
  misc_feature (335)..(335): n is a, c, g, or t
  misc_feature (451)..(451): n is a, c, g, or t
ttttttttgncttttcaagagcgatctttnatttncngaaagtcctaaaanngatccatttatcaaaagatgatngatgccccagttcacaaaccatatcttttctctttcagcaaatccngnagccccaanagggctganccngantgaagnggngacatcagaacctgccctccacacccaacagctgggantgcagcctccngcanggcctgggnggatgtgcctggacctctctcggggacagagtccgntccangtgggggnacgtgatgcggtagnangggnngggtctgnggcgtcttgggatgtacaanctngtctatnaggatcancctttcccaccaggtctcctccaatggtccggactaagtcatagaaatcatttcctggggaaattctcagagggcacccagatatggaaatatcattggatcacagccgggatatnggtacaaaggctggaaccttcaccttcctggattaatggttgggatacccagacctggtccaggaaagcgctcgtcctccaccaccagaagagacgggatactcagggaggcgacaaggctcaggggctagctttctaatccaaggcgcaaaaaagcccaaggccggaatacggttgctgggagccaccacgcgtgaatgacacaggctgggtgggtacaatcaaacccgggaagaccaaaaaaagtacaagccagtgtgtccatgaaaagtggcttcccagacgcaacggggagggcgggttaaggggcagagcaggtaacgagtgtaatacacagacctaggggtggaaaaagcgaggccccagggggaaacagtgggtgcggggcgagagacggctgcatccccccctgcacgacttcggtacagccaggggaagacgagagcacaatgagacaacaggaatgaccaccaggaggatagaaaacgaaaaca

SEQ ID NO: 580890 - DNA, 452 bp, Homo sapiens
  misc_feature (272)..(272): n is a, c, g, or t
  misc_feature (419)..(419): n is a, c, g, or t
gactcattacactatgctgtcagacacagtgtgacagctctgagggtagcacctttcacaccttctgtgtcaccagcacactgtggacacttctactgaagccatttcatcttctgaacttttgacagcaccaccatgtctgtgtcaatgcccatggaaataagcacccttgggaccactattcttgtcagtaccacagctgttacgaggtttcctgagagtagcaccccttccatatcatctgtatacaccagcatgtctatgaccactgnctctgaaggcagatcatctcctacaactcttgaaggcaccaccaccatgcctatgtcaactacgagtgaaagaagcacttcattgacaactgtcctcataaggcctatatctgagatgagtccttctgaggccagaacactatcaanacctcctggtgataccagcacacctttgctcac

SEQ ID NO: 580891 - DNA, 991 bp, Homo sapiens
cgtgcgcgtgtcaggcgtgtctctccgcgtgtcacccacaggccgcccgcagaccacccccgccgcgcgcgggacacgacgccccccgcaggaccctggcccatcagcccggaaacccctgagctgcttctcccgtgaggccagatgcccaccctggtgagccccccaaatgactctgctggctccctgtggggtgcaccgtgcatactcaccccgcctggtgcctggtgccccctggtgagcctgaccggcaggggtgtccccaggcctgggcctctagtgcaaaagatttagcccctccagtttgagggactcctggtttccctgacaccccgatttaacgtcacagacacacgattcctgtggcagctgcagggactggcgccccgatggcctcaaaaccacgctgccccgcgcggacctcacgtggccattgcgcctcatgcctgggaccccacgaaggcaagaggaccataggaacgattaggtgctcctgagcggacttgatgtattgcatcattccgcaaagtgctcccttcccttgagggcagccaatagaaagcgcttacattggagagaccgagtccctatacatggggcggcactaaatgccgcgtaaagtggcccccaaaccctatagttgacaccggatcgttatttgacggcttatacgggaggggcaccaaaacgtttggcaagaagaccggggtggatatgtaaggagaaggggggacgcattattgcaatgaagtggaaagaccgcaaagtgggattgaaagtgatctatggatagattacgcgagtcagactgtagtgggcttccttttgtgataagcgtactgtgttgtaagtgaaagctttacatgtatgtgaagtgagatgtggaaggaatgaacgatgtgtgtgacacgcaggatgtatgtcgttttagtatgtatatgtcatatgagttgtatgataatttgtgtgtagcgaaagtagcgtatgtatc

SEQ ID NO: 580892 - DNA, 154 bp, Homo sapiens
tcatgcacagttattgtgaactggcccagcactaaccctgcggagggacttcaatcacatcaatgtagaactcagctttcttggaaagaaaaaaaagaggctccggagttgacaaatggcggggctaacagcaaagcgaactggcctaccgctt

SEQ ID NO: 580893 - DNA, 366 bp, Homo sapiens
  misc_feature (97)..(97): n is a, c, g, or t
tggttgttcaaacccctagtgagcttctagtcctcctgagggggttttgtggtcaggtaggaagcccagggaccttccagctgggcctgcattcccntaatcagtgcccccaagccaccaggggtacccaagccctgaggcttcttggggatcctggcagggctgggttgcttcctgagtgtctcccccgaaagcctgatgtcttgagtggacttcaggcctctccaattcccttacacctctaaggtgatgcctggtagtgggtgtcagcagcctgtcattttatttttatttatttacttttagagacagtatcttgatccattgccccaggctggagtacagtggtaccattacagtcgacgc

SEQ ID NO: 580894 - DNA, 412 bp, Homo sapiens
gtgctgcagccatgcacaggcacgcgccatcatcagtgtggccagtgcacatcatcacctgctcatctcccatctccagcaggtcgtctctcacttttcccgtttggccctttccagtcatcagcatgtgcatttcatgcattctcgttcacagcattgttttgcttgcggcagcatctgcatgttcatgttgccagtctcgttggtccacaatgcatgctcagttggaggtttacattttccatttcaatttttcacaagtctgttctagtgtagcagggcacattcaggcaaagcagcacaacaacatcatgttcagccattttcaatccagggcacattcacagttagcagtccagactcaatggcaaaattccattgtgctcaacagcacacagcaagcacaacattt

SEQ ID NO: 580895 - DNA, 94 bp, Homo sapiens
  misc_feature (11)..(11): n is a, c, g, or t
  misc_feature (91)..(91): n is a, c, g, or t
gctgtgttcancgccttccctcctgcaggcaatcttggacaagttgagcttccctgcggccaggtggctctgcaccgtccgccagcgcctnctc

SEQ ID NO: 580896 - DNA, 541 bp, Homo sapiens
ggcgaggccggcgcggccccgctaattacataagcgggacgtcaataattcgcgggaaaacgcgaaaaagatggcgccccgcgcccggggggccccttcctgagcgccccgggaatggccgacggaatccgcaggagacaccacggcgcgaggacacgaggagacgaagaaaacacgagaagaaagagacaacagcatgaaacgaaagaaacaggagagacgaaacgagaaagaacaagaagagacgcacaagaagcaccgaagagatgaggagaacaacgacgagaagaggagaggaaagaaaggaagaacgcaacgaaaaaaagagaggaaaagaaagaaagaacaaacacaaagaacagagaaagaacaggacaaaagaaacggacgaaagaagagacaacagaaagagagaaaaaaagagaagacgagagcaaacaagaaggaaacaaaagaaacagagcagaaaaaaaacaagacagagagagaaacaaggaggagcgacagcgcaaaaacgagaaaggaaggagacaaagaagag

SEQ ID NO: 580897 - DNA, 175 bp, Homo sapiens
gatatgccaaaagaatatagatgatagtagatatattttattaatagaagggttcatgaatcggagataacaaagtttacatgtgctcagaataataaattatcgtgtctgcattttcttacgataaaggaagacacacgatgctcatccggaaatcagcatacttggcatacat

SEQ ID NO: 580898 - DNA, 606 bp, Homo sapiens
  misc_feature (330)..(330): n is a, c, g, or t
  misc_feature (473)..(473): n is a, c, g, or t
  misc_feature (491)..(491): n is a, c, g, or t
ctatggcttttgaattaattgctgccgaagaaaaagcccaatcaattcgtgcgcatcttgtgcgacttgcagggcagctggcatctcgaggaaaccatgaattgcaccaggatagtttctaattaaaaccgaggcacccgcatcgagcaattcgcaaccatagcgcaatccttcatccctcaacacgtcagctcccgcggtcagtattaaggcaggcaccgatgtccggctttgcacaccaagaataggcgacaggcgaatatcttcgtttaatgctttctcatgcgctagatatgcggcaacgttgcgcattgcctgcaccgtaagagnaggcacttctgcattcgtttttcgtgatgcatatcgctcgtgtgccgattcccggttatcaacgctaggatagattaggacctgagcgcggacgggcaattgttcgtcacgagcagcgagcgcagcatacgcagccaaccctncacctgcactgtcaccgncaacggctagggcgcccgagattcgcaggaaataagctttgtccacaacccaacgcaccgcagcgatcgcatcgtctgcagccgctgcagcggtgctcaggcgcaagccttaccc

SEQ ID NO: 580899 - DNA, 187 bp, Homo sapiens
gtcgaactgaccaaagtcatcatcatcatgaccatggtgttgctcagcaagactgctgactgtttctggcaagaacagcgctcggccacatcctgcagaagccctcaaggaccatagtacgcaccacctgacaccgatgactgcagccgcgagcagagttggcgcccagcctagtcttgctgcgaac

SEQ ID NO: 580900 - DNA, 224 bp, Homo sapiens
gttaggaagagagtagttcagacacgttaggaagagagtagttcagacacttagagaaacatttttgtaaaaaaaaaaaaggagagtgcactcataaaaccatcacatggtcttagcctcataataattctttttggagacccggaattcagtgtgggctctgccaagagctcagagatccagttaaaaggcagactaactgccttttaactggatctctgagc

SEQ ID NO: 580901 - DNA, 87 bp, Homo sapiens
cagagtctctcctcagagggagcactcctcaggagtaattctcctcaggggtaacttctcttaaggggacccttctgtcgtcttctc

SEQ ID NO: 580902 - DNA, 740 bp, Homo sapiens
  misc_feature (670)..(671): n is a, c, g, or t
  misc_feature (724)..(724): n is a, c, g, or t
ccttcggatggcgtttctgagtggacgtcctttttgttgatattgatgctatacctttctgtttgttagttttccttctaacagtcaggtccctctgctgcaggtctgctagagtttgctggaggtccactccagaccctgtttgcctgagtatcaccagcagaggctacagaacagcaaagattgctgcctgttccttcctggaagcattgtccctgaggggcacccgccagatgccagccagagctctcttgtatggggtatcttttggcccctgctggggggtgtctcctggtcaggagacacaggggtcacggacccacttgaggaggcagtctgacccttagcagagctcgagcactgtgctaggagatccactgctctcttcagagctggcaggcagggacctttgagactgctgaagctgcacccacagccagcatttgccccaggtgatctgtcccagggagatggcttcatctataagcccctgactggggctgctgcctttttttcagagatgccctgcccagagaagaggaatctagagaggcagtctagctacagtagctttgctgagctgcggagggctccagccagttgccatttccctgtggctttgtttacactatgaaggggaaaaccacctgctcaagcctcaagtaatggnnggatgcccctccccccggggcaaagctttgagcatcccaaggtcgattttaanactggttgttgctggg

SEQ ID NO: 580903 - DNA, 972 bp, Homo sapiens
  misc_feature (474)..(474): n is a, c, g, or t
ccagggttaaatgatttgaccacgttcatacagctagtaaaatggtagtacctgaattcaaaccaagtgtatatgattctaaagtatattcacttttctccacacaccaacatagtttaaaaaacaaaacaaactcaggaatgagaacactcaagaaggcttagttggtagtaaccctttacttgaagtcaaaacttaagcaataagctgcttccctgatagcttaatgaatatttatgtgtatttgctggcttttatatgcaaattttacatgtttcctttgtaaagattttgggatcctaaagaaccttctcataactgtactttgtgcgttatacagccacttgcatttccttcatggcacaactcactgtgccttgtattttagttgtgtccatatctgtctagcttggaagctctagaaaggtaaggccatgttgtcttcatcattgtggtacttgccatgcctctgtntttttcatgtagcggacattaattgttcagtaaatattttatactcgaggctggaaattaatcatcacaacaccggtaccttgcaaaaacaaggggaagagcagagagaagtcaggaaggatccttagggaaaagctagaggaatgaagcttgaagcagccattttcctcaagattttcacaaccagttgatgcttcttggcccattctcccatttataggccagggagaaagagtcaaaggcatgtgtaaggaaaaataagttcccagttggccccctcctcgtacttgtaggtgaatttgtcattattgtgctgtgtgtggaagcacaagaaggaaggaattaactcgttcttcagaactgctgattgaggagctatttgctggaagtaccacaagtaggcagagccaggttgccttttaagagtaatcattttattagccaaaaatctgggagcactccacatattgaatgccttaatggtcatccactctggaa

SEQ ID NO: 580904 - DNA, 991 bp, Homo sapiens
ggccactcctactcactagctagacaaccttagccaaagcgcatttacccgaataaagtataggcgatagaaattgaaacctggcgcagagtaagatatagtaccgcaagggagggatgaaaaattatagagcaaggcataatatatgcagaggactaacccctataccttctgcagtagctgaagttagactagagagagtaacttctgcaaaggagatgccaaaagctaagaccgcgccgaagaggccagacgatgctacctaagagagcagctaaagagagcatcgacccgtcgtatgtaatggcaataaatagtgggaagatttataaggtcagaagggcgagggaagggtaccgcacgtcgtgggtgaatccgctgggttgtacaaggataccgagtcctagttcaactttggattggccatcgagaacccttctaagaaatctccgcgtggtccagtggtgaactcgtagagcttccaaatgaggaaactagctctccgtgacagggggagggccacttgtagagagagtaggaatctggaatagcccatagttaggcctagtagcaagaccacagaacttgatgaacagcgtacaagtctgcaacactcactaggtagtaacatcccaaacatatacactgatactcctcacaacctagatttgtgacccaaatctttcagccctgactagaagaaactagtgtgaggaataacgtaccgatgaccaacagtctcctcggaataagctgagtcagatcaagacaactgaacatgaaagattaagaagccagtatctacgaatcaaccacacacgtactgagtcacctaatgatcaacacaacagggatgggaacatacagaaggtacaaagtacaggccaaccgacacgtaccgcgtataccacaaacaacctgtagagacaagaaaaaggaacacacacgacaaggacagcacgaccaagagacggcgtcgtttttatttagg

SEQ ID NO: 580905 - DNA, 112 bp, Homo sapiens
ttcttgatctgctgcatatctgggcgtgttcggtgaccatgttgccgcagttcagccatcttctgcagcagtttggggccatgcactggaggggcccacccacatgactttt

SEQ ID NO: 580906 - DNA, 655 bp, Homo sapiens
gaaaagaattttttaaaccatacttcgatttaagagcagcgtaccctaatcgttgtactacttttccgttcaaaatttccatgaaacatatggatttcagttaccaattagtaaaagttgctaaaagtttagataaactaccacatctttctgatggtctgatatttactcctgtgaaggcaccttacactgccggcggaaaagattcattgttattaaaatggaagccagaacaagaaaacaccgtggacttcaaattgattttagatatcccaatggtggaggatccttctttgcctaaagatgatcggaacaggtggtattacaattatgacgttaagccagttttcagcttatatgtctggcaaggcggagctgatgtcaattcacgtttaaaacatttcgaccagcctttcgataggaaggaatttgaaatattagaaagaacatacagaaaatttgcagagttgagcgtttcagatgaggaatggcaaaatttgaagaacctagaacagccattaaatggtagaatagtagagtgcgcaaaaaaccaagagactggggcgtgggaaatgttaagattcagggatgataagttaaatggtaatcatacatcggtggtccagaaagttttggagagtatcaacgattcagt

SEQ ID NO: 580907 - DNA, 872 bp, Homo sapiens
  misc_feature (872)..(872): n is a, c, g, or t
gccccaggcccgttctgctgtggcttgtgtgtcctggggctgcagtcccttacacgagcaagaagatcattgacagggacctgaaggtgggataagccttctggcaggatgacccagggattcctgaaggatcgcacgacttttgagactctagcacaggaagggatcggattcaggggacctggacttagccaccgttctgtggcacgcccggagttcctggctaacctcggaggtggctgaccactaggaggcatacgacacagggactgtggactggtgggcggctggtgtgtgctagctctactggaagatgctggtggggtgagtgcccgtttcccgagggggacacgaggatggaatgaggtgtctggatcgtgcatcgtctaggacaggtgtgactgccgcccttacgcctcggtctttctagttcgtgggctagagggggcttgaggttacattccagagacgcatccgtccgagatagttgccccgagagtaaagccagcctcagggggcctaggtgacgccaggagtgcccgaaggcatgatccgaagtgtccagaccattctttgcagtgaccagccgaaacttggggcaacggccgcttgacttcttggccgcggcagtccattgcccagtgccgcccgctctttccgtttgaccttacgccgtcgtggttgggcccccttggccgggagcccgtcgtcctcgtaactatgcggatccggggcgaacgtttcaaccaaggggacttgaccgggccttgtccgcttgggactccacaaccttggcctttcccctagcaggacctttcactcacataggtcctctgcgcaaatccacggagccggccctattcccggggaan

SEQ ID NO: 580908 - DNA, 317 bp, Homo sapiens
tgaccagaggaccccattggatagcggataagggcgatggagggtgcgaggtcttgcaaaagacgaggtttaaatgcctgtttctattttaccagcagcgaagaaatgagagtcgagttgagaaaatgctcatttaagacagtcagtcacgggacagctgtatactcaggaccagcctgtcatcgataagtccaagccctgggtactgctgctggagaggcaaaggaacaatcttgcctttcagggccgtcggaaagctcgagatattctccaggcattgggttcctcatagcggttgtacaaagggttcaagacgc

SEQ ID NO: 580909 - DNA, 369 bp, Homo sapiens
agtgtcatctttgaagatccttataatattagctcttacatttagttcttaggtcacctttaagttaattttaatatccaatataagtgtagaagtccaatttcattattgcgcatgtgaatatccatgtttccaagcctcatttaatgaaaaagcctattttgcccccattgaattgtcttagcactattttcaaaactcagtttatgataaatgtgatcaatatttgtgaaccctcaattatattggtatttcactctttctaacgctgtcaatttttctcttctcttttgtgttttttgtgagtcaatgtctatctgtgtcatacagtctggactacagctcgtgccatattcctacagcccgggg

SEQ ID NO: 580910 - DNA, 191 bp, Homo sapiens
ttgatctagactccgaccatgagaaagagagagatacaggaagtcaatgtaaatggcagacaggccagctcggtgggttcacattacagctacctaaggtggggcttaatttctttttcttcttcttcttcactatcatcaacctgttggatgaccagatcagcagacccatcttctacgatcaccaccag

SEQ ID NO: 580911 - DNA, 175 bp, Homo sapiens
gggaaaaaataggaaccaacaggaaggcaagggcaaaagggttaagggttaggaggccaatgggaccccccaaagttggggaaaaaaaggaacattgggtggtttggtgggaagtaaggtccttgtttgtttccagcacccagaatttcattaaaggttatttattggacctccc

SEQ ID NO: 580912 - DNA, 1170 bp, Homo sapiens
gcagcggtagcccagtgtctgagtggttgccgggtctccatggaggaattcggctcgccagtgtcccaggctgtctgagctctcgccgccctgagaccccgccggcgcggtcgcagggccatgctagccttgcgcgtggcgctcggtctcgtggtggggccctgcgcggacgctcgttgggctccgggaactgcggacgagtaagcggacgcgaccttgatgggccctgcgtgccgtccgtgcccttgcatgcgttgggctgcactggacgaacgctggaggcttgccgtccggccctctcttgggcttgcgtgattgccccggggtatccgtgctcaagctggagaaacccacgttgtatccggggcctgccgggtggcaaggggctgggtttcccatgtgcccaagtgggcgcgggaagccgggtgctgcacggtttgtccgggaagccgccctcggggcggggccaggttgtgcggccaccggtcgagaaggtcagaccgcccacaaggacctttgttatttgacaaacacgcccagtggggagccaatttcacctggaaagtatttcgttgggtccgaacgttgaccgtagagaaacttttggagctttttgggacgcccaagtattcttggggggcctatttatcgagtatatttgcgggacggaaacgcacttttcgacaataatttggggcagctaaatggacggatatctattggcgctatttacagctttggcgaactttaaaccacagaacttatgaggtaagaggggacgtgggcgcatttggtaatttgaggccttcggagagacacctttggggggcccaatattcgacaacaggatttcaggccttttaggggagacaaggttggcttcttttggatttcgcaactttttggcgttggatttagcacacttacctttagtccagggtaattccttaaataggtggcttaacgccttgtgacacccttaatcgccagcaattctttagattttcccaagttttcgccagcctttgactttgaggtattgcactcgcattatccacacgtgcagagccgtgctcaccgctgcatctgacacctggcctgggccggtatgcccaacagcaactggcttccggcaactatacccgctcacccgttcttctcccccacacc

SEQ ID NO: 580913 - DNA, 356 bp, Homo sapiens
tgacatgataaatcgagctcgtgtacctgttgtgtagcacagtacaggaacgggtcaggcttggggagagccccaagttgagaactagtaagtgaacaattattgtatgaacaacttgttagatgacagctaatcatcaaacaacctgtgtgcaatattatttccataaaacaacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 580914 - DNA, 931 bp, Homo sapiens
tcaaagcccacagaatcccaaaacgaccaagggtgagccaattccccttcgccgtagctaacctagaagacggttgatcctttttccctcgggaaaacacccttgggaacgaattgggtcccgccaacccctgggcgtcgaacatccggagcagaatctcccgggacaaacggacgttctcccacccggtggcgaacacattggcgtggcttccgcgtttcgtcccgcgaaaaggtgagagcagccgcaaacatcacttttcgatgaaaagaacacccctgtcacttgagttacaagaacccaccacaaccccttcgtaagggtgggacacccccatgggaaccacccctttgagtacactctccagggccgaacgatccccaaagcaccacacgtgtaatggcatccccgcccggcagcccccccgaggcgtgattctttatagctggcgaagacccatctggaaagcataggatcgccccccgtgtcctccactcaccgaacatttcgcgtacagacgtttctccccttcacgctggtcgcttccgttcttcacgaggtgcggatgcacgattcttttgctgaagacccctcgcagctggtaagacccactcacccctcccgaggtggaggcccccgtgacaccccttcgagcaatgtccaggcccaagattcccacgatcaaggaacggcacttccctcccctgatccacgccacgacggttgtatctttgctgggaaacacgctggaagatggagcgccccctcgtctgagacctacccaccatcccgagaagagtccacctctgcaccttggtcctgcgccttgagggggggtgtttaagtttccccctttaaggtttccaccaatttccttgccctttcccttccataaagttgttgcctttcccccaagaaaaaaaaaaataaa

SEQ ID NO: 580915 - DNA, 127 bp, Homo sapiens
ctagtttagaagttcaatagcactaacagaaccacctaaaagacatatataggtaacatttcacccaagagtataacttatattcttctcaaacacacctggtaacattctccatggatacatcact

SEQ ID NO: 580916 - DNA, 138 bp, Homo sapiens
gctctcagcaggcatccccatccaggcgcaagcactgtggcaggtgcatgcatgcacagcccagcaagcccccaaccattttccaccagggccagggcgcagtcgcaggcgcaggggtccacgtttcaacagccccag

SEQ ID NO: 580917 - DNA, 216 bp, Homo sapiens
  misc_feature (152)..(152): n is a, c, g, or t
ggtcatagattacctgtctcacctcccgagtagatgggatactgggcacatgccacacacctggctaatatttgtattttaaggtagagacgagggttcaccaataagttgtcaaggctaggtctcaaaacctgaccctcagggtgatcacnccaccttggcctcaccgaagtgttgggattaatagggtgtgagccaccggagccatggcctggt

SEQ ID NO: 580918 - DNA, 467 bp, Homo sapiens
actagcggaatcggaggaagtacatggaatgtcctcactgtccaccacacctcgaatgaatgcgcagccacttggcaggatgtcgtggccttggcttggatagaggactttgcggctgtacagtgcaacgctggaagccagctcccggctcacatcaaacatggacggttccatgtcgggcacgtagaagatgctgcggatgttgagcggtgcgtccgtcttatagtgcagggtgtagcggggcttgtcgtgaccctgcgcgacgtagcgggtagaactcctcatgttgccactcaccggacatccttggggggtccaatcatccgagatggccttgcaagggtggtacatccgccttccaattcaagtacaaggggaagctgacgaagttgctgtacttcgttaccacatttcggacccggggcctcgttggaaaactcctttgcagccggattccaaggtgggtg

SEQ ID NO: 580919 - DNA, 382 bp, Homo sapiens
ttacaaataataatctaaacttctctggccattcaatttgatacattatcccaaatgtcccatgtgacatggtccacaaggttttcttttgggattctgaagcaatcaatggccatacttgtcattaaaatggcaactgccatctccacttggaccttcaggtgggacccacacacaaaagtctgggccatctgcaggatattgggaagaaagtgttggtggaagctaaaaagaaaagatggatagttttatgcacaagaattaatctccagaaacctgacaactgcataagggattggggtcctattgatagcctccttatgcagaataaactttagggaagaatttgggatccccccaaactaacttacatgattggaaa

SEQ ID NO: 580920 - DNA, 127 bp, Homo sapiens
atccacggccacggagaaggggagcatagacagtgcttcatctatacttgtctgaatagatgaagtagagtggtgcaggtctggatatgcagatcaggaccagctagttcatctattcagcaagtat

SEQ ID NO: 580921 - DNA, 229 bp, Homo sapiens
ttgggccatgtccccattttatctccaaagccagccatggtgtatttctctctgcttttcttccatatttccaacccagaaatgactcctgttcccatatgtgattattatattgcgctaacccaagtgattaaggataatctcactacttaatgacagctgattatttccatctgcaaacttactcaagaatgcaatccagactaacacgacaataggacatcaagct

SEQ ID NO: 580922 - DNA, 817 bp, Homo sapiens
  misc_feature (381)..(381): n is a, c, g, or t
  misc_feature (591)..(591): n is a, c, g, or t
  misc_feature (631)..(631): n is a, c, g, or t
  misc_feature (642)..(642): n is a, c, g, or t
  misc_feature (648)..(648): n is a, c, g, or t
  misc_feature (650)..(650): n is a, c, g, or t
ggaagtagggctggcgtagggccgccatgttgcagcaggatagtaatgatgacactgaagatgtttcactgtttgatgcggaagaggagacgactaatagaccaagaaaagccaaaatcagacatccagtagcatcgtttttccacttattctttcgagtcagtgcaatcatcgtctatcttctctgtgagttgctcagcagcagctttattacctgtatggtgacaattatcttgtcgtcgtcgtgtgactttgggcagtgaagaatgtcaccaggtagactaatggttggcctacgttgggtggaatcacattgactgaagatggaaagagccattgggtgtttgaatctagaaaggagtcctctcaagagaataaaantgtgtcagaggctgaatcaagaatctttcggttgggacttattgcctgtccagtactgtgggtgatatttgcctttagtgcactcttctccttcagagtaaagtggttggcggtggttatcatgggtgtggtgctacaaggtgccaacctgtatggttacatcaggtgtaaggtgcgcagaagaaaaggcatttaaccagcatggtactncatattcgggaagcagttttaaagacaaaacactggagangatcagacttnctggananaagaaaggtaaagtgggtgtgacagtggggaacactggagaagaatttgatcacctttgaggttagtcctgttggacgcggatgtgggttggtttccattaaacctcttttaaaggcacgctcataagttttctcccatggctattgttgccactgttaattcgttc

SEQ ID NO: 580923 - DNA, 528 bp, Homo sapiens
  misc_feature (290)..(291): n is a, c, g, or t
  misc_feature (388)..(388): n is a, c, g, or t
  misc_feature (393)..(393): n is a, c, g, or t
tcccaccacgcgccgctttgttttgggggccccccccccccccccggagagggtggtgtgtgttttttctctttttggggccgccaaaaattttcttaaaagaggggggggtccttttttttccgccctcttgtggggtggggtggtgtggggggtgttcccaccagggggggtgttttttattacccccctctttgtggtgccccccgccggaggggtttttaattttggtgtttttttacccccccgggggggggggcggcccccccgggtggttttttacccggggnnccccggttcttggaggggggtccttttttttgttgtttttttcccccccccccccccctttttttttccgccccggggttcttcccccaatatagtnggggnccccccctcccccaaaaaggggggggggggggtattttttttctttttttttttgggggccgggacccccccccccccccctttttttttttttttttggggggggggtgagggcccccggttccccccccccca

SEQ ID NO: 580924 - DNA, 270 bp, Homo sapiens
gatctgcgcacttcagcctaccaaagtgctgggattacaggtgtgagccactgcgcctggcccacaaataccatttcaagagccaggatacgtaaaactttctgatatggtttgtgtatttgtcccttccgaatctcatttggaaatgtaatcccagtgttggaggtggggcctggtgggaggtgtctgaatcacaggggcagatccctcatgaatggcttggtgttctgcttacagtaatgagatcttgctctgagttcacgggagatc

SEQ ID NO: 580925 - DNA, 680 bp, Homo sapiens
tagtatgtatcaaaatttccttccttttttaaggccaaataatattcagttgtatgtatatagcacattttgtttacctatctgtcagtggacacttgggttgcttgtgcctttgggtaactgtgaataatgctgctgtgaatatgggtatacagatacctctgtgaccctgctttcagttcttgtgggtatatacccataagtggaattgctggagcacacagttattctaattttttcaggatcagccgtactgttttccacagcagccatactagtctacagtaacagcacacaaggatttcaacttttccacattcttgcctatacttgttattttttatttttttttaaatagtggccatcctaataggtgtgaagtatctcagtgtggttttaatttgcatcttcctaatgattagtggtgaacataatttcatgtacttgttggccatttgtatatctctttggagagatgtctcaagtcatttcgaatgagttaaatcattcaaatgggttaaactcccttaaaatggttaagggggtagatggcgtattaaaaaaatagcgtgtagtctttcatgttgaagtccattgtatatcctggatgttaacctcttatcagatgcatgatttgcaatatttctcccatctgtaagctgccttttttttcttaaatg

SEQ ID NO: 580926 - DNA, 825 bp, Homo sapiens
ccaaggcccctctatccagagggtcgaatctttgttctcaggcgggtttgcccgttgttccgaaagtactcttgttggttgaccgaatggccagtttgtcgcaatgggcagacattaattctccgtgcttctgaagggcttatcccctcctggcgtctacaccaagatccccctggtagacaccccaggaggttgtcggcacaggacagatcagccgtccgtttatgagaaactgccccacaattagtttgtttagtggcgccccttttccccctttctctccaacgcatttactaccctttctgaaacgggtattaattatatgggaccacactctgatggatgtttgtttacaccttccacgcaaaaatacccgcaccccgcataaataatgtggacacccacacatttgcgcgccccttgttttatttcaacccgcgtgaagtatataataacaaggctccgattctccctccaaccaacaattatatcatcttcccgtcgtgattcactatcttggctcaaaacactagccttgaaaatggacggaagtgtttatttccacccaaatagttctcttgacgcgccacgatcttgtcataattaccctccctttctctcctaaactctctcgttttaataactcttatccccggcgcctcaggaaccatcttatcattcctttctcccccgaacttcgtctataaccacgatgtgtccacaaaatacacatgtactctccaccccacgatggtgaaacaccatggaccgcttttgtcttatcgttcttcaccgagaatgaagctttccccccccccgcctcat

SEQ ID NO: 580927 - DNA, 595 bp, Homo sapiens
cttttattattatttttaattgacacaataattgtacatattttctgggtgtacagtgtactattttgatacatgtatgcaatgtgtcttggtcaagtcttggtaattagcatatccatcacctcaaacatttatcatttctttgtgttgggaacatttaaatcctgcttttatagttatttgaaaatatacaacaagttgctgttaattatagttaccctatagtgctatagaacactggaacttactcctcctctctagttgtacttatatatccattaaccaacctttggctactctcccttctccgcttcccttccttggctccccttcttctcctctagtagccactattcttctctatacttctatgagatctacttttttagcttccacatgtaagtgagaacctacagtgtttatctttctctgcctggcttatttcatttaacataatgtcctccaacttcatttgtgttgccacaaatgatagaatttcatgttatttttatggctaaaaagtattatttggttatgtgtctatgtatgtgtgtgtgtataaatatccgcacacagcacattttcttgctttatt

SEQ ID NO: 580928 - DNA, 355 bp, Homo sapiens
  misc_feature (336)..(336): n is a, c, g, or t
tcttccgtcctcttccttctttttctgggcttttttcagcctggacaactccctttttggctggatcaggctttccttaagctcggatatggcagcaatatccttttcggaatttttccttcagcttcggcagccttcttttcataaggggtggtggtcatctggcagcagggttattccacatctctcccagtttcttcgcaacatcaccaagggacaggccaggaggttctccttggatttgggggcgatactaagagcagaagaggaagaagaggaggaagtataaagctcaacgctttatacttctttaagtgcagaaggtggttcaggttntggctttttaattaaataa

SEQ ID NO: 580929 - DNA, 642 bp, Homo sapiens
  misc_feature (278)..(278): n is a, c, g, or t
  misc_feature (294)..(294): n is a, c, g, or t
  misc_feature (380)..(380): n is a, c, g, or t
gaacggctcaaggaaatatgaaaccggtcttggaactaatcctggcccggccatcaatccaagtccttcatcggccctcccatccctacgcatccttaacataacagacgaggtcaaggatccctccctttaccaatcaaaatcaatgggccaccaagggtcatggaacctacgagtacaccggataaggggggactaatcttcaattcctacatacttcccccaataatccctaaaaaccaggcgacctggcgattcctggaaggtggacaatcgangtagtactcccggatntgaaggcccccattccggtattaattaattaacattcacaagagacggctctggcacttcattgacgctggtcccccacattaagnggctttaaaaaccagagatggcaattctcccgggaccggtcataaacacaaacacacttttacaccggcttacacgagaccgggggggtttactatacgggtcaattggttctggaaaattctgggggacgcaaaacacacaggttccattggcccattcggtccaaggaatttaatttccccttaaaaaatctttgggaattcagggcccggttatttcacccttaataagaaccccctttttaaccccctcttagaagcc

SEQ ID NO: 580930 - DNA, 275 bp, Homo sapiens
ggcgtctggaattagctttatgtcccggctcccagtagctaaaaaggggtcattcatttcagtgcaattggtgtgacagcacacagagtcagatataaaaatcaagattgctacgtagaatagttaatgtgagatgcccatcaaacatccaggtggataactgcggggcagtggcatgtgagtctcttggagctcagtggtcagggtagaactggagcataccacttttggagtcactagtctcaccccagtatgagatccacgagggcaaagaa

SEQ ID NO: 580931 - DNA, 126 bp, Homo sapiens
tcgctgactcagctatcaccttgcattcattctaaaaaataactattttatatctactagcaccttgttagctccttactagctcctggcacaccccgtgggcagtttactcagagtagtctaaat

SEQ ID NO: 580932 - DNA, 167 bp, Homo sapiens
tgtgatgttagtcaggaactaccaaagtcagccgtgatccacagccatgaatttcacagccatgaagatatgctggttgtagaccccaaaagtaaggaagaagataaacacctgaaatattggtatttctcatgaacttagatatgtgcatctatcagagtgtcaat

SEQ ID NO: 580933 - DNA, 1138 bp, Homo sapiens
tacctatcttctgctgcccctgagcacatcaagcagacagggaaagaggagtcagacatggcccagtcacatcctgagctgctcctggctgataaccacgatggagcccgtgttagtcctgccatctggcactgcactgagtgtggcacaggcaccgtcctgttgatctcacaacacagttctcaagttaggcacgttcttggctccgttagaccaggtgaggcaaactggcggccacagcagcaggtagatgtccatctgccctggtgtcaaatccagctcagcaagtgcatggacgcccagtctttcaaacccaaagggggttacgtccaggtggctgagttcccactacacctggtgctagagtgccatctgggcaccattgctccagacgtgttccgaaccgcttacccagccccacaggcgctcgcaagtggaaggaacagcaggccacgggaggctgggccaaagccccaagggcccagggataccacttgcgcagcaagccgtgcccagcggggctcagcctgccttcagcgcgaactggtgtcccatcccaaccactggaccccgaaccttcacgcccctctctcaacgctcagcgtcgacgaccaaaggcgagagccaaaaaaacgcaacggccgctagagccatacaccccgaagataccagcggcacccgcaaggcggaccgccacacacgcctgcccccgccccaacacctacgcaacggagccaaagccccagacaacgagatagcaatccacaacacggcacccagccacacaccagacccgaataagcacgaccatgactgcatgccacacaacacaacaaacccaacgccgaccacatacacactagcccaccacacctaggccaaacacccgggggcacaccagaaatgggacaggaacaggccaccgcgacgcccacagggcccacaaggacacacgacgacaaccgcacggaacgccaagcgcgcacacccaggacagagaccacgcccccaaaggacccccaaccagcacgcacgcatatacgccacgagcaagcaacaagcaacagcccacacatgaaacagaaccacaaccacccgaaaaggtgcacagcacgagagaccagacgcacgaacgaaa

SEQ ID NO: 580934 - DNA, 373 bp, Homo sapiens
  misc_feature (138)..(138): n is a, c, g, or t
  misc_feature (170)..(170): n is a, c, g, or t
  misc_feature (185)..(185): n is a, c, g, or t
  misc_feature (249)..(249): n is a, c, g, or t
  misc_feature (253)..(253): n is a, c, g, or t
  misc_feature (255)..(255): n is a, c, g, or t
  misc_feature (261)..(261): n is a, c, g, or t
  misc_feature (273)..(273): n is a, c, g, or t
tgttagcttataactatgcttattggtaagataatgtgaagtgatatcgttctaatttgactattaatatgtatgttgtgacgaaatatgcgaggcaggatagttattattagattaaaaaggctgctgttgctgatnaggcttcatagaatgctgatgcaaattcgaantggcagaatgtggantggtattattgttattatgaatggaagaggaaggctcggaaccggtgaatctgatgagtatgcntacnantgatantatgtttgttanacgtggtatcgggattctgaagaatgctgtttggaatatggtcttagaccttgagtaatttgccttaactattatcatgccctggagacgcctacgctgc

SEQ ID NO: 580935 - DNA, 778 bp, Homo sapiens
atcacctgaggtggagagttccagaccagcctgaccaatgtgaagaaaccccatctctactaaaaatacaaaattagccaggtgtggtggcacatgcctgtaatcccagctactcgggagactgaggcaggagaattgcttaaacctgggaggcagaggttgcggtgagctgagatcgcaccattgcactccagcctgggcaacaagagcaaaactccgtctcaaagagagagacagagagagagagagagaaggtccaggtgtggtggctcacacctgtaatcccagcacattgggaggccgaggcagatgaatcacctgaggtcaggagctcgagaccagcctggccaacatgttgaaaccctgtctctactaaaaatacaaaaattagctgtgtgtggtggcgcacacctgtattctcagctattcaggagaatgaagcagaattgctttaatccgggagacggaggttgcagtaagccaagatcatgccactgcactccagcctgggtgacagagagagactccatctaaaaaaaaaagagagagagagagagagagaaaagagaaggaaggagaaggacagatgacgcagaaaaaaaaaaacacaacacaaaaaaaaagaaattgtgtggggcccccgggcccccgagagaacgttcctcaaaacccattgttgtgggccggggggccccaagggttagcggaacggcggcaaaggtggttcccaagagacacccggggccacacaactggcgctgggtccccccccaagtaa

SEQ ID NO: 580936 - DNA, 289 bp, Homo sapiens
gtcattcatgccttgacatccgtcgcatttcatcggatctcttatcgagatcaacatttggctaaccacggataggcttagcaccatttcttcggcattcattacatttcattgtcgtctaaggagattttccccacagagttgctcaacgtctatgatcggaacatatccctaagcagataccgcgttgctacgcatcagacacttcgtcgctctgattctcactcgagtcatcgctatctccagtagtcgaattcttcgtcgaatgctcatcgatttcaatctccag

SEQ ID NO: 580937 - DNA, 503 bp, Homo sapiens
tactttcacagggcctatggcaaaatggagttggtgacttaattattaaataaattgtgccagtgacagtaaagattagagacagaacacctagtgacattgatagcacagtgctacaacatgtgaaatgattaaggaatacacaaatactataatacatatggctccgttaccttgaagaatactcaatgtttgctcttgagcctgttggccccactgtcccactggtcagccctgtctatcgaccatggccggtagcctttctgctcaaggaaaagaacaaaagacagatagaaaaagagtgagagaataaatagagaaaaatgacagagacctgagaggaaagtagagaacaattaaagaaagggaaggtaggaagctgcttagccaagttgcaactggcgagttactgtgagatggtagcaggtgggctatctagccaaaagttgagacaccaaatgtggcattagctacattgtgtggctcaatgaccctgtgaactg

SEQ ID NO: 580938 - DNA, 301 bp, Homo sapiens
catagtccacgtaaaagaactaggaataccaggactgatgcaattctactgggtacactatcgcttgtcacaagacacagacaatcagaccaaagtatatgctgtaataactcacgaaccaagaagaaaaaccacttgactatcaatacagatattttcgtcgtgtccctgtacaagaagcagatcagagctttcatgtggggctacagctatgttccagtggtcaccagcaggtcaccaaactcatctggatacatcattcttgtcacatggccactcaataccgggaaccgagctcgaa

SEQ ID NO: 580939 - DNA, 742 bp, Homo sapiens
gcactgtttgccttaataccctgacagattcatcttcctttcttcctgctaaccttctgctctggactggactcacttttctgctccagggactccttttctgggtttgggtcttgcccttcccaagggactgttcttgtggcccttaactgggaagggggcacggggtgaggagctgacgcctgctcaaggagtgggaagtggggctataggcacgctctctgatgccactctcttccatctctttcccccaaggctccgctgactgtcaaactgggccgtacgagaggcggcaccactttaccgactgcgctagattcttcagaaccaacatcctacaatatcctatttataaatcttcctctgcaccaaagcgacgtcggtctcctcgccctgaactactatcttaccgctcacaggagaaacaacatccccattccccttccaggcagcctgtctcctcacagacactccgacctactgggccacgcctgtcctgtccctcccccacgcattcaccctcctggcccgtctgtgccctcctcgccctccctgcgcggtcacttactcctgccctctctacccaccggcccggcccgggtctcggcgctccgcccctgcctccgccgcccttgtactccctctactcgtctgcccggagctgctcccccctaccctttgccttcccccctatcacctcgcctcttggcatctctttctccaccgccgcggccgctccccc

SEQ ID NO: 580940 - DNA, 114 bp, Homo sapiens
aagagggccagctgagccagatggccaggccgctgtccacccccagctcttcgcagatgcaagccaggaagaaacgcagagggatcatagagaaacggcgtcgagaccgcatca

SEQ ID NO: 580941 - DNA, 93 bp, Homo sapiens
taaatatcatgatgataagccctttcaggctgcagcgggctacgatcatgcccctgtactccagcctgagtgatggagtgagacttcataata

SEQ ID NO: 580942 - DNA, 472 bp, Homo sapiens
ctgggtttgatatattttccttttatatttatacctttgactcttgaacaacacaggtttgaactgcacaagtccacacatacagtggatttttttgtcaaccaaatctacatagaaaatatagtattcataagatatgaaaccagcctataaggaggggcaactttttgtatatgtgggttccgtgaggtggattgtgggacttgagtatgcacagattttggtatggagagaagggggttcctggaaccagtcccccatttataccaagagataactgtagttcattaaaatgttgcctgataagccacttttttaattttaagagatggggtcttgcttcgtttgcccaggctggactgcagtggtgcaatcatagctcactgctgccttgaactcctgggcttaagcaatcctcccagctcagcctcctaagtagctgggactacagccaccatgcgtacctttaaaa

SEQ ID NO: 580943 - DNA, 517 bp, Homo sapiens
tgggaggctgcagtgcatcagctgggcaacagagagtgaaacttcatctcaaaaaaaaaaaaaaaaaattatgtgggtggggcgtagggctcatgcttgtaatcccaacattttgagaaggctagggcaggaggattgcttgaaggcaggaggatggtttgagggcgggatttgaaaacaagcctcggaaacacagtgacaacttatctctacaaaaagataaaaatatccgccggagggtggggggcgcttgcctctagtcccagctactcaggaggctgaggcaagaggatcatttcagcccaggatttggaggctccagtgagctaggaccgcaccattgcactcaagcctgcgcaagtgagggaacctccatctcaaaaacaaaaacaaaccagaaaacccccattgtcttccagaatcttcctcacagcatcccagttcctttcccagtcccttcccatcagacatgggtggctcacttgtatcaccaaaacacaccaggcgcggtcgcgct

SEQ ID NO: 580944 - DNA, 430 bp, Homo sapiens
  misc_feature (31)..(31): n is a, c, g, or t
tttcttagggaacacaaggggcagggatcanggaagcaaggcaagttttgaggacatcccatttgtgatgtgtccactgagttgaacttactaatcctttaaccctggggcagcggagtggtttctaaatgtggtttcccatcagaatcatctaggatgttcgttaaaaacacaaatacctgactgaggctgttgctcactcactggtagagttcctgcttggcatgctccaagccctggggtttgatctctaacatggaaacaaaaaacaagtgcattcatttccaacatacattgtcagatgggatggggtggggggagctgaaaaaactgtattagaaccaactgggtgaaacactccgatgatcctagtactaaggaggctgaggcaagagggctgtgggttcaagaccaacaagctgggctacac

SEQ ID NO: 580945 - DNA, 1270 bp, Homo sapiens
  misc_feature (370)..(370): n is a, c, g, or t
  misc_feature (386)..(386): n is a, c, g, or t
cacctgttccccaaacacctagtaggtgtgctacacctccctttgccagtcatcccgccatggatggggagtctacttggtgccctggcaaacctgtttacactaaggagatgcccacagggagcgggaagctcccaaaccctcagtcattctccagcagagacctttgctcttggccaggtttgaaacgatgttcaacctcgccacgtcaatgtctcagtaaaagacactatagatagttatggacaatacactccaagaatactgggcttatgggtgggttggttttttgttttgttttgttttgttttcaagtcatgtctttatccccatataatggagaatgtgccacttggctaataatgtgttntcaaaactacaagttnagtgatgacaggaaagagggctaaagtagtcccacagaggctggtagaaaaggcgaatcacacttaagcaccagcaggttaaaaacctgaaagggtggccctgacaattcagactataggttttacagcatgccacttgtgcaataggaggtctagggttgaaactttcaagaacgagaggaggtgaaggaaggagacgtttactgctcaaatgccatgcatttcactgcttgccactgaacttgtatttgaatgacttagtaatgcttaatataattgggcaacttttttagcactttggaaagagtcatcaatctttctggtaaattataaaagttttctgagtgagaaaaggtgtgtttggagtttgtttgactttttatattattattgttattaataaagaaaaaaatctacagcatttttcagactccaccctagaaaatatgtacccctgaatttggtttgcagtttgatactcagggaaggatgtattccatagatatcctttccgtataaaacactaacatctttgagaaattcacctaccaactaacttcaattgttgtcactatgcattcttcaatgaaaactagcttatttttccatatagtaatgcagttagggttctcagcactttctttcttctatcctttttttaactcttcatattatgttcagatgatcatactgtcaaggtttgtgtacattactgaaaatttgtattgtataaagctttttgcattacgaggctgtacagggtcattttgacagtaactggtatattcctttgcatcttatgttgcattgccaatttctagtgtatccagtttgaaagtataatatactctaattaaaaaaaaaaaaggttggctataaaaaaa

SEQ ID NO: 580946 - DNA, 208 bp, Homo sapiens
ccctactttcagacactgccctagcaccttcaggcgtcggtgggagagcagggaggagtggagcacctatcttgctagacatcaggacccttaagagcatatatcagagggagcccctgaagctgggtgggcactttcagactaatacttcaaggagagaaaaaagctgttatggcacagttccgccacttgctaattcctggtatcg

SEQ ID NO: 580947 - DNA, 336 bp, Homo sapiens
taaatgaacctatctggactgtctgtctgtcgatgggaaagctggcctcagtttcatgctaagcatcgcgcaagcacttactactccctcaacggtccgtgctgcattttgttaccggtattcacacatttcgtcagttgtcgtcagtataattctcgattatcagaaggtataacggtaattgttttaggaaagctgcaaaaaagtgtctacttttcatggtctgataaacatttcgaagtgacaattcatgtagcagataaaaataggtttttaaaaacagaaaagattaggtctcgatgttttgccaaggctgcactgcagcatcgtcgacgc

SEQ ID NO: 580948 - DNA, 157 bp, Homo sapiens
ttcttgtcccctggaggaggtggaattgggacgatagatcgagtcaatgatggtgtgacattatgctgacaagttatagcttataatcccattattagtgtggaacacacgatgggagggcagaaagcagttttctgtcatctgcaaggaacccacg

SEQ ID NO: 580949 - DNA, 1448 bp, Homo sapiens
tacattggggtagctcaaaaggggaaagaggcattaatagagaaccattcccgaggcacggggcacccgaggggcgaggggcggggtccgaggtgtcctcacgcctcagaccaggaaagcaaagaggcagggggtgaaaccacccgcctggacatggcctaacccgggactctaaagcgaacaccagtgctctcctcccgccagaggaagagaacaagagcccccggggagtggtgaacctataaggagaggggggagaaaagtggctatagtgtgtccagcgcgcggcgctttggagcgcgcagaaagcttgagggccgaggggatggcgagggggccatcccacgcccaactcggggcgccctcaaggggaaggacaacaaacttgggggcgcggtaaaaaaggagaacacggggcagagaggggggcataaagccgagcgtactgagcgctggagagagcgtctgagagtggagaccctggagcacgagcaacgcgggggggactatacccccccgagaaaaaccccgcggcgcacacaacctccggttgtagacacacctctccccagggaggagaatataaaaaatcctatatgatacataaccatctaaagagaagagaaacaaatcttccacaaacgggcacgccaactaataaaatatacaaggggggaggacaccaaaacccagcggggtgaacaacacaaacaggggggcggcggggacgagaccaaaaacacagggacgactgtggcaataaccgacacacccgaaagcaaaaacacacacagggaacccactagaaagcaacgatctaacaagggacaccaaatagatggtgtgccaccccgagcacactcgtggacaaagagccacacaaggagcataaaaaaagagccccacacccacaacgacaccacgcagctacaccaaagggcacaaaaaacagccaacagagaaaaacaacagtgaccaccgtcacgggacaacacaaaccaccaggacacgcccacacacagcgaaagtagcaaaaccaggaggaacaaagaccccgcaaataacgcgaccaaacaacacacaccgccccaccataagacagtggaccaaaagagaaacaaaaacaacacaccacagacaacacaatcaccggaaaccactaccaaacacgaagccaacaaaacccacggcagcacaagcgagacgacaaccacagaccgagccaagagagcaaccacgcaccaaacactcccccagggaaagcacagacaccacacacccagaaccgatcacaaacaacctaacaccaacccgcaggccgcagcacccccacagaaagagccacacacagcatcaagcagaaacagacaccaccacgcaccaacgacgagcaacaaacgcatcacaccagcgaggtcggcgaccccctaccaccccggcgccaacca

SEQ ID NO: 580950 - DNA, 175 bp, Homo sapiens
ctctagaggattccctgtatcccggggagctggaattatagttgcgcatcaccatcaccaccatgcccagctaatttttgtatctttagtagaggcaggtttcgccatgttggctaggctggtctcgaactcctgacctcgtgatccaccctccttggcctccccgggatacagt

SEQ ID NO: 580951 - DNA, 282 bp, Homo sapiens
tcacatgtgatacccacgtttgtggtgggaggctgtgtaggacacaagaaggcaatagacactcagtaaaacgacaacctcgaccagctgcgcaacaaataacagcacaactccgactcccagctagacagttgacctatgagactgtaatactcgattcttcagctagtattgagatgtgaccaatatgcaaacaactcactgcgatacctgaacagcttaagctactacttttgcagcaaaagccttccagctggctcggactggggttaattgttaaac

SEQ ID NO: 580952 - DNA, 131 bp, Homo sapiens
gttataaaggctcagaaaaatctgcgaaaaataacttctgaggtaataaataggattatcccgtatcgaagggcctttttggacaggtggtgtgtggtggccttggtatgtgctttctcgtcgcaatgaga

SEQ ID NO: 580953 - DNA, 394 bp, Homo sapiens
ggtggccgacggtggcttcagcagccacacacctcccctggtcgcgatgcgcgcgttgttcgcacagatgggtcgcaccggcatgtaacgtctggcgcaccgttcgcgctgcgccgctgattttcgccaccacagccgccgcttgtcgccgtggttgaacttcgacttggaagcatttcatgaacccgaaccagaattcgagtaggaccgctttcgacgtgatcattgtcggcggtggcaccaacggcctgtcggccggctgttacctgggcctggaaggcaagaaagtgctggtgctggaagcgctggacaaggtcggcggcatggcctcgtcgggctatctgattcccgaggcgccggagcacctggtccacccttgtgccctggacatgat

SEQ ID NO: 580954 - DNA, 311 bp, Homo sapiens
  misc_feature (148)..(148): n is a, c, g, or t
  misc_feature (161)..(161): n is a, c, g, or t
  misc_feature (222)..(223): n is a, c, g, or t
  misc_feature (248)..(249): n is a, c, g, or t
ctctagaggatcctccggaggccttaaccctggaaaacaaaaagttatccagaaaagtgaaaacaatcctattataccacttcgtccagctgtaaatggcaatatgtagtcataatataaacaatcaatactgaactaaccaaattanaggatatatcacntttgggcagccatggatccggtttgcacttgagaacggcagacgggtgacaagaaacgctnnaggaacttccctacccctattctcnnagtgtcaagccgaagagacattcaccattgaaacaggggttaacgggctcccgggggggtac

SEQ ID NO: 580955 - DNA, 320 bp, Homo sapiens
cacagcacctgagttcaaagggtgaagaactggcctgtgtagttataaaacaaagcagcagttttcttcatttgtagatattatatttaatttaccttgcatttccaatagcattaaatattagaagcgtataagctttttctttttatgcctaggggatatggcttaacactgagaaacacttgagaaacactgccacattctaaggaacaaccaataataagaaaaattatttcatataaaaggatgcagcttgcatataaaatgctgaattcaactgaagttcattatgctgcctttatgtggactcaggtggtgtg

SEQ ID NO: 580956 - DNA, 223 bp, Homo sapiens
  misc_feature (223)..(223): n is a, c, g, or t
ctcagctaattttttgtatttttggtagagattgggtttcactgtgttagccaggatggtctcaatctcctgacctctgtgactacctgtctcgggctctcaaagtgcttgggattacaaggcgtgagcaccttcgccccggccagataatttttaatattttttcagagacgagggctctctatgtttccagactggctcgatcattcatgagaaaaacacn

SEQ ID NO: 580957 - DNA, 214 bp, Homo sapiens
agataagcatttccctgcaggagctgagatggaaggatgatatgcccaacaactacataaaggcagacacactgctgatgatgactagaaggatccttaagtgtgacttttgttttttcatctgttgaggctgtattatctttatccctccaggagcacacatctctgaaataattttagaaacaaaagggggaaatggcttgatggcaaattc

SEQ ID NO: 580958 - DNA, 1102 bp, Homo sapiens
caggtgggggacccgccgacggtctgctgccaccgccgccaccaccgcctctgctcgatggcgtgggaaaggaggtgtgagtcccgggcagcgagccggaggacggcgccgctgccgggagggtcggcaggtgggcaaggcgcatggcaggcatttcagcatcaacactcaaccatcgcaccagctttttatcccaacggactgctggccagtgcagcagggtccaaagcgctggtcaagcaatgtccagcgttcaggacgaatgaaactcagaggactgtgcttacacgtctcgtgaccatctttctcagtacagccatatcctactagaacttgaagcaccactcaaaatatgtggtgacatccatggacaatactatgatttgctgacgactttaacgagatacggtggttctcccaaccagaacacgcaactacctgtttacttggggactatgtggaacaggggaacaaggcagtcactagcgagaccggcatctgcctcgttactggccttacaacacataccaacgtatcctgcagcatcgaataatccttctcaacaggggaacccatgaatgctgcagcattcaaccaggcaactccattgggcattttaccgcacgaaatggtcaagaagcccgcagcacaaacattcacacgtatgggacaacactcttcccaaaacctgcttcgacctgcataacggcatagcaagacacacgaggcatgtcagcaggataatctgaatgaccatgggacggctaagacaacaacactgttcaatcttatggcggccgatctcggcgaactactaccaaccacatgcaaggtacacgaacaacgggacatccaagcgaactcacggcgagccgcccccgagtgaaaccatccacagcctgaggaaaaacaccagcggacacgaataccgccgggacaccggagagcacaacgcaaagatagaagaaaacaatcacacacacagcacgcagccagcgcagccacacacgacaccaacgcgggcgccgaggggcagcaccacggccaacaatgggacaagctagcaaacaccaccacaaaagactagcggcgaccagccccc

SEQ ID NO: 580959 - DNA, 206 bp, Homo sapiens
cagctccccccctgggtttttaaaaacggcagacccaacatgttcctccccccgggtcccttgaagcctgcaggccccagggggggcccccactgattttgacttcaggaaaagtaacccagaggggccctggcctgttgttttcccccattttttggccccggtcatccgggtttttgaagaacaaaaatgcttttgggccccca

SEQ ID NO: 580960 - DNA, 200 bp, Homo sapiens
  misc_feature (73)..(73): n is a, c, g, or t
  misc_feature (103)..(103): n is a, c, g, or t
  misc_feature (181)..(181): n is a, c, g, or t
  misc_feature (193)..(193): n is a, c, g, or t
gtatcaccttgaatttaaaacgtataaagagagccgggttatcattctgcaccctacgtgacatgtgctagtnctccttcttctgtctcctccttaccctggncctgcacccctgtacttaagagggagagggggaggtgctgtctgtatcattttctgcctcgcagtagagggtgcgctntcagggtaactnccgctgt

SEQ ID NO: 580961 - DNA, 322 bp, Homo sapiens
  misc_feature (11)..(11): n is a, c, g, or t
ctcatggttanggtttaataaaattaacacttcttactgcttcatcaaagatataaggtgaggccgggcacggaggctcacgcctgtaatcccaccactttgggagactgaggtgggcggatcacctgaggtcaggaattcaagaacagcctggccaacatggtgaaaccccatctctactaaaaatacaaaaaaattagccgggcgtggtggtaggcacctataatcccagctacaggaggtggaggcaggagaatcacttgaacccaggaggcggaggttgcagtgagtcgagattgcaccattgcactccagcctgggc

SEQ ID NO: 580962 - DNA, 284 bp, Homo sapiens
agtataaattacaataaaattttgtgtatgtgtacagctgtgttcacatccacagtgtaagctgtgatatggtttggatgtttgtcccctccaaatctcatgttgaaatgtgatccccagcattggaggtggggcctgatgggaggtgattgggtgatgggggaagttgcctcatgaatgacttggtgccctcctggaagtgatgagtgagttctcgctgagctcactcaagatgtggttgtttaaaagagtgtggcacgtccctcccccaactctccctctca

SEQ ID NO: 580963 - DNA, 358 bp, Homo sapiens
aagaaagaaggaaactgcagcatacgagaccgtgcagagatatatagtaagagtactgttcggcctgatagagtatatacagagacacaagtttacagcgagagaaggagaaaacgcgccttggttggtacctatgcagattcatcacaagagagctacaagagcctggaagagctgaagactgctacctccatccttactcaccctgggacctgagagacctcttcaatcgcctccttcatgtggtgagggggtcacttcagctgcctgctgtggacaaagaacatcaattcgcatcacgagtgctattgttgcctgtggtggtctcctgtcaagcggacacttgcagagccagagg

SEQ ID NO: 580964 - DNA, 103 bp, Homo sapiens
ccccccccgggggcaatggccggtttaaaaaaagggaatttaaaatttttttcccaaacccccaaggttttttttaaaaaaaaaatttaaaatggaaaaagga

SEQ ID NO: 580965 - DNA, 198 bp, Homo sapiens
tatattttcaccatcctgcaggcactcagccattcaattgcaccagctgcaccaggtgctcacacagcaagtggtattccagtgcactctcaggcacagcacagccagccagcaccaggcattcccaggcacacccagtgttttgatgcacagctcaggcactgcaggcagcacagcgcagccacagccagccagttc

SEQ ID NO: 580966 - DNA, 774 bp, Homo sapiens
  misc_feature (9)..(9): n is a, c, g, or t
tcaatattncacacattagtcattttaaaactatgtattctttctttggagttaaaagtcagttgttgacacttaaaactgaagatgcttgtggagggctggcaggagccctcagcagggagcgttatgcatattctataactctgcttctgaaatctgcaccagggcttctgcaatttatgtctcccttcagctcaaccaggtgccttgtacccaacacagggcaattcctgagagttaattgtgccttgttatttcagcaggacttaggatgaaggtgattaccagctgtagttattcagtgacatttcaattctcctctctcagactcccccttacaaagcttttctgccagcagcccaagacaccttgacttccaccaccccaacacccatggaataacttctaattgtctgcctttcaaagaagtgaactccatagctgtcaacatttgctgtactaattgtttgtacatttggagttagctgaaagggtccggaatctttcaagatgatctgtctcttctgttaacttcctcttattcttggtccacatgtgcttaaggaaaacctggctggatttcctccctatttgagaacacctagggatgaatcagtgaagaccacggttttctccctggccccaacaggctattcctttgaaggcgtttgttaattctgggtagtgaatacacacctgtttgttatagtattctttgtcctcttctgtatttttaaaaacatagattaaaatgaacatgttatatgaagcaaa

SEQ ID NO: 580967 - DNA, 157 bp, Homo sapiens
ctcatgaggaagaatgaaagcaactgtctgccagatcatcctgaaatacagaaatgacatcacggctgctataatggattacggccaggaagatgtactgtacctgcaggagcagagactttgactgtcctggatttggagattaccatgccagtgg

SEQ ID NO: 580968 - DNA, 362 bp, Homo sapiens
ggtcgacaagagacattggttagctctggatgatgacaatggctatggggtcagtcaaccttgtagaaagaataggctaggcacagtggctcatgcctgtaatcccaccactttggggtggtcgaagccagtggatcacttgagcccagcagttcgagaccaaactcggcaacatagtgagagccccctctctacaaaaaatttgaaaattagccagggcatggtggtgtgtacctctggtactagctatcaggaggctggggtgggaggatctcttgacctggggaggttgagtctgcatgcagtgagccatgattgcgccactggactccagcctgggtgagaaagtgagaccttgtctc

SEQ ID NO: 580969 - DNA, 1073 bp, Homo sapiens
ggagtgcagatggtgcgatctcggctcaatgcaacctctgcctcccgggattcaagcgattctcctgccttagccatcccgaatatcatgggactacgaatatctgggactacaagacgcccagccatcacgcctggctaatttatagcatttatagtagagacgggatttcgccatgttggactggaatggtctacgaactcctgacctcaggtgattctcccaccatgggcttcccaaagtgctaggattacaggcgtgacccaccgcgccagaccacttgcaaatattacacagtgccaatgtgtaacttgcagtggtgcaaggacatgacagtttacccaaggcttaccagttgatagcatactggctccacatatggtgatcttcaacagacctaacagacactatcagttcagtattcctcgacttcacaaatacaacatcaaacacgtaatcattaaacatgtgaacctatccatcccatcccaatatagatcctaatatatctacacacttcttatatgtgtgcgtatgccagcattaactgaatgtactgatagacatggagtactaattgcctccccattcacctttctcttgatgcgtcacactaatagtagaactggacggttcgtcacatggtcctggacgtcacggactggctccacacataggagaccaaaacgctgtacacactttcagtacgcaaaagcgtcaatctagcaatacaagtcgctgacagaatgacaaccatgggcacaggtccactgggaaccagaaccaggacacaagcaacatgcctgaacgccctgccaccccgaccctgccatggcatggcctaccatcacactcggacaagcggagtacgaaggccctaacacggagaaccacggcagccgacccacaccactcgtggacccacaggcaacacgacaacgggcccctactaacgtgccaccaagtgcgcgtcaactgcgaaccgacgcgcccaagcaagagcacttcctcgaccaccagagctgccaacccaagcatccggcgcagtaaaatagcactagattcctccaaaa

SEQ ID NO: 580970 - DNA, 2097 bp, Homo sapiens
  misc_feature (1078)..(1078): n is a, c, g, or t
ataaaaaataaaaaaagctacaaaacaaaaactaaaaaaaaaaaacaataaaaaacaaatacaaaaataaaataccaacacatcacaaataagaacacaaacaaaacaacaccatgatacacacgactcacaaacaattgcccgtaggactcatctcgtctcgcaccatcacatacttccccccacccaccctccgctcactgtcgcgcgctccgccgtgccgatgacgccgcttcaccgcgcatgcgcccaccccccgtgcgacatgccttcactacctctcgtgcagcaagcccgctgcccaggcgaccaatgccgcgcctccgccacaccgcctccgccctcgcctccccgcagttctgtgcctcgccatcatccatccaatcctcacccacctcactcacgtgcgccccacgtttatactctattgtagaacaaccacaatatcccaccacacacccctaccacctccacctcccttgcgcagtcctcttgctacaaccatcccccacagcacaactcaacacccacacatacatcccctcatccctcctgatccctacaacacacaatctattatcctcacctcctctgtcctgcaccactatctagccgactcatgtttcaattctctacctcctccgctcctcgtcctacccacacggacggctactatcaacactatccttatctccatctacaccactcactccaccaccccaccgatatggatcgccccctcatctctatactgacctaactcccaccacactcacctcccccacaaccccagccagcacccccagctcgtggcctaccgcctcccccgctcgccataccactcaacagcaccatcgtcgtccctaactccatcaccaacccactccaccaacgaacgatacacaccaccaccaccgactcgagcgccgagtgcgcgtcgcgccgcagatgactcacgcacgtgctatggatcgccgcgcggtgcgctcgtccgtcgtccgtgcctcacgtcccctcgctgctcggccacgcggccacggcctgtgccgccacgcgctgcagctagccaagctctcanacgccagagactccgcagcacgcatcgcgtcgcagcgagagagttaagtcagcgcgacagcgcatagcacggcgcatgctaggtcgttcgtcgcacgtctctcacagctctgcgtgactgggtcgtagcgcgcttcgctggccgctcactgcgctcgttgtcacctcgccgctcatgctagtatccagccgcgtcccatctcaccgccctgcactctcgctgtctgcctcgtcgcgtcgcgcagctcctccaccctaccactccgtcgcacagctcgtcaccaagacactagacctcgtcctcctagcagacgaccactagacggcgcgccatcacatctcacctttctgctactctgagctactcagctacctacgaagactagtcacgactcccaccgatagctcgacatctcgactagcgctgctcagtagcctaccgcatccaccgtccgacgttcacgacacgtcaccgatccaccaacctaccctctacgctacgccacgcgccactgcacccacccacaccatactcccgaacaccaccccacccctacacaccctcccacgccacacactctacccaccacactcactcctgcaccctccccacctctcctctacagtcatactcaggaccgtctactccatgtgactaaccctcgcagtacactcctctcgctacacagccccgcgcccccgccggctcaccacagccagagccccctcaccgccaacacgcctctaccatcctctccccaacttccccattcctagttcaaacacaagatctacacatagcgcactcctaccgcctccttccccaccccccacctatcccctacacctctcaccctaccacatctagccacctctcccctcacgctatacatcacccgcgctccgcctgccccacacacaccatagcactatctacagtcagtacgaacgcacatgctcgcatgctaatcttctctcttctcatgtcagggcgatggtccaacaccaacaccctcatgt

SEQ ID NO: 580971 - DNA, 122 bp, Homo sapiens
tataaaaaaaaaaaaaaaaaaacaccgttagagttgtttaaagtcttctccagcatattatattggtttttgattattcatattttcttcttctttatagccttctacattaattatttggc

SEQ ID NO: 580972 - DNA, 880 bp, Homo sapiens
ggtgatggaatgataaaagtgaagaatcagctccgcgttccttgcagaactggcctatgatctggatgtggatgatgcgcctggaaacagtcagcaggcaactccgaaggacaacgagataagcacctttcacaacctcgggaacgttcattccccgctgaagcttctcaccagcatggccatctcggtggtgtgcttcttcttcctggtgcactgactgcctggtgcccagcacatgtgctgccctacagcaccctgtggtcttcctcgataaagggaaccactttcttatttttttctattttttttttttggtaactccgtgtattacctcctccagccattgaagtacgaggactaaccagtggtgttactgttttcgaaaacttcaaaggggtatctttgggaggaagactacttttcaggggtagcattatagatggtcctttggcaaagaacgcaactaaaaacgcatcaagtttggtgccaaattatctctcctagtgctgggcgtgctcagcaaccgtggtcaccagtgtcctttctctctcattccctccctttcaatcggtctctcttgtgcctggaatcccctttggaccacaaacacttaacttgggtccatcttaccccaccaacacacacacaacaacccaacccaccatcacccacaccacacacctacaccaccacaaaaaaataaacactaatacaattcctctccaacctaactctcacactttactcaccaacaaaacacatacacccacccactaaatacactaaaacaacaaccacaccaaacagcacaaacaaactaattatcgcatcaactcaacgatcactcaacaactctcataacaaatctaacttcatacgc

SEQ ID NO: 580973 - DNA, 1320 bp, Homo sapiens
  misc_feature (838)..(838): n is a, c, g, or t
  misc_feature (1218)..(1218): n is a, c, g, or t
cctgcttgtgtggttgtcgacgcgcaacagccagctgttcgtctcctcaactctctctcgtccggtcagcatcacctcagttgtgttctccccttcaggtggtcgactcacaatacagtgcgacaattactcagagggggggtcgtcgctctccttttttctccgttcggaagaactcaactattattaaacctcgtgggggaaactgacaagcagatgtcgtcgggcgtcccacacccacagagggggatttttattttgtggggggcgcgccacatatatactttttaggctgaaacatgtttcggtgtaacctccaaggtgttgtcgtccccccccctgtgtggtccccagcttggggggccacttttcccccggtgtttgtttagaccgcgtggttcctcccgctggtgattggccttcttgtctgcgcgttgtgaaagagaagcgttgggtgtcccaccaggggaaggtgccgctcgggctcggggccaccatggggcaacagtggccccccctgggccaaataagggttcttgtggtttttgaaaagtggttgccttggggggaatattcaactcttggcccagggacaccacgaataatttacgccctttgggttttccagggaatattttcttttgtagcctccccccgatatctgggcttgtgggaaatattccaggggacacacttccccgttggcgctttagtgaaatacgcaccccccacagtttaggtgggggacacatatgtgggacacaaaagaggcacatacttgcgcaccactcaagaggggccccccctctggggtggacaccccagcgcacacatttcnacacagaccagatgtgttaaaattaggccctgccatttttgtggagaatagcttggcgtgcgcccttttctcagatgtccctctcccagggaagagcacacacatggcccttgtctccttctttcacagaaggccctcagaagggaggttgcttttagagggcacaggtggaagttgtctcgggagagttgttgggcggcctccccttctgggccccggggccctctctcgtgggagacctctggcttccctctccgtggagacactgggcttcgtggtgagagcacctgcacgcctccctgggcacatttccctccacgcgccacgcacccacactgcacaacaataataagaacctgagagtgctatattgtaatttntggccttggtgtgtatgctcttcattgtgtaaaattgctgttctttttgaccaaattaagtgattgttttgtttactgtaagttttaaaataaaaattaaga

SEQ ID NO: 580974 - DNA, 388 bp, Homo sapiens
gctctagcctcactccccgtcctctcccgtcctctccctcctctctgaatgccatgtagaacacagttcaaggaaggaaacatgcaatcactagaccatgaacaattcttatagacacacaaaggtttggtccaaaagaactcatgataattgatccaatgactgtgaagagctccactgagtaggattaagatactgcagatgtagtgtttccatcagggtggctcttcagtgcaccatcggggcctgcttgagggacattaggactgagcgcatgcgggagacatctttggcctgcttgctaaacttggggttaaagtcacactgcctggccacccgttcccactcagtgcctggggacgactcgtctactgtcatttacatcggc

SEQ ID NO: 580975 - DNA, 547 bp, Homo sapiens
caaggatctggccagccaccatgatgtggttggcttccttgtggcaggtactctcctcaaggcgttattcatggacatagtcgatgagaactagtacgcaccagccatgttcccagcccttctggagaggcacggagtcatctgaccatctgtccagtatgtgccctttccatgcataagtttcaaatggggtcatagctcgttcctgggcggttattcgagctgaatcttccttatatgtttatgtgcccgcacctggcatggtttggtgcaggtccatcccataaccacctactataagggtgggaagtaaaagtccctaacagtggttctccaaggctaacagatcctagcagtcttcgcatttgattcagggtaggggcctccccttttaatcctccccacccccccgccaaggttttcatactggcctgggcttgggtgcccatataggaggtatgtatgttcaccaacagtgcggaggggtctcacattgcaaaacattgcccagaccagtaaaaagagcctgcatgccaaaaaaaaaaaa

SEQ ID NO: 580976 - DNA, 348 bp, Homo sapiens
cggtgatctacaggatttcggtatgagagctttctgggcagacttgtgtgacttgccagctccagcagacttctatgtaccactggtttgatgacacccaccggaaatgtctgtctccatatacaccggaaacagtgcaaaggggtcccaaaggtggctagtctgagaagctctcaaaacaaatgggctgccaggaaccatatcaacaattggcagcatcatcagacttcaaagaatatagggccatcttccagctttttaccagaacggcgatcaatcttttccttcagctcagcaaacttgcatgcaacggtgagccgtggtggcaatccaagtacagggggccat

SEQ ID NO: 580977 - DNA, 634 bp, Homo sapiens
atcaggcttttaattgtggtaatccccccgttattccctagggtttgtggaacgagccggggtgtgtttgggcacacatgggggccaagggttttgtgtcctgggttccatgtgatttggctctccgggtcttttccggggaacgccttgttgggggttctgggggtgtgggtggaagaaggcccttccgccttaatgtaccctttgttctttccaaaggccccgcgggcctggtttgtggaagggtttgaccaatggggcccgccttggccctgtttgtgttgccaaaatgtcccgggtggttgggggggtgtttcgcccggcccccccccctttttttaaagaggccccttttgcccttttcaaaaaaaaagggggggcaggctcctgggcctttggttttttggtaagggggggccccccaaagggtttttggggggtggattgaaacctggggggtgggggttgaaaatttttttgggcccctttgggcccccccggttttgttccctttttgggggccgggggcccccaagcaaagcccgcgggccatgggggggtttttaatggggttttgggtttttttttttgccttaaggtttttgggtttttccaataaatttttgttggccca

SEQ ID NO: 580978 - DNA, 396 bp, Homo sapiens
gtacagacagatcagtgccagatgtcctagctagccgtagtccttatgccagtggatacttagagctctcatcttcatactgaaaaaacttacacaaatgagctatacatttaatgggagaaaagaaagaaatgattgtgggccctcttggcattcaagaaaaattcagtgtcagcgaggccacaccaaattgtgtgtgtgttgggagtggtggggaagctgattcagtgtgtccatctctaaaacccaaagtggcctactgaaaatagtgcatctggccaggcacagtggctcacacctgtaatctcagcactttgggaggctgaggcggtcacctgaggtcaggagttcaagaccagcctggccaacatagtgaaacctcatctctactaaaca

SEQ ID NO: 580979 - DNA, 1427 bp, Homo sapiens
tcgcgcggggcgcggtggttctgtatagttactcgtttgcacgcagtgttttacccttattcttggtttagtcttgttgtgttcgtctgctcttatctccatagtggtttttcccctattactgtccctggttgggcctattatatctcgcttgtttgagacgacagcgttttttttttgtgtaccgtcgctggcgatattttttttgtccccacggcggcggccacacactcggtcgtgttatttcctgcgccccccccgcttgggtggctgtgcgtccgccccccccatcacggggggggggtttttttctttcggtgtccggccgcacactggggcttgttttgagcacccctccacggtggttttttttgctatgtgagatgttttttgctcccccatgtgtgggccccccccgctcccttcggtggtggtgtggtccgccggcttttgttgtgtgtttgtttgtgtagtaagtggggtgtttctcgcccccctcttgtgttgtttgtggccccccccctcccccccctttttgtggggctgctcttctctttttatttatgtgtggtgtttcccaccgttggtttctgcgtttgtcccccgcggggggtttcacacccactttttctttgtgtgggcccccccccaaagaagtggttgttttgtgtttttttaaagaagtaggctgtgttttgttttcccccccccccgttgtatttcttcccccgcgcgggtatccctcctcgcggattttgttttatagaaaaaatatatttttcgcgccaccttgtggggacccacacccactttttctgttgccacacagccctcttgtgtttatattgtgtgtatataagatgtgtgtataaaacaaagagaggtgtatataatattttctctccaccccgccctctgtgttctcttctatttaaaagagtttctctccccctctctcttctctcccacactatatatattgtgtgcgcccttcttctctctttaagaatatatatatcttctaataaagagagaagaaaaaccctcctcctctccccccatatataataatatataataaaaagagcggcgctctctttttatataaagagagagtgtgtctctctcccacacacccacactgtgtgtgtgtatataacaccccaccacctctctgcagaggagaaaagagagactctctgtcttgtgtgagagcgcaccacctctctcatagaaacacacactctcttctataaaagagagaccatctattagtgaaataaagataaaaagaggggtgccacacaaatgtgcatccccccgtgttggcccactgtttttgccccgctgttttataaaaaagagagagtagaagaaaaaaaaaaataagcgtcgtttttggtggagtgggggcccccccgtcccca

SEQ ID NO: 580980 - DNA, 709 bp, Homo sapiens
gccggggggggtggatgtactgagcggataagcccacccttcgactgaaattaaggtgatcatccaggtgaagccttggcaccaagtgaattagcgcaagcagctattaatcgtcagcatgccctggatcacaaaccatctgaacagcaattctctaaagaaccttttttaaaatttttatcgagctgccactaaactaccccaacccctacattatacactgccagattgtttttaggtccgggatgtaaaccctaccatcacatgaatccacaatgtggtgcacaaaacaccaacatgttggacacttgatcagtcccgcactagcaggagattgaagaactgccaaacgctttcgacatttccaatttaaaccgttcccacggacgaatgacccaaccctacctgactggatatatttgtctgccctttttcactaagaccgccacccacatactggaaatggggcgtttatccaaaaatggcctatcaaagagttggatcccaccgccgcccgcccctatgatctccttacatgcccgcaacccgtcccagtgccaaattctccttaacaaatcccaggttatggctattagtattcataacctttatacattgagcaggcccctaaacagttacctatcaaaaaacccggaaattgcttcccctaggatatccacgtttttcattcttaataatggagtttttg

SEQ ID NO: 580981 - DNA, 441 bp, Homo sapiens
  misc_feature (7)..(7): n is a, c, g, or t
ccagggntttgtgccggctgcgtacgtgaagaaattggaccccgttttagtcagcctcccgggagaatctcctggaggagcaaggctttatagcactgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggctgaaggacattaacaaggtaggtatgatgaaggacg

SEQ ID NO: 580982 - DNA, 365 bp, Homo sapiens
gcaggaaagatgggattccagtgggctctctgagcttccacccttagctgagacaactcagtacagttttctctggtcaaggaagtagactactgtttgcctaggccgggtgcagttgctcatgcctgtaattccaggactttgggaggccagggcaggcagattgtctgagaccagcctgggcaaatagtgaaaccctgtttctacttaaaaaaaaaaaatacaaaaaatcagagcctggtgtggtggcacatgcctgtaatctcagctactcgggaggctgaggcaggagaattgcttgaacccggcagacagaggttgcagtgccccaagatcgtaccatttgcactccaacctgggcgaca

SEQ ID NO: 580983 - DNA, 684 bp, Homo sapiens
tacagtggtgcaggagtgtgattgaattctttgtgatggtcatacgcttgttgaataccccaggccctgtattgttggtgcgccgtatgctgctctcatctgatctaaggagcctggtgtccgggaagcctgtgcttaatgcctaccgccaatctacctcaaccccaaaggaactctgccaagccaaggcccaggctttgattcagaatctctctctgctgcgtagtggattgcctcggatttggtgcacccattcaatgtcttgcagagaaattctctgtagataatgtagcagaaaggcatgagttgacaaccagcagtagacccagctgctgtgggcagcgaagccaccggaccacaggtcgcctgcttgtacctctggaagcgctgtacctactgtcatggccttctctgggctattgacttggccaccgaaggaaacgccacgaacaactttgtggcgaagccacactttacgatcaccacctggatgacgcatagcgggctgactgagcacacgatcatccaaccagggaccttagcaaggcctggcgcgcacggcaaaagtagatgtccactaggccatatgtggccagaatattctcgaccaccggagaaaacacgcctctatcctcgtgcgaagcagtgtttccccacccccaagagaggagcgcatccagacac

SEQ ID NO: 580984 - DNA, 624 bp, Homo sapiens
  misc_feature (624)..(624): n is a, c, g, or t
taaaaaatagaataactttattaatcttggaaatcagtaatcccaaggggggccttatacccgggctcatgtggtcaagggcacaccgattggtctcctctctctaggaaactggtgatgaatgctcctctttccccctaaatccctccgaaaagggaggcaacaacttgggcgggatgatgatgtcgaaattttacgctggtcacaaagaaatataaagcttcatcacgggaatctgggaaaagcaagaggaagcaaataatgcaatatagccaaagagcctcttttatatcatctcggtgcagcagcagtaaaggggacagacgaagacctaagcagtttggggggcacgggggcaaagggaaggtaacaagatcacaacgttgtggctcctgacggggtcatatacaggcatcagctgaatggtccccacggccaagttccatcaaaacccagaagatctggcttactggtgggtcccagtggaaagtctcgcatcgggctggactgggcaaccatctaactggcgcacttctggctcgaaaggcttagggggactttggaggcagcaaacaaaacaaacttaccttaggggcccccttgaaagtcgctgggggagatggn

SEQ ID NO: 580985 - DNA, 321 bp, Homo sapiens
aagaatattgaatcttggctgggcgtggtggctcacacctgtgatctcaacacttcgggaggctgaggcgggcagatcacggggtcaggagttcgagtccagcctgaccaacatggtgaaaccctgtctctactaagaagatacaaattatctgggcatggtggtggctgcgtgtagtcccagctactcaggaggctgaggcaggagaatcgcttgagcctgggaagtggagggtgcagagaaccgacgtcacgccattgcatgccagcctaggtgacagagtgaacctctgtctcatgagcagaaatcaattagcaatat

SEQ ID NO: 580986 - DNA, 387 bp, Homo sapiens
gtcgaccacggctcactgcggtctcgacctcctgggttcaagtgatcctcccaccttagcctcccaagtagctgggaccattggtgcatgccactatgcctgctaattttttaaattttttgtagagacagggtttctcagtgttgtccaggctagtctcgaactcctgagctcaagcagtccgcccaccttgacctcccaaagtgctgggattacaggtatgagctgccatgcccagcttcattctttttaaagactgaataatattccattgtatgcgtatgccatattttatttgtctattcatccattgataaacatttggtttctatcttttttttttttactattgtgaataatgttgctgtaaacataagtgtacaaaaa

SEQ ID NO: 580987 - DNA, 224 bp, Homo sapiens
gacaaatggcgagggactaccacataaagcagagagactcaaaaacacacccagagaaagcagaggacagaggaggtcaggtcagtgtgggaggcagggacataccctttcaaagggcggagataaggaggcatgagatcaccgtccatacctaccagggagcgtggagacgcagcccacctcataaaacccagcatgcccctcacagcagatcaccagcttct

SEQ ID NO: 580988 - DNA, 269 bp, Homo sapiens
  misc_feature (57)..(57): n is a, c, g, or t
  misc_feature (222)..(222): n is a, c, g, or t
  misc_feature (255)..(255): n is a, c, g, or t
ataaaaaccaccaccctccagcctggggaacgtagtaaaacctcatctatacaagantttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccancaccaccacccctactacccctgtattcaaggnaaaaattgaagttt

SEQ ID NO: 580989 - DNA, 706 bp, Homo sapiens
  misc_feature (48)..(48): n is a, c, g, or t
ccccggtagttccaaacttcttttcgtagagaatataaggaaccgagnagaagcggcaccaaaaagtgtttttcaacccagatctagaacaggtccttcaacaaaagcccacctgctcggggtcataaacatggcatgttcaaaggcctcggaaacttcaagaagccccgagattcaccgtgttttcataggatcctttcggaacacgccaaccaggatgttatctatcagcagataagtggacgtctgttccacacctaacatatcgtaggcttacccataagacgcatactttcgctcactttcccagtgagaaaagtctgtttacgatgtaaagtgcacttgctcaggggctaaacccctatagcatgacttataaaggagaaactgagtcggatagtgaagaatatcctgcctctgagagagatgtcatctgagtagtttttagagcagtcttcttgtgcaagaaggttgcaactacggcagtggttatcaaagccaccagtgtcagtgaaggcaacataggttcacatatggggcagtcccatggtcagtgcctggtttgggcagctatgggcattattggaccgagttctccattaactagtgcgaaggccaccttttgtcgcaactgagtccccccgatccatagatcagcctgtatcagcagtgtgtgatagattcctctacgagaatatttttcccg

SEQ ID NO: 580990 - DNA, 143 bp, Homo sapiens
atgtcgcggataagctcccagagttctctagagactctcttcatttagttctcagtcttttattctctattaatagtatactagcatccagataaattatccactaaatactgtacctaccatcctcatcttaattacatatc

SEQ ID NO: 580991 - DNA, 84 bp, Homo sapiens
tctgtgtacttctgtgccagcatagggggggtggatggggggcttgaagctttctttggacaaggcaccagactcacagttgta

SEQ ID NO: 580992 - DNA, 210 bp, Homo sapiens
  misc_feature (13)..(13): n is a, c, g, or t
  misc_feature (101)..(101): n is a, c, g, or t
  misc_feature (158)..(158): n is a, c, g, or t
cccgggacgggtncccccgccgacctgagttggggggcaacagcggctccagccgggcccactgcttatcggtcagaacagcggaacgagtacgcgatttngacgacaccaccccagcttgccgccagaaccccgccacatatgggagacacgctctngcccttacccgtgcttcctgggggcgtttggctgtccagcgatggggccggc

SEQ ID NO: 580993 - DNA, 443 bp, Homo sapiens
  misc_feature (24)..(24): n is a, c, g, or t
tcgcgaacgtatatccaccatagntatgtaccaatggtgtgtacagatatttaaaatttgcgggagtgtgcgggaagtcagggaccccgaatggagggaccggctgaagccatggcagaagaacaccgattgtgaagatttcatggacattgattagttccccaaattactacttttataatttcttatgcctgtctttactgcagtctgtaaacataaattgtgaagatttcatggacacttatcacttccccagtcaatacccttgtgatttcctatgcctgtctttactttaatctcttaatcctgtcagctgaggaggatgtatgtcggctcaggaccctgtgataattgcgttaactgcacaaatggtagagcatgtgtgttggaacaatatgaaatctgggcaccttgaaaaaagaacaggataacacgttcgcgag

SEQ ID NO: 580994 - DNA, 185 bp, Homo sapiens
agcacgaatgtactcggcattccggatcgaacttcgcaggtgtgcgcgtggccatcaccagttgcaccaggtattcctccacggcatcggccatgtacaagccgaggatttccttgcgggcggcaaagatcgcctgttggctgacgcgccgctcggtgcttggtttcgccacttcaagtgcttcg

SEQ ID NO: 580995 - DNA, 687 bp, Homo sapiens
  misc_feature (87)..(87): n is a, c, g, or t
  misc_feature (96)..(96): n is a, c, g, or t
  misc_feature (133)..(134): n is a, c, g, or t
  misc_feature (136)..(136): n is a, c, g, or t
  misc_feature (157)..(157): n is a, c, g, or t
  misc_feature (182)..(182): n is a, c, g, or t
  misc_feature (194)..(195): n is a, c, g, or t
tggaaatgacgggcttttaatttctcaggaacagccgaaatgacctccagaggttcccagcgaagctgtaacaatccacccgggagntctatgacngggaggagggcgaatcaaatccatcatcttacgccannanttcagcccggggggagctgcntgcctccaaagaaagcggggaccgngggcggactggnntctctcccccgtggtgggaagaactgtgacagcatgtgaaggggtgggcgctgacagacacacggcctgcagcaagcccagccatgtcccccacagatcgacgccaaagtcatttaaaagggatttaggccactggccttttctctgagggaggagcggccagctgtgttgccccggggttcatggggccgtgtctaatcacacagccatgggcaaagaggagtatctgccaagacgcttccatatcactctattctgtctcctacatccaccttgaagttcaccccggttttcccccattggatcttagaaatcgggcttcgggggctaacgtttaacattggtcagttcgggggcctaattcctggtggaattcaccatcttcaaccacaacttaagaaacgccattgttgtgtcaacaccagtcacaggaagccagggcactcttgtctcccatttcttctcaccacacacaagtcatgcatctaccaa

SEQ ID NO: 580996 - DNA, 389 bp, Homo sapiens
tgcgtcgtggtgacaaggagccaggaggaggcatgcctgtgctggagtgaagcccagaccccaagtgatataccacaggggttgggatcagacgtgagttgctccatggtgtcattgcccctgctgatgaatgctctcaagttgagctagcgggttctgagctggcagatgtccttcgtctgctgacgtatggagttcaaccttgcctgtcgttcttgaaggcataagatacggtgataggacggttacagaggtactgcccattcatggcttcaattgctgcatccgaagcatcaaatgaagcaaaattaataaaggcataacctttggagttgcctgtgtcagggtcccgcataattttgggggtatgtaagatgaccccaaaggcg

SEQ ID NO: 580997 - DNA, 1399 bp, Homo sapiens
  misc_feature (361)..(361): n is a, c, g, or t
cgaatacgacgaggagtgagtcggagtgcccagggccccaatgctgaagctgctcgctagctggagtgagaggccacgtgtggctggtcgggttcgcgatagtccagtcagtgtctaaacccccgtgcagccatctacgtcgtgcctgagcaccgctgctttcccctcgccctaggtggctcccttgaccgccctcctgcagtatttatgcgcctcgtcctcccctactctatggccacgtgtgatgctgctcctgtactctgtcttattagcaagctccaggcctgacgatttaacggtctgtgtttcctagctaggttgcgtggtttatattgtgtccggtggaataccttaagtaaantctaatttgcttgtcatgactacccttgtaaatagactagagacatacaagaatagcataacaagaattggaatatagacagacgaaataatagaatagacaacaagacatataagagacagttgaagaggagaggcgcgccgacattccacagtggacaccactcacgccagagaaggtgtgctcccaatgtatcccgtttgtgcgacacacactctcattcggatatgtatgtttgccaattccctttgtattgcacactgcaactaggcggaactaggcccttccttgtaaagaatggcaggcttcgcacctgggccacgtgaataacattccgctagaacttgcattcgccccttaatctaggaagaccaagccagaagaaaacccgtgatatgcccccaactttccccttaaaaagacaaacggggccttataaacttgggcgcgagaatggcggacaagacgacttatttctgagccgacccaaaacaacaactttgcaactggaaaggttatgtaatatggtagggcgaagaaggcaggagacccaccatgtcaaacgaaactgggaccacgaagtttactatggaccaacgcgttggaagacataccccagcgggctaccgcgcaagcaattgcgcaacccttctggcgacacttggcggacatttcgtcgttggcacccttatacgagagagcccgagttgatttttcaccaccagcaggcctttttaatacatcccagagcgaagggccctataatctttctgcatacaataaacatcgaccgcggtgccgaaaaagttggtcgcccccgactcccttataccactttgaacgcgaacacagcatggcgacgacactatccctatgcccgggcagtcgatgtggcactgggactttgtcaaacagcggcgcacggactcaatgtatcgaacagtagcataacaccataaacgaaacaatctgatgtaccatcacagagaatgaatttaacgaaacgcacccgcgttaacatgacgagtactaatgaac

SEQ ID NO: 580998 - DNA, 511 bp, Homo sapiens
ctagaggatcccgggccaggcttggtgatcctatggtaaatatcagaagaggaagggagggtgtgactacagggcggaggggataggggagatcagacaaaaggtgctacaaaatcatgcacccctcttacctgaatgaaacgccggtgctgaaggcagttctaggtgggctagggccgcgtggtgtcacatagtccccaggtgcctgcttcacagggccgggtggtgggatcttaagtgccggttaatatcttaaggagaatttctaggcctgcttctgtgctttctggtttgggttctgttttctggatctcgggcttctcggttgggccagatagggtcttggctaaaggaacactctgctctgggacaagaatcggggagaatggccaaacagaaagatgtgagtgttaaaccaaaaaataaatttccaaaaggttttcctccatccagggtacaaataggatgtgctcatttattcatatatagacaagaaaaaggggatgggctg

SEQ ID NO: 580999 - DNA, 241 bp, Homo sapiens
tgatctacggatccctttcctacgagcgcatctcggtcactgcactcttccgcaccaggtacaagcgatctcctgcctcagcctcccgagttgctagggactacaggcatgcaccaccatgactaggctaatttttgtatttatctatgtagcagatgaggtttttgccatagtttggcctaggcgtggtctcgcaactacatgcacctccaggctgatcctgcccgacctcaagcctccc

SEQ ID NO: 581000 - DNA, 280 bp, Homo sapiens
gcggccgcctaccactactaaattcgcggccgcgtcgactagcaaacccccagcctctggcgaccactggaggagtgggatgaagactgataaaggtatatttgcgatcttaatccccgttttttgccaccttataatggatttgaggggagggaccttctgctccaatagggttgatgggatgctagtaattgaggagactgagtgtcttgactgcaaatgtgttggtgaggaggtttgactgtcattttagtgtgggaacagcatgctactttgggcc

SEQ ID NO: 581001 - DNA, 1305 bp, Homo sapiens
ccacaggtcccccggacttcctgctcagcttaccctgagcagcgcccctacctgctttccctcctgagcaccttgtgttactcagcccacccaagcagcctgctcggcgcccatacacctggcctgatccccatctacagtcaactctagcatctagggcccaaggtggtcccctcgacctatgcctctttcctctctcctcattccacactccgtgcgtcaaccaccctgaagccggtatcacgatccactgagtcccacacaagatcacctctctgacctatacctcccatgacagatgcaagcgggggagaaccccatagagagagcagccccacgagggtaacgcccgcctcaaagtagcgcgagattgcccaagagtgttcccacatggagggcgccaaccgtgcccatcgaacagcccaaccctactcagatggccactcataagccatcggcgggcaagacgcacgcgtgggcgaagcgcgatgaactgaggagcacggggacgagcagaagcgcacggacggacattaccccaacaccggcacgggcggatatcaccgatctggattcatccaccgcacaacgaccttggcgaccgcacgcgccacaataccggaaccaggcggacacgcccgcgccagcgccatacggagtatatcaccactactccagaacgcagccaccccattagaagagcccaaccagacagtaccccagccaagcagcgctaggagatacgcacataccacaacaacgacacacatgcacacagacgaggaccgaccgatgggaacaccacaccgcgatatccagcacccatcaaccccatgggccacaggaaaacacacaaacacacaggccacagcatgagcacgcaaacggggagtgcgcccccaggactacccaggtcattacgcgataaaccccgccatgatgcaaccgcgccagccgaacctatgggaaacgatcaactacgggcgcaccaccgaaaaagcccaaagacactcccccccattaaggcgtcacacaaggggacgtaccgacgcccggagctgggcaaaacccgcaccaaggaagacgccaacgataacagccccccaccaaaggggggggaccacaacgaaagaaacgcgtctactcggcaatccacccgttctcggcccacacacgaagcgacgcattgagtcacacggcgacaccgccacaggtaaaacccccacgaacctacgaggcccgccgaaggcgccgtcacagcaccgaaaaaacgaccagaggacggagcgcacggcacacaggcgg

SEQ ID NO: 581002 - DNA, 220 bp, Homo sapiens
ggccattgtccgaacgagaaatgcaccctcgaaggagaggcctatagagcggacacccacgtacataaggccgactatgagcagagaatccctgcagctgaaagagaagaagcactaccctaggtgaaggaacgccttccacttgtgccgagagaagcccatacgcagctacataatcgtggacactagcatagaactctgtgccgagctggactacgcc

SEQ ID NO: 581003 - DNA, 89 bp, Homo sapiens
cagcgccggggtcttctccacaatggttactggacaaattgggccatggttctggaatcagactgctatctgaataaataagatttgtc

SEQ ID NO: 581004 - DNA, 599 bp, Homo sapiens
aaaaatataaagtgccaaagtagacatataaaaagaacaggagtttaagaccagcctgggcaaaggagtgagaccctgtctcataagagaaagagaggccaggcacagtggctcatgcctgtggtcccagcacttggggaggctgagacgggcgtttcaccgtgttggccaggatggtctctatctcctgacctcatgattcgcccgcctcggcctctcaaagtgctgggattacaggtgtgagccaccgcgcccggccgcttgcgtaatctttgattgacagttgcttctagccaagcattgctctataattttgcctttttacatctatcttctcggtgttaatgatctataagaaagtttgtcaagtaggtcaatgtccatgcagaactgcatagctctgataaggcattgagaataatcacactcttactatatctcttctgtaaaatacaagatttcttgtaaggatattccttgtagtccctagtgtcggggtatggtcagcattagtacgcagtcgcaattacaggcataacgtgtctcaaactagatcagattgtggtggttgtgttgagggccaatctccagttatagat

SEQ ID NO: 581005 - DNA, 331 bp, Homo sapiens
caccagggatgctcctctgtcttaagcttcattgttccaatgggcacatagttatagttcttacctttacttctctgtatatataaggtattaatatttatttctcagtgttacaagatttctcctatcattgattttacgcaatttgaatatggtgagcctgggtgtcagttttcttcatgtttcctgtgctaggggtatagtgagtgttgtgaatctgtggctgtatggttttcagtaaatgtggaaacgattttgcatcattatttcgtttaagcatgtttctctgtttcccagcgccccccaaaattgaatttacagcatagattag

SEQ ID NO: 581006 - DNA, 738 bp, Homo sapiens
atataatactaacattgaccatctcacttctaggagtactagtagatcgctcacacctcatatcctccctagctatgcctagaaggaataatactatcgctgttcattatagctactctcataaccctcaaggaccacacgtccctcttagccaatattgtgcctattggcgatactagtctttgccgcctgcgaatgcaggcgggtgggcctagccctacgtagtctcaggtctccaagcacatatggcctagacgtacgtacataacctaggactattccaatgctaaacagtaatcgtcccaacaattatattactaccactgacatgactttccaaaaaacacataatttgaatcaagcacaaagcagccacagcctacttattagcatcatccctctactattttttaaccaaatcaacaactaacctatttagctgttccccaacttttctcgaaccgctaaaaacacacgtctaaacgtagtaactgaatcctacaccgttaaaagccatggacaggcaaatgcaaatctatcagggacagctataggaagagaaagggtactctctatactaattcccgtaacctgtgcttactataaactcacaaggcaagaataaacatatgtatatctaacgagagccacttataccaaccgggcatcagaccgatgaggacgcccgaaggctgagcagccgtgaacattgtaacgtagtagccatcgcacacagag

SEQ ID NO: 581007 - DNA, 534 bp, Homo sapiens
  misc_feature (92)..(92): n is a, c, g, or t
  misc_feature (226)..(226): n is a, c, g, or t
tcaaggatccaggcaagctctactctacccatgtctctcccaagcagtccttctggattctaactgctcatttgatcaaggtgctattacanaactctccctaccattctagcagctctgcctcctttcaactcttcacatttgtattgccttcccagactgctccagtctatatagctttaaagttcactttgggcccacagacccaagagctaattttctggtntgtgggttgaaacaaagctgtgaatcactgcaggctgtgttcttgcatcttgtctgcaaacaggtccctgcctttttagaagcagcctcatggtctcatgcttaatcttgtctctcttctcttctttatgatgttcactttaaaaacaacaaaaaccctgagctggactgttgagcaggcctgtctctcctattaagtaaaaataaatagtattagtatgttggtaagctattctgacagaaaagacaaaggttatacttgtatgatagtgttttcatatggaagaatgtacagcttatggacaaatg

SEQ ID NO: 581008 - DNA, 741 bp, Homo sapiens
  misc_feature (73)..(73): n is a, c, g, or t
  misc_feature (107)..(107): n is a, c, g, or t
atgctgtgttggcagggctctgatcagtaatgaggggaagacaagtcctgtaagtaaacattagtgagataanatagcccgtgaaacgctggcggtagtctgattgncgtaacaaccatagtgacggggatcattaccagcggaacaccagtcagtaactgctcacatcgctactctcactggttctctgttgttaactgatatctctattgcatgaggaattcgtcccagcaaatgggatggagttaatccctggggtaggaaaccacgtgaaattgggccagctagtggtgctctttggcataggggtgcaaagtcctgtctcgaatatagattgacagttgtagtcgctggagtaagagttagaccagcgaatggagtgttcaggacaatgatccgttgttagatggacttggagtaccagaactaaaacaagagtacattatgcggatgtaggagaatggctatggcgtggcattttccctgagattaggaactacaacttatttcagataatttaacatgattgcaggtgtttagccgaaaagtgggtcgataggaggaaatatgtctcgtgacaagcttatctgaggtggctggccaggagagaagtggacagcaggatagtgaaagcagctgcgagagatatcaatgggaacagaggtttcagaagaagatatagcaatattctgctatctttggggccaggtgattgatggtctctgaatatcgaaccagatt

SEQ ID NO: 581009 - DNA, 212 bp, Homo sapiens
ccccttgtttgctaatgtttaattttgcctcataatttttcccttgtccctgagggtcagaactataatttattccctttctctctgggtctgggccaaaaaacccaggctttgggcctgccccctgccccggaggccctgcccccctgtgggcttgtgggacccccctggccctgggcttccagggccccataaaaaggctttttttttta

SEQ ID NO: 581010 - DNA, 261 bp, Homo sapiens
tggcgaatgacctgtgtgttatcccaggagttggggatggaaggggagaaatcatcggctgtaagatcagatgagaatgaacatgggaacagcctacatcaagaattgtagttaccaaggcacgaaactactacagcaatgttctggtaacatggaacaagaagcaagtgctattatagtcgaggccaacatcgtacatcttctcctggttggtgtccacttgttacaaaatggggcacgatgctctaacccgaaagagta

SEQ ID NO: 581011 - DNA, 328 bp, Homo sapiens
caaaatgtgctctgatgttagcccaggaggtcaaagctgcaatgggcagtcagtccccaaaaacaagctggccagctgggcgtggtggctcacgcctgtaatcccagcacttttgggaagccgaggcggatgggtcacctgaggtcaggagtttgagaccagcctggccaacatgaagaaaccctgtctctactaaaaatacaaaaattagctgggcgtggcggtgggcgcctgtaatcccagctactcgggatgctgaggcatgagaatcgcttgaacccaggaggcagaggttgcagtgagctgagattgtgccattgcaccctag

SEQ ID NO: 581012 - DNA, 570 bp, Homo sapiens
tcattcacttaccattatctacaactatattttattctaatttataacagcataaatgattctacaatgtactttatcatctcaatcttcaacacggtggattccttttaattaaaaataataataataatcaatcttctccataaattgtcttagctctccatagcatacgttatataaaattagagttttgcttccaaaaatatgtttccatgtcgtcgtgcgtgtcgtccagcgctctgagggccaaagcaccaaagacatgagaagtttaaccatcgacttgtcatttttcataaaaactaaacatttccttataggtctggagtaaaatcttctaggcattttagtgctaaaagtcactttaaattaaatgtgaaataaaagctacaaaaagtatgagttctttcaatacaataagttgtgtagctgaagttgtgggctcctttgacatacataagcagtttcaacaaaatatttgctcaggtaagaaaatagaaatttgtctgctttcatttagcatacgttccagtcgatgtcctgcttatccctgccagaacttctgaagaa

SEQ ID NO: 581013 - DNA, 248 bp, Homo sapiens
acggaacgtcgcgcaagtcgacgatggataatcggcggtgctcgacgcgatatccagttgcgtatcgaaattttatgaaccgatgctcaggtttgaaactcgctttccccgaaccccatgacatccatcccgcagccccgtaaatcgccgcgccagcagggttcgaagcagaccgtggacaccattctgcaggccacggatcgcgtacgtgccgagcacggctaccgcgggaacaaacaccaacctga

SEQ ID NO: 581014 - DNA, 1441 bp, Homo sapiens
ggcagtgattggggccccaccatctatgtctggagccggggtaggaccccacaagccaaatctgagacctgctcccggaactgtaccaatcctgatggatgctactgctgccgtacgttggggcccaacccggaactctcctacggagacaactaatgagcgacctggctttctctggtatggagaaacaactggatcctgctgtattgaccccgagatgtccgtggagagggaacgacgcatcaacgagtactagtctaccaacaagtccgctgccccacgttccattgactccaagctcccacagtgcgtgatcatcgccggggttgggatcctatttccgcaaaaatcgttcaccaccaatagaacagcatcctagggtaggccatggagggcacttgctggacccgaccaagtccccatgtcatccgctggacactttgtgaacgcaagctcgctgtggcgcccacttgggcgacggggggctgtcccacagggaacgcggggaaggccctcgtaggccggagcgatacctcatactgtgcaaaagtccgtcggccttgagtttgccaatcgaaaaccgtggagactcaatggggcgatcgaccgggtaggcccctccattgtcgcacaaagtcccttcgtttgatccccaagtacccattcgaaatccccatcgactaacaaactagtgcgtcaagaatggctccacctttgagttgggtcaacatgcacctcgatgacccttgcgattcgcctgtcccaactcgacttttgcctcttggacgccgggagaccgcaagtgacttggccattccttcgctccccattggcccattggcgacccttaacgtggtacagaaagggataataatcccatatcccactgacgggacgaggaaagatgaatacaagtaggtgggacaaggtgcgtgggcctcagagttacccacgatgaaaatccgcttttgggcgatcgaaggtggtgcgccccatggtaacccccaaacaaatcccaggatcaaattgggagcgcatccgtttggcattgtgaacacaacttagcgcggagccgatacaaagcgcttgcgaacccacaagaccacacaatcccacaattgacggattcaattgatagcctgcccccgaacaaaagacacaaaggactaccagagatagcacggaacgaaaaaaaagcaaaaccacagggaacacgggaaagaaagagaagcgacaagcaagaggggggcaccgtgccaagcacagcgccgcggaaccggcggcgccccagggcgcacgggcccgacggtacaagcccagagaaaaccacggatggcacaccagcaagcgagaccgagggacacgagcaccggacacacacgggcgaacgacacgaagacagacagagcacacacgaacacgacagccaggagaaaacgag

SEQ ID NO: 581015 - DNA, 861 bp, Homo sapiens
caactaagggtgatttgtctcccaggtacagttggcaatgtctgaggtcatctgcaatcgtcacagctggagagtggtgctgacgtctgtgggtagaggccagggcatgctgcgaaactagcgcccatcatgcacaggacagtgcatcccccgccgcaaaaaataattattcaacccaaaatgctgttgagagaaaccctgcataaactgtgaaaatatccgtcttttcccctcatttctccatcgatctcgacccagaagctaagagacgtgattccaaagatgaagggagatagagctctgggagtcacgcagcgtataacaacactgctgtgtatttctacagcgaaattagttctcagtcgacggtaggtcatagtggcctcttctgaaaggtggggctggtgagcagcaactggagatgtcgtgagaaggacttacctaggaaggactgccctcagctgacccgagctcctagaggaaagcccgtatggtggctatctcgttgaacagctggctcgattcgcgaatctctagccatcccccttacccccgttagttctacgtgcggtcacaggaaaaggaaagcgtcttggctgctatcttcgtcaatgcggggaagccagaagtatctcagggctacctgttcgtatgcctttcctgtaagtctacaccatcgctatcatcaccacctctcaatgtactgaccttattcttcctttaaccagaagtgcatgtggaaacctcatacagaagcacgctacatgtgaccctggcttaccacgttccaagccagcagctaaccaccctagagaaactggcccacaaccatcgacgtccaactcgggtgtcaccggatgg

SEQ ID NO: 581016 - DNA, 254 bp, Homo sapiens
cgccaagggagtcgctgagcctaccgacaggaggtaaaaagtgtagtaccagcgggtacacaaacatacacaaagtagcaagtgtaacatgtcaccagagagggacaaaccacattctaaaaagagttaagacaacggagaaatcctttatgagggtaggtggcaccatggtttttattatgagcacagagtcttgctctgttgcgcaggctaggagtgcagaggtgcaacactcggttcaatgcaacgtttgc

SEQ ID NO: 581017 - DNA, 142 bp, Homo sapiens
tctagaggatccgtagataacgccattatagccattagagttctgcggagggctcggggatgccaccttggaaagaagccacgtagtccatagtctttgaaaataagtgtcactgctgtgcccaatccattgaaacttcagt

SEQ ID NO: 581018 - DNA, 223 bp, Homo sapiens
atggcagtgtgatcgagtgtctgagttcaacgtctccgggatacagagcgcacagaacccggctcaaagcaaagggtgctgataaagttacattttacacccgtaaagctgcattaaaagctcaaaatgctcttcacaacatgaaagtcctcccagggaatgcattacccctatacagatgaaacctgtctgcacagtgcagaagaacgaatgcgagtggaag

SEQ ID NO: 581019 - DNA, 1309 bp, Homo sapiens
  misc_feature (744)..(744): n is a, c, g, or t
  misc_feature (907)..(907): n is a, c, g, or t
  misc_feature (916)..(916): n is a, c, g, or t
caccggcgtcttccacccagtggcacacgctccaagtgtttcgccccgacccacgggggggcgccccccgcacagatgccgtggtccacccacacgccccggggttttccccaccgggttgcccacacacccggtttgggggtccccgcaaagcccgccttccgtctccaattatccctcccccggccttgtcgcccctggggagttcccccgccgccctggggaagagtccgcccttggtgctcttccctgggccactggtttttggagcccacgcccacgtggagtaatggtaatgaaccaacggaggaatgcccagaaaggcaaaagtgaagaggaaaaggcctcctctttaaaagaagagtgccgccccaagcgcccccccccctagagcgcgcgccccacacaaggtggcccacacacaaggcaatgggcacaagccaaattccctgctcgtcttgtcgcggtcgcgtgcgcggtcgtgtccccaggccagtggaatatcttggagcgctgtggatatacccgggccccctggggaccccgttcgccctccaaagttctgtccacccacgatatctttgcgtgcttcgccccatcccaagactttccagaatagccccaatagtttgtgacatggggggggaatagtttagcgccactttgtggcgctcccccaacgcgcccgtatcgcgtctcacacccctgagagcccctcacacccgcctgtcctgttttgagagncccccctgagagtgtgcctataggggggagaatatgtggagaagagaggagatttcgtccacctggcgcctgcgcgcacatctctttgtgtttgtcctgtctctctgggttatgagatcacataatatagctataatgagaattatggccacagcgggagagnctatatttntgttgagaagagatgagatgagaactataaatgtttgagaagaccacacggtttgaggagatctgtataaaatggtgaattttttaacgttccaccctataaataacttgtgaattggggagggtttgtggagaaattcacaattattgatggaaaacctatcttttttgtaaatgttggcactaacttggggagaatttaagtggcacaatacacttccccacgcacggcctctttgttggttgcacctaactgccaggttgctgggaaatagagtccacatttggttgatgaggctttgagctgcggttttggaaccctacctctcctccttagccccatatgctgttcttgggtcctattccaaataaagttattttctcctggtttcca

SEQ ID NO: 581020 - DNA, 1026 bp, Homo sapiens
  misc_feature (1)..(1): n is a, c, g, or t
  misc_feature (64)..(64): n is a, c, g, or t
  misc_feature (72)..(72): n is a, c, g, or t
  misc_feature (100)..(100): n is a, c, g, or t
  misc_feature (152)..(152): n is a, c, g, or t
  misc_feature (170)..(170): n is a, c, g, or t
  misc_feature (176)..(176): n is a, c, g, or t
  misc_feature (186)..(187): n is a, c, g, or t
  misc_feature (190)..(191): n is a, c, g, or t
  misc_feature (197)..(197): n is a, c, g, or t
  misc_feature (200)..(200): n is a, c, g, or t
  misc_feature (227)..(227): n is a, c, g, or t
  misc_feature (291)..(291): n is a, c, g, or t
  misc_feature (322)..(322): n is a, c, g, or t
  misc_feature (334)..(334): n is a, c, g, or t
  misc_feature (337)..(337): n is a, c, g, or t
  misc_feature (342)..(342): n is a, c, g, or t
  misc_feature (344)..(344): n is a, c, g, or t
  misc_feature (348)..(348): n is a, c, g, or t
  misc_feature (360)..(360): n is a, c, g, or t
  misc_feature (412)..(412): n is a, c, g, or t
  misc_feature (422)..(422): n is a, c, g, or t
  misc_feature (441)..(441): n is a, c, g, or t
  misc_feature (473)..(473): n is a, c, g, or t
  misc_feature (477)..(477): n is a, c, g, or t
  misc_feature (482)..(482): n is a, c, g, or t
  misc_feature (494)..(494): n is a, c, g, or t
  misc_feature (497)..(497): n is a, c, g, or t
  misc_feature (503)..(503): n is a, c, g, or t
  misc_feature (519)..(519): n is a, c, g, or t
  misc_feature (548)..(548): n is a, c, g, or t
  misc_feature (554)..(554): n is a, c, g, or t
  misc_feature (579)..(579): n is a, c, g, or t
  misc_feature (600)..(600): n is a, c, g, or t
  misc_feature (606)..(607): n is a, c, g, or t
  misc_feature (610)..(610): n is a, c, g, or t
  misc_feature (614)..(614): n is a, c, g, or t
  misc_feature (645)..(645): n is a, c, g, or t
  misc_feature (655)..(655): n is a, c, g, or t
  misc_feature (767)..(767): n is a, c, g, or t
  misc_feature (801)..(801): n is a, c, g, or t
  misc_feature (856)..(856): n is a, c, g, or t
  misc_feature (903)..(903): n is a, c, g, or t
  misc_feature (1024)..(1024): n is a, c, g, or t
ntttcctggcggagaggtcagtgcatcgagttctgtttccgtggaaaatgtgcaccttggaaancgcatganagccccctcggcagggtccccgcggatncgccgcgaagcaggcacagcagcaagttcctccagcacgaagctggcctgcncgggcccaggtgtgaggnactgtnctgctcccannagnncccgcngangcttccctctgcggtctcggcgcaacntctgtccctggccgccctcggagccgtgcccagcctggcatgcatatgcggtggttaaggatanagttaaagggtcaattacgcgtgttcacganagagacgcacgnggnctcanancgantcctcggtgganagcaataatgggttgatatactcaaagccttcgaactctgactggtcgatcntctttatggnatcctcatcgtctggggtnagctgcacgggctcgctggtgaactgtgtgtnaaanttgtncagaccgtagtngtntgtganctgtggctggaatggngggagcgcctgcttcttctccagcaagtnccagtntatgctgcggaagaacgcgtggganttgatgtcagaaaatccagtntgtggnnggnagcngagcatctctttggggtcttatttaaaaatncttttaaaanatgggaggctttgacggacaggaaccgggggatccggatgggcttctccaggatcacttggaaaaggtagtcctctgtgttcatgtccgggttgtcggtgatgatgtcgaanggggagcgcccggccatcatctcaaacatgaggnctcccagcgcccaccagtccacgctgaacccgtactcctctccccgcagattttngggggcgatgtaattcggggttcgcagaaagtgctcgttgtgtcacnagggcccaggccttccttgcacatgccgtagtctgtgagcttgatgtgcccgtccgcatccaggaggacgttgttcagcttcaggtcctgtagatgatcccctctcgtgcaggaagttgangg

SEQ ID NO: 581021 - DNA, 878 bp, Homo sapiens
cgtagtggctcatgcctgtaatcccaacacttgggaggctgagatgggaggatcacttgagctgagttcaagaccagcctgggcaacacagataaaccccatctctactaacattaaaaaaaaaaaaaaaatcagcgggggttgggtacgcacatccctgtagtcccacctacttgggaggggtggggctgaacatgggaggatcaactggagcccaagaaggtaaaggctgcagtggagccctgattggtcgccactggcaactccaagcagtgggcgtgcacaagacagcaaggcccaatatcgcaggttgcagaactcggatggaatcaagtcttccatggcggtagagcctgggctatcattattcgggggtaaaactccctttggaagtgggctctaaatggtgtacccaggattgcagaaccattggcgttaaataacgcgaaagacattgggtggggcacgggggctcacgcctggtaatcccagacatttggtggaggccgaggtggggcagatcatctgaggtccaagagttccaaacaccagctggacccaactaggggcagaacccctggtctctaagtaaaaatatccaacaatcacgccaggccttgttggggcaacactagccctgggtaaattcccccaagaccaaacctcccggaaaggccttggaaggcgcagggacaaacattcgggttggggcaccccctggaagaagagctcgcaaggttgaggacgtaaccgggaccaagggagattccaggcccccagtaacagagttcacaggacccaaggggcaacacaagagagcgaaaactgtcaccgaggctccacaacaagaagcgacagcgcagacagcaagcacacaa

SEQ ID NO: 581022 - DNA, 304 bp, Homo sapiens
  misc_feature (36)..(36): n is a, c, g, or t
  misc_feature (42)..(42): n is a, c, g, or t
aggacccggaatgtgtggtgttatgcgtcaagctgncggagnactgttgtgctgctgctactgctggaatcaagtgacgatttggggttgttcccctccttagaaaatgctgaaactctggaatcaacctctactcaataaacccagaaaatcccagaaagcttttctaaaatcactgacccccgaaaatcacccctttgaggatctacgctattccccaaggctctgcactgccattgaatagaaccctccaaaactctactcgaaactctgccataacaccacacattcagggtcctgctag

SEQ ID NO: 581023 - DNA, 290 bp, Homo sapiens
acattgccattatcctgcgtctgttttctctgtgacatgaagcaacagaaactgatactacaaacaggatataatcttaactttgatctcaggtttctgttgcttcatgtcacagagacaaacagagatcaaagttaagattatatcctgttgtcgtatcagatataaaactgtgtacaattataggatgtcatctaacactggaacatttttaggcagtacagtcaccacaaacatgtgttagataagacacacagtaaaatcattataactaaaagcttaaaaaaaaa

SEQ ID NO: 581024 - DNA, 272 bp, Homo sapiens
gtacccccatgtttggcccgcaacgtggtcggcatcatcctgaccgtgctggtgggccgctacgccatcgtcgccctcaatcgctacctggaaaaacagaagcagaccgaagcgctgcccgatatcgagcggcgcaaggaactcagctacgacacggcgctggcgcggctggccaagaaggtctgccccggttgcgagcggtcggttgatctgaccaatacggccattgattactgcccgcactgcggtatttgcctgtttgaccacgtgcg

SEQ ID NO: 581025 - DNA, 353 bp, Homo sapiens
gctgacctagaggacccgcgttatccgtacaggaagtctcttaccccactgcacatacctctgttttaaagataagtccactaactgtgagtaaaatgatatatataggccattaaccacaaactttaattggtattaatttccttggttgcctccccttcctcagcccattaggttaaacaccaaaaaaagactggtgtgtactgaataggaaaggggaaagtttattttgggacccttctaaagaggaaatcaaccaggaccaaagagcctttaaaggaacacaacagcaaatggcacaggcaacttcccttccccagcttgagttgccctaaggtggatttcttcaaagc

SEQ ID NO: 581026 - DNA, 260 bp, Homo sapiens
tggtgttaccgtcttacaccacagtcacagcacgcagatccgagctgcatctgcaactacaccacagctcagggcaatgccagatccctgacgcattgaccgagtgcaggaatcaaacccacattctcagatactagtctgattcttttctgctgcaccacaacaggaacttcctataatcccaaaattttggtaagaaagtccatttgctattttcctgactttttagaataatcatgataacagtatttaaaatctac

SEQ ID NO: 581027 - DNA, 759 bp, Homo sapiens
gtatgtacatatatatatatttagatgaagtctcgctgtgtcacccaggctgtagagcgcagtggcgcaatcacggctcactgcagccttgaactcctggactcagcctcctggctcaacctcccaaagtgctgggattactcttgagccagtttgaaatgaggaatcccttttcaaaaccatctttcaggctgacaggatggctcatgcctggaacctcagcacttgggaggttgaggcaggaggatggttgagcccaggagttcaaggctgcaatgagctatggatgtgcgccactggactccatccgtgggtgacaaagtgagaaacccctgtctcaaacaaacaaaaacaaaaaaataacaaaaacatttttgggggcggcgctgggccccgagaaaaattttttaaacccactctgttggggggcgggggcccaatgagggaaaagggaaatctggggcaaagggggtgtccaaaaagaaaaccctgcgggacaggacgacgcgaggtcgagagttcccacccaaagataaaaaaaaagcggccgggagagaagacccgggacggtttttgagaaacacaaacccaccagaggagagagatcaagaagggccaaacagcgggggtccacacacccagggggcgcccaagaggacgtcagaataaaataagcgccgcgacgggtgaggagcacaagaaacggacagagacagcgagcagaaaagaagaaggagcacgcgacaagatcgaagcatg

SEQ ID NO: 581028 - DNA, 431 bp, Homo sapiens
tcatacacgactatatcaaatcgctggccagtaccagctctacctaatgcgtccaggagcgatggtatataggcctcaacatcctgaggaggagaactatgcatcaccaggtccattacaggcatgtccacaccacgggcagacaccttggttgccagcaaaactttaaaactaccttctactgaagccttataacgtgtactttctactattgtgactgtgcaatgtccccatgtaaagactgggcatactgttatatgtgtggattcatggccatttcagttacattcttctctggtctcacagaaaataatagccctcccttcagagcccactgtagacttgaaggacaatctccaataactgctggcctcatagaccaatgacacattgatggacaaatgttccacagtagttgcagccttttgcgt

SEQ ID NO: 581029 - DNA, 583 bp, Homo sapiens
caaccaggcaaaggggctatgtgatagaataatcaggagagactctaacaagcactagtaagatacagctaaattcttcacagtacacaagacccatcaataatgtagtatagagaccaaaaggtcaagagagataaaatacataactgatgtgtggattaattcacgttcaagcatctacatgtgtaacagcacagctgatcaccaggcgataatgagtaaatcgtacaacgggttagtttcttcccacattattctataaatggacaccgatgggtagtgaagcaatggtttcgcagtccaacttcagaggctgctgtggcgggggtctagtactgcatctgctcaaagaactagtcggtaggattatcgtagccgttctgctgcatcttggacaggtggcgcacctctggggtgacagcggcgtcaacctccaccacaccatgatgcatggatgtgtactgtttcttcttcagcatcaccaatgtgatgacgatcactgtcgctatgacaacaccgaccaccatgagtccaatgattgcacctttgtttgaacccacatcttctgcaaagaacacaattt

SEQ ID NO: 581030 - DNA, 1001 bp, Homo sapiens
  misc_feature (12)..(12): n is a, c, g, or t
  misc_feature (56)..(56): n is a, c, g, or t
  misc_feature (128)..(128): n is a, c, g, or t
  misc_feature (188)..(188): n is a, c, g, or t
  misc_feature (191)..(191): n is a, c, g, or t
  misc_feature (266)..(266): n is a, c, g, or t
  misc_feature (282)..(282): n is a, c, g, or t
  misc_feature (288)..(288): n is a, c, g, or t
  misc_feature (300)..(300): n is a, c, g, or t
  misc_feature (397)..(397): n is a, c, g, or t
  misc_feature (434)..(434): n is a, c, g, or t
  misc_feature (484)..(484): n is a, c, g, or t
  misc_feature (487)..(487): n is a, c, g, or t
  misc_feature (501)..(501): n is a, c, g, or t
  misc_feature (513)..(513): n is a, c, g, or t
  misc_feature (519)..(519): n is a, c, g, or t
  misc_feature (530)..(530): n is a, c, g, or t
  misc_feature (535)..(535): n is a, c, g, or t
  misc_feature (568)..(568): n is a, c, g, or t
  misc_feature (574)..(575): n is a, c, g, or t
  misc_feature (590)..(590): n is a, c, g, or t
  misc_feature (597)..(597): n is a, c, g, or t
  misc_feature (607)..(607): n is a, c, g, or t
  misc_feature (612)..(612): n is a, c, g, or t
  misc_feature (618)..(618): n is a, c, g, or t
  misc_feature (625)..(625): n is a, c, g, or t
  misc_feature (636)..(636): n is a, c, g, or t
  misc_feature (641)..(641): n is a, c, g, or t
  misc_feature (663)..(663): n is a, c, g, or t
  misc_feature (675)..(675): n is a, c, g, or t
  misc_feature (683)..(683): n is a, c, g, or t
  misc_feature (689)..(689): n is a, c, g, or t
  misc_feature (692)..(692): n is a, c, g, or t
  misc_feature (694)..(694): n is a, c, g, or t
  misc_feature (703)..(703): n is a, c, g, or t
  misc_feature (747)..(747): n is a, c, g, or t
  misc_feature (758)..(758): n is a, c, g, or t
  misc_feature (768)..(768): n is a, c, g, or t
  misc_feature (790)..(790): n is a, c, g, or t
  misc_feature (799)..(799): n is a, c, g, or t
  misc_feature (811)..(811): n is a, c, g, or t
  misc_feature (828)..(828): n is a, c, g, or t
  misc_feature (839)..(839): n is a, c, g, or t
  misc_feature (856)..(856): n is a, c, g, or t
  misc_feature (878)..(878): n is a, c, g, or t
  misc_feature (880)..(880): n is a, c, g, or t
  misc_feature (901)..(901): n is a, c, g, or t
  misc_feature (904)..(904): n is a, c, g, or t
  misc_feature (911)..(911): n is a, c, g, or t
  misc_feature (934)..(934): n is a, c, g, or t
  misc_feature (949)..(949): n is a, c, g, or t
gtggtgagcgcntcgaggatgaggaggtgaaacagcggctccgggccgccgccgtngctgctgctgctgctgctgtggctgctcgcggttcccggcgctaacgcggccccgcggtcggcgctctattngccttccgacccgctgacgctgctgcaggcggacacggtgcgcgggcgcggtgcgtgggntcncgcagcgccatgggccgtggagttcttcgcctcctggtgcggccactgcatcgccttcgccccgacgtggaaggngctggccgaagacgtnaaagcntggaggccggcnctgtatctcgccgccctggtacgtgtgctgcaggagaccaacagtgctagtctgcagagacttcaacatccctggcttcccgactgtgaggttcttnaaggcctttaccaagaacggctcgggagcagtatttncagtggctggtgctgacgtgacagtactgctgtcgtggagaggctcattngangcccctgtgagtanccatacataganacgtgngccccccagcnctgtncccccactgggagcctggctcaagctgggaggnagattnnatgggattcttttgncgagaanataaacgaangagtnacctgngctctgnatcttttgaanaaggngagagctccttacctcgcggtnagaggagtgtgngctctagngacctngtncnccagccacnaaagggcggtgggcgggtggcgcaggggttgctggaacgacagnaggcccaatgntggttggagnaaagtttggttgtgcaccgacnttccccctnctttgctcaccngctagttcccgggaatnggctcttgtgntcccggagttccccgtngctcatgggaatcccaggtccntnctataaccgctttacctgcanganactctcntggggctcaccaggggaggctgncccaggaccacagtncgccccaaccactgctgaacaagatagctcccactggtttgggaaattgggg

SEQ ID NO: 581031 - DNA, 626 bp, Homo sapiens
  misc_feature (191)..(191): n is a, c, g, or t
  misc_feature (222)..(222): n is a, c, g, or t
  misc_feature (241)..(241): n is a, c, g, or t
  misc_feature (563)..(563): n is a, c, g, or t
  misc_feature (586)..(586): n is a, c, g, or t
ccacttccacacacctgctgcgcttctggcagcagccactacctgcaccaggacacaggaccaccacctgcctagagaccagctcctgcatcagacttctcataactggaaggagaccagtgtcccaacccgtgtgaaccccggaccggccagtcaccctctgctctccattagctctgtgtgagctcctnccggtttcttggctgtcagtcagtcccagantggggaggaagatatgggngacccccaccccccatctgtgagccaagcctcccttgtccctggcctttggacccaggcaaaggcttctgagccctgggcaggggtggtgggtaccagagaatgctgccttcccccaagcctgcccctctgcctcattttcctgtagctcctctggttctgtttgctcattggctgctgtgttcatccaagggggttctcccagaagtgaggggcctttccctccatcccttgaggcacggggcagctgtgcctgccctgcctttgcctgaggcaaccgctcctgcctgagcctggacatggggcccttccttgtgttgccnatttattaacagcaaataaaccnattaaatggagactattaaataactttattttaaaaatga

SEQ ID NO: 581032 - DNA, 606 bp, Homo sapiens
  misc_feature (9)..(9): n is a, c, g, or t
  misc_feature (17)..(17): n is a, c, g, or t
  misc_feature (102)..(102): n is a, c, g, or t
  misc_feature (501)..(501): n is a, c, g, or t
  misc_feature (598)..(598): n is a, c, g, or t
ttgttaatncaatagtnggtattatacacagtttttaggttaatccttcattctcagtatgtcttaagacctatgcctttacctcaggctcagtttttttantgaattaacagtatttcattggatatacatgccataatttatttaaactagtaattaggatatttttagtatttttcaattgctaaccttgtaacactgattgttctatccgcttcatttggggtcattttgtatttcatcatctttgaagaaggagtaaggaaatttttctggccttcctattccccattcctaaattaaaggcaaaaaaacctttgtcagtatcaaggctcaatttctctcacgcctgtaatcccagcactttgggaggccgaggcgggcagatcacgaggtcaggagatcgagaccatcctggctaacacggtgaagccccgtctctactaaaaatacaaaaaattagccgggcgtggtagcgggcgcctgtagtcccagctactngggaggctgaggcaggagaatggcgtgaacccgggaggcggagcttgcagtgagccgagatcgcgccactgcactccagcctgggcgacagagcganctccgtct

SEQ ID NO: 581033 - DNA, 618 bp, Homo sapiens
  misc_feature (17)..(17): n is a, c, g, or t
  misc_feature (59)..(59): n is a, c, g, or t
  misc_feature (71)..(71): n is a, c, g, or t
  misc_feature (75)..(75): n is a, c, g, or t
  misc_feature (114)..(114): n is a, c, g, or t
  misc_feature (183)..(183): n is a, c, g, or t
  misc_feature (214)..(214): n is a, c, g, or t
  misc_feature (233)..(233): n is a, c, g, or t
  misc_feature (555)..(555): n is a, c, g, or t
  misc_feature (578)..(578): n is a, c, g, or t
cttggtgggagggaagncctagaagcccctcgccccccctgggcctgaggcccctaggncatggagagccncagnccccataatgaggacagggtaccatgcccacctggccgncagaacccgggggcccagggccacccagaggtaagaggacatttagcattagctctgtgtgagctcctnccggtttcttggctgtcagtcagtcccagantggggaggaagatatgggngacccccaccccccatctgtgagccaagcctcccttgtccctggcctttggacccaggcaaaggcttctgagccctgggcaggggtggtgggtaccagagaatgctgccttcccccaagcctgcccctctgcctcattttcctgtagctcctctggttctgtttgctcattggctgctgtgttcatccaagggggttctcccagaagtgaggggcctttccctccatcccttgaggcacggggcagctgtgcctgccctgcctttgcctgaggcaaccgctcctgcctgagcctggacatggggcccttccttgtgttgccnatttattaacagcaaataaaccnattaaatggagactattaaataactttattttaaaaatga

SEQ ID NO: 581034 - DNA, 135 bp, Homo sapiens
ataaatgtcactgaaaatcagatgcaacactaacttgcaaggattcccacatcataaaaaagaagtgatgcttacatgtgctggccgtggacgatgtggaaaaactgaagcgtatacagcgctgttgtcagaaca

SEQ ID NO: 581035 - DNA, 477 bp, Homo sapiens
aattagctggatgtggtgctaatttcaaggagagctgcttgaacccaggaggcggaggtcgcagtgagccaagattgcgccactgcactccagccttggcgacagaggaagacttcttctcaaacaaaacaaaacaaaacaaaacaaaacaaaacaaacaaacaaacaccaacaagaaaaaataaagagcacagctgtgcgtggttgctcacgcctgtaatcccagcattttgggaggcccaggcgggcagatcagaaggtcaggagtttgagaccaccctggccaatatggtaaaatcccatctctgctaaaaataaaaaaaaaattagctgggcatggttgcgcaagcctgtaatcccagctactcaggaggctgaggcaggagaattgcttgaacccgggaggtagaggttgcattgagccaagattgtgccactacacgccagcctgggtgacagagcgagactccgtctcaa

SEQ ID NO: 581036 - DNA, 267 bp, Homo sapiens
tgcttgaggatcccctccctagatgaggaattgcccagatcacacgtacttgcgtcctcgctctccagaaggttccggtatgtggcaatctcgtctccaagcgggcttcacgtccagcagcacctggtactcctggttcttgcgatccaggtcggcccggatctcagacaactggtcttccaagttgctaatgaggctctgcatctggggccagctctgtgccgtagcggtcctccgctttcacacagggagttctgcagacagttt

SEQ ID NO: 581037 - DNA, 102 bp, Homo sapiens
tggatattatcggaatagcatctgtaaactgaagtgtagacctctgttttcttctctcctctatcatctgttatctgattcggttggctgggtcgtgacaga

SEQ ID NO: 581038 - DNA, 353 bp, Homo sapiens
cgcacaacgggtgatagcgataaccacgatgcatctccttcgaacccaggccattctccgatgcgaccgcccaggaaccgaggaaccggtagcgttcccggtagtcgctcggcacgcggatattgccggattcatccacaagctgcggcttcttttggtctatcggctgagcggaaggctgactcagcaatcccgccgacgtggccagcagcgtcaatgcgccagagacatggagcagatagcgacgatacatatcgtatctccacacagtatacgatctaactaatcgtccaatcgcggatagaactgtgtacagacttcatctttctttgctggggcagtacggcgcccaa

SEQ ID NO: 581039 - DNA, 674 bp, Homo sapiens
gacaaacttatgataaagtatttgtcttgtagatcaggtgttagttggttttttaatgttaaaatgcaagcctgccccctccccagcaaagtcacagctccatttcagtaaaggttggagtcaatatgctctggttggcaggcaaccctgtagtcatggagaaaggtatttcaaggatctagtccaatctttttctagagaaaaagataatctgaagctcacaaagatgaagtgacttcctcaaaatcacatggttcaggacagaaacaagattaaaacctggatccacagactgtgcgcctcagaaggaataatcggtaaattaacgaatttgctactcgaagtgtgccagaatgacacacaaggacagaattcctttcccagttgttaccctaagcaaggctagggagggcatgaacacaaaacataaagaaaccttggtcttctaacacttttctctgaatcatttaggtttacagactgtacagtgaacaattcttatcttatcttggccaagaaacacaagttttggatgaagcttttatactagtgggaacttactcccaacagggacttgagggacccaaggaaaaccctgatggcgggacggcagagcaggtgccaagagtaaaaactgtagccatacgctttagtacacgtgtcactaggctgac

SEQ ID NO: 581040 - DNA, 1387 bp, Homo sapiens
cttgctctcttccatcttcttcttctcctcctcatcctcaggcagctccagaccctccttggtaactagagagcaggctcttacccaaggagggtctggagctgactgaggatgaggccgagaagcaacaagatggcagcacgagcacggccaagcccgcgcaccaacctacgtgacaagcgtcactgacagaactcgcagacaagcaacggcgacgaagcgcgaccactcccaccacagtaaaacccgcagcccccacactcgcacgccactgcccacacaagacaactatcgcgcgccaccagccactaatgggagcgcgatacaagaacagccgcagcgcaacttcagcgagaacacacaccaccgaagcagcctatatgaatgcgacgaaaaagaccaacatggcagaatcaacacactggacccaagcaccaacatcgaaggaagacgcatccgccgccagaagggcctagcaggccagaaacaacggacaatacagctcaacgagacacagaacaacacgcgcaccctcgcggccgcgctgcgcatagcccggcaaccagcaagcaaccccgcgcacctaggcaagacaccaaccagcgcggagagcacaaacacaccaccatgtcgcacagcagaccacaccagcacgcacacgccggagcacaaccaagccacgacagttcaaacatcaggcacatagagaccaccaagcactacaagaccaaccaacaggcatccgagtgaaggcacaagagcacacaggaaaaagcgcacacgacagcggccccaggcacacagcaactgccaaagaacccaacaagcggaggctgcaacaacacacacacagcacaagggccagcaacgacacacacccacaccgagaaccgagacgaccccacgcaaacacacaggacaattagccgagatattcgaacaccaagagcagcggacaacacccacacagccaaaggctacacaacaaccacgaaccagacacagacgcccacaaacccagacgcatggaacccgaagggacataaccagagacaaccaaacaagagagcaagccaccccactcgacgagccacaacaacacccggcccacccacatccgcgtaccccacaccatcgccaaagcagcacaagatagccagacaacgccgcaccagcgaaccaccagccacaaacaggcacaacgacaaacagaactaggacagcaacactcacaacgcaagacaacccacacaccaaacacaaccaacaaacgattgagacagcccaaccactcaccgacagaaccgccaaagacgcatgccccacaagaccgaaaccccccataccagaacagcaaacaccacacccactgacacgcgcgacaacg

SEQ ID NO: 581041 - DNA, 850 bp, Homo sapiens
ttcaatgcccaaacaatgcaccaacgggccccttccagaaattctttccattcggggacctttggtgcccccccccaattttcctttcaaacggggtttttttacaacaaaaatatatacacaagatattcctccgcgttctgttccccaccgccactcaatacgcgtgctttactattctatataaggagacacaataaaatatctcctcttactgtcaaaaattgccccctccaccctctttcccaggtatacaatatgaataatagaacgcgtcttattaagacttacagacgaccaccccatcgaatgcgggttataacaccggttctcgctcaaatcgccccctagcaacatttcatatcattgcctggggagaaaaaaaaaagttacattggtatttatgattaaaatatctctctctctatcaacactctccccgatatggttggatccctctctcatccaacccttttcccccgccccctttcccgttgtaacaatgtcgaccacaactgatacacactggggatcatatcacgccacctggtctatcaaaattgtctcgcgttcgatctcaatagactaaacacatcacgcaggtaggagaattctggtaaacacgattcatggtaagacttctcctaaaacggttgtaaaaccagttggtggttcaccccccgcacgaagtttcggtccggaacaataagacgatctgtttcccctggagaagggtgtcgctccgccaggtcgacggcacgtggttatattactaggggagcggtggcattgttaatacaacccccgccgtcccctccacaattacacgcccaacctggcgcccaaaaca

SEQ ID NO: 581042 - DNA, 194 bp, Homo sapiens
  misc_feature (25)..(25): n is a, c, g, or t
  misc_feature (50)..(50): n is a, c, g, or t
  misc_feature (95)..(95): n is a, c, g, or t
  misc_feature (110)..(110): n is a, c, g, or t
gatcgaaccactgcactccagcctnggtgacagagagagacactgccttngaaaaaaaaagaatctcactcactatctagagaggattgtcagantattcacgattcagntcttgaaactttgattatgcaaaagaggtatatataaatatttcattatgattcaggttttaggctttgcagcttctataaggt

SEQ ID NO: 581043 - DNA, 286 bp, Homo sapiens
tgtggggctgggacgaggatcctcaaaaccctgctatctccttacttataagttgtgattctctagccctcctctactacaagaagaagaggataaagtacggcatttcttggaggacaagaggcagaatgatatgatcagactaatttctcaatagcaccacaagaagacaccaaaacgaagtatgctgctgagtaagaagaagagggtgtgtcatgctgctaatgccagggcctgtcactttccaaggtgaccgtctatcaggaccatgcctttattatatata

SEQ ID NO: 581044 - DNA, 439 bp, Homo sapiens
ggacttgttaccaggggtacacctatagagtctctgagtgaatggaccagatgaggtgtctaccacgactgtgtgaatcactactagagagcctacatagggccacaggactgatacgcaccatagcaatgagaggatacaatacgagctaatcctatgaggttgtaagcaccatccgtaaagatcagacaataacttccatgtaaatcttacctgcatgtcgatgtgtaaactgccattgatggagctcatacctgctgtttacataaagtgttgtacagctgttaataaatattatcagaaagcttatggcccacaagcctgataagactgacttacaatcttataccagtgaattttgacatctaacttacctgcaaagacctcggggataccatgctgtccgtttgaccacagctacattgtctgctgtggccct

SEQ ID NO: 581045 - DNA, 217 bp, Homo sapiens
tcctttaaatccaagcagtcggttccccagagtgtgatgttccccttcctgtgtccatgtgttctcattgttcagttcccacctatgagtgagaatatgtggtgtttggttatttgttcttgtgatagtttactgagaatgatgatttccaatttcatccaggtccctacaaaggacatgaactcatcattttttacgactgcttggattacaagga

SEQ ID NO: 581046 - DNA, 275 bp, Homo sapiens
  misc_feature (12)..(12): n is a, c, g, or t
  misc_feature (68)..(68): n is a, c, g, or t
  misc_feature (75)..(75): n is a, c, g, or t
  misc_feature (95)..(95): n is a, c, g, or t
  misc_feature (128)..(128): n is a, c, g, or t
gcagagactgtnccactgcacttcagcctgggcaacagaacaagaccctgtttcaaaatagatataantagagantgagagagcacgagcctgtntgatctggagcttcaactagatgattttttttnatgttcaaagagttattactggccagatgcagtggttcacacctgtaatcctagtactttgggaggccaagatgggtggatcgcttgagctcaggagttcaagaccagcctgggcaacatagcgagaccccccatctctgtttttta

SEQ ID NO: 581047 - DNA, 236 bp, Homo sapiens
ggccccccgggcccaaaaaggaccagggcaaaagcattaagccccccccttggcagggaaaaaggcaattttgggcccttggccaccatgtggaggggagaaaattctccccctggggttggaacatcctggggggaccccccacccacccccgttggggtgtcccctgtccctttttttccctttgggcccaggggggacatcctaaaaaaaaaactgttgggttagaaccccca

SEQ ID NO: 581048 - DNA, 434 bp, Homo sapiens
gttcctccagttgttatagcaggatctcagacgtccctctgccgatgataaaagctaagacagctgtcctcccacagctctcagctggggacctgtgtcccgtgtcccctcagtccagtacatgcttcatgatcaacggtccatggctgtagcgctcagaacagctacccctctcagggctccagaccggagctcgttgagcgagccagcgctgctcagcaggatgcggtccgcattcatcattacgcccaggcagcctatcggggagtgtggctgacttaaggggctacgtctgctcggagcagagcctggttctaagcggggcgcagcgcgtcagtccgagcatgcaggtgcgctggctggctcgtgcgccccgtacctagactgtggtttgagggtaccgcggaatccagcgtctgagcacacagtcgtag

SEQ ID NO: 581049 - DNA, 193 bp, Homo sapiens
agcagcgcagccaacataatttgaattcgatatgacgtcaaattggatttatacgcaggccgatccggtcatcggagtacatcggcaatatgcctcgaaggaaattcgcaaaggcacggtctttgttaacgcgtcacgctggagctctcccgagaccgataagttgatggatgcggcatcgagcgaaattcgc

SEQ ID NO: 581050 - DNA, 343 bp, Homo sapiens
tctggagacagaatctggctggtggtcacccaagctagagtgcaggggcgccatctcggctcactcccgggttcaagcgattctccggcctcagctggggagatagagatggcagtgagccaagatggtgccacggcactccagccggactaattttggtatttttagtaggcacagggtttcaccaggttgggccaggcgggtcgggaactccggacttcgagtgatccaggtgcctcggcctcccaaaaggcggggataaaagacgtgagccaccatgccgggccccacggttacttttattactacctagactacactggtggaaagggtcgccaatcgg

SEQ ID NO: 581051 - DNA, 156 bp, Homo sapiens
atattatttagatatacggcccttgatacgtatccatacgtctacgctcacaccccagttcttacaacagggttctgtcctgattctcaactcaggctctagatcgattatctctctaaagttcctctctcacacagatctgaacatgttaaattt

SEQ ID NO: 581052 - DNA, 113 bp, Homo sapiens
gagattgagtgaccgagacggcaagagagacagagagaccgacggggagacagagagacacgacggaggcgacagaggagagaccgcagaaagagagtgttggagacacgaga

SEQ ID NO: 581053 - DNA, 608 bp, Homo sapiens
  misc_feature (250)..(250): n is a, c, g, or t
  misc_feature (252)..(252): n is a, c, g, or t
  misc_feature (275)..(275): n is a, c, g, or t
  misc_feature (380)..(380): n is a, c, g, or t
  misc_feature (388)..(388): n is a, c, g, or t
aaaaagcaatcttggcccaccttaatccattaaacgtgagttgcccaggacaggtccaaaatctaagtcaagaccaaattgaggtctccaatgccaactcctttatacccagccccagtacattctgatcgctcttcctttccccaccattcccccttttcctttgaccaaatccgccatcgtcatcaagggccggtctcgatgggtgctgtctcttggaactgttgggtacacctccaagatgggcgancngggtagaggcgctcttctcttcncagacagggtggtggggcagaggcactcctcacatcccagacgatgggtggctgggcagaggcgctcctcacttcccagacggggtgccggggcagaggtgctcnccacttcncagatgatgggcggccgggcagaggcactccccacatcccagatggggtggccgggcagaggcgctcctcacttcccagacagggcggcggggcagaggcgcttctcacatcccagacgatgggtggccgggcagaaacgctcctcacttcccagacggggcggccaggcagagacgctcctcacttcccagatggtgcggctgggcagaggcactcccc

SEQ ID NO: 581054 - DNA, 152 bp, Homo sapiens
ggcggcctactctcttatggggctctaaaaggtattttatatgttctttttaacaaatatgtgtacacctttaaaacatcaatgtgtggatcaaaacaagacccagcttattttctgctgctgtaaattaagcaaacatgctataataaaaa

SEQ ID NO: 581055 - DNA, 232 bp, Homo sapiens
  misc_feature (17)..(17): n is a, c, g, or t
  misc_feature (25)..(25): n is a, c, g, or t
  misc_feature (32)..(32): n is a, c, g, or t
  misc_feature (35)..(35): n is a, c, g, or t
  misc_feature (148)..(148): n is a, c, g, or t
gcttagtagtaccaatntcgaccgngcttgtncgnccaactcaccctccaaattcccgccctggtgtccctgctcaggaatttctgcaacacgctgctcaaacctgaatttgacaaaatttcaaagcgctgtatctttatgttgatcngacaacggataaagtgccatacttggattctagatcactcactgttgcctgtcgctgagtccacttatgaaaaaaaaaaatctc

SEQ ID NO: 581056 - DNA, 138 bp, Homo sapiens
tcttaaagatgcttttttcactattccctgcaccctcgtcccagcctctcttcactttcaccctgacaccctttaggctcagcaaattacctgggctgtactgctgcaaagcttcacagacagcccccattacttcaa

SEQ ID NO: 581057 - DNA, 212 bp, Homo sapiens
aactcaccgcgtaatagatagggctcaggcgttgtgtatgatatgtttgcggtttcgatgattgttctttggagtatacacctgctgaggaaaggtattcctgctactgctaggctgtcaatggtgaggcaggttgaagtgagaggtatggcttttgagtagtcccccttgatgaaaagaactatgctcggtcctggccattatggcactgg

SEQ ID NO: 581058 - DNA, 104 bp, Homo sapiens
  misc_feature (104)..(104): n is a, c, g, or t
gaggaggcttaggtaggaggatccacctagcccaggaggtttaggcttcagttagtttttattattccacttcacttcagcctttgcgtacagaacaagacccn

SEQ ID NO: 581059 - DNA, 204 bp, Homo sapiens
tgactggcatagtattagcaaactcatcactagacatcgtactacacgacacagtactacgttgtagcccacttccacaaatgtcctatcaataggagctgtatttagccatcatagagaggcttcattcactgatttcccctaattctcaggactacaccctcagaccaaacactacgccaagaatccattttcacatatcat

SEQ ID NO: 581060 - DNA, 235 bp, Homo sapiens
  misc_feature (45)..(45): n is a, c, g, or t
  misc_feature (172)..(172): n is a, c, g, or t
acattacgatcactgatagttggtgtgcgactgaaacccacattntggtcaatctcctcgtagagcttcttcttcacctgaggattggcagcaggaaggccagggtccatttaactaagaggtggtgatctccacgccagccccaaagatgtcccctatatggtgagaatgngtcatctgaaagcagctctgagtcttgatctgggccagcattgccattattgagtttatctag

SEQ ID NO: 581061 - DNA, 353 bp, Homo sapiens
  misc_feature (348)..(348): n is a, c, g, or t
tcctacagattcagtgaaatttcctatcaaaattcctaatggcattttttaccagaaatagaaaacacctattcctaaaaatttccctaaatagcccaaagcaactttaatcaagagcaaaactggaagtatcataagtcctaatttgatttttgtcaaattatgccattaaatatgacatttgattaatgtcaaaaaatgccattaaaatccatttcaaagctacagtaatcaaaacagtatagtcttggaataaacccaggcatataggccaattaaataaaatagagatctcagaaataaaaccataaagttgtggttaacttcaacaaggctgcctagattacncaagg

SEQ ID NO: 581062 - DNA, 364 bp, Homo sapiens
gctacttacataacagacgactttacataaaataatcatctgcacaaaatgtaaagggtggggttatgcatgagatattaattttcctcaataatgttctacttgtactgttctagaactcattacagtttccacggcaaatttgttttcaaaatgccgaattgcgaaacaattgctgggcttcacgtttcttaatacctttcatagtttctctgcgttgctgtttgtaagtttccttgtgcatgacacagtctatcattaaagaagcccaggttatccatgttttcaatgcgatcagtaatcaccatgtgctcattaatcacattggactgatgcatctcggttccagccttgatgttcatca

SEQ ID NO: 581063 - DNA, 302 bp, Homo sapiens
ctcaaacgaatcacccaccttgacctcctaaagtgctgggattacaggcgtgagcattcgtgctgggcccaaattttaaaatacagtataacaaatatttgtatagcatttatattattaggtattataagtaatctagagattatttaaagtatacaggatgacgtgaatttaagttacatggaaatactacacccttttatgtcagggacttgaacatctaagggtttttagttagggggagccggtcctagaaccaatcccctgtaaatgccaagggatgactatatatatatatatat

SEQ ID NO: 581064 - DNA, 395 bp, Homo sapiens
cagagcaccttcaatgaggtggctccaagatacatctcacgagacggtagcagctccaggtacaggcaggcgtggcacatctgatgatcaaaggcgcacgggactcccatgctgagatgtacatgtaggaacctcgtgacacaccagagaactaacagacaagtcacactggaagttacaggtgcagaacccaagtcacgccccgacactgagtactggcctgtgccacaggtggtcactgctgtcttcatcctcttggtcagctctggtacatgttcgcctggtacaggtgccgctattcccagcaatgccgggagacgaagttcttgctcctagaacctcagatgaaggtcgcagacgtcagagcgggacgcccaagcacggcctgagcagag

SEQ ID NO: 581065 - DNA, 105 bp, Homo sapiens
agaaaacgcaagtactaagaacttgacaggcctttccagtgggactgtagagaaacctcgattacatgacagttcttagaatgcgagccaaaacccgtgccccga

SEQ ID NO: 581066 - DNA, 546 bp, Homo sapiens
  misc_feature (503)..(503): n is a, c, g, or t
agcgcggtgatctaaggatccctgggcaggtctctacctttcaggaaagcttctctttagtaatagatgaatggttccctgaagtgttaggagcgtaggatcacaagggggaaaataatccaaaaagacaggcaagatattatagcggggaaaaacattaatcataacttaggatttctctccccagggaacggttatcagctataaatcggtttaggattctatcaagatcagcaagggcaaaacctcggcaggcttccagcccacacaggggcaccttcctctcctcttccatgcagggcagtgggaagccccctccccagtttcctctccaggatcacggactagaccggggccaagtctgaggaggccggggagccagtacacattcaggggtcactgactcttcagataatgccctaaacaatgggagtgtgggctggtttgctccaagagcagttgcccggtcaggggaactccggcgcacttccactcaatacggnacggcgggggatgaaagagggatttttaaatggcagaaaagtg

SEQ ID NO: 581067 - DNA, 1160 bp, Homo sapiens
taaagtagtaatggctgcatatttattcataatttcaaattgtatggcttaatcccaaacattcttcaaatgtggtgaaatattttaacacatgtgacgtgcacaagagacattcatccaagcctcagattacaagaacacagaagagttggtaaacttcttaccagcactgtgatatccgtgggcctttcttcttcccatttccagctgtgttccctttctaacgtgcctttgggtcgcctcccttttcttgggcctcttcccgtgttccaggtctcttccagaccctcttctgcggttcgtgggtcttctttgtggcctcttccgcgaattccgagggcgtttccgtggccgactctccgagggcgttctccgtggccggcttccgagggcgtttccgtggccggctctccgagggcgtttccgtggccggtctcccgtgtctcttggggtctctcttcctctctctctccgagactgtgtgttcttgtggtccccaagtgtcagcttcccctctcttcgcgaggccctttttccccttttttctttaaaccctcctctctcttctctccaaaccttattcctctatttctccgattctcttttctcctgcggcctcccagggccttttctccccgggcctcccagggcctccctttttgggcccgtgttgccgtgggttcgtggtgataggtgtggatctctcctgtgggagattttctcccaaatctcctctcttggggggggcaatggggcgccccatttttgtgacacacttttgagagcccaggggtaagattgggtggcaagctttaagagatgctaaaggcgccacagtgtttttgggcccccgtggtttttccctgtggtgtgcaaacttttaacaccaatctttctctagagggcgcagtgtcccatccaagtgggcgccactcttggggcgaaaaggacccctttgtgggtgactccccttcccttgttgggctgggccccaaacggcttggaggagcccttttatcgccccttggtttcttaggccattctttcgcgccccctttggtcgtgtgcccaggcgccttgtgtggtataaccttggggatctgtgtccttcccacagcccccttcttagagagagtggtgcgccggtttatttctccgca

SEQ ID NO: 581068 - DNA, 610 bp, Homo sapiens
  misc_feature (293)..(293): n is a, c, g, or t
  misc_feature (298)..(298): n is a, c, g, or t
ggctaaatagccgcagcctctgcgcgtcgcctccacggttaccccggtctccgcccctccttctcgcggcgctcgagggaccatggcgatcctcgcgtgaacagatcaagatcaagaccggcgtggtgaagcggttggtcaaagaaaacgtgatgtatgaaaaagaggcaaaacaacaagaagaaacgattgaaacaaatgagagctgaagacggtgaaaattatgacattaaaaagcaggcagagatcctacaagaatccaggatgatgatcccagatggccagcgcaggtnggaangccgcatatttggatcttcaacggatactagaaaatgaaaacagacttggaagaagctgaggaatataaagaagcacgtttagtacgtggatccagtgaagttagaagcctgaaacttttctcgtatggggtggttttgcattaaatcctggggtccattttacaatccattatttttgaccactgctatgtgttcaagtagtatgagacatgtgattgtctttatctggtacatatatatttctttgtctaatttaatatgtcaaataaatgagttcatctaataaaattgtttatttttttcctttaaaa

SEQ ID NO: 581069 - DNA, 1055 bp, Homo sapiens
gcacctctacgggtgcagtatcctcccgaatcaaccctgacccctctccttcacccacagcaccaatcctacaaaaaaaaaaaaaaaaaaaaaaaaaaaaaaaaaaaaaaaaaaaaaaaaaaaaaaaggggggggggggaaaatcccccggggggccatagacccctttgggacaggcgggcccccatatggaaagagctctatataaaaaccgaagcacgggcgcggcgggttataacaaaaccggcgtgtagcgaggaaaaacaagcgctactagcggggaacctcttggggaagagagcaacactccaatctgtcgggggggggacaacacatgtgggcaccaacaccaccagcacgagatattgaacgccgcccacggaggaacataatacaaccgttacgacggttatttggtgtgctaacacaccaccgacacaatttgattagcgcgggagaaaaaaatttggaaacaggagaattattaatttgagacaaaatatttttatacaggggagctttgtgtaaaataaggaggggaagagagatgataagaatagaaggaaagagaatgatgaagatagagatgaaaaaaatgaagcaaacaagatgaagacaataaacgaataaaaggagtaatagataagtgaagaagaaatagatgatatacagaaaaagagaaacaatatagatcaagaagagaagagaaccaagacgacagaggaaacaaaaataacgaagaaagaaaagagagaaaacgaacagatcgaaatagcagaacaggatccgcaaatgaatagaggagacagagaacgacagaaagaaacaagaaacgaggaaaagaagaaaaagaagacaaaacgaaaggacagaaaagacagacacggaagaaataaaagagagaaagaagcaaagcaaggagaaagagaagagaagaagaaggagagctgagaagggcgagaaacgagaagagaaagaaaagaagagagaaacgagacaaagacagcgtcacgagagaaaagaagaaagcagtgacgagaaggccagcagagaaa

SEQ ID NO: 581070 - DNA, 256 bp, Homo sapiens
tgagttattttacaagatacaataccaaaacctatgttactattattcaacacatattcctatgctgaatacccatatgtaccataagtcgtgtcaggtgccaggcatgcgatgatgaacaagacaatcataatcccagcttttcgaaacttaaaaacagtctatgtctaaaaccaggaaattctatttcaggcacaatttacattattaatgtaataaatacttacacattggtaaggacattcgtttaggaaag

SEQ ID NO: 581071 - DNA, 1179 bp, Homo sapiens
agcggaggagcatggcgcaagctctgtctgaagaggagtttcatgcgtgatgcacggctcagtgtccttggcaactccgggacataacgaagctaccaggcttgtcagatgaactacgcaagaatggtgttgaatctcaccagttcttcgacgtgaaggtctgcctatcttgagagtaaggagtttcagtcaaatgctgcgagcaaggcatcgtggatgcaagagcaggaacatgctctaagcctttgcgttatgcttaatgtgtcgccttgtgacaatctcgcatgacgtaacctcgacatggcgcatggtagtgtggctcgtcatcttggcactgtagtgaacccctgtgtatttggtgcacttaacatcatgtggtcatactttaactctcatacatctctattcgcgatgcgttattcgttctgagtcctcctttcctcgatcgtctcgattcgtgttatgtgccgtggttatccagtctctactggactccagtgttctccttccgcataatcattcatctgttcgtctcttcctcgcactcctgtttccctgtttccggtcgatgttctgctctgttctatctagcttttcatcgtctcgtagagcgtccttgatctctcttcgctgggccccatttcccgtcatcgtacgtgtccttgagacatctactttgcgtttctccatgaagctcccgtccatcgttctcctcatgtttcatggttcttcttcccctgctatgtaattgcacatggtttaggtaaacgtttctactgcccaggatcatatattttcaacatcatttctccccgtcgccacaaatgtgcgcacttcttcccacccgttgtatatcttaaatcttcataccacacacattttccccacgagtcgtcctaaacttttccgcatacgtacatacaacacgcaagattcaatttcacttctttcccagtgggtcgttgtttacacatacacagacagacctccttatacccagttcctcttgggtgatttcgcacacatttgacatacttacttaaccctattccccaagtgagttactatacaatacctatgcccttttaccccattggtacatcttacattattaaattccgcttcacagcaatagatactacatttcacacgataataatcaacagcgttaaattcttc

SEQ ID NO: 581072 - DNA, 465 bp, Homo sapiens
gaattggggccgtaccatggcggagaagactcaaaagagtgtgaagattgctcctggcagcaagtctgtatgtgtagcaaagtgcaaatcagcaggcagcatgtacactcatcggcacctcaggaccagctgcatcccacctctcaaacgcaagcaattcatttgcggcaagcctgggctcaatcagtgcattaggcgcaaggagacaacctacacagcacagaactaggccccttagtcatacaatggcttgacccagcataagtatcacgtcctgaacacatgaacgatcccagaagccaaacagctcatgactcagttggccagccaatcaatgtcgttctgcaacgtctggcatgtctataaccgcacagcacatagaacgataggcgcagcatactaccatcgtacacttgtacatcagaacagcatactgatacggcagcacaatgtaactacttgaac

SEQ ID NO: 581073 - DNA, 455 bp, Homo sapiens
tttccgcgggacatttttttacacgagagagtcatctgtctaggaggagctatttcccgggttagcagcctagataaagaggaatgggtgaagaggactgtcgcacggttccagaaggtggaggtgaagggattgatacctagaccgcttaaaaccgttatcacggttattactgcataaccccctggtttgcgcgatccgatttacgcactgcgctcggtggctccacgttcagaggtctgagttattgagggaaacgcccaacctgtccacatttctcggatatttactgcttccaatttccgtatttcatgctgtatttcgcgattcgggctggttataactgcgcattttaattaattggtcatttcgagactgactttccacttgattcttatgttggggcttctccaaactgatgttgcttatccaaggccgtaacggcggaaatctag

SEQ ID NO: 581074 - DNA, 435 bp, Homo sapiens
atgttaaatgatccactaactttttttttcttggcccatgattaatggaatgtatgtaactaggtagggttcctttcttagatctagaggaagtacagccacccactgacatctgaatttatatacctgttgagttttgagtgcacccaaacactcgtataaaccagcgtgaagaagatttaagcttaccagtgttctacattcagactaaaacgagactacaatacacacgctagtcacaacttgaaagtcagacaagacatttcagcttgctctacctcccacgtactagagccgttgctttgggaaaataaaagatttagtaccaacgtcactcgccacgtttcttgccttatgttgcattcttgtacagtttcttatatttcttgatatctatgtaacataaagatcaaccagtcttttaccagattacat

SEQ ID NO: 581075 - DNA, 104 bp, Homo sapiens
aaacgttcatcggagcaggtgagtcggccctaaggcgagccagagatgttagctgatgggaagcaggttaatattcctgcaccgtcgtattacgccgatgcggg

SEQ ID NO: 581076 - DNA, 843 bp, Homo sapiens
tggtgtgctgtgaaaaccatgagtgctgcatgtcactagtcgtgtgacttctgactgatacctgtgcgattattcgtacatgctggacatgcttcgtgtggtgctgactgcccagtgccgacgagtgggcagtgcccgcaaatctgcagctgcagaggcgcttcaaggagttcctgcggcagtaccgagtgggcacctgaccgcacgggcttcaccttcaaatacagggatgaactcaagctggcattacaacctgggggagtactggattgacggtggagatggaggatctggcacagctttgatgaggacctgtgcgactacttgtacaagcatgccagccgagcacctgcagctgctggagcgaagctgccaagggaggtagctgatgagtgtgacccgtgccctggccttctggggaaggaggtgctccaggacatccagtgtcatgctcaagtcggacgccaggcccttacaggaattcgtagccctgaacgtcggacatgattgtcacacctggtgaaagatcccttggcatcatcatcgcgggactactgcggtaccgttgccaaaggccaacccagcattctctatgcaggtggccgcagcatggctgcaaggaagcgctcacgcaaccattgccagtgaggccccttggcctacgaggggtaatgcccatggccgatggaacggtgctaacacaggaatcactgcttgggcggaccccagaaatgcccaatttggaccccgaagcttacatcatggcccgagacaattggacaaattgcttggactttcaagagccttgaaggctgcatgagcttgcctggattcagggcccca

SEQ ID NO: 581077 - DNA, 202 bp, Homo sapiens
gcaatcttctccctcctcctccctcctccctgattaaagggccgctcccgcatcttcttccctgccccgcctctccgggaagcctctgctttctacctagctgagcaagttggcgcccatggtgggcgcgaggcatgggcggcttcttcctgtggcggccctccttgtggccgcctgcttctcccctctcttgctaccgccg

SEQ ID NO: 581078 - DNA, 386 bp, Homo sapiens
  misc_feature (329)..(329): n is a, c, g, or t
gtccaccttctgtgtctaccatgaccccccttcctcacactgacctgtgttccttcccctgttctcttttcttattaaaaataagaacctgggcagagtgcggcagctcatgcctgtaatcccagcacttagggaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcaggagaatggcgtcaacccgggaggcggaggttgcagtgagccaggattngcgactgcactccagcctgggtgacagggtgaaacgccatctcaaaaaataaaaatt

SEQ ID NO: 581079 - DNA, 860 bp, Homo sapiens
cggctggtactggtctgggagttttgggcattcggctcggcaccgtagcccctgacgccgtggcgttgggtggttccccccgtgcccgtgtctccttgccatgtcacttatgcagccctgtagcctctccaacgtgagctctggtgccgggagaggattcaactactctgccctcccagggcccgacgtgcggagaccctatgccggctggtgtttacactgatgtggccaatgcgcatccatgttgtgatgtggcctgggacaagcctggacttctgatagagacccatcacgggtgcctacagagctccctcactcccttgatggtcaagaccgtactctgaagatcttccctgcacaagacacaagagggctgagccaggtccgtagctgttcgtccagagcccaccttgctgactttagaactcgtaaggagagggccctatgccaggctgggacgttctagaccacatgagcttctcgctgatcctgagggccctggcacagagggcatccctcatgcgtgagaaggtcaagagcctctggctggcttcctcatgcccctgtccaggatccctcacatcaagggtctgcccccgagtaatgtgggaggaaatgagggagataacggagtgcggaagggatatggagggaaggaaagggggaggttgccactgctgtgaagggagatgagctgtattaagggaatcttggagcctccatctaggcggtagagggaagagcgaaaaccaccccaaggtgactacgggacacgagctagagtgccaggactcctgacaatggggggcccgggacaaacgccgcccagaagaactgagagacttgaaaacatggtccca

SEQ ID NO: 581080 - DNA, 656 bp, Homo sapiens
gggcagtgagagacttcggcggacatggctcccagcgtgcagcggggaacccgagtatcctaaaggcatccgggccgtgctgctggggcctccccgggcccggtaaagggaccccaggcaccacagatgtgtttgaaaacttctgtgtctgccattatagctactggggacatgctgagggcattggtggcttcgtggctcagagctaggaaaaaaacctgagggcaactatggatgctgggaaagtggtgagttgatgaaaatgggtagtggagctcatttgagaagaattgtggagacccctcttgtgcaaaaaatggtttcttcctggatgggttccctcggatcgtgtgaggcaggcagaaatgctcgatgacctcatggagaagaggaaagagaagctgtgattctggtggaatggaattcagcatcccaagactctctgctgatccgaagaatcacaggaaggctgattcaccccaagatgtggcctgttcctaccacgaggagttcaaccctccaaaaagagcccatgaaagatgacatcaccggggaacccttgatccggtcgatcagatgatatgaaacggccttgaaatccggctgaagcctaaccaaattcaaaaccaccccaattcacagagtactaccggaaa

SEQ ID NO: 581081 - DNA, 1082 bp, Homo sapiens
  misc_feature (224)..(224): n is a, c, g, or t
agcgggaggtttctgggcccagaagagaatgtaggtaggtctgtagtggtaaatgtagcgagcgtgtcagagaacttggcgcccgtgttcgactaagataccggtagaaggtgccacccgagttgagacatctcaccagtacatgttatcaacctatgtttgctcactccgtggtcaggcatcaccagaggtgctgtgggaggcgctgtgcctcgggtcatggnaccatcatcgtgcccaggcaggatcagactagggcgcagcgcaagctggactagcatcttgctgtgagagtcaacctgacgtgtaactggccctggcacatggtcgttgcgcacgtcctcattgcacctgcattgttctcagtgcaacctgaacggtcgtagacacttggtatttgtgactcgttcgacgaacatccgcattatcacatctctaggagtggagtcgactggtggattggatgtgtggcgttgcaagaaaacctcccaggaaactgctgtacagcgcttccttccccttacaattccgagaggtagcacagtactgcccttggccaggcatgacatcgtacaagaatgcacaggaaacgacacagcatcgggcagattgcgatcaagaacttccgagacaagttgccctgctttccgaaagaaggaactgaaaactatgcggggtaaagctttggctgatgcgccctttttgcccttggatagagcaggtgaagctaatgttcaagctattgatagcagacaactttgggagggtactggctccgtagaatcaccccgtccgaagattcgtgggaggcacattgatcttggctcaggtgcatctgggggtacctcccaagggtgtttcgaaaggccagtcttccgactccgcagtttaccaactggccttcaagaagctttcgcaattactgggtcaacggatccactgacccttgggagggtggagagtgttcgcttggtaccttggcaggatgccccgataaaggcagattttaagttgccttaccatgggccgtgaaggaaaatgctatctatggccagtggggatttgagtttagaagtaaacac

SEQ ID NO: 581082 - DNA, 988 bp, Homo sapiens
ggacgcgtgggtcgatccacgcgtcgccttggcagccatttctcccagacagtcttaaaggatgaacattggatttcatgccatcccatataaaacctgtcttaacaatttttagggatctgtacttggtcattcatgaaaagtacatctgcttagaaattatagactattatgatctgtccactagtgcccattgtgcactctcttttgcttctcattcttcttccctgttgttccttagtcatccaaataagccttgaataacgcaataaggagatattacttgtattgacatatggttggcattataaatttatgcatttcattgatctagagcaaaattgaagtataaattccacggacatggtaaaattgtgttttaataacccccagacccaaatgaataatttcaaagtcaataccagtagattcactgaaagtaaatttagtcctataattttcagcttaatgtataaacattaggaacacgataaggtggcaagggctgctattaccgtccgtcttagttcaaaacatttcggtttactgtcctttaatacacttcctatcatcgagcacttccacgcatgtattacaagtctgatccatggcctgtcgataactccagatacaagttactgttactacaaaaactttttatcagttgatctgaaccaatagttacctctgaacaggtaggtcactaaccgatgctttcatttctgaactagcgcttggccacaaatgtggttccccttttgtgaatccgaggtaatcaggacgttggggttccctgaagacaattcatcacgattgtgtgctcctatcgcttggtccggtttgtcaggaatgtcccttggctccattgggagaggatgttaatacggttcagttaagtaaatggatcttcacagagtagggtaacctttgcccctggcagagtgccaataattgaagtttcccagtcggttgacgaaaagggaatcgc

SEQ ID NO: 581083 - DNA, 264 bp, Homo sapiens
ggccacgattattggctcgaccgtctgcacatccgcgagcgctacaacggcatgaacaagttcacgtcggcaatggcgcaggtttgcacatctcccatattggtcatggtacaattaatgcaaatgccaaaccccttcatctacgtaatgttctgcatgtaccccaaatcaccaaaaacctcctttcagcttccaaactcacacaagataatgatgtctttcttgaaattcatccatctcatttttttgtcaaggatcagtgtg

SEQ ID NO: 581084 - DNA, 1068 bp, Homo sapiens
  misc_feature (443)..(443): n is a, c, g, or t
  misc_feature (449)..(449): n is a, c, g, or t
tcccgactctgatcttatgtattggttactcaaaaaatcttatttctgacgggatccaaacttaaaagtagaagctcgcagaaaaggaaagtctgcgtctctatcgcaattggtcccgtggcgcttctcctttagcctcctttcatgtctcgtgggccaaaagtttaagcatatttctgcagccctctctctttatttttattctgtggatacgcgttgcttcttcagaagccaatacgcgcgcgcgttgggtgcgtgcagagacacgttggagttacacagagaacgctagaatctgaggggtgcttgtggccctgagggtttctatacctttcttattattaaagcgggtctttcctataccaacgcatacctggggcggacctatcattcttccttatagaacagagcatgtgaacacatgttgtggccggtatccctgncatagnctacttattgtgggcgcccacagggcgagcgaagcgccacgtgtatagctattcgagctcgagctcccgaggaaatactcgctttcgtcctcccatagttttgtctcacgaattacacccagagtgttgaagaaagcgcctcgagaaattgtgcattcccacgaatggtgcacacccacgaaaacgtgattattacatacttttccatatgactacacagtgatctccctgtggttctggtaacacggagaatggccctcttaactcgagtaagccaggtgggcacacggcacatgtgggtcaggaacaccctgtgttacatggggaaaaccttgtttggtcagtacccaccagtgggattcgagaccaaatataacgcttctccattcttacacccaaaagggtcaggcagccaactctcggttggacaatagcgcttctctatagaaaggtccgaagtttggcgtccatcgtcgcacttcaatgacttttctgggacgcccagtggcttggacaggatatgtccaggttcctctggaaagcagttgaacgcctcggaggctggaactttggtatgaagcctcccgggggacacatgggggctccagtgcacaatgtg

SEQ ID NO: 581085 - DNA, 340 bp, Homo sapiens
aaaaagcgcgattgaagagtgaactcctatatactctttcccagcatgccagttaaatacttcaatcgaggccaggtgcagttactcatgcctgtaatcccagcatattgggaagccgaggcgggcagatcacctgcggtcaggcgttcgagaccagcctggccaatgtagtgaaaccccatctctactaaaaatacaaagagaagctggctgtggtagcgggggcctgtagtaccagctgaggcaggagaattgcttgaagccaggaggcggaggtggccgtgagctgaggtcccaccattgcactccagcctgggcaacaagagggaaactctatctc

SEQ ID NO: 581086 - DNA, 326 bp, Homo sapiens
  misc_feature (68)..(68): n is a, c, g, or t
  misc_feature (254)..(254): n is a, c, g, or t
gtcactttcaactggctgacaggtgcccagtatttagcccccaaattctaaggaaaagtaggacagantagcaagtgaaagggatccgatggtactccccacttggcgatagtgattgccccatctgggtcaccaaagtgtgtccagaattggttccttccagtgggttcttggtctcgctgactgcaagattgaagccgcggaccttcgtggtgagtgttacagctcttaaaggtggtgggtcttggagtctnttccttcagatgtgtccctgagtttctttccttctgctgggttcatgggtcttgctgacttcaagaatgaaa

SEQ ID NO: 581087 - DNA, 386 bp, Homo sapiens
  misc_feature (57)..(57): n is a, c, g, or t
  misc_feature (81)..(81): n is a, c, g, or t
  misc_feature (88)..(88): n is a, c, g, or t
  misc_feature (106)..(107): n is a, c, g, or t
  misc_feature (126)..(126): n is a, c, g, or t
  misc_feature (153)..(153): n is a, c, g, or t
caggatttgtgtccacacctctcccccgccgggggcaggggtgataagagaaatcgnactatagaggcaaagtcccccaangacctcngcggagatgagatttgtnnccaaaagatcttttacctncgagcaagtttaagcggcccacccttncgagagtgaggatcttctgcagatgccatgatgcaggcgctgctgggggcccgggctaaggagtccctggacctgcgggcccacctcaagcaggtgaagaaggaggacaccgagaaggaaaaccgggaggtgggagactggcgcaagaaaaagtttgagagctgagccttcctgcctactgcccctgccctgaggagggccctgaggaataaagcttctctctgagctgaaaa

SEQ ID NO: 581088 - DNA, 1080 bp, Homo sapiens
tggtgtcgccggggctagggagcgcgttctcccgggaatcgcggcgtgtgatccaagtggtggcggatcagttgggggctgcgtagcgggctggctcaagcaaccaggtacgtaggtcggcggccaattcgggcgcaagcgtgctgggaagccaggaagggccagacatggtcagtagcacggggctgaccacgcgggaacgacgaaccggcaagaatccaacgtatagagaaccccggtgcggatactgacgagagcgagacaggatcatgagtgtaccgcggggaccgtccatcgtgtgcatgacagactgtcgtcccttagcgaccgtcggcgctaggataccctcctgctcgagtgactcatatgtagcatgacccaggtggatctaaccgaacgtggcgcctatggtaagacacacttcagcgacgtcgaggagaaagcccatgagatgtgtgtcctgtccctgttctgaagggctgaggtaggaaggtcggagtggagcgcaatcttaggcattgaccacacaatcccacaatatttgagggtactagtacggacggctgctcactctccagatgtgacgtcactcgcaacaaattggggtacgcgccaggcgctacgggttgtggtcagtggatgccaacgctccctggagtgagggcccctgattatgacggccctgggaggcgcgcgaagcaaggcccatcggactaacaatcatatcccaggacggccggagcatgggtgcagaatccgagaggcactcggtttcaatcggagagcaggggaaccgaagccatgagcctgaggaagcggggcagcagaatcagtctggagacatagtgcattgggcaaccacccagggatggcgttggagggcgcctcagagacaggctgcggcaagggaaggaagggccccccgagagggcggaaaagccccctggggcaccacctccgcgtaacacccactggcatgccgcctcagaaaccctggagcccgcaatctgcagtgggcgaacctagaagagggcacagagacaggctccagtggagcagaccgggactcagggaagaaag

SEQ ID NO: 581089 - DNA, 1801 bp, Homo sapiens
tcaggattcactgcctggggtatcccactatatatatctcacctatgatgtagtggtgcttgaaatactcatctcattagctcgattttattattctaatctaaggttttttatattattcatactatgatatttttagggacaatcagtaatatttggggcagagtactgagggacctcttgaagtctgcaacagcatgcattttctttgtttttgtgggagtgcttccctgtagctgtctttgttctagaacactgctccaaatttatttccatgggatgtagggctagtagcccatgtgaaagtcttctgtaatctccttggggtgtgagttattgggttattctaacaggagttttccaaagggatggcccatttttaattcaacatttgctttttgaaaatccagaagtagacagttggatataatagtggtggaagagcatgggctgtaagcagaaggaaatagagatgacaaatgcctcttaaaggggatctagttgatacctctgttaaatagtgggagaacacagtagctggtaccttacactgtgctttaggaaaatcctatgaggatttcatttacaaatcctcataggattttctgggttgagggacaatgcaactattaagtagagggagagggagagggaaagggagacatgaagcactgggtctatgtgaagggacaggcagatatacccaaagagggagaaaatacttaataaaggaagagtatagctgcaaaacaagacatataggagctgaaggccagatatggcagaaaccagctggagaaagaagcacaggacaactaggacaacttagtcaagcacaatctgtcattccagtacggactaccaagttcaattcaggatgcttcagttgaagacatgtggggtaatgtgctcagctcatgagggtccaaggagtccccattttccctatcaccctatcctatgctcgtggtttggattgttagcacactaggcaatttcagagtccgctctagagttggttgccacgtcagtgcaagacagactctagaatcctcttaaccatggaatgcaaggcctgttcctgtggatctatcctgacttgagtatgtcagtactgttgggaaaatgagttcaagaatatttcagtttatatatcctggttgccgtcatatattttttcatttcaccacttgtttgtgtttgcctcactcaacagtcatgggtgtagaagctggtttcagcttggggctgttacaaactccctacataagccatgtagctgcaatccagggttcctcccaccctacggctttagcggtgggttctctggccctcttgataacaaatactccagtctaatggctatattaatgctgctcagaggctattaactcaaatccttgatgtgtttcatttacaattatgtggattatttattttaggagctttttttttttttttttttttttttaagggccaaatagccctacagataaatgagctgctgggctgtgtagaaaatattgtccaaatgttgccaaatattgacttcgtaaaggggatatcaagctgctgtttataaatctgaatgtcttaaaagcattcttgcttgctctctctgttatagatggtgtcttagccagtcctgagttttccaatgaacccaattttaatatatggtatttttgtatgccaaactggtgtcttgtcctttgtatatgtggtaatgttgattttatgactaccgtaaaaacacatttgctatgattaaagttcataaaatgatttcaaaaaaaaaaaa

SEQ ID NO: 581090 - DNA, 212 bp, Homo sapiens
aataacaagtgtggatcaagtaaaaaccatgtagaatgtagtcaacggagtcaaataagaccacacacaggctatcaatgccagagtcttgaatatcaggtcataaatctcaccaattgtgcaatataaccaacatgatgagaaaagcaacaactcacaattgacaataattagtacatatgattaacaaaaataaaatctgaaactgcata

SEQ ID NO: 581091 - DNA, 237 bp, Homo sapiens
aaccattggcctggtacaaccttttggcaggcgaattcgaggttggaccaatacttaacctgtgttctggaggctgtgtgaaccttctataggttgcgaggggaccaagaaccaaggttaccgggggaaggcaaactgggaggatgggacaggaggtattttacacggggcggaaatccatcccggttggggggagggggatatgggcatttggtggggggagtctgctcgaggcct

SEQ ID NO: 581092 - DNA, 1436 bp, Homo sapiens
tcaggattcactgcctggggtatcccactatatatatctcacctatgatgtagtggtgcttgaaatactcatctcattagctcgattttattattctaatctaaggttttttatattattcatactatgatatttttagggacaatcagtaatatttggggcagagtactgagggacctcttgaagtctgcaacagcatgcattttctttgtttttgtgggagtgcttccctgtagctgtctttgttctagaacactgctccaaatttatttccatgggatgtagggctagtagcccatgtgaaagtcttctgtaatctccttggggtgtgagttattgggttattctaacaggagttttccaaagggatggcccatttttaattcaacatttgctttttgaaaatccagaagtagacagttggatataatagtggtggaagagcatgggctgtaagcagaaggaaatagagatgacaaatgcctcttaaaggggatctagttgatacctctgttaaatagtgggagaacacagtagctggtaccttacactgtgctttaggaaaatcctatgaggatttcatttacaaatcctcataggattttctgggttgagggacaatgcaactattaagtagagggagagggagagggaaagggagacatgaagcactgggtctatgtgaagggacaggcagatatacccaaagagggagaaaatacttaataaaggaagagtatagctgcaaaacaagacatataggagctgaaggccagatatggcagaaaccagctggagaaagaagcacaggacaactaggacaacttagtcaagcacaatctgtcattccagtacggactaccaagttcaattcaggatgcttcagttgaagacatgtggggtaatgtgctcagctcatgagggtccaaggagtccccattttccctatcaccctatcctatgctcgtggtttggattgttagcacactaggcaatttcagagtccgctctagagttggttgccacgtcagtgcaagacagactctagaatcctcttaaccatggaatgcaaggcctgttcctgtggatctatcctgacttgagtatgtcagtactgttgggaaaatgagttcaagaatatttcagtttatatatcctggttgccgtcatatattttttcatttcaccacttgtttgtgtttgcctcactcaacagtcatgggtgtagaagctggtttcagcttggggctgttacaaactccctacataagccatgtagctgcaatccagggttcctcccaccctacggctttagcggtgggttctctggccctcttgatatcccctttacgaagtcaatatttggcaacatttggacaatattttctacacagcccagcagctcatttatctgtagggctatttggaaattaaaa

SEQ ID NO: 581093 - DNA, 128 bp, Homo sapiens
ggcccccgaatatttgcaggaccctatgtgcaacatttgcaatcatttattattaaacgatacacattttaaaaattcaagtcaaatccagatagatagatacaggccagttggttggtatcagctgg

SEQ ID NO: 581094 - DNA, 444 bp, Homo sapiens
ggcgtttatcgttgcacataccacatcttaacacgtgtattcaatgtttagctaccatctataagtgagaagatgtggtatgtggctttctgttcttctattaggtcacttaggataatggtctccagctccattcatgttgccacaaagaacatgacttggttcatttttatggctgcatggtttttggtgatgtatacataccatattttctttacccaattctctatggatggacacctaggttaattctatggcttgggtatggtgaatagtgctgcaatgaacataggggtgcatgtgtctcttagataaaataaattattttcccttgggtatatatactcaatagtgggattgctgggtcaaagggtagttctattttaagtggtgagaagaatctcaaaacttctctccaggggggcatcgataaacaccgggtac

SEQ ID NO: 581095 - DNA, 314 bp, Homo sapiens
gtgtgcggagtctgaatacgcaaccgattcccaggttccctatccctattccagagaggcaagcatttccctctctctcatctctgcagaagatccgaggcttgagagagaaaaactatagcagggcgcggtgtgtcacaccctgtaatcccagcactttggaagaggccatgatagcagatcacctgaggtccagagttcgagaactagccgtggacaacatttagaaaccctgtctctactaaaaatgatatcagggggctgggtgtgatggctcatgcctgttatccctctactaaaaatacaaaaatttg

SEQ ID NO: 581096 - DNA, 328 bp, Homo sapiens
cctttctctgaaaatgatggtataaaaggaaacagaaaataggccaactcatagttccttttcctttcagtttacccttattcatcagtaagccaaaggtagggagtgttggtagcatgtgtgcatatcaaaatgtgaaataaaagtatttggctttgttctgtgtagtgttttcccctgttctggtaagaatgaaatacatatccgtgtgccctccaaaatactaattgcataattttggtgattctgcatatgggttaaatgctcttatattttgatttaaaagtagccctgggtaacataaaaataaatgacccaattcatgcta

SEQ ID NO: 581097 - DNA, 157 bp, Homo sapiens
tatgtcagtggaaatcctacctaaaacaggttgagttatgggcagatatttgtatacagcatggtagcttatggttaaggaggtttggtcccctaaaggtgagatgtagttggcgtgtttgagagctgacttagtttaccagattgatgatagtttt

SEQ ID NO: 581098 - DNA, 954 bp, Homo sapiens
  misc_feature (1)..(2): n is a, c, g, or t
  misc_feature (31)..(32): n is a, c, g, or t
  misc_feature (309)..(309): n is a, c, g, or t
  misc_feature (432)..(432): n is a, c, g, or t
nnaaggcagcaggcgaacagcatagcgggtnnaacgaccccacgtgcgttgtcggagcatcgcgccaacgagggtgccacgcagtgtacgccagggaaacatcgtgcggtgttagcggcgtggtgggtgcccccccggagattgggcgccgccgcacccttagtatggtcgcaaccagaggatgcagcgtgggatttggtcccagccaagaaggagtggtgacaacaaatggagccactgcccgtgaggccccagcggtagccggcctgttcagccatcggatgttcgacaccagccgtaagggcgtgngtgacatgaacaccgacgggcgccaacagcgccgtcagatgagaagggcgtgtgcaccctggggtcttggagtgtatccccctcccctcctcgtggagagagatcttatgcccttctcccccncgcccacagggtatctccccgtcgagttctcctccccgctagaagttggcgctccacggccaactttcgttctgttattacccgcctacggggcaattcctcgacaaggcgagatatcccccacgaagcgagacttgcgataatcgcttagctcgttggtgcgctcgagcccctccgcgggtcttcttacctctgcgttaaattagcggagtgtctcacgcgtcaccccgctagtattatccactcttgatgatgaacagggatacttatgatttcccgcaggattatacagaggagaattatctcagctccagacccgtggatgagtagcattcattgcgggtaagccggtgatcacccacgtgttgcacgacggtcccacgtttggggccacgaaattctcgcggccgtgtactattggggtcttctcccccggcgggccttttcgaacacccctccaatagcacacaccttgtcctaaaaacccccagaaaaaaccctttaaaccaagcggacataaca

SEQ ID NO: 581099 - DNA, 130 bp, Homo sapiens
atgggttgacgtggcttacattttgtcttctgttccctatctcggtcattagaagccccttcgatcccatcatccctttatccttcaaatcaggggcactcagagatagctttcttggctaggggggcct

SEQ ID NO: 581100 - DNA, 185 bp, Homo sapiens
acagaagataaggaggaaacaatacagaaactagagaccctgagaagaggaagaagaagtaacttcagaggaggatgaggagaaagaagaagaagaagagaggaagaggaggaagaagaagagtatgatgaagaagaacatgaagaggaactgatacatcatgtatattttgacaatggagagga

SEQ ID NO: 581101 - DNA, 202 bp, Homo sapiens
tatgagccactgcaccagccacatattttttatttctaatgaatttgtttcccaatttattttcattttttgagacagagtcttctctgtcacccaggcgggagtgcaggggagcaatcctggctcacggcagcctcgacctcccaggctcaagcgatccttctacctcagttccccagatagctagaacttaaggtgcata

SEQ ID NO: 581102 - DNA, 161 bp, Homo sapiens
tgcgttgtgcggcggatgttcgggacgtccgtagagccccagcatgcggcgacacccccaagttggggaaccgcgggtaccagaggaggctgcccagtgaccggcccatgtaccccggagactgtcctccggaaacaactgagacccccaagtgcagcagt

SEQ ID NO: 581103 - DNA, 150 bp, Homo sapiens
  misc_feature (56)..(56): n is a, c, g, or t
gtggtttttaatgactaaaagaaagttttaagccgaacacagtggcttgcgcctanaatctcagctacttagaagtctgagatgggaggattgcttaaagccaggagttcaagaccagcctgggtaacatagtgagaccctgtctctata

SEQ ID NO: 581104 - DNA, 410 bp, Homo sapiens
  misc_feature (113)..(113): n is a, c, g, or t
aaaattttcttacaagtaaaatactacccctataaaaaatactgtaagaccctttgctatgacccaggataatttaaagtgatgtctcacagacctttatttagactgaaggncttataaaaattttgtgtgtgcctgtaatcccagcactttgggaggccgaggtgggcagatccgaggtcaggagttcaagaccagcctggccaatgtggtgaaaccccatctctactaaaaaaaaaaaaaaatacaaaactacaaaaattagctgggcgtggtgttgggcacctgtagtcccagctgcttgggaggctaaggtaggagaatcgcttgaatctgggaggcggaggttgtagtcaaccgagattgcgccactgcactccagcctaggcgacagagcgagactccatctc

SEQ ID NO: 581105 - DNA, 144 bp, Homo sapiens
tagactcgagctggtaccccatgctgcgcaaaccgggcagttcagcctcggatgctgatgttcgcgatggcgctgttgatcctgctgtgctggtggccgctgtccaaccggatgcaacatcaggggcataccgcataacgacag

SEQ ID NO: 581106 - DNA, 221 bp, Homo sapiens
gtacggcgcagtgtgctgagtttcggctttccccatccaaatcttatctcaattatatcccaatgtgttgaaggagggacctggtgggaggtgattggatcatgagggcagtttcctccatgctgttatcatgatagtaagtgagttctcatgagatctcatgctttaaaagtgtttggcagttccccccatccctcctgccaccatgcgtgaatagccag

SEQ ID NO: 581107 - DNA, 311 bp, Homo sapiens
gttagtagctcggtaccgaatccggggatgggatgggagaaagagcaaagacttgttgtcttttaagatctacctttggcagggcacggtggctcacgcctgtaatcccagcactttgggaagcccaggcaggaggatcacgagggcaggagatcgagaccatcctggctaaaacagtgaaaccccgtctctactaaaaatacaaaaaattagtctggcgtggtgtcgggcgcctgtagtcccagctatttgggaggctgaggcaggagaatggcgtgaacccgggaggcagagcttgcagtgagccgaga

SEQ ID NO: 581108 - DNA, 978 bp, Homo sapiens
ctctctgtgagggtccacctggtgctgctgttttgacccccctggggtggtgtatatctcctcactcatcgcgcggggtttccaataggttgcttcgcgcgcggtgtcccgccaaacaatctgtggaggccaccccctcttttttaagagaaccccggccgccctttgttttttctttcgacggaacgtgtctggtcgccgatacataccctgttgcggacagtttagtgctccgatctttgggacccccgcggcacctcctcggcccttcatggggggccgagcacatgtctggccgcgcgctcccccctcgacttgtggtcgtggatccataacacagggtgccctctcctcccctaggcgcggcggaattattccgcaacttgttcatcaagaaagccggcgggggctaccaccaccagctggggaaccgcaggcggggtcatcttgacaaaaccggtcccccagcggggtggcacccccccttgggggcgcctcccccccaaaccccccctggacgccgccacatcaagcgacgggcgtcccccctggagaacgtcctcatccacgcgccccttgaaaaagataagaatagaataatccctagagtttctaagaaaggcgaaactacataaattttggcaacacattaaggccagaacgccgaggttcatatctctgtagtatggaaaattcgattggaggccgcatgttgcggaagacggagtgtataagacacattgctctgttatgacgctccagacggatctttttctattaaatgtaataagaaattggcgccgcatttgggtgcgagacggtccagcccccagaaatgttttaagacattgttcgccgcccccccatagctggataaggtccggcctgatgactcgccgccccttggcccacgaaatgctctgcacttggaggctccccggcggttaaaaataaaaggccccaacacaaacaaaaaca

SEQ ID NO: 581109 - DNA, 134 bp, Homo sapiens
ttgacaagaattgaagaagtacaaagatgtccaggctgaaaaaatcatcatcgccgtacgcccctgatgcgttggcaggactgtggtcgccgtggcccgtgcacggtgagatcctcgacactctcggtgccacg

SEQ ID NO: 581110 - DNA, 608 bp, Homo sapiens
ccctaatattctggctatcaactccttttggcttatcttactaaccaacctagtcccatgtcctatttctttctttcttttattttttttagagatggagtctcgctctgttggccaggctggtctcgaattcctgacctcaagcaatctgctcgccttggcctcccaaagtgctggaattacaggcataacccatttcaccccgccatgttttctttcctctagcttactttagtgaagaatacagttatataatccttataatatagaaaattatgtgttagttacctttatgttgattatgtcgataatgtcatgggtacgtcttggcccaacagtaggctattagtagttaagtttctgggaagtcaaaagtttatcgctcatttaagactacggtgctcctaacccctgctttatccaaggggcaactgtattccccttttcttcttgatttactaattctattctacttccctcacagactttttactattgcaatatatttttatacttgaaagccttctgttgaccacccattgtagtaaattatctgtccttagatttaagcttttacggtggcccagaaatatcaggggggaccctct

SEQ ID NO: 581111 - DNA, 202 bp, Homo sapiens
aaagtagttgtcactgagaggggaggggaacacaaggagcaaagatgcagaaatacagaaatagaccaaactgtaaactgaggcttgtggatcatgtaaattgtagctgagttattaactcaggaaagagacggacaaagaaaaaaatatctaagaggaagatgaaattataaggtgtccatgagaatatagaaggtgatac

SEQ ID NO: 581112 - DNA, 313 bp, Homo sapiens
ccttggaaagaggttcccatccctcattggaatccccacccattccatccaggactttttttacacttgggggaaggggggtcaggacaatcatttcagtccggcatttttttttttgcttttttccccccaaaagcaaaacctgggcaaggggacttactaagtgggggtgggtgggggttgggaaaagggaaactggtgggatatggaacatggctttgagcaggactgttgagctcccaaagtgttttgactccaaatttgggagcaggaaaatgtgtaaccaaaaataaagtggaagcaggttggggta

SEQ ID NO: 581113 - DNA, 664 bp, Homo sapiens
aatgatggcgcgatgtaacacgagaaagcacataccaaggcatccacacaccacctgtccaaaaatggccttcgatacgggataatcctatttattacctcagaagtttttgtcttcgcaggattttgctgagccttttaccactccagcctagcccctactcccgccaactaggagggcgctggcccccaagaggtcatcaccccggtatatcccctagaagtcccactcctaaatcacatccgtattactcgcatcaggagtatcaatcacctgagctcaccatagtctaagtagaaaacaacccgaaaccaaataattcaagcatctgcttagttactagaatttgttacctgggtctctatttgtaccgctcctacaagcctcagagtacttcgagtctcccttcaccatttcgctgacggcgatctactggctcaacattgtttcgtagccaagcaggcttccacggactggtcacgtgattattggctcaacctttcctcactatctgcttcatccgcgcaactaaagtatttcacttgacatccaaagcatcactttggcttcgaagccgccgcctgatactggcgtttgtagatgtggtttgactatttctgtatgtctccgtctattgatgagggtcttcttagtcttccctcag

SEQ ID NO: 581114 - DNA, 688 bp, Homo sapiens
caaggagaagccagcgcctctacaccccaggtaggatgggggagggactcctggcctttggagctgagcttctctgctggggtgtctgagctgaaggtagggaggaggggtgggagactccagagccgctggagtcacttttgagacaacagacctgagtggtcaggagttgggaggaggccagcccaggggctgtggtaagtgaactggcggtttcacccagcccaagtccaagcccaagtccaggggctgtggtaagtgaactggcggtttcacccagcccaagtccaagcccaagtccaggctcagttggagaaagttttttgcccttccacaagtggaattcccaacttgggagtgacttaccccaaagtaagacatggtgggcatgaaggatatggaggtggctgtagacaaaagcccagagccctgagaacagaggagggctctcctgaggggatctggggtgggagcggctgagaaggcagagaaggcagtcagagcagtgggtgcaaagccagctcctggggaagtgtcccgggcacagaggcgctgtctgcccaaagaggaagggaggaggggacagttgaggaccagaactgtgatgcacaagaaggtgagaatgcaaacctacagcatcttcctcgtgttcccattagggcaggtggaaggagctcctacccagaaa

SEQ ID NO: 581115 - DNA, 172 bp, Homo sapiens
attttaaccttggtacggctgaagatgtcatgcaagggctggtagagaagattgtcatttttctattgtaaaatcaaagagaaaaggaatgtagccaggataatatcttgttttcctttcctaaaagagaaaataatggtttctaaaagctgtacaaaagagtgctaacaag

SEQ ID NO: 581116 - DNA, 165 bp, Homo sapiens
gacggactgtgcctgtgtgtgttctgtttttgtctttgtactcactccagactcagtgactgcaagacgggcatgtgccatgtgctttccgtgtgcattctccactgtgtgctatcacgcacccatggcacggatggcatagggggacgggcataccccgtcgta

SEQ ID NO: 581117 - DNA, 1265 bp, Homo sapiens
ttatgtatgaccaattatgatccatcgtatattgtggatacaaagctgttgttgtgatctctagaagttattgtacactctcgttgctcaaaacggtggttgatcatgtaacaatatttgtgcaggttataggaaaagattgtatccgtgcccttgtggtatcttccgtctcgattaccggagttttctttccctccgaggtctgttttcccggcattagaggttttttcccgagctcttgtgggcttgcataatgtgcccaggttccccatttggcaatttttccctcgccaaatttcggtggaggtcacttggaggagaggttgaggggacacaaattttgccccgtgtgcccctgtgccaagaaaagggcttgcccctaatttgtcttggaagaaggaaggccttgggggagtttggacacatttccagcaacttgtgtcccacaggaaaataggaccccccccctgtaggaatgaggccctcaggggctccccctccgcggcgttggcccagaatcccagccctggttcaaccccccgaatagccaagccaataggcccactgggggaagtccccacacacacaatcgctgtccccgtgcgaatcccccctggaaaccctccccagaaccaaactttgggcgtctttgccccccctgtgaccagggataacttggagcccaagaccccctgccctggtgggccccaagaccccctggaatggccccccaatgctccaagactgccggggaaagggttcctgagccacaggggcacttcttgggagggcttcttggctgccttttgcacatttaatttccccttgtttttctttttcttcttgcgttttaaaggggtttggtggccacccacctcgtttaagaatgagaccctctggggaccacgtgagaacgtaagaaaaattgttttctagcacgagagtttgtgagccacacaagttcacgaagtggattcactggtggtttggcacaccacgggaatttgttctctgttggaagcctgcttctgtgctccccacctccactttttctgtcccttctgcctgggctaatgggaaagtggggaagcacgagtggcccagctcccacaccctgggtaattcacaaaacggcagaacaccacacacacatgttcctccacgcggcgtcactcgaagcctgcaggcccccgtgtgtgcctcaaactgattttgacttcagggaaagtaaccccgagtggccttggcctgttgtctttccccgt

SEQ ID NO: 581118 - DNA, 544 bp, Homo sapiens
tcaaattcatggcctattgtgatcctaccagctcaacctcccaaatcgctgggattgcatacatgagccactgtgcctgactcaaaaatcatactttattcttgagcccattggtcagggtagattcgcacactccctctgcaatgactccaggaacccctgtcacagctcagatcggaagctgaggctgcagcctgccatcttctccgcatagtccgcatcgaagcgctcattctgcgccacggtgaatgtggtcttccagtccccagccatgcctttcctcatgaagggggagatgctgtggcccatgaactcctgggggacggtggtgtagttggtaataaggttctttttcatatcctttgaacgacgtgtgctgaaccattaaatccttgggtctcttttggcaggaagcgccccacaaacaccaagaatcttttggtttttcccttttgaggggtttccttcatggacttcataaaaaaaaggtaaataccaaggttgggttgcgggttaaaaatcccaccaatacctgcaccttgcc

SEQ ID NO: 581119 - DNA, 756 bp, Homo sapiens
  misc_feature (480)..(480): n is a, c, g, or t
attccgttctttttttttttggaaacagtctcgctctgtcgcccaggctggagtgcagtggcgcaatctcggctcactgcaacctccacctcccgggttcacgccattctcctgcctcagcctcccgagtagctgggattacgggcgcccgccaccacgcccgggctaatttttggtattttaagtagagacagggtttcaccgtgttagccaggagggtctcgatctcctgacctttgtgatccacccacctcggcctcccaaagtgctgggattacaggcgtgagccattggcccggccacatcagttcttatcaaagaaataaccagatttaatctggaatggatacgattatgcccaatattaggtaaaaaattataagaaagggttatcttaaatagatcttaggcaaaataccagttgatgaaggcatctgatgccttcatcggtcagtcatctccaaaaacagtaaaaataancatttttggtgtgggcaatatgaaattttaagggagtagaataccaatgatagaaacagagtgctgaatgtgagaatgggattctaaaagtgtgttctttctaaatggtgtcctaaatgggataaatttaatccaggtattatgataaatctgaggcagatgagttacaagtttggaaatacttactatttaatcacaatgtgaagttatgcatgatgtaaaaaaataccaaaattctaattagggttgtgcaaggcaaaaaaagaaaaagaaaaa

SEQ ID NO: 581120 - DNA, 108 bp, Homo sapiens
tctacctcaaccaccagagcagatgagactacaggtgcatgggttatgagcctggggtctcctttactcccagatagagaaagcagataaaagcagacttgcttttgt

SEQ ID NO: 581121 - DNA, 321 bp, Homo sapiens
ttcagcaatttaatccacttggggttttcagcggtatgtacatctaaagacaatagactagaactggaattatgttctacatagtgaaatcacaattgtggaattacaggaattctggtgatattaatggtgaaataacaaaatacaaaaggtcctattataacatgttgatgtgacgagtctgttttgaatagaacctgtaacttcagtttgggaagatgcttctccaccatgataggggcttataccacctattgaacggagccgagatggtattgaaagagtgtggaatataggcaggatgtagatcttgtatcttcc

SEQ ID NO: 581122 - DNA, 132 bp, Homo sapiens
cccagaaaaccctatttgagaaagggccctaccctccacaatcaaagggggatacaatctacccctttgggggaagctcagagaaattcagaaggcaactgctacattcaagctctgggaagctcccgagta

SEQ ID NO: 581123 - DNA, 506 bp, Homo sapiens
gctaggcatcatgctactttctataagcctctcccaaaagacaaaaaatgcattgctctggatcagaattgcacaaatgagctaagaagggggtaagaaccaccaataaccatatcctggttattccaggacacctgcgggcaggctcgttgccctattggccttagaattacccttcacggtggagggagcaagagcagacacctgccaggcatccaccggaagggttggtcccagccgggggacccgcaggattgagctcaaggtcaaggcccgccagccgcagggtccgtccatgggccctgctcagcgcgcatgcgccctccaatccgtgccgcatttccccccgcccgccgggcccagtgcgcacgcgtggacgtcgccacgccctgcagcagcggtcacgtgatgcggcccccggaagccggcggcgcgtggacaaagcgatcgcggccttccacttccggcgcccgcctgcaaggctctgctgcccacgtccccgcccg

SEQ ID NO: 581124 - DNA, 188 bp, Homo sapiens
agccggtacccatcagggcattatactcagtattactattttacggggtcttacctacacctcccctacttctatcatgggggtaaagtggttgcccactacaccccaacagactggacctttactttgcacacttgtaaacaccactttctgccacctaattcctaggtctgatgggagcaagatgg

SEQ ID NO: 581125 - DNA, 366 bp, Homo sapiens
cacagcaggcagcgaagaagtagcactcctgagcctaggagacgtggacagacagaagggcacagcagcgttgcacatgccaggcacccaccaagggcagctcttatacaccttctgcaaaaaggaggggacctggagtgcacaataatgaatggatttgcttgcagaaaagggggcgaggttaaaaagaaaatggggtggagatgacagattccatcagaaaacttagctgtacagagaaacacatcaaggctttgggtgggcgatatcagattcaaatcttatcaccaggacatattgggatcagttcagggggttgtggcccaagttcagagtcaaaaactattatctcctctctggcgtagg

SEQ ID NO: 581126 - DNA, 643 bp, Homo sapiens
ggggaacccttggaggtcaactgtgcagacaatacttggctcgtactcaggcgctttgcttgggtttggctccgtagccatgtcagacaaacccgatctggttgagaacgagaaattcgataagccgaaactgagaaatacagagacgcacgataaaaatccactgccttccaaagaaccgattgaacaggagaagcaagcaggcgaatagcaatgaggcgagcgccgccaatatgcacggcacattccacaggcatggccttgttattttacttcttgtagctggtcaactttgtaagaggcaagcaggtcggatcaagtttaaatgactgcgctggccctgacaacaaaaagaactactgacacagaaggccgcgcctgcctttcccatcggcctatctatcagggtggcagggaaggaaagagcttgcatgttggagaaggaagaacaggggtggaagaagaggggtgaacaacagtgcaatttagagtaagaccatactggcccaaggtgtcctgcgggcttgaaagcaggtaaataaaagtgcctttttttgttttgcgcaagggatttcaaaaaggggaaaggcccaactttttatatatgcaacacaaagggggtaataccccaccatcacaaaac

SEQ ID NO: 581127 - DNA, 1124 bp, Homo sapiens
  misc_feature (591)..(591): n is a, c, g, or t
gcctagccctgctagaggctacaggactttacaagcaagggtatgctgttcttccagcccctaggctgtgggcgctgtatacaagtaggaacttcctttccttcacttcccttgtagcccctaggtcagagcatagacacgccgcgtttgctacctcgatatcctcctgtgctcggacagaggctgggagagcagctgccagtgctgattcttcctgaccttacctgtcatttgttcccgccttcagtatggatggacagctcttgctggcgtacttgactacggagatggtggacgtgggatgagggtgcttcatccctctacccagggcctgagggttgtatctgaaaattggaatgaatactggtggacggacacgcaaccgggacattcctgggaaggagacggactggcagatagagagcccgacgtggcgtgattgaggaccgggctgacgcacccggactggctgggctgcgtaggggaccgaccctgccatggaggcacacaaactggcagcccgaagagccgcaagaaggctctctgtatggaccccagtatttcccctggggcaagctcgcgactgaagcntgggagcaccttgtgcaccttggatgtggaggaaacatattcgggccggtgcatgtggaggaaccaacacctgagacaggctggtggcccccccgcttggcttgaatagaaggtcatgagctatatcaaactggaccttagcagctttaactcggtcaccgacaaacaagttcctctcacagctaacttcattttccatagggcggatgaaccaaggattccattgtataactttgtggcgacaccgaggactaggcacacagccacaggctcagaagaaattcatgggaaaacactacaagagggggatcagatcccaaccggcatgaaagggaagttagttggccacgcgatccaaaaaagaaggcatggagaaggaccgaggggtaggacaaggacgagtggcccattacctgtacaacatgaaacaccgcatatattgaacacaaaacattagtgcacctgcgaatgtgtgatacaacagcggcaagagagacaacccataaatgagcgagcatgcatgaacaaccgca

SEQ ID NO: 581128 - DNA, 771 bp, Homo sapiens
catctcaggctaccagaaagaatggtcgacctagactttcagtcaggcatcctcgttgcattgtcctgtaagtcaagttagttgataaatagttcccccttcatcccttaagttatgttttagttttagtttttaatataggtaagtgggactctacctaaaattgtgcatcatacttatgggtaatatctttgtcatatattatttatcaaagtgatgaagtggagtatttggcttgtaccatttgcaattgctggcattatagtagttcatagtataactgaaagaaatgatttcttcataaggtgacattaagatatgaacattcatccaattggaatttagcaaagatctttccaaaattataagggagaaagaatcgggttatacttccatctttagaaagatctggcacctcttagtaactttcagtgatttcgtaaagtgtctaaaattgtataataaagtagatcagggttgagcaatagtcttaattgtttaaggccaaaggttttctgagaccttaggtttagtagtctgaacagctatgtgtggttatataaaaagaatattcttagggtgtaaatggctatttttaaaaaagctttttattaaccaatagtataaaatgtgataatcatattggtgctgcgatgttgcaggtatcctacatgaaagtggttgtattaaaactcaaaatagggcaaatattgataatattaaagggatagggtggtatatctggtaggtaaagcttgagaattgtcagat

SEQ ID NO: 581129 - DNA, 117 bp, Homo sapiens
gcgctgatgacagccgtggggcgaactgcggtgtgtactaggggcaggcacttaatcataccgcagtcttatgacccgcacttactgggacattcctcgatacatggggaataattg

SEQ ID NO: 581130 - DNA, 134 bp, Homo sapiens
ctggaccgtggcggacacgtagtggcggatcacgtacagggtaggtaacatatatacgtacgtgtccggtggccggacacgtaccggcacgtgtgttacctaccctttcggtccggccactacgtgtccggcca

SEQ ID NO: 581131 - DNA, 382 bp, Homo sapiens
agagtatcccctggggacccctatccctttcagacagagaatccaagatagctatgtaaggacacttaaataactcaagctaacacagagaaggaattcagaattccatcagataaatttaacaaagagattgagataataaaaaagaacctagcataaattctggagttgaaaatgcagttgaaagactgaaggatgtgtgtttttaatagctgaattgatcaagaagaagaaagaattggtgagcttcacgacaagctatttataagagacaaaataataaagaatgaaacatgcctagaagactctagaaaaatgcctcaaaagggcatatctcagagttattgaccataaagaagtggtagagagaagtagaggtaga

SEQ ID NO: 581132 - DNA, 414 bp, Homo sapiens
cattcaggggccggaggacgttttgctacagctgctgtgggcacaattgcaggcgctgtattagcaccaatcacaagtggtacggcgtccactgcttggtcaggtatctcaggttcttctaacgccttgcaagcgtctatggatgacaacttcgctcaggctgcagctgtacgtcgcagagcaagcgttgctgaagcaggaaaaactgggattctggcgtacagcaatgcgactactcctggatcgaaggtgactattgcggtttctatggcttttaactgcagcgttgccggcgcatctgcagatgcatccagcttgcaggcaattgtagcggcaccggtcaatatgcctagtggttcagccgtcacaccaacatcgtttccgtcggctcccgtgacagttcttacacatttc

SEQ ID NO: 581133 - DNA, 812 bp, Homo sapiens
gagaaggcgggtaggaagggcagtctgtcctgcgctggctgggcagggagcggcagcagcgagccggggaccccgtgctgcctgccctgcgctgcggtgggacttggggcttgcgtgtccctggcctggggtgtgctgtgtgctcctgtgtgacactgtgacctgtgtggctggctgatgctgtggcctgtgtgctggactggtgcttcctgcctgtgtgcctggtgctgctggtgccccctctgagctgccctgccttcccctgcatggcccctgtcttgagtgtcttggcatgtcatgatgacatgcctggtgctgcccactggccctgaggcgcccaactgtgcatgcacccatttgccctgcactcctgtgatgctgccccaatgctttccaactgccatgtgccattggctgcttgcacctggcaacattatgagtggaggcggtgagccgcaaggctggcagcggatggacacgacagacggttggcatacacgcatgaattggaaaccaaggaacgacttgaaccgcgacctgaaacccagcgagcagacacggcgacacgacaacacagggcgcgcacctggcgcagagggaaccaggcagacgttgcttcaacttgtaggaacgagccacgacacccaacgggtgtacaccaccacgattatgcttggcaaggcatcgcgtgcgagccgctcgcacgagcctacacgtgggcctacctcaccacgggccacagcaggaccgtgtcccccgggccgtttttcgccgtgcgcgcggccttcccagggtaaaagggtttgctgagc

SEQ ID NO: 581134 - DNA, 306 bp, Homo sapiens
taatttgggaaggaatggaaaatggacccccccggacccccccagcccctaggatgggatggatggttttttgggggatggggtaggggaaataaggcttgcggtttgttttcctggggggctccctccaatttttgcagatttttgcaccctcctcctgagccgggattgtcccattactaaaatgtaaataatcccgtattgtgggggggggggttccaagggggccccccttttttttccggcctggattttttaaaaacccatggggggaaaccccctttttaataaaagtaatagaatcca

SEQ ID NO: 581135 - DNA, 137 bp, Homo sapiens
ctgcggatgtacatatgatgattgtgaaaccccagaatgcagctgctctcctgggagcttgaagaagaaactggctacaaatggggacatatgcctgaatgtactaccagctggtctagtatagcagaccctgcaat

SEQ ID NO: 581136 - DNA, 157 bp, Homo sapiens
agaattgtgtaggcgtaatgaaaataggggaaatcaatgaatgaagctctgctatgatggcaaatacagatctattgattggacatagtggaagtgagctacaacgttatacgtgtcgtgtggtcctcgcgcgtctagtgatgagtttgttattcaa

SEQ ID NO: 581137 - DNA, 627 bp, Homo sapiens
gggaagccccctgccttttttggtctaaaaaactttccagggccggggcctgttttgccaaaaaggggcccaatgggtttaaaccggtttaaaagtgggggtgggggtgagggatgggccccgaattcctttcaggaaagctggtacctgtccccagggacctggcagggaaaaaaggccggggggggcttcccagacccaaattccaaaaaaaagtttaattggttgggggaaaaaactcccaaaaaaccccggggtccgttgggggggagtcccacaaataacaattttttctttgggaggggccggggggggggcccctacttgggtgcaaactttggaagggggccggggattggaagcttcccaaaaagcattacaagaaggggggccaccccttcttaaggctttccaaaaaacccccggacttgttggggttggcccccaagtgtttttaaccccttccccggggggggttttttttttttttaacccagaaattggccaggacaaattatgcctctgtaaaaccccttttttccagtttttgccaggatttaccaatcccagcggggtccccagggtttttcccctagggcctctcccaaaaatttggggtttttgggg

SEQ ID NO: 581138 - DNA, 562 bp, Homo sapiens
atcccatttacgctgcagcggtaaaagatcagagtacagtagggctatattttattccccttatccttactttaaggttgcaaccccattgacagaggcaaaataaacacgtttcatagcagaaagaccaaaaaattgaatgtaaaccatagctctccctggggagattacccaaatacaaggttcatctgtacttagaacaaggctcataacttcttgtagcatggacattcaacaggcacagagcaacaacattcacccaaataccagctgcaatttgtcctttaaggatgcctcacaaggatatgatgtccaggtagctagtccatatatatcggggaacagttgcccttatgtaggatgaggctgtctataaaatgtagtgccacaactttgtggtgaatatgtcccatcatttgctacaatctagacagatcatcctgtctacaaaaaatcattttcaacatttctaagaccattatcagttgatctgctcctgcaagaaaaggacctactttttgtcaatttacattacccgaggctctgcaactccccatttaac

SEQ ID NO: 581139 - DNA, 153 bp, Homo sapiens
ccttcccccacagttgatggcactatccttggggtctttactactagggtctcttctactacaaagcacaacactaatgttcgtttccttagcacctcagttcaatgtgcccctatttatttcaatcaagaactgcacatatccccagctgtt

SEQ ID NO: 581140 - DNA, 620 bp, Homo sapiens
  misc_feature (72)..(72): n is a, c, g, or t
  misc_feature (159)..(159): n is a, c, g, or t
  misc_feature (239)..(239): n is a, c, g, or t
  misc_feature (295)..(295): n is a, c, g, or t
  misc_feature (297)..(297): n is a, c, g, or t
  misc_feature (320)..(320): n is a, c, g, or t
gttgttgttgtttttcttaaaaaaaaaaaaaaaaatagagcgcaagaaaggcccagagccggagcaccaagnttaaaggaggcagctggtggctttgtcagcgacgggaacgcgtggggcagagacctgcagagaccctgggcaggggtccggaggctntgggaccgtttgttcctgagatttgtgtgtgtgaatgagattgtgtgagccacccggggggtgaacacacgccggtgagntacaggtagtgagggcaaggggggtgtggggaggccggaggggcggggcggggaananagatggcggcgtgagaggggccncagcaccagggacacgggtccccaggggccctcgtactggtgccattcctcctcctaacagcgtgtccccctcatttctcagggtaggaaacaccgaggtgcaaacggccataatctactcggaatccattctcagtctcacgtggccaagtcgatggtctctcccaaagcagatgtttaaaagcgagagtcttcctgccatcaatttgctctccacgcctcagtcccaaacccctagcaccaaagtgcctcagttttcccgctgtatactgagctgagtcactgaggtggacctgggtg

SEQ ID NO: 581141 - DNA, 564 bp, Homo sapiens
ttgtttttctgaatggattcattgaatgcagtttcagcaaaactagaaagctccaaatgactttaaagaaatgctgagaccaactcagtatgaatgaaattgtttttataagtttctctgtataagtgcctatttttaaaattaaaaacagttcaagtttagaaatgaatgtgaaatcaagcttcagtatatttactgaaaattacaatggaaaagatacctaggaaatacatatttgaagacagatatgaagtacttaaaccataaatacctttagctgtgtttatgataatgctcttaatcattactaggggcatgtgtcatttaagtatagactaggcaattaaatggtattttgatgaacttgcagaatgaaatataaatctacacattaaaaccaatacttggaaatcttttcaggtgtttttaaaattattttagcatctataatttattctaagacacaagcttaagttttttttaataaactatagattattttcttagaattggcaatctattattttagtaaacatataataaagatgtacatacaaaaccgaa

SEQ ID NO: 581142 - DNA, 927 bp, Homo sapiens
  misc_feature (356)..(356): n is a, c, g, or t
gaggacactgagatctagatgatcactgaaatcacatctaattttatggtgcttctaaagctcgtttcagcagagcgataactgtgcacacgcaggtcgcatatgagaccactctatcgtgactaagacaccttcattagagcttgcctcttctaggtaaacatacgactactaggataatgatcacattatccttataccaacattcgcactatgatctgggaaatagagatctgcagattcaagagatcataatgtcatcggatcctgtggtcgagttaggatgctcttcttgagattaacgatgtgacatgagtctgcaactgctaggatgagtaccctcgagagactcgcgngctgctctctgtgacatagtggttgcttgttagcagaacatcttatcaatatgttgcaacttacttgtagctaccaagtaacataactagctctatctgctgttgcagaataccgtggagaactattacttcttagacgatagtacacttggagtatcatgttgtggtctaatagactgatgcagcatggttacgaatacgtctcgacccttaataatgactacgtatcatcttcgtcgcgaacatagctagacaggtgatgctcagacataaatcctgctcgagaaatagacattgtctgactactcatcaagccgtctatgacagtctactgtgggttccttgcgggctgtaggacgtcttacaacacatcgcctatgaaatacacagcaccactctgtcagcttattaactactgatcagtgtcccacaacgatgacattgggggaagaagtattgattaatcctgatcctctgaggtgtgaacatgcatgatttactatccagattatgttcttgtagacctatacatatctctttatagtctcctggagactgatgattgtgcact

SEQ ID NO: 581143 - DNA, 385 bp, Homo sapiens
  misc_feature (25)..(25): n is a, c, g, or t
  misc_feature (32)..(32): n is a, c, g, or t
  misc_feature (50)..(50): n is a, c, g, or t
  misc_feature (68)..(68): n is a, c, g, or t
  misc_feature (90)..(91): n is a, c, g, or t
  misc_feature (283)..(283): n is a, c, g, or t
  misc_feature (285)..(285): n is a, c, g, or t
  misc_feature (288)..(288): n is a, c, g, or t
  misc_feature (290)..(290): n is a, c, g, or t
  misc_feature (295)..(295): n is a, c, g, or t
agactcctcgcacgaatgtgctgtngctcgcnggtaacctcacgcgatanctatctgatgactcccanactcctacaggctcgtacctgnncatcaatcgaattatcgcaggtatcagcacctgggatttcttacccatcatgggcgcattcgaaggtaagcgaacgggcattacaggttgcgtaacggcagccagttatgcggcaacaactcggcgatctcactggcgcgctgcgtcggcagccgcatcagcacatccttgagataagcatacggatcatgncnttngntgccnattggatcaaactcatcagcgcagccgcgcgatgtccgctgcgtaacgaccctgcaaagagccagttcttgcgtccgagcgcccatggcc

SEQ ID NO: 581144 - DNA, 310 bp, Homo sapiens
  misc_feature (208)..(208): n is a, c, g, or t
  misc_feature (210)..(210): n is a, c, g, or t
  misc_feature (213)..(213): n is a, c, g, or t
  misc_feature (215)..(215): n is a, c, g, or t
  misc_feature (220)..(220): n is a, c, g, or t
acagacacaagagaactgccctactgaacatgcggctgatcttgtcgctactcgagaacatcgcgacgatgcgaccctcgtggaagcgaacgggcattacaggttgcgtaacggcagccagttatgcggcaacaactcggcgatctcactggcgcgctgcgtcggcagccgcatcagcacatccttgagataagcatacggatcatgncnttngntgccnattggatcaaactcatcagcgcagccgcgcgatgtccgctgcgtaacgaccctgcaaagagccagttcttgcgtccgagcgcccatggcc

SEQ ID NO: 581145 - DNA, 431 bp, Homo sapiens
tcttacacgagggtcgaagattacaagcctgaactatctagatgtcagtctagttctctaacaaaaggcttgacaactgtagtcctagctacttgggcaggctgagatgggaggatctcatgggcccaggagtttgaggctgaagtgagagctatggttccgtcattgcattccagtaatgtgggcaacagagcaagaccctgtctcctaaaactgaaacacagaggctggaccagtggctcacacctgtaatcccagcacttcggcaggctgagataggcagatcacctgaggtcaggagttggagaccaacctggcgaacatggcaaaaccccgtctctactaaaaatacaaaaattagccaggcatggtggtgggcgcctgtaaacccagccactggggaggctgaggcaggagaatcgcttgaaccc

SEQ ID NO: 581146 - DNA, 955 bp, Homo sapiens
aaaaaaaaaaaaaaaaaaaatttaaaaagtcccaaatctgccaccattaattcttgatcttttgcaaaagcggcaccatgtactacagaacgggtcatccctccccttggtcagggtatagagggttcttgggatgtagaacacttttcaaagaaccaatgagctgctgcagaaagtctggcaagaaagcccatggactggaaggagctgtgatcatcagctgaggggtggccttggagaaagctgctgtaaacgtattggccagttacgaagttccactgaaaattttcctattaattcttaaagtactctgcataagggggaaaagcttccagaaaagcagccatgaaaccaggctgtccaggaaatggcagctgtatccaaccacaaacaacaaaggctaccctttgaccaaatgtctttctctgcaacatgggcttcggcctaaaatatgcagaagaacagatgaggtcaaatactcagtgggctctctttatctcccttgccttatatggtgaaacaggggagatgtgcaccatttcaggcacagccctagttgggcgcctgctgcatcctgggtattggcctgggtaagaactttcagtgacagatgtagggggtagtataggcttagaaaggtcccctggtctcagccttgcagggcaaggcatgccagatctctgccagattccactgcccccttgatcttggacaggagtcctcaaggcccatcgcagcataaggatgtttggcaacatttccagagatctgggccagaaattacgggcgtcaaatacccggaatggtaggacaaagggtcacaatatgctgagaagctaaatccagactaaaagacccgcgaagaagtcaagaggggaccagaaaataccttggaatgaaggggggaataagccagggaattggaacacaggcacaggagaacacggcaaaaggc

SEQ ID NO: 581147 - DNA, 122 bp, Homo sapiens
tacctagcagcactgggcatttcccgtgctggtcaggttttctctccctcctcacgatgccccgtggcagagaaatgaggatctcctgaagtggccagatgtgtctgagctcagagcatcct

SEQ ID NO: 581148 - DNA, 255 bp, Homo sapiens
cgttcaccatgttggcccggctgttctcgaactcgtgtagctccggtgactgcccgactcaggctccgaattgctcttttgagctgcgtgagccaccgctcctggtgggacttccttcttgtgagctggttgcgtgtgtctgaaggtatcttccggaccttctcatctgttactgactgctgtgaggcttgacttacgccttgtgttagaacagcctcccgtaggctttgggtcttctcctgttttctctcctcc

SEQ ID NO: 581149 - DNA, 161 bp, Homo sapiens
agttggtcaagataaaacaagttgagagatgagtgcaaggaaaaaaatatttccaaagtccatgtgaaattgtctcccattttttggcttgtgtgggggttcagtttgggttgcttgtctgtttccgggttggggggaaagttggttgaccgaatatcgtg

SEQ ID NO: 581150 - DNA, 453 bp, Homo sapiens
  misc_feature (6)..(6): n is a, c, g, or t
  misc_feature (39)..(39): n is a, c, g, or t
  misc_feature (142)..(142): n is a, c, g, or t
  misc_feature (255)..(255): n is a, c, g, or t
acagcnggctcgtgcactctgtgccctgagaaccggaancgaataatgggctctcatgggtgaaccctgggcttgcagccctgaaataatcccggtcactgctcgtgttgtctgaaactgaatcagagttagggaaagtccnatgtttgttctccaccgagaaaaaaagggcgttctctttacctcttttctaatatcttcctaaaaacaacaaacaaaaagtgactttgatgggaggctgtcttataatgagcncattctcctcactggtcttgaagcccaggctataaacagagtcatggctagggagctacagaatattagctcatgtgggaaaaggaagggagctgttggctagaactttgcttcatgtggggaaagcataaaaatattgtgggcagacttcagctttgtgtcccctggtaagtttgactcattagaacaaaacaagac

SEQ ID NO: 581151 - DNA, 342 bp, Homo sapiens
ggtaaagggacgcggcgtccacatgtgtcactcgggcaggctggtgcctctcattactggtgatgctagcacggtgatgtcttgggtaaacatggcggggtaagatttgccgagttccttttactttttttaacctttccttatgagcatgcctgctgttgggttgacagtgagggtcatactgacttgttggttgattgtcagatattgggctgttaattgtccgtacagtgtctgaatctgacgcaggcttctgcggaggaaactgttttcatgttacttatactaacattagttcttctatcgggtgatagatcggtccagttgggtgaaaggccgtcg

SEQ ID NO: 581152 - DNA, 225 bp, Homo sapiens
  misc_feature (29)..(29): n is a, c, g, or t
  misc_feature (41)..(41): n is a, c, g, or t
  misc_feature (79)..(79): n is a, c, g, or t
  misc_feature (168)..(168): n is a, c, g, or t
  misc_feature (207)..(207): n is a, c, g, or t
  misc_feature (212)..(212): n is a, c, g, or t
ctcaggtgaatgccggccaccagcaatgnctggacctggtnagactccgcttctgcctttcaccaagagagtgtttctncactcaactcaggtgggcatttggggtgacatctcaaaggccaggaattccgttaacttgttgggctgccagtaggggcgggaggaaangcggaggcgagccctggaggagggaggccacaactccgnagctncccacctggtgct

SEQ ID NO: 581153 - DNA, 1309 bp, Homo sapiens
agcggccaggtgggagaagaggattgctgagctcaggaggtcaatcaaggctgtagtaagccgagattgtgctactgcactccagcctaggcaacagggtgagaccatgtctcaaaaaaaaaaaaaaaaaaaaaaagacggctggaatctcagtttaattacagtactttcttcaaagttatgtggtcccattaagaaacaaaaccttattttaattaattaccagaaagacacttatttggccctctttaaaggtgttccgtggcatttgggtggccgtgatgttgtgcaggggcactgaggaggttaaaccccacggtgcgcccctttagttccagaagggttactcaagcggtggcccccaaagttttgctagtagcctccatgggtgttccttctcacttattcacacacttcagaagttaaaaaaattcacgtttccactttaatctcctaaattgaagagacgttacaaatttcctagttttcctaagtcttatattcccttagggaccccattcttaatggccctgtgttgttgaccaacatggggagggtattgcccctaaagccactttcgtgcattaccgtgacagttttgggggttgcgttccccaaatttgacaaccctttgtgtgctgtgcctttggaccttgttgagcctggtttccgtgtttctcgtggaccttaacccgtggcgccggggtttccccaccaggttgacgcacatctttaggcgatatttggcctgtttacccctcaaatttttcccccaccaccttacccagctttggctctttgggacaagtgctcactttttactaacgaattgttccacccccctggttttgggtccccctttcggcccactcatgtttggggccccctcctgttgcgggtttacgggaaaaagcttttggccccctcccaaaggccaccccggtttgtgtttttcagggaagacggggaacattttgggacccctgtggggggaataacgttagaagctctttggtaaaaacgctttttaaaaggggctctccttgtgggaaccgaaactctccggagtatctccacggacccttgtgtccagcggttgcttatatcttggacaaaaagggccccttgtctgccccctgtgaaatgtgttagcgggtttagttgccccccccaaggaatttttcgtgggaggccacgcccgggtggttcacggcgtgtatcccccgccttttggtgggggattaggccggagagctgttcaacacccgggtgtttggcccccctcggcgcaactttgtgtgagtacccc

SEQ ID NO: 581154 - DNA, 277 bp, Homo sapiens
  misc_feature (261)..(261): n is a, c, g, or t
tgtttactatactatgttattttcaaagatgcgcctcctgtttataaaagaaaaaagttaactttaaaatagcctcaggcaggtccttcaggagggattccagaaggcattgatatcataggagatgataggtccatgtgttatggcccgaaggccttccagtgggacaataggtggaggtggaagaaagtgatattgatgtcctgacccagtgtttgggctagactaatatgtgtgtttgtgtcttagtatttaacaagnaaagttttagaaagtt

SEQ ID NO: 581155 - DNA, 127 bp, Homo sapiens
aatttatatagctcttaatttagggagtgctttgacccctgcccgtggagccaagcactgagcagggaggtgaacgccagtccagaaagaaggtcctggagcccttgctctgtcctctccatcacgg

SEQ ID NO: 581156 - DNA, 767 bp, Homo sapiens
cgagccccgtgtcccacggcgtgcagcagctgcgtgcgtgcggaggatgaacgcggagggggcggatggagtccgcggtgagtgatgagctagctacagctgaatatggactggagaccgtgtgtgaatccggtggttgatcaccaagccgaagaaccttgaatgacgccatacgtgacctcactccagcaaattactcgagatcgatgtgagcaacccgcacgacggtgggggtcaggaacgtgcgtgcacggcttcaccagcttactgaaactcagaggttcagatgacataatcttcctaattatctcaaagcctgaaaagaatcatactgttagaagaaagatactgatgaactctatgagatggtttgcgaacgtgaaattagacaaatgagagagcactggatcgtagtctcccccgagtccctgggataagcgttctatgcgtcaactaccttttagaggagatgatggaatatttgatgacagattttatatgaggaaagaaaagaagggctggagcagtttataaacaaggtcgctggtcatcctctggcacagaacgaaccgttgtcttcacatgtatttacaagatgaaataatagataaaagctatactccatctaaaataagacttgcctgaaatttggcaagaaggggcaaaacgtgactattaatgattgataatgcaccagtgaagcaagttctaattttaggcatgctgcgagaaaactgttataccatgaccttcagtaatactaaacg

SEQ ID NO: 581157 - DNA, 601 bp, Homo sapiens
  misc_feature (1)..(1): n is a, c, g, or t
  misc_feature (10)..(10): n is a, c, g, or t
  misc_feature (46)..(47): n is a, c, g, or t
  misc_feature (49)..(49): n is a, c, g, or t
  misc_feature (53)..(53): n is a, c, g, or t
  misc_feature (108)..(108): n is a, c, g, or t
  misc_feature (137)..(137): n is a, c, g, or t
  misc_feature (154)..(154): n is a, c, g, or t
  misc_feature (157)..(157): n is a, c, g, or t
  misc_feature (160)..(161): n is a, c, g, or t
  misc_feature (164)..(164): n is a, c, g, or t
  misc_feature (172)..(172): n is a, c, g, or t
  misc_feature (177)..(177): n is a, c, g, or t
  misc_feature (185)..(186): n is a, c, g, or t
  misc_feature (188)..(189): n is a, c, g, or t
  misc_feature (191)..(192): n is a, c, g, or t
  misc_feature (209)..(209): n is a, c, g, or t
  misc_feature (211)..(213): n is a, c, g, or t
  misc_feature (224)..(225): n is a, c, g, or t
  misc_feature (231)..(231): n is a, c, g, or t
  misc_feature (233)..(234): n is a, c, g, or t
  misc_feature (237)..(237): n is a, c, g, or t
  misc_feature (239)..(240): n is a, c, g, or t
  misc_feature (243)..(243): n is a, c, g, or t
  misc_feature (259)..(259): n is a, c, g, or t
  misc_feature (269)..(270): n is a, c, g, or t
  misc_feature (272)..(272): n is a, c, g, or t
  misc_feature (278)..(281): n is a, c, g, or t
  misc_feature (283)..(283): n is a, c, g, or t
  misc_feature (288)..(288): n is a, c, g, or t
  misc_feature (293)..(293): n is a, c, g, or t
  misc_feature (295)..(296): n is a, c, g, or t
  misc_feature (299)..(299): n is a, c, g, or t
  misc_feature (301)..(301): n is a, c, g, or t
  misc_feature (308)..(308): n is a, c, g, or t
  misc_feature (310)..(310): n is a, c, g, or t
  misc_feature (314)..(314): n is a, c, g, or t
  misc_feature (320)..(320): n is a, c, g, or t
  misc_feature (327)..(327): n is a, c, g, or t
  misc_feature (332)..(333): n is a, c, g, or t
  misc_feature (335)..(335): n is a, c, g, or t
  misc_feature (338)..(339): n is a, c, g, or t
  misc_feature (341)..(343): n is a, c, g, or t
  misc_feature (346)..(348): n is a, c, g, or t
  misc_feature (359)..(359): n is a, c, g, or t
  misc_feature (361)..(361): n is a, c, g, or t
  misc_feature (365)..(365): n is a, c, g, or t
  misc_feature (367)..(367): n is a, c, g, or t
  misc_feature (370)..(370): n is a, c, g, or t
  misc_feature (374)..(374): n is a, c, g, or t
  misc_feature (380)..(380): n is a, c, g, or t
  misc_feature (383)..(385): n is a, c, g, or t
  misc_feature (394)..(395): n is a, c, g, or t
  misc_feature (397)..(397): n is a, c, g, or t
  misc_feature (470)..(470): n is a, c, g, or t
  misc_feature (475)..(475): n is a, c, g, or t
  misc_feature (482)..(482): n is a, c, g, or t
  misc_feature (599)..(599): n is a, c, g, or t
nacaccagcngcacgcgccgtggctccggcatctcttcggcttagnngngtanccgagtgcgcggcagcgccggaggaccccagcagccatgtccggagccccatagngaagcgcggggactgccttcattcagacncagcagctggacgcagncanggnnganacattccnggagnacatgtgnngnnannaaaatagaatatacaanannnaaacaacaaannaggaanannggnannaanaagataaaaatggccnagcttcccgnngnaggggnnnngnggggnggggngnnggnangcggggnangaangggtgnggagggngaaannanatnnannnaannntatgtaggacnangtcntntanatcnattaanaannngcgcaaagnnanggaaagctttgcttctgaccccatcctctaccggcccgttgctgtggctctagacactaaaggacctgagatncgaantgggctnatcaagggcagcggcactgcagaggtggagctgaagaagggagccactctcaaaatcacgctggataacgcctacatggaaaagtgtgacgagaacatcctgtggctggactaaaanaa

SEQ ID NO: 581158 - DNA, 235 bp, Homo sapiens
tgcgccagaagttcagtacctgtcttagacagcatcggtttggctcagctgagggatcatggagtgctgtttatggtgttgaatttctatgaaaatttctttagcaactctggagcccaggctgccaggttggagtctttgttctcccgctttctagctttgctgtccttccgcatgttacttaatttctgggcctcaatttcctcatctgcgagatatctagtgcccttatcaa

SEQ ID NO: 581159 - DNA, 110 bp, Homo sapiens
aaggcgagcacgaccatgcccacggcgtcttctactgcacggacgcctgacgacttgcctcccggcacctggcgtggcagcagctttgactgacaacctgccgcgcacct

SEQ ID NO: 581160 - DNA, 225 bp, Homo sapiens
  misc_feature (204)..(204): n is a, c, g, or t
  misc_feature (210)..(212): n is a, c, g, or t
  misc_feature (221)..(221): n is a, c, g, or t
gaagacctggggtccaagaaatgggatttaatacgagagagagagacgtattcctggattatgaagtaaggccccaaggtaaaggctgtgcctcggcccttgaagtcaccagtccagagaagacccagaagctctgggaaaggctccctcaggacaaaggaactgatgaaagtagttggtcacatggaaaagagagttataaantggggnnnaattagaancaat

SEQ ID NO: 581161 - DNA, 137 bp, Homo sapiens
tgtagtcgttctattgagcattaagtgtacactttaaattaagtattcacttacgaatttggtcactgtcctatcaacggacataatagaaaatattacacagaactcaaacatgaaaataataaacaactacaccg

SEQ ID NO: 581162 - DNA, 347 bp, Homo sapiens
ttgtgccctgtcccttcaccttggatccacactgcttggctcactcatcactagtggcctccacgacacggtggcgacgctctgcttctcacgtttcacactgtggacacggaccactctggtccccgcggcaggctgcggggctctctggggcttgcgggcagcccaacttgtgtcctcacgaccgcccacttcacggcttcttccgggggggctgaacgctacgacatcggccgggtgtgtgctgctgggacgcacgtggcccggacgctggacggcctgggacgtggggacggtgtggtggccacgcctggggtgtccctctggggtcgtacgtacggcggacg

SEQ ID NO: 581163 - DNA, 270 bp, Homo sapiens
aaaatggctcacgctttcgtcgagacggggcccgagcggataccgcaggaaacagatcccgcgcgcgtcatcgatgacgtgcagctggtttttctgcaaaacggcaaaaaagatcttgctgctgtacgaagtaaagatttcgcgcagaaagctgtaggcgaagaatgcccccagactgagctcgccctccttgagcagcggcaacgccagcagcatgaacaacaccatctccagactgccgatcagctggtaaatgctgccttttatctg

SEQ ID NO: 581164 - DNA, 396 bp, Homo sapiens
ccttccttaggcaaccggtggtctacgctcccgggaggctcaccatattgatgcacgaacttagtgcggacacccgatcgcatagcgcactacagcccagaactcctggactcaagcgatcccccacctcagcctccttactagctgggactacaagcatgcaccacacccggctaatttttttttaacttttatttttgtagagacagggtttcgccatgttgcataggctgctctcgaactcctgatctcagtgtgatttacttgcgtcggcctcccagagctctgggattacaggcgtgagccactgtgctcggccatttccagcttttgatttagggtgtgagacattcagctcttcctttgcttgagccctttgaggcgattagggttagt

SEQ ID NO: 581165 - DNA, 743 bp, Homo sapiens
  misc_feature (46)..(46): n is a, c, g, or t
  misc_feature (81)..(81): n is a, c, g, or t
  misc_feature (126)..(126): n is a, c, g, or t
  misc_feature (147)..(147): n is a, c, g, or t
  misc_feature (160)..(160): n is a, c, g, or t
  misc_feature (170)..(170): n is a, c, g, or t
  misc_feature (180)..(180): n is a, c, g, or t
  misc_feature (182)..(182): n is a, c, g, or t
  misc_feature (216)..(216): n is a, c, g, or t
  misc_feature (300)..(300): n is a, c, g, or t
  misc_feature (333)..(333): n is a, c, g, or t
  misc_feature (342)..(342): n is a, c, g, or t
  misc_feature (367)..(367): n is a, c, g, or t
  misc_feature (376)..(376): n is a, c, g, or t
  misc_feature (378)..(378): n is a, c, g, or t
  misc_feature (380)..(380): n is a, c, g, or t
  misc_feature (438)..(438): n is a, c, g, or t
  misc_feature (450)..(450): n is a, c, g, or t
  misc_feature (457)..(457): n is a, c, g, or t
  misc_feature (462)..(463): n is a, c, g, or t
  misc_feature (471)..(471): n is a, c, g, or t
  misc_feature (478)..(478): n is a, c, g, or t
  misc_feature (491)..(491): n is a, c, g, or t
  misc_feature (510)..(510): n is a, c, g, or t
  misc_feature (522)..(522): n is a, c, g, or t
  misc_feature (524)..(525): n is a, c, g, or t
  misc_feature (533)..(533): n is a, c, g, or t
  misc_feature (541)..(541): n is a, c, g, or t
  misc_feature (549)..(549): n is a, c, g, or t
  misc_feature (551)..(551): n is a, c, g, or t
  misc_feature (555)..(555): n is a, c, g, or t
  misc_feature (557)..(557): n is a, c, g, or t
  misc_feature (559)..(559): n is a, c, g, or t
  misc_feature (571)..(571): n is a, c, g, or t
  misc_feature (576)..(576): n is a, c, g, or t
  misc_feature (578)..(578): n is a, c, g, or t
  misc_feature (582)..(582): n is a, c, g, or t
  misc_feature (584)..(584): n is a, c, g, or t
  misc_feature (599)..(599): n is a, c, g, or t
  misc_feature (614)..(614): n is a, c, g, or t
  misc_feature (617)..(617): n is a, c, g, or t
  misc_feature (628)..(628): n is a, c, g, or t
  misc_feature (637)..(639): n is a, c, g, or t
  misc_feature (643)..(643): n is a, c, g, or t
  misc_feature (661)..(661): n is a, c, g, or t
  misc_feature (743)..(743): n is a, c, g, or t
gcccagtcatatcccatgatcttcagcatttggaatacttgctganaatgctttttttgtcctttatctgttacatatatnattgtatcaaaattatacttgtccattcgatctatagcagctgcnagatctctggttgcatagagngaagtcccatcanttcgcattanagtacaaatngngggggggtcgccattgccagagagatctactacngccgttccttttattgttttcagtaggagttctttactctccagcaactttaagacctcttgagatttttcacgataaaatgantctcctgaatattcatcaaaatatactcccagncgcttgtcnacccgaatgtactcttcaatgctcnagtcccganantnctgccacagtgaaagtgcttgcacatcgcccagttccaatcgttggaagaactcctgngctgcgtttgcnacacttntatcnncggctgcntctttantaacttgtacatnaacttcacagagatgctgncgaggactggantnnattttttnctcatagncaaaaagntngaancnanttcccagaagancaaantncatncnccaatcgccaaggtnatttattcttattanttnatgtcctaaancttcttttnnntttnctattaaatttcctatgntggtagaacgctaatgtccaacatgatattttttggcaacattaggtgaactgaattcaaccacaatcttcttctgggggan

SEQ ID NO: 581166 - DNA, 253 bp, Homo sapiens
aaaggaagagctaataaatctcttctttgctgcagtcatctactttttttttagttcaaaaaaaatttttttttgaagcagtcttgctctgttacccaggctggagtgcagtggtgtgatctcggctcactgcaacctctgcctcccaggttccagcaattctcctgcctcagcctccctggtagctgggatgacaggcgcctgccatcatgcctgactaatttttgtatttttagtagagacggcgtttcac

SEQ ID NO: 581167 - DNA, 188 bp, Homo sapiens
aaagagcagcttgagacaactgaggtgtgcctggaatatatttcctaactcagattgagcgaatggctcaacctgtttggtttaaaaacaaaacagcaacaaaactacctgtaaataataccaggtttgggggcacatgggaagcacacgatagtaaaacgtatttactttgacagcatccaggatta

SEQ ID NO: 581168 - DNA, 225 bp, Homo sapiens
  misc_feature (41)..(41): n is a, c, g, or t
ctggggccttgtttttaaagccaaaaacccaatgtaatccnccccaaggtaggttcacaaaaccccctttgtttttaatattgaacaaaaaaaacccagtctcccctcttcatgggaaaagtggtgaattccccccccaaaaataaatgcctcttggtccttaaaaacccctccctccatccctgggcccctccctggatgacattaaaaaagggtttagctgga

SEQ ID NO: 581169 - DNA, 1337 bp, Homo sapiens
ggaagagtgaagtggtctcaaaccccgtgcaggttgcgaccaggccagaccagtgtgcgctcgctgcctgcgtggccgggctgtagtgcgaggtgcgcgccccagtgccgagacccggggcttcagtgagcctggccccgtggagagaagagtgctggcaggctggactgtgagaaaacaactccaaatgttggcgaaatggcaccgccccatactccctgtggcttgcctgacctgactccgcctgacccctagcgcctggccagtcagagtacgggtcgagcccgggccatggagacccccctggtgggaggctgggcaccagatggaaggccttggcgctgcccctggggggcctcccgaccgaaggaacccaccagtcggagtagaacccacaagaaggctccggggacccatttcccgggcaccctcttgggaagtagacccaggtgattgctggattagggacaatccgtcgctaccttaccgttcctaccgtttgtgaagggcggcatcgttggccacaggttgccacggagcccgtggagttacatctgatatcgcgaaaagttacatgctttgattgaacggggacgacgaacacagcaaggcgagggtgcctcctgtacgcagaaggattggcagctggggcgaccccttttagcaaggacgtggcccccttggataccggggggagccagtggcgcgacgaccatcacgcagcatggacccaaaagcttgccagacacttgtgacctttcgattccacttgcggaggcagggcagaagaggaacagctaagagaagtttggataccacgccgagttcaaggggttttccagagggacaacggccttacagaagtaccctatggggacagttgggttggggcttccacggagaggacggcgcgttaaaccacagttaactcggcgtaccgcacttccttaccaagacgacagttggagtcactacccccataggttcatttgagaggtgaccagcaccttcaaccgaggacgccgctctattgagcagagagacttgacccaccagagagggagcacgaaagcacgattcacaagcagccagttcaaacattttagccaaggccatctagttatcagttagtgtaggcagcacagacagctccagccaccgagttgcgggcccgagagggggcacttatcccagttggaagtctagttacagctacagaggagagcaacagaacattggaggcagttgaattgttcgccactagccacgaggcagctgcaggtttcacaggtatggcagcttagaagcaccaataacgggatgagtagatctacatg

SEQ ID NO: 581170 - DNA, 193 bp, Homo sapiens
ccttaggaagaggaattaacggtacttatcgacacacctatataaagtgccgatctacaaagtagctaaaacttccattaaaagctgtttaactggaagttgagagtctgctttgtacctcaagagttacattagcctgttgtggataaatgtaaattatagtccaagtaagatactctgcaaggaacccgcg

SEQ ID NO: 581171 - DNA, 255 bp, Homo sapiens
tctttaggggaaaaaacccccccttcgggtttttcttgggggggggggggccaaacccccttggggggggggacccccttttttttaaaaaaaaaaaattttttgcccccccaaaaaggccccccccccccgggggccccccccccccaggggggggcgcttttttttttcgcgaaaaatttttttaatcccccagagcgggccccaactttttttttttttttggggcacgggccccccccccaaaatttaaaa

SEQ ID NO: 581172 - DNA, 976 bp, Homo sapiens
  misc_feature (937)..(937): n is a, c, g, or t
cgggcgagacgggacaggagcgtgacctccccagtcccgaggggccggacgctcgggcgcctccgccgctcgccccactcggcaggccgtgcgcgccggttgtcccttcctcgtctctccctgaccccagtcccgtcagtccgtgtgtatgttggggtgtctgtgtagtcggtgctgaagttggtgaagctcgacgcgggttgtctgtagcgtagggtcagttcggctgatcgggttttcgacgttcagagcggtgagccattcttgctcttgtgtggaatgagtctccaggtctactggaggtgatggtacagacacgatgaggacattgacaagagcagtgccgtatgaggacttcaaagccgactaaaccttgtaaccctaagcggaagtgtacataacttccgcattccggttaaatgggaaagtgaatatgtcaccaatcgtttaattcctaagagggcgagcaaagtagggaacagaactagtcacccatttgcggggcattaacatcgcgtggtccccaaagaacagcttggtggggaggcaggcgaagcaaaagccgtcctacgcaagcccgccataaccttagcaaagtgctttctatcaggagatggccaataggtggttggtagaactctttagggtagcctacaaaattcccgttccaacgccacgtttgtgaaaaaccctaaggtcgcaaccaacaaattggtttgcttgtgttgcgcaccctggtaaggaaagacaaaagacaaaaaccgcgcgttgcccacacacatttcgcatagaaccccttaagaagataaatcaaagaggagctggcgtacgcgattctcggcagcacccatttgtttttccccattacggtataccttgtgtgttaagccaaagagggttggtgccgcaccgttaatgttaacacacagttggtgancccgttaatatacagtcaagacgaaagagatttaccaac

SEQ ID NO: 581173 - DNA, 788 bp, Homo sapiens
  misc_feature (5)..(5): n is a, c, g, or t
atccncactgtttgccatcgccaaacagtgaggacagatcagcgccagtgcagtgagcaccggcacggaacctttttactcggcctgcaagacaccacggcgcaactgatcgcgctcgatggattcaaacaaggccttgaagttgccttcaccaaaaccatcatcgcccttgcgatgaatgaactcgaagaatacggggcccatcaaggtttcagagaaaatctgcagcaagagacggcggtggccaccttccgatgtgccatcgagcaaaatgccacggttttgcagttctgcagtcggctcaccgtgcgccggcaagcggccttccagcatctcgtaataggtttgtggcggcgcagtcataaagcgcatgcccatggctttgagcttgtcccaggaggcaatcagatcgtcagtcaggaaggccacgtgctggatgccttcaccattgaattgcatcaggaactcttcgatctggcccgaacccttggcggattcctcattcagaggaatgcggatcttgccatcgggggcggtcatggctttggacgtcaggccagtgtattcgcccttgatgtcgaagtagcgaatctcacggaaattgaacaggtgctcatagaactgggcccagtaggccatgcgaccgcggtacacgttgtgggtcaggtgatcgatctctttcaagcctgcgcccacgggatgacgatccacgccgtccaggtaaacgaagtcaatgtggtagatggagttgccgtagacgcgcccgcgaatttagtagtagtaggcgg

SEQ ID NO: 581174 - DNA, 500 bp, Homo sapiens
  misc_feature (31)..(31): n is a, c, g, or t
  misc_feature (35)..(35): n is a, c, g, or t
  misc_feature (99)..(99): n is a, c, g, or t
  misc_feature (105)..(105): n is a, c, g, or t
  misc_feature (109)..(109): n is a, c, g, or t
  misc_feature (130)..(130): n is a, c, g, or t
  misc_feature (133)..(133): n is a, c, g, or t
  misc_feature (151)..(151): n is a, c, g, or t
  misc_feature (163)..(163): n is a, c, g, or t
  misc_feature (174)..(174): n is a, c, g, or t
  misc_feature (233)..(233): n is a, c, g, or t
  misc_feature (277)..(277): n is a, c, g, or t
  misc_feature (350)..(350): n is a, c, g, or t
cccaccccaaatgcaaacgcgccacggatgngatnttggccttatcatgtgtcgcaagtcccgcttctggtattgtatctcagttaagaagtgaagaantcttcngggnagattgtctatgtgggcagtnttngagaagtcccccctgggntgagaattcggnatctggtgcgntatgactccggagcggcaccaaaacatgtacgggaatacgggactgaccacgcaggcgntgtcacccagtgctaccgagacatgggtgcccggcaccgcgccngagcccatccattcagatcatgaaggtggaggagatcgcggccagcaagtgccgccggccggctgtcaagcanttccacgactccaagatcaagttcccttgccccaccgggtcctgcgccgtcagcacaagccacgcttcaccaccaagaggcccaacaccttcttctaggtgcagggccctcgtccgggtgtgccccaaataaactcaggaacgccccggt

SEQ ID NO: 581175 - DNA, 337 bp, Homo sapiens
ccttttttttttttaattgggggccggcaactttcttaacaatgattctacttccggggctatcacattataaggctctgggcctctttttggcggcggtttggctattcttaaacttaggccaagtaccaaggtgggctgttagaagggattcggttcattcaacatgcaactttagggaagggaagtaagttcatttttaagtggggtggtcagtaggtgcggggtctagggtagtgaatccggtaagttcaaatttatgattaggtgacgagtggacatggagatggtccttttccctgatcaaaaaatgaataaagcctttttaaaaaaaaaa

SEQ ID NO: 581176 - DNA, 335 bp, Homo sapiens
tcagagggagagatgagagctggcacgatcatcgaggtacaaggagatcaaggactatcgctggacaagcatggtgaaaccccgactctactgaaaatacaaaacagacaggggagctggcgtgagcctgaatcccagctacttgagaggccgcggccggagaaccgctggaacccaggcggtggagggcgcagtgagccgagatcgcgccactgcactccaacctggtcgacacaacaagactccatctgagaaaaagaaaatgaaaaaagagggagcaagggaggaagagaaatgcacaggaacggcagcatggtgaggatgcagaacccaca

SEQ ID NO: 581177 - DNA, 154 bp, Homo sapiens
taccgttttctcgtcaaaagctaatatctcttagaaagcaaggtcttccagtccaggctcttcgtaattttatttttttttggaaatagaaatctcactggtgtcgccaaggcgggagtgcgtgggacctgtgatctcagctcacggcaacctt

SEQ ID NO: 581178 - DNA, 102 bp, Homo sapiens
tgatttgccagtgtctgatgtaagtgagaattcatgaagcgcggtaacgggggagtaactatgatctattaggtagccaatagctcgtatctaattagtgac

SEQ ID NO: 581179 - DNA, 361 bp, Homo sapiens
gctcgacgccgccgctcgtattcgtcggagttttatagccggggaatgtccaaaagcatcaaagatcctgacaagtggcctcgcgacagatcgttctaccttttcaggcgtttgcgcgacagattctgatctacctgtagacgttggttgcaaaataatcactgaaacgaacgcgagccaactgcttctatgccgctggaaggacactgcacaggatggtgaaaatattctaggagatagtgctactggctcccgttgaaagtaagagcccggcgaagagagtatttaaatttctagctgcttttcagtttaaagtgaataatccatctcaggatttatctttgatgctgaaaagtcgacg

SEQ ID NO: 581180 - DNA, 130 bp, Homo sapiens
ctcagagtatcccgggagcatcactttgctttcgaggcattaagtagtaataaaacgtatttctgaccagctgggcaagtatagcgagacccccatatctacaaaaaattttaaacattaggccaggtgt

SEQ ID NO: 581181 - DNA, 606 bp, Homo sapiens
gggacccacaagcctcaaccagagatgttttgcgacgcacaccccgcctccccgcgggtacaacattttgttctgggaaacaaacccccaccaccgcttctctgtggaaaaaactctttctgactattttcttgatgttgctgactctgtgtcttgtccatacactccagtgttttctctcccacgcggcacatgcgcacgccgcgacatgcgactctttgtggcggcttctccacagagagacatctcatttcatcttctacgagggacccccctcttgtcaaaaacgaggccgctctcttctcttatagggcggaatatcttcttctcgggaggccggttctacacgtcacccggctcagacattgttattgtgtaaagatgatcagtagggaaaataaagagacgatcttcaggaaaaacatgtttctgtgcaacaggcgcgtctcttgtaaaccacatgtctagaagaagttcaagccccaggtctctccccagcaggcggcaacgtttatcttctctcatacgaggcattcccggcgtaattccctcaattcctgtgcggagcatatcaaagggcgggtggggcggccaacaaatgtcgag

SEQ ID NO: 581182 - DNA, 195 bp, Homo sapiens
aggatatgatatggcaaattcagagcctttccattatggtcattccacatctaaattacaaatctgaaaaaaagattttcgagctgaaagatatccaaatctggtaacatggggagacccgaaagtttctactcctactcttagcaactagctttaacgatttcttctggacttaccacacacactacaataaca

SEQ ID NO: 581183 - DNA, 809 bp, Homo sapiens
gggccgtctttccttggcactccagagaataggaactacaaagctgaatttgcatcatgccgactgaaggctgtaccatttggagttctgtggtgactgatcagccctctggaagactccatgaaactgtcacagagtcaaagacaaagaaagtgaagcggaaaggaagcactatcttccacgtcctcctccctccgtccgagcgtccgtggtggacccgtctgagcagcagtccgtcgatgggacttgacccccatcgtcctatgtttgcagccgactgcgtgacccctgcagccgttggcgagcatgccgatggaacagctccagaaggaaacggtgatagagatgataacgtccgtttgtaggatcaggattttgagccttgtgaccatcaaatgggggagaaatccttgtcccggtagcagctccactaccgtaaccacgctgtctattagatctgttctatggtgatctgaaaaaggcaaaagctgggactgccacattggcaatgtcagagaaggtgcggacccggctggaggagctggatgactttgaggagggttcccaaaaggagctgttgaacttgactcagcaggattacgtgaaccgcatagaggagctcaaccaagtcgctgaaggatgcctggggcctcagaccagaaagtgaaggctctaaaaatagtcatccaggtgttcaaagcttctttcagacaccagtgttattcagttctacccaagcgaatttgtccttatcaccgacatacttgatccatttggaaagctcggtacgagcgcatctttccggtgtg

SEQ ID NO: 581184 - DNA, 233 bp, Homo sapiens
atgaacggcgggatcatgtccccggccaaactaggcctgctctgacatccgcaatatacgtccactagcagtgcgcaagacctcccgcgagacaggtgtagttataaatgcccatctcacagatgaggaaaagatctcaaagtagcttgatgatttacccaaagttcccgaaccaggcctttaaaactttttatgcatgcaccgcctcttgatcacatcagcctcatactgca

SEQ ID NO: 581185 - DNA, 348 bp, Homo sapiens
gagagagagagagagagagagagagagagagagagagagagagagagagagagacagagccccagagactttcatctccttaccttctttctctcttctcttcctctttctcccttcttccctcccttcttttctctcttctttctcttctctctcttccctcttctcctcttctctgtctttccctttccttcccttctctttactctttctctcttttccccttctctcttttcctcctctttctgctctctctctttctccttttctctctccttctcttctctctcttttcctacctttttctcctttgcatcctctctctcctcctcttctctcttccttcct

SEQ ID NO: 581186 - DNA, 109 bp, Homo sapiens
tgaataatgtaacctagaagtaaataaaaggggaaacaggaaagagaacaggttaggttaaaggagagtatagacgaataataggtaagtatgcaaaattgatagcaac

SEQ ID NO: 581187 - DNA, 209 bp, Homo sapiens
  misc_feature (15)..(15): n is a, c, g, or t
  misc_feature (80)..(80): n is a, c, g, or t
  misc_feature (83)..(84): n is a, c, g, or t
  misc_feature (87)..(88): n is a, c, g, or t
  misc_feature (92)..(92): n is a, c, g, or t
  misc_feature (95)..(96): n is a, c, g, or t
  misc_feature (103)..(103): n is a, c, g, or t
  misc_feature (136)..(136): n is a, c, g, or t
  misc_feature (145)..(145): n is a, c, g, or t
  misc_feature (156)..(157): n is a, c, g, or t
  misc_feature (159)..(159): n is a, c, g, or t
  misc_feature (172)..(172): n is a, c, g, or t
  misc_feature (180)..(180): n is a, c, g, or t
  misc_feature (182)..(182): n is a, c, g, or t
  misc_feature (185)..(186): n is a, c, g, or t
  misc_feature (199)..(199): n is a, c, g, or t
  misc_feature (206)..(206): n is a, c, g, or t
  misc_feature (208)..(208): n is a, c, g, or t
gtgggggaaaagatncagccctcccacctcattttttactataatatgttgctaggtataattttattttatataaaaantgnntannttantcnnaataccntacgactaagtgttggtggtttgagggaaatgnaaaaaatgnttaatttaaanntntgtataggtgaantaagaaantnagnnagaaaggcaaggnggaaatnana

SEQ ID NO: 581188 - DNA, 258 bp, Homo sapiens
  misc_feature (8)..(8): n is a, c, g, or t
  misc_feature (32)..(32): n is a, c, g, or t
  misc_feature (35)..(35): n is a, c, g, or t
  misc_feature (58)..(58): n is a, c, g, or t
  misc_feature (106)..(106): n is a, c, g, or t
  misc_feature (110)..(110): n is a, c, g, or t
  misc_feature (117)..(117): n is a, c, g, or t
  misc_feature (120)..(120): n is a, c, g, or t
  misc_feature (225)..(225): n is a, c, g, or t
tccccccnaatgccggcttgcttggtggccgnggncggacatggcaagggcaccgaancgccccagctctcttcctgctgccggggccgccccggccgggagtaangagncccggcnctntgccccgcagccggccggggaaggcgcggtcccgccctgggaggaggccagcgggggccccggctccttgagcttacggtgccgggggaggaagtgggcttcggncgcccaggctcgtcctcgggccgcccagcgcgc

SEQ ID NO: 581189 - DNA, 911 bp, Homo sapiens
  misc_feature (651)..(651): n is a, c, g, or t
atgcacgaaagactactagccgcggggaaaccgtaggcccgcaaatgcacctcgggaaccccaaaagggggggtcccttaaaatggacggcccgcggggccagccccaaaagaaacttcgcggtgagtagccggatgtagaggagtgaaaatgagaagataaacttagagtggacctgtagaacccccgcgtgatacttttcgcggattccccgcgaggcgcggaagcagaaccggagggaaagccgcacgccgctgctcgcgcccaggggtcaaaacggccaagatccctccacggaaccggggaaactcctgtgacgcccgcaggagcctagttttctgttgaagagccgttagccccaatgtcggcccaaggtagtaggaaaaagagggggtcttcttcgcccccagggggaacgcccagttccgccaataatgtggaagaaattgcttctcggagtgtgctgtaccccagaggcgtatttccaagaatcttctctgcgccctgtgagggagaatcttctctttatagagaaatcagtgttagacacgcaaaaattggtgaaaaagttttcccgtgcttatattcaaagttgttgtaacacgatgaaaatcttggcgcgtcctccttttataaaagcagagggtaganactttccccttcggtctgttgtagtaaaatgttgtcaccgggtgttaatttcaccacaaaagtgtggtgtccacacagcgccgtggtaatgttttaaaagagtgggaccgcgcacccttgccgtgggtttaaaggaattgtattggggaagtcttattaactaggacaaatatgtaggtaagccgggggtccagaaaaggaaaatggggggggaccaaaaaaaaaaaggggaaaaaaaacccctttttttttaaaaaaaa

SEQ ID NO: 581190 - DNA, 84 bp, Homo sapiens
gcggccgcctactactactactgctcgaattcaagcttctaacgatgtacggggacatgaaagctaataaacctgtcagagaac

SEQ ID NO: 581191 - DNA, 347 bp, Homo sapiens
  misc_feature (347)..(347): n is a, c, g, or t
attccatgtgatgtttgtgcctctgttgcttatttccaaacctcataggctatcttgcctatgaacagttgaaagttttgacttctttggactcaattgaattcactaaaacaatgaattttaataatttttttccaaattcttattcccattgcctttaaaagtcctttagaggcaggttgtataatcataatagcctcctctgaactgccttgagttgtttttcttttctgcttttctgtcacttatgtaaagagtacatgtatttacataaaccttctctgtcccggcctatttcaaaataaagtggaaataaaaatctttagctcaatcttaaaaaaaaaaan

SEQ ID NO: 581192 - DNA, 379 bp, Homo sapiens
gggtccccccccctgggaggggggcccccttttttttttgccccggggggccgaaaatataaaatttggggggggctttaaaaccccccttttgggggtaaaggcccttccccttttaaccccaaaacccaaatttttttccccccccccccccaaaaagcccccaaattttgccttttcccccccccaaaaaattttttgccccccccccggggtttcccccccccccccccgggggggcccccccaaaacccccctttttgggggggttttttcccccccccccaaaaaaaggggttaaaatttccctttttacccctttggggggggggggttttttttttccccccccccccccccccttaaattttctttttta

SEQ ID NO: 581193 - DNA, 226 bp, Homo sapiens
tcggtctaccttgtttagcttcagagtaggatttgttcactggccaatgcctgccatgaaactatggctttcagcatctgtcttgctctactggctcttgacaaaactcttgatgtgtcttcaatgaaaagtaattgtactacctgtgtgctccatgtggcttgtgcttgatgctccacacatgctcatcttgcacaaatgtgtttgtccatgacgaatgtgtaga

SEQ ID NO: 581194 - DNA, 175 bp, Homo sapiens
cggagtcattcagtccaggaggtcgatggctgcagttgtgcactgtgatcagcctgggcgacaaaacaagactctgtcaggccgggcgtggtggctcacgcctgtaatcccagcactttgggaggcgaggtgggcggatcacgaggtcaggagatcgagaccatcctggctaaca

SEQ ID NO: 581195 - DNA, 133 bp, Homo sapiens
tacggctcacaaacaggggcttcagaactaagcatacagggatctattccacgtgaggtcccaaagggtggtattccaaggatcggtatcctggggacatatggcgcacaggaggcccaaatttcttcgggaa

SEQ ID NO: 581196 - DNA, 257 bp, Homo sapiens
gcatagagtctctgtgacttccgggtacgcctgtggaaacatgcacgtgtgccgctggggcagagaagcccagtggccccacgaacgacgcgggggagaggttgcccatgcatgtagactaggggttcgggcgggggaagccttgcaaaagcccaggcagaacatcaatcagtgacacatctcttctcttctaaggtgacaggcagagtctctggggcattcctccacaaaatgcagctcagtggggacggactagc

SEQ ID NO: 581197 - DNA, 132 bp, Homo sapiens
ttgcaggcattgtgtgcagtatcgtacggatctacttgtccatgatggtaaagggtagcttactggttgtcctccgatcaggttagaatgaggaggtctgcggctaggagcaatcactttattgactcctag

SEQ ID NO: 581198 - DNA, 303 bp, Homo sapiens
gtttttaaagttgattaaaattatttttctgttaaagccttctgaaagggtttgtctttccctagaatgatttggaccccctcgtggtcaactgaacatgaatgtcagtagtagtctaattatgggaagggtaaacgtgttagattaaggcttttaaagctttaacccatataaactatgggcttgtatcatgatttaactgtttttagatcttttttacccagtgattcattcctctatttggccaggggctttatgaaatgttgtgaattgatcctgtaatcaataaagggcttttaccca

SEQ ID NO: 581199 - DNA, 340 bp, Homo sapiens
gctgctttcactgtatcccataggttttggtatgttgtgtttccatgatcgtttgtttcaagaaatttttttaatttccttcttaatttcttcattgatccattggtatttaaggaacatattatttaatttccatgtgtttgtatagtttctaaaatttatcttgttactgatttcttgttttatttcattgtggtctgagaagatacttgaggctgagtacagtggcacatacttgtggtcctagctatctcaggaggctgaggtgggaggatcacttgagcctgggaagcaggtcgcagtgagcctgagtcacataatcggtcaccgacagaggact

SEQ ID NO: 581200 - DNA, 210 bp, Homo sapiens
tcagctggtcctacgtgtgctgatcagaactcagcctggccatcgcatcggctatccggacctgttctggtcggtgttcacgaccatcaatatcaccgggcatgccatcgaaggggtcttgctgctggccggcgcctatctggtgctgacgctggggacctcatgggcgttgaacctctggtatgcacggctgcgccgcaaaggatgatt

SEQ ID NO: 581201 - DNA, 120 bp, Homo sapiens
ggggcgggggaagaggggagtggggagggacggggtcagtcttcctttcaggctcccaaacacggcggcgggcacggctcttgcggctccaagccggaaccgtcgtggggctccaaggtc

SEQ ID NO: 581202 - DNA, 248 bp, Homo sapiens
acacacacacacacacacacaacacaccacacacacacacacacactatcgcatccacagcgtcaaatccactgggtcctgaagagtctatatggattgagacgaatacaagagcgtgggctatctaccatcagagccatgatacaaaagagttccatcaccctgatatttaaacatgctatcccatagtagtacactcttgtgtctccactcgtggaacgctagggtcgcgcgcgcgaatacgtaat

SEQ ID NO: 581203 - DNA, 1053 bp, Homo sapiens
gattgtagacatgaaatgcgaacacttacttacgatattaatgttaagctcaatcttagggacctggaatggttgcattagtgcttataatcgttggatcgccacatttcccaaaaataataataaaaatgcagtaagcgcttttttaaggatagaatatttaaagttttgacaagaattcgaatgattgcaagttatcaatgtaaagtgagatttggaatgcttattagaagactttccacaattcaaacatgaaaatacataagaacatggaggaaaaggagaaaaaaatgaaatacaaaaaaaaactaacacactaacaagaataacaaacaacatataaacacttagcgcatcataatatatacacaccacataataacacacctaaaactctctatcttcacactgccttacgcacggaacagccctaacgagccaaacgaccaatccggccctccgaggtacgcgcattgcactgacacgaagggcgacgccacttgaacgcactctgccctttccccctcacgtctctacagaatacagagggactgttcgcaccccgacgcacttaccacgaaccagttcaaaacacctttgagagcgctgcactcgacacctccactggccaaaggcatttctcgactccgtcccacccatttaaccccagcgcttgtactaacttcgcatcaattgaaatttcctcacgcgatagagtttaacgacctctccgacagggccacacccttggcactgaacaccaacgacacaaaaacttaccaaggatttacacggccaaagggcggcctgctcttcagagacggcggggccattcggaccgccttccaaagcaccaatgggctaagttacgtccaccggccggactcaacccgcaaccaggctttcccaccggtggaacttcaccaatggctgtcacacaatttaacggctgggctccgtctctgttcggacttacgctgggccccgaacaaaccccgcgtcgcccttcatgtgtatggcgcagaacatatttaacgttatgccttgtactaa

SEQ ID NO: 581204 - DNA, 359 bp, Homo sapiens
  misc_feature (38)..(38): n is a, c, g, or t
  misc_feature (65)..(65): n is a, c, g, or t
  misc_feature (139)..(139): n is a, c, g, or t
  misc_feature (165)..(165): n is a, c, g, or t
  misc_feature (186)..(186): n is a, c, g, or t
  misc_feature (223)..(223): n is a, c, g, or t
  misc_feature (231)..(231): n is a, c, g, or t
  misc_feature (271)..(271): n is a, c, g, or t
  misc_feature (340)..(340): n is a, c, g, or t
tttttttttaattatggggtcttgccgtgttgcctagnctggtcttgaactcctgggctcaagtnatcctctcacctcagcctcccagagtgctgggatttcaggcgtgagctctaccctgctgtgcacagcgtatttnaaggctgtttgatcactgagattttnctttgtcactcactgcctgtnttgggggtaaggcctgcctgggcttccagctccctgnatgacagncttgcctgtacctctgcttccccggggccgtgtgtctgtntgcacagcagcaccagcagcaggacagggcaggaggcaggcgggatgcagtgggcagttagtaaagggnccagagcatttgggtggct

SEQ ID NO: 581205 - DNA, 1258 bp, Homo sapiens
tgttcctcatccgcctccttgctacgccgcagaccgcctccggccgcgacgcctcctaccgccgccgcggactccgtgcagctattatcgcacagagtccctgaactctcgctttctttttaatccccatgcatcggatcaccggcgtgccccaccatgtcagacgcagaccgtagacaccagctccgaacatccacccacccaaggcacttcacacagggaaggacagcacaggcaacgtatgtggcaagcaggccagcaacaatggcaagcagcactgcccactgcctaccggcgcacatggtcacactcgcaccgcacacacatgggcgcagccagcgcaggcctgcacacactgcccaggtccagcaccgcacacgcacagcacggcacacgcaaagggtaggcgcgccacgcgcacacgcaaggccaagggccacggcccacagccaccacgccacagcgcctcgccatcgcgctcgcccacgccggccacacgccaagcggcatccgcgcacgcccacacttctccgcccacaaccaaccgacaaaactcaggccacacggcgcgccaccacgccctcggcaaacgcattccctcaacgccccttcaccaccccggcacggcgatccgcccccgaaacaacgggcccacggcgcatggccacaagcgccgattaggccaacaacacgacacacactacacgggcacaattatgggaccacaccccgccggcgccacaacagttgtgggcaaaaacaccgcgggtcaacacgcgtcggcgcacgatccccccgggccaaaccagctctgaagccgccccgaacaagccgcgacccacaacagacgcgcccccagccaacgcaggcagccacacaacctcacgcgccgcggcacacaacaccagccgccacacgcggagcaaacaccaccccgcgcgaacaaacagcgccaggcgccgtcacaccacagcctttcgacgccaaacaacagcccccggactgtatccaccgggcgcgacaacacccccccctccaaccgaggcccccacccacaacaagcaatcgcagcacgccaacacacacccaacacgaccaacaaccacgactgagccagcgggcgccgccaaccacccacccgccactaacagcacagcaccccccgcggccgaaccattcgcccccacccgaccaacacaggcacaactcgaacgcataccctcactaaaccgcacacagcagcaaccatgccaccgcg

SEQ ID NO: 581206 - DNA, 622 bp, Homo sapiens
gactgcctgtaatagcactgggattctgcctcccagccaaaatgctccaggtatagtgcacgcaaagaagaaatgagctgcgatatgaggtgtacatgtgatgtctggcagtccaaattcatgttctctgcagcctgctgtttcgggtagtttgtgaataaaggtcacccgcctacttgtctatgcacactgtgggtgtgtaactcagttcctggattctcggttctaaaaatcagacttccaactgggaaacatttttggggtgaaattaactggacacctatctcggaggtttcattttacttagcaaccagtgacagtcgtacctacctacccttccctgggataactcttcagattttgactgtcagctgtactgggtagtcaactccagcgtcggcacaggcagaaggacttcagtctgctggtctcattgggtatccactgccattgatatgggtggggtgcagagtgagcactcatgtgtccatagatggagatccaggacagactgggaggactccgggaagaggctaacttggggaagaggacccaaaggcaggtacttcctcctcactgatgcctcagggttgctgtgtgggtgtgtaagctgataaggttc

SEQ ID NO: 581207 - DNA, 185 bp, Homo sapiens
cgcgaatacacacacttcttgaagtcatagcaaagtcgccgatcttcacgacgccgaggcaccaaactgcacacgccgaatcaccaaaccattatcgccgatcttcacgagatcggcgacttgctatggaccctcggcgtgtgcatgcacacgccgaagatccataccgatgtcgccgatcttca

SEQ ID NO: 581208 - DNA, 189 bp, Homo sapiens
gtggtatgattctgttccaaggttaaagtactgggcgagagaccgagtagcgaacaagtaccgcgaggtgaaagatgaagaggactttgaaacagagagttaaagatgtgctatgaaattgccgtgtgtagggaagctggatcttggccttcgtgccagggtaccggagctctgaattctgtcaatcat

SEQ ID NO: 581209 - DNA, 82 bp, Homo sapiens
aacccggcctttttttgggggcccccctgcccccaattttttcccccgtttttttgcccccctttaaaggttttttggggga

SEQ ID NO: 581210 - DNA, 560 bp, Homo sapiens
attgcttgaacccaggaagtggaggttggagtgagccaagattgtgccattgcactccagcctgggtgacacagtgagactgtctcaaacaaacagacaaacaaaagagaatatcgcaggtatttaatccattttgcgtcttctcccccatcctctctgggtctcaattaaccacatttggaaataggaatcattcatttgtacctcatagggctgcagtgaagggaagaggtgacaaggtctgtgcacacgctttatacacttgggggagttctccttccccaaggcttaaaggagggtaattccctaagcatatcactctgtgaatccaagggtttccctcctgccagctgtgactcagagggacctcagcccaactgccactgaaagaggcagcagggatagagtctatggaagctggacctcctggtgtacagggggttttggaactggtgaggccagggtttgaatcatggctctaacaccgactagctgggtgagcagaaaattcaatttctgggcctaccaaattgaagaccagatcccagaccttgggaccc

SEQ ID NO: 581211 - DNA, 829 bp, Homo sapiens
ttatgcacagtcgtaagtcttcgtgaaacctatggtgaaatgtgtgctctgttgtgctctaaagacgctgaaagacatgaatgctgtcttgcaaagcatggatgacaaaccaaagctcccccgctgggtgagaacagaggttgatgtgatgtgcacggcttgtgcgtgactatggctgagacctttatgataacaaaactactgtactatgaagatggctccagtaagatgacatccattagcctttgatgccccggaatctcgctttacttatgctgataagaggtaataatctgctgtttactggaatgttgccaagtctgactgactcatatggctggcctgcctgttgtccaacaggtcgatagatacttcgggatgactgagtggagatggctttcgtctgaccagatcggagactcaagtgtgccaatctccaatgaatgtcggctgagcgagctttcaaatgaatgggcagtagttcgcctgaggcagagatttcccaaagctgagttggcgcgaagtttccaagttacgtgacagatcttatccaaagtccacacggaatgctgccattggcgatctgcttgcatgtgctgatgacccgggcggaccttgcccagtggttctgtggaaatcgaggattgatctcccagtagctggatgggatgctgtggaagccctctggttgcaaaatcccatggaggccggagttgggcggaggttatttctcgcgggggctcctgggcggggttggcgaacgaaaggggtgccacatgggggggccgcgtcccggaggtgggctttgaacggtctgtacacttgcgtg

SEQ ID NO: 581212 - DNA, 289 bp, Homo sapiens
caaccgcagttcggtctcgacttcgacagcgatctgaccaccaccccgcaacccaacgcctggcagcgccgctggtcggaattcttcgccgagcagcgcatcggctggcagctgcagctggcggcggagaaaggcatgaccttcggcgatatcgacgacatcgtcgatcgggtgtatctgcgcttgcagcaccaccagccgcagccttccctgctgcacggcaacctgtggccgggcaactgcgcgatgaccgccaacgggccgattctgttcgacccggccagctact

SEQ ID NO: 581213 - DNA, 440 bp, Homo sapiens
atgtaaggtactatagaggatcttgtgcggagctgggagtagagttgagagtgagtctgagaatctcattgtgtatgtgggggtgtccctgctaaaagcctggaggccggggcaggtgggctgcccgtgctgacggaggagagggaggccatttcccatctcctggcagccaagagcccacacagacccagaactttggagacaagagtcctgggaaccctggcaatgagaatgcattggagttccaaggccgtggccatggtttggggcagagcagacaggagcagtgggtgggaggaaggaagggagtcccctcccacagagccatgttccccacaatgttcatccacaccccgatgtcaactgccaagccctgggcagcatccaggtctccggataaaccctgggagatgcctaggaccatggcaccgagtgcccag

SEQ ID NO: 581214 - DNA, 983 bp, Homo sapiens
cgaaccctccggtgtaccgacccaggctaagcttgaggcatggctgagcaggagcccacagagcgagcaggtggcccagattgcagcggagaacgaggagtgatgatgcactcgtgtcaactacgaagtcctcccgggcccataagagacatccatggagatccaggagctggacaaggacgatgatgagcctgctgaatagtacaacggagggccctgctggtggccgcgctggcaaggtttccagcaagaccgccaagcgttcctccatacgtcggatgagtgacatgtgaccttgatcctcttgaggtgatgcagagcatctggcctccgaggacccccacgtgtgagcctgagatcgctgagcgcggcagactcctggcagcagcatgtccaacgaaggcacgtcgtctatgctgcctgagagggcaggcggtcgtgggagtacacgtgagtaagagagagtcgtcgttctcccggggtttaacccgatgcagcattagctgtccgggccatgatagtcacatctcgtgaccattacagtgagcgagggtagacaggccgttcaagaatttgtagcaagactagacttacagtggtatggacagcttagtggtgcctcgcggggccgcaggcagtcacgaagtttcccttgtagcgcccccggtggtgaagtgacgggtcgaacccaatgggggtcattgtctgggggcccacggggggctacgctgaacaagacaatccaagattgcccgatttacacgagcaacgcacggaacaaagatgcggagacagcgtggttccctgggggaagattggggagatcttcaaccgaatgcaaacggaaagggaggtgggaaaggggacattggagtcccccaagccctgagaaggcccgggacgcagggcctagaacatgggaacgggaacgggaaccgagctgcacccggcggactctgtttttcccggggaacacacggcca

SEQ ID NO: 581215 - DNA, 771 bp, Homo sapiens
gagtctacatgaaaaggatggtgtcttggagcttccactaaacttaataaccatgaaacagtctattattgctactatgtgtgtcttctagttagatgtcccaaggtgtcaatcgacaactgaggagggtgttctatcgaggtgacgccgatggttcacttcgagccccgtatggacaagaacgcacgagaagaggctgtctggctacaaacaggaaagggcaatcgagaagatagtgtggatgagttaaataacaatgtggaagctgtattcccaggacctcctcttgcttccttatcagtcactgtgtattggctgtagaaggaccatgtggcataagaggagtgcgagaagcaagtgagaaagattagatgaataaggtgtaaagtaccaattgagtactgcactgcaagaatctggaaaagtcgaagcctattatatatagatgagactgtgaatagcaatataactcaatagacctatcggggtgcttgggttgcatgtgcctgggagaagggtgagaagtcacagattaaagatgtgagtaatctgatgtcatctagatcaagatggatgtattgtacttatgcaccatggacttggcgagaatgcaagtattacctgtgaggggtcgtaggtctaaggaatgtgaggaaataatctaggaaatggaggtgaaatcatcgtagagaatgtatcttctattcaatcctgactagttcgtagtttagaccgtaatataagtagtactgtgacatgatataccaattt

SEQ ID NO: 581216 - DNA, 177 bp, Homo sapiens
  misc_feature (28)..(28): n is a, c, g, or t
agacgttgtcgcttcggatgccaagacncttcgttgttggcaaagttcgccagtacaatcgccccagcagttgggtttgttcgttggaatagttgccgacaaccgtaccgtcatcattgatttgataactcaccagatcgcccggtttgtagccgttctgggtggttgccacaatat

SEQ ID NO: 581217 - DNA, 708 bp, Homo sapiens
gccctggtctccggacttcacttcccaggaggcctcgcgcgcgacgtggcaagtgctgcgagcctataagtaaggcgaggcggaacccgccgctcgtgctctggggcggcattgcgcagccggcctgtagagcattcagggacagatgtcttctgcatctcaactaggaaccttctgggagcgcggagctccgtgcgccttgagtagccgagacggcgaggttcccggagatcctcggccgtcactatcgatcccactgtggtatagggggtgaagtcgcctgcaaaatgttaagctgattgtgctcataggtgcccaatttcgcaggaaattggaagcccagagccatggttcctctgaagcctagtcaattaagggcatagaaggaggttgcgtggatctagaatgggtcgtcgtggaccgggttcataccttcgtcacatcgccttgctcgctggggtccctgaggcgtctaatgatgcatccttcttctagtatctacatggatggcagtacttggggtcgagtggcttttatgccgtgggaaatgtgccagcaattcaacgatgcttcaatcgtaggcaaccgctagttgcttatggttgctggcatggtgcgacattctattaggtaggtgacgtaagaagcgtgtaccggtctgatcccactcgtgggtggggccctagagttgcccctgacactcactcc

SEQ ID NO: 581218 - DNA, 164 bp, Homo sapiens
ctcctgggcatacgagctaaggatcatcagcaatggcccgctgggcattggggaagcgctggggactgtagttcggggtcttcctgcagctcgtttttgtgtatcataccggcagctgctgcctgtagcgtctcctagaaccctctggtgcctccaggttcccg

SEQ ID NO: 581219 - DNA, 425 bp, Homo sapiens
gataagcggcagggtcggctcgctttcgcgcaggtcgtcgcgggcgttcttgcccatgtcctcgacggtgcccgcgtagtcgagccagtcgtccatgatctggaatgcggtgccgatccggcgcccgtattcggcggcggcagcctcggtcggcgcatcggcgcccgcgagtaccgcgcccaggcgggccgacgcctcgaacagcttggctgtcttgtagcggatcacctgcatgtagcgcgtttcgtcgacgtccgcatcgtgcatgttgaggagctgcagcacctcgccttcggaaatgatcgtcgtcgcttcggacaggatctccatcacgcgcatcttgccgacgccgaccatcatctcgaacgagcgcgagtagaggtaatcgcctaccagcacgctcgccgcgttgccgaacagcgcat

SEQ ID NO: 581220 - DNA, 185 bp, Homo sapiens
tatcttgctgatcagaccagcaggtgcagcttgctcggcctgttgctggtgacctggctggtactcggcacctggtactggtggaccaccaacctgcattggctcgatgccttgcgtcatgtggcgctgaacgtgacgtctgtggtgactaccaccggctttgcactggggcaaagaatcgtgcc

SEQ ID NO: 581221 - DNA, 841 bp, Homo sapiens
  misc_feature (23)..(23): n is a, c, g, or t
  misc_feature (107)..(107): n is a, c, g, or t
  misc_feature (124)..(124): n is a, c, g, or t
  misc_feature (356)..(356): n is a, c, g, or t
  misc_feature (365)..(365): n is a, c, g, or t
  misc_feature (368)..(369): n is a, c, g, or t
  misc_feature (371)..(371): n is a, c, g, or t
  misc_feature (408)..(408): n is a, c, g, or t
  misc_feature (420)..(420): n is a, c, g, or t
  misc_feature (444)..(444): n is a, c, g, or t
  misc_feature (480)..(480): n is a, c, g, or t
  misc_feature (482)..(482): n is a, c, g, or t
  misc_feature (558)..(558): n is a, c, g, or t
  misc_feature (611)..(611): n is a, c, g, or t
  misc_feature (614)..(614): n is a, c, g, or t
  misc_feature (616)..(616): n is a, c, g, or t
  misc_feature (627)..(627): n is a, c, g, or t
  misc_feature (656)..(656): n is a, c, g, or t
  misc_feature (658)..(658): n is a, c, g, or t
  misc_feature (662)..(662): n is a, c, g, or t
  misc_feature (670)..(670): n is a, c, g, or t
  misc_feature (672)..(672): n is a, c, g, or t
  misc_feature (674)..(674): n is a, c, g, or t
  misc_feature (678)..(678): n is a, c, g, or t
  misc_feature (697)..(697): n is a, c, g, or t
  misc_feature (709)..(709): n is a, c, g, or t
  misc_feature (711)..(711): n is a, c, g, or t
  misc_feature (717)..(717): n is a, c, g, or t
  misc_feature (722)..(722): n is a, c, g, or t
  misc_feature (728)..(728): n is a, c, g, or t
  misc_feature (732)..(733): n is a, c, g, or t
  misc_feature (752)..(752): n is a, c, g, or t
gagtcagaacaccctgtgtcagnactgcgcccccgggaccttctctcccaatgggaccctggagaaatgtcagcaccagaccaagtgcagcttgctggtgacaaagnccggcgctggaccagcngctcccactgggtatggtggtctctctcagggagcctcgtcatcgtcattgtttgctccacagttggcctaatcatatgtgtgaaaagaagaaagccaaggggtgatgtagtcaaggtgatcgtctccgtccagcggaaaagacaggaggcagaaggtgaggccacagtcattgagccctgcaggcccctccggacgtcaccacggtggccgtggaggagacaaaacccttntttattttnatnngncttaaccactaacctacatactctgcacccctacgcnagagatacctgnagcaacggctgctgaaagaggctntccacctggcgaaaccaccggagcccggaggctttngnggcttccgccctgggctggcttccgtctcctccagtggagggagaggtggggcccctgctggggtagagctggggncgccacgtgccattcccatgggccagtgagggcctggggcctctgttctgctntgncntgagctccccngagtcctgaggaggagcgccagttgcccntngctnacagaccncncncccngccctcctgggccagcccngagggcccttcngncccctnctgtntgcgcntctnnctcttgtggcctcagcagnacaggcccgggctctgcctctcttcctaggctggactgggttgaatcagtgtggtgtttagtggaaaccacatcgaaagtgattttata

SEQ ID NO: 581222 - DNA, 436 bp, Homo sapiens
  misc_feature (275)..(278): n is a, c, g, or t
tgcgggttctccatggtgaccttggagtggtcattacctccgggcagcgacctcgcccactttcggggaccccttccctgtgctcctggtggagtcctggggtgaggctgtgggggcagcttggaacagccgcagtggaccaaccggtgcccagtcatacccgcttctgatcacgaaggcggtggccctcgtgtgcgctcttggtcaaagcctggagggaattggaataccaagtttgctctactgctggaggaatttaaagaacttttgttgannnnagcgtttgtgatttaacataaaaggtgtcatttaatgttatcccccatcccccagaccgtataaaaaccatgtaacaatattatggggagtttgaggaaaggaaatcatttctaccagaatgccacgtagagtactactattaaaaattttgtaatgt

SEQ ID NO: 581223 - DNA, 465 bp, Homo sapiens
  misc_feature (304)..(307): n is a, c, g, or t
gcgctcgggggtcttggcctccgggcggtggcgtggaggcgccaagatcagggtcccgggttttgtcggccaccacgccgcaatgtgaggattcgcctcggcggagcccctgggagcttcggggtagctgctcgggatggggcgaggggcgcggcgcggcgcagagagtgagacctggacttaagagtcggggagtcctgggccacaccgagccctgtctgcgggttctccatggtgaccttggagggaattggaataccaagtttgctctactgctggaggaatttaaagaacttttgttgannnnagcgtttgtgatttaacataaaaggtgtcatttaatgttatcccccatcccccagaccgtataaaaaccatgtaacaatattatggggagtttgaggaaaggaaatcatttctaccagaatgccacgtagagtactactattaaaaattttgtaatgt

SEQ ID NO: 581224 - DNA, 341 bp, Homo sapiens
agcggaacagcaaatatgcagaacagcaaatatgtgcctggttcttcctctggaagcttcgtctcagaggggcacctggcatatggggtgtcagtctgcccctactgggaggtgcctcccagttaggctacttggcagtcagggacccacttgaggaggcagtctgtctgttctcagatcttaaactgcatgctgggagaaccaccactctcttcaaagctgtcagacagggacatttaagtctgcagctggctctttctttctttctttctttctttctttctttctttctttctttctttctttctttctttctttttctttcctggctggttccgctg

SEQ ID NO: 581225 - DNA, 364 bp, Homo sapiens
  misc_feature (87)..(87): n is a, c, g, or t
  misc_feature (129)..(129): n is a, c, g, or t
  misc_feature (142)..(142): n is a, c, g, or t
attgagtgtcgtgtgagcggtgcggttctcaggagtatgtcgcaacaactggtgtatgacacctcggacaggatgactatcactccntaaggactagaggaaggatccaaacgctgatggggaggctgnaagacggagccgncggactgtgcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctgg

SEQ ID NO: 581226 - DNA, 1017 bp, Homo sapiens
ggagaccctgagagacggagcgcgaacagaagaacagcctgcgcaaggcagctgtcacactacatgagcatcaatgactccttctacaccagccacctgcgatgtctcgctggatgtgcctctaagttcagtgacgatgctgccgagcccaacaactgatgccgaggccctggtcaatggctttgagcactggcggcctggccaagctgccacgtgtgacatactaatgacctccatcgccgcaagaatggagggcctcgcaccgccctcccccagccatcgtctccgacctactcagtgagctcagacatctctgcagatccagaaagctgcaagcaagcagctgcatgcgagatggagcgggaacacaggcgggccatgctggcaactgctgcaggactacacgagaatgcagctaggaggcacactgcggtggcttcccttgtccagaatcatgccagtggacgacaggtcgaccctgcctcacagacgaatctagagtgccctgtcggagcactgcaaggccaagcaacggacgcgggcatgacatggcccctggaccaaacgcaggaagggaccggtgaccatgccaacttgacgcgatgggggactaactacgaaggttgggacatttctacgtggcctgagcatctttgagcccttgcaagttaccatggtggctggtgggctgaagcgctggccgcagcctccgaccggaacccaaccctccaagggtcactatgctgcctgtactaacgcaaaggaaggggcatcggcgtgacgggcccccaagccaacggccggaagggcacgaaagggagcccgcctacatggacacaggtaagacaggggcccatagggcacactccaaccgcgaaccaaaacgggataatccccagtggcatctacaacacaacggaccacgacccggccagtaggaaccccgcagaagacctcgagatggagcccaaggatttagcacaacacgcaacgctatcaagcccccagcgcacaccg

SEQ ID NO: 581227 - DNA, 777 bp, Homo sapiens
  misc_feature (14)..(14): n is a, c, g, or t
  misc_feature (84)..(84): n is a, c, g, or t
  misc_feature (153)..(153): n is a, c, g, or t
  misc_feature (157)..(157): n is a, c, g, or t
  misc_feature (159)..(159): n is a, c, g, or t
  misc_feature (173)..(173): n is a, c, g, or t
  misc_feature (200)..(200): n is a, c, g, or t
  misc_feature (204)..(204): n is a, c, g, or t
  misc_feature (213)..(213): n is a, c, g, or t
  misc_feature (217)..(217): n is a, c, g, or t
  misc_feature (219)..(220): n is a, c, g, or t
  misc_feature (278)..(278): n is a, c, g, or t
  misc_feature (280)..(280): n is a, c, g, or t
  misc_feature (341)..(341): n is a, c, g, or t
  misc_feature (343)..(343): n is a, c, g, or t
  misc_feature (349)..(350): n is a, c, g, or t
  misc_feature (383)..(383): n is a, c, g, or t
  misc_feature (388)..(388): n is a, c, g, or t
  misc_feature (396)..(398): n is a, c, g, or t
  misc_feature (401)..(401): n is a, c, g, or t
  misc_feature (403)..(404): n is a, c, g, or t
  misc_feature (410)..(413): n is a, c, g, or t
  misc_feature (422)..(422): n is a, c, g, or t
  misc_feature (425)..(426): n is a, c, g, or t
  misc_feature (430)..(432): n is a, c, g, or t
  misc_feature (437)..(437): n is a, c, g, or t
  misc_feature (441)..(441): n is a, c, g, or t
  misc_feature (444)..(444): n is a, c, g, or t
  misc_feature (454)..(454): n is a, c, g, or t
  misc_feature (468)..(468): n is a, c, g, or t
  misc_feature (473)..(473): n is a, c, g, or t
  misc_feature (476)..(476): n is a, c, g, or t
  misc_feature (479)..(479): n is a, c, g, or t
  misc_feature (483)..(483): n is a, c, g, or t
  misc_feature (485)..(485): n is a, c, g, or t
  misc_feature (542)..(542): n is a, c, g, or t
  misc_feature (669)..(669): n is a, c, g, or t
  misc_feature (676)..(676): n is a, c, g, or t
  misc_feature (678)..(678): n is a, c, g, or t
  misc_feature (684)..(684): n is a, c, g, or t
  misc_feature (687)..(688): n is a, c, g, or t
  misc_feature (696)..(696): n is a, c, g, or t
  misc_feature (705)..(707): n is a, c, g, or t
  misc_feature (711)..(712): n is a, c, g, or t
  misc_feature (718)..(718): n is a, c, g, or t
  misc_feature (723)..(723): n is a, c, g, or t
  misc_feature (727)..(727): n is a, c, g, or t
  misc_feature (732)..(732): n is a, c, g, or t
  misc_feature (735)..(735): n is a, c, g, or t
  misc_feature (737)..(737): n is a, c, g, or t
  misc_feature (743)..(743): n is a, c, g, or t
  misc_feature (748)..(748): n is a, c, g, or t
  misc_feature (750)..(750): n is a, c, g, or t
  misc_feature (753)..(754): n is a, c, g, or t
  misc_feature (757)..(757): n is a, c, g, or t
  misc_feature (760)..(761): n is a, c, g, or t
  misc_feature (764)..(764): n is a, c, g, or t
  misc_feature (775)..(775): n is a, c, g, or t
ccacaaggagcttntcatgcccctgtgccgcatagcctcacctctttcctccagagtggctctctgcggccctgtgtgcctgcnacagagtgttcttttctggagtcaggatgttttcggtcaccctctctggttctgcgcctgtcccagacnagcncnaccccagggggaanaggagcggcaccggggaagggcgccanggcncgccgggcncacncnnacgggcgggcgccagggacggaagcaggccccacccggggaagggcacagcggcggcngnccgtccaacgccttttggttttggggggagaggggaaggaacagggggccaggccagcagngngggggnnacaaggagagggaaaaagggccggtgggttaanacaanaaaaaagnnnacngnnaaaagnnnnggggtgggnggnngggnnnggggnaggnagnggccgggggnaaacggaagggggnggggnggnggngggngncggggagccgggggggcagggcagggggaagccacatagacatccctttcttccctngcacgctcgctagcagctggtaaggtcttcacaccctgattcctcaagttttctgcttagtggcactgacattaagtagtggggggacagtccatgccaggacaccctggagtagccttcccccttngccgtgncngccctnacnncctgtccntttggagtnnngggnncttttnttttncttnctttngtncntgtatnttaancnttnntanaannaantgtttttcccnga

SEQ ID NO: 581228 - DNA, 138 bp, Homo sapiens
  misc_feature (20)..(20): n is a, c, g, or t
  misc_feature (47)..(47): n is a, c, g, or t
ccaaacccaggcctaaaaanccaacaattgaaaattgggttctcctnctaagccttagtatttcaaagctcaaaacagttacaaaaataagcaaacaaataagacaaaaaaaccttgccagcagatctgctgaatact

SEQ ID NO: 581229 - DNA, 419 bp, Homo sapiens
  misc_feature (184)..(184): n is a, c, g, or t
  misc_feature (311)..(311): n is a, c, g, or t
  misc_feature (318)..(318): n is a, c, g, or t
  misc_feature (320)..(320): n is a, c, g, or t
  misc_feature (326)..(326): n is a, c, g, or t
  misc_feature (329)..(330): n is a, c, g, or t
  misc_feature (338)..(338): n is a, c, g, or t
  misc_feature (347)..(349): n is a, c, g, or t
  misc_feature (353)..(354): n is a, c, g, or t
  misc_feature (360)..(360): n is a, c, g, or t
  misc_feature (365)..(365): n is a, c, g, or t
  misc_feature (369)..(369): n is a, c, g, or t
  misc_feature (374)..(374): n is a, c, g, or t
  misc_feature (377)..(377): n is a, c, g, or t
  misc_feature (379)..(379): n is a, c, g, or t
  misc_feature (385)..(385): n is a, c, g, or t
  misc_feature (390)..(390): n is a, c, g, or t
  misc_feature (392)..(392): n is a, c, g, or t
  misc_feature (395)..(396): n is a, c, g, or t
  misc_feature (399)..(399): n is a, c, g, or t
  misc_feature (402)..(403): n is a, c, g, or t
  misc_feature (406)..(406): n is a, c, g, or t
  misc_feature (417)..(417): n is a, c, g, or t
atggataatgtgcctgttttttaacacaacaaaaaagccttcctccaaaatcccctttttgttcttcctggacctgggcattcagcctcctgctcttaactgaattgggagcctctgccacctgccccgtgtatcctggctctcagctcatggggaagccacatagacatccctttcttccctngcacgctcgctagcagctggtaaggtcttcacaccctgattcctcaagttttctgcttagtggcactgacattaagtagtggggggacagtccatgccaggacaccctggagtagccttcccccttngccgtgncngccctnacnncctgtccntttggagtnnngggnncttttnttttncttnctttngtncntgtatnttaancnttnntanaannaantgtttttcccnga

SEQ ID NO: 581230 - DNA, 283 bp, Homo sapiens
ttcatctctctcatttatactgtaataaccaactttcttgcttcgaggaagtacttgagtggtcaaaatatcgtttctcaggttcgtgggtacactgtgtgtctgcatgactggctgttaatactgatgccccacatttctcagatcgcctttgttgcgatgactgctcatttattcacaagtcacaacatctttagctggtattccagccaatcctaacttgtactagcgtagcttctactgcaatctcatctaaaggcaatacctcaatgtcatagatact

SEQ ID NO: 581231 - DNA, 135 bp, Homo sapiens
  misc_feature (27)..(28): n is a, c, g, or t
  misc_feature (92)..(92): n is a, c, g, or t
catgataaatgcagagggaacaccagnngacgtttttcttcaactctgcacagctattgactctattattttctgaaggcaaaagggcgtgngtgttagaatggaaacagaaaaacattaaaaagttcattcctt

SEQ ID NO: 581232 - DNA, 146 bp, Homo sapiens
tgcagaactgtgaggcaattagacaattaaacctcttcttttttttgtgtgttgttgttgtttttcggtggtggtggttggttttgagacaggctctcactctgtcacccaggcttcagtgcctgaccaggcttcagtgcctgacc

SEQ ID NO: 581233 - DNA, 136 bp, Homo sapiens
ccgtacttttcgtccattgctgattccttgaggttccccggtgcgcggaaaagcgtagtcctcactaaataatacaaaattagccgggcattgtggcatgtgcctgtaatcccagctactcaggaggctgaggcac

SEQ ID NO: 581234 - DNA, 337 bp, Homo sapiens
agggttgcaatcctagtctctgataaaacagactttgaactaacaaagatcaaaagagacaaagaaggccattacttaatggtaaagggatcaattcaacaagaagagctaacactcctatatatatatgcacccaatacaggagcacccagattcataaagcaagttcttagagacctacaaagagacttagactcccacacaataataatgggagactttaacacccactgtcaacattagacagatcaatgagacagaaagtcaacaggatatccttgttgaacaatatccttgatgacatggaggcctgtcatggatcgggggaaggggaggg

SEQ ID NO: 581235 - DNA, 191 bp, Homo sapiens
ggagaagcgggcacaggcaaatgcccgccagactttgaaggagcatgtgcaggactttgccatgcagttgagcagcagcatggcctgaggggctgctggactgaccgagggggtgcccagcaagactgcagccttttcctccctcagatccccccagaccccccaggggccataataaagcggattttaga

SEQ ID NO: 581236 - DNA, 602 bp, Homo sapiens
gcacgagttctccttcacgatttccatcaaagagtgaacggttaaaaaggtatgtcagaaagggcattccagcggaatggagaggaaatgcatggtggcatttcgctagagggcaagagaagttaaacaagaataaaggcgtctattcacaacttttacgaaagatgaagcagatcaagaaacaaaaccctaatgaaaaacaagttcaagacttggatattattgaacgtgacttgaatagaacatttccggacaatatacatttccaaagtagcttgcataacaaagagggacctccgattataaaatctttacgccgggtgcttgttgcgttctctctctacaatccgaagattggctattgtcaatctatgaactttcttgcaggcttgctattgttatttttagacgaggaaagggccttttggatgctagtgattattacttcaagatacctaccgggggtgcataatatcaatctagaaggtgttaacattgaccaaggggtactgatgctatgtgtcaaagaatatattccagaagtttggtcgtacattaagccttccattgaccaccaccaaaaaaataacaaaactttttct

SEQ ID NO: 581237 - DNA, 172 bp, Homo sapiens
atggcatgtagtgaggacaagagagctgtaagacgcctccgtactgcttcgtgaactgtgctaagcgtaccctctcttccagcacccaggccatgtattgagatcgtttctctctatgaaggcattgagttctatacctccattacccgtgcccgatttgaagaactgaatg

SEQ ID NO: 581238 - DNA, 868 bp, Homo sapiens
tagagcatattggctgtcaggctgtttcgaggcgcgcctaatgcggcgggatcccatccccgggacggcggcgggccggagagacaaatcggggcccggggcatgtcccgtgccccgttaggaggcgtgcggcggctatggagatcgcgccgctggaggctccgcccgtgcgggcgcggacggggacgttgaagaggccccagctgatgccgggtctcccaggccccggtcgccccccgccgatgggcgcctcaaggctgcagccaagcgctgtcacattcccgtccgacgaggatatcgtgtctggagcagtgtacgcccaaaagacccctggagaccttgcccagaatgtgaccgtggacgagggtcatcgggcggcctacaatgcaggcctgccaagaaggctgaactgcaggcagatccccaagctcctcaggcagctgcagggaatcacagacctcgggcaccgctcgattgtctggacctgaaaggtgagaagcttgactacaagacctgtagaggccctggaagaggtcttcaagaggctgcagtccaaggtcgtggacctggagcagacaaccctggatgaagatggttgcctcggccctcttcgacattgatcgaggtactacgagttcgcgccacccactcttcaacatcttcttcaacaaagcacaatcgggcacccgggggcttggcagggcgggccgccccacattattgccgcaagaagaagctgccctgcaagtaatcttgggacgccccggaaaaaggccccctttttgggaccacttcgtgggccctttctgtggcccgtggccctgggcaatccggaacaatcgttggagtgctgcccttggagaaaggc

SEQ ID NO: 581239 - DNA, 1139 bp, Homo sapiens
  misc_feature (1139)..(1139): n is a, c, g, or t
ggtagtttccagtgaaagttttccggtttgcaggccgcgcacatctgtggcagtgtgccatcctcggtcccctatgctcgtttgctcgcagccccgtatcggctaacaagtgagtttcagtggcgtcatggccagggtgccaccgctggccagccgggtgtgaggctgcctttctgctgcccgcgcgctccagtggtctctggtgtccgccggcgtccgtattcggcctgaacgcagcccctccgcggcgacgagcagtctcgctgccggagctcatggcctcggagtgcgccgtccccgccgcggtcgccgaccgcgcccagctccgcccgagcctgagctggaccagctaaggcggaaggtggagacagttggacacgtgaactgcggaggctgcaaggcggcaggtgcgggagatcgagaagcatgcttgcatcagacagaactgggtgtaccagaactgcaggaaagcaagaacgcaggagctaccgcaacagcaaggtgtgaaagaactcaggtaagagatagtccaagcgtgggagaaatgaagataataagaagagtctgatgtaggaggtaggaagagaggaaacagtggttccatttgtaacaagtcgtacagatgcatagtgttatcagaagggtactagcaaatgacagtaaggtactgacgagataaaaggtgaagtgaggctgggtgaggatcaagagaagatcacagcgtagtacgagagtatcctataagtggaaaaacgagacaggaaccattgacacaaggtagaacaaactgcactgcgataaaccccagggggagccggagaaagcaacacagaagacaaagtgggcaggaaaactaagaccgaaaggggacagcgcaaaaggaccatacaccggtacagcgaggggaagcacacgaggagagcaaggcaagaaaacgacaaacaaaagaggacgaaaaccaacccgtaccacagaccgggatcgaaggcaacacaagaggaaggagagagaaagcgggagggagaggagagaaaagcggagacgaagagcaacagaaaaggacgacggacgaacggagggcagagagacaacgaagaggaggaaagggcgcaaaggaacgggaagaagacgcaagagcn

SEQ ID NO: 581240 - DNA, 332 bp, Homo sapiens
  misc_feature (303)..(303): n is a, c, g, or t
  misc_feature (306)..(306): n is a, c, g, or t
ataagtagagagtttatttgggccaagcatgagggttacaacccaactgtatggagacaagttgtcctgaacaatacacattcttattagcaacagttataagtaggttttcaaagaaaaagaagaggcagttcctaagttatttaccacgaatttacattgaaacagcataagctatcaattggctataaattgctctctgtatcaaattccagggaaaatgaagataatgtgcaaggcagcttagtcgggaacaaaatgactttaaacaattgcccccagctatggtttgtggaggggcanttngcacaaggaagcaaggcttaaaggac

SEQ ID NO: 581241 - DNA, 547 bp, Homo sapiens
catctcagaggatgtaagacctggaaatgtaagaactgactagtgataaacataaacatacatagtaagaaaaaatcctaagtataatgggaattggctatggtgccctctcactactgcccctcccgtgtgctatgtagctctgcaggtatggataaacagtcacgggcttacagtgatagaaacacaggtatacgggccaaacagcagaagcaggccaagctcacagaaggtaaagtggggtaagtgtcagagaggcctttcttattataataaggaggaaacgtgggagaaatgctggaaacatatctagtgaaataaacatgattgagcaatagcaaaaaccactgaggacctcaggacacctctcctagagcgatattcctggtcccacacagcttccaagagtttaactggatattgcaatttagcaaatactcactttgcctctgccttgtaatgtaccctgtaaccgataatagggaggcctgaaagcaagcgaagacaagcggctgggcaatgatcacacaggcaaagagggcaggac

SEQ ID NO: 581242 - DNA, 244 bp, Homo sapiens
gaggagttacttgaggcgtgagagaggtgggaaatcaggtccaaggtgatggatagaaaacgcctcccgaactcgcatccagctttcctaacttaacatagcctctgccgataaagccgttattcgcaaaactcaaatcattcactgaaatgcaagtacagtccactttggttcttcttttcccaacacaatcccaaagagcgttctccctctacccctttactcacctacccacaagcacctg

SEQ ID NO: 581243 - DNA, 101 bp, Homo sapiens
atgcatatccgctctaactaagctctgtgtatacatacagagggaagagtgagtcgagctagtagtggtctagagctggcacgtcttcggtgccatgcctg

SEQ ID NO: 581244 - DNA, 177 bp, Homo sapiens
  misc_feature (68)..(68): n is a, c, g, or t
ggcggactcgcggaggcaaggccgaggataaggagtggatgcccgtcaccaagttaggccgcttagtncgggacattaagatcaagtccctggggggggatctatctttttttccctgacctattaaggaattagagatcattgatttttttccggggggcccttttaatgatgagg

SEQ ID NO: 581245 - DNA, 727 bp, Homo sapiens
agcggcgtgcgcgctgagacgcgagggctaatgggtagcgggagcgctaggggaagcctggccggcgtcgggcccccgggggcatccgcgagctatcggcggttggaccggcggctctcggtggggttccggacgcggatctggcgccgaattctcacgagacctgataccttccttatttgtatattctcttacttaaaaagccagatgtcttttttttttttttccatggaaaagagaaattggacagggtaaacggccgttgggaggggccaccgggggacgcggcccgagcccgggttctaccgtgaagaatatcttctattggccacatttcctctcccggtttcctttcttcgcccctctcctctttccctttcccctcgagggtacatgagaactacgggaccgattacgctaacctctgggcccttggtcaaaaatgggagccgaaagggtggatttagacagacccccgtgctcagggcagcaccggtaatctcggtattatattaccaggggccttcggtaatttttgacaattgggatgccaccggggacaacacggcttagacagcacgggaagacctttataattatcctaggtggcttttctccaatcagcctagcctggattggaaattcatttaatattttggagacgggggaactccattttacaagatagtttaacctcagcgatctcggatgttggcgcctaatacct

SEQ ID NO: 581246 - DNA, 696 bp, Homo sapiens
  misc_feature (23)..(23): n is a, c, g, or t
  misc_feature (67)..(67): n is a, c, g, or t
  misc_feature (90)..(90): n is a, c, g, or t
ctttcaggtcttccgaggctganattcacgtttcattctgccacactcgggaacggtgatcggggangcatggggatccgggagaagcanccacaaaactagcatcctcctggaggagctcggtttcttgttgttggaaacgaagctcaactcatataaggagtctggaattcccctgccggagttacaacctccgaacttccgtcgtcgtaattgaggctcatatggagagctgtactaaaaagggctggatcaggtgcaacaccgaccgatcaaggaacgagtggattcggtggcgatcactgatgcctcgttcacaggatacttcgtcctgtgttgtacgctggagtttcacgaccgtctgaaaaacattgtgccgacccctgacctggaagagcagccagtacctccatgcatggctgtggcgaagacggactggggattgccgctctatcgaacatgttgtggattaggaagcacgtccaagtaggagaagtcttcgtgacttctctctagtgcctttgtgccctggtgttgcccactgaattgcctgtgaacatctaagtgtagtggtagcattaaggggaatacgcttacgaaggcctcaaaggttatcacgcgagcactttgtagtcaactgctattaagagtaaaagtagtatcacgttgggcctaatcctcaatgatagatcctca

SEQ ID NO: 581247 - DNA, 364 bp, Homo sapiens
ggtcgaccggagtttcgccgcctgtatccggatatgcagttggagctcaacagcaacgacctgatcatcgacctgctggagcaaagtaccgatatcgccattcgtatcggcaacctggcggattcgaccctgcacgcgcgttccctgggcagcagccgctgaatatcctcgccagccccgcgtatctggaaaagcatgggctgcaagccagcgtcagaggtttgtccgggcatacattgctcgggtttacccagaccgaaagcctgaaccactggcctttgcggcatgcccagggtgatcgctggcagatccagccgggcatctgcgcgtccagggcgagacattgcgccagttggccctggaa

SEQ ID NO: 581248 - DNA, 437 bp, Homo sapiens
tagaggatcccgacaggcatccctaaccagcacggccactccccggctcacttccaccctgggtctccatctatgaactaccacactcggtagcttatattgtgggtggcttcccccacggaataacggctcggggggacaggggttggggtatggctggcatatggtagacacccaataaatacctcgcgggtgagacaattaaggatactcctaaatggggggtctgagccaccagaaaatcaccaaacctggtggaacagggcatttcacaggactagtgttccacagaacacacttcagttgatcccctaaaactggaagacccgggccacatccacagcagacacagatgagaactcgggaacccccagcccctccactcaccagccaggtgacatttccggggtgatcacaacggctctgagaccgggtta

SEQ ID NO: 581249 - DNA, 509 bp, Homo sapiens
  misc_feature (17)..(17): n is a, c, g, or t
  misc_feature (33)..(33): n is a, c, g, or t
  misc_feature (42)..(42): n is a, c, g, or t
  misc_feature (62)..(62): n is a, c, g, or t
  misc_feature (118)..(118): n is a, c, g, or t
  misc_feature (280)..(280): n is a, c, g, or t
aaaaaccctaaagcccngggaactttaagttanccggagccntggacaggaattgggtcccngcagcctgagtccaggggggcatgcagctgcaaccttcccacctattttttttttntcctgtaattaccttagggaagacccaaatgggcacccagagataagactccccttagatcccccaccttagatcacccaccctttcctcagggggtaataaagtcatcttccttggaatgtagcaatctataaccaatcaaagcactgtaacatacgcacnggtcttgtatggaaaatgttgtaatcctgctaaaattcctctctctttgcctgtggaagtgaaaccttaacttctccagtttggaatgctcaccccatgcctttggagtcaatgcttactgggtggctattctcaaactttgcactcaaagaaactctatacttagtcttattttctgaatctcattatttaaggttgacataataaacaactaatagtaacatataaa

SEQ ID NO: 581250 - DNA, 120 bp, Homo sapiens
gttatatgctgttcagggagaagaagaaagaagaaaggaagaggaggagtgggaggaggaggagaggagaaggaggagaaagagaaagagaaggaaaaagagaaagagaaggagaagaag

SEQ ID NO: 581251 - DNA, 137 bp, Homo sapiens
tgggtggcggggaggggggctgcaggaccccaagtggggtgtcccgtgagccagagggccaattggcgtgtccccccagcagcatgggcatctgtgtgctgaaccctctgagccctctgccccactgcccgcctggg

SEQ ID NO: 581252 - DNA, 116 bp, Homo sapiens
cgtggtgtgtcatgcactacaattggtaacaatcggaacagtcttctaatgggtctacaggttcagagatgaagcccaaggcacttcggggttgggcacataaaataataaaaggg

SEQ ID NO: 581253 - DNA, 465 bp, Homo sapiens
  misc_feature (465)..(465): n is a, c, g, or t
ttctgtttccgatctacattatggcaaatttttaaatgtcagctcaaaaacatgctaacaaaatgtgtcttgtcggaataactgtacaagttttctccagcttattgtcactgaaaaggtctaactgatcacgagaatgtctatcggtgatctgtacgtgagccagtgactgccttctcttttatgggggatgcagaaagtgcaagagttgcactatccatcgcttccctgggttctttaaaaaacacccgttgccctattgcctgctcctctgaacagcttacccccatgggactgtactgagggcctgctcaagatgcatttttacaacacgggtgatattcaaaggcgggtactgcttgcagtcaaattcgttgaccacttaagattggtcccctaaattgattgttaccatgtggaagcgtctgcatgctagtcatgtcccatgatagctacctctttatn

SEQ ID NO: 581254 - DNA, 316 bp, Homo sapiens
tgcttccagacaccaagggccattgtgaatcccatcctggaagggaaaggtagcatcgccatctacaggagcagaagaatggacattgctaaatgacctagcactattctctggccgcgattttatcatatcgccttgtgtcatccgtccagaatagtttctcctcgtcaccttttctgcatgggacgttaagctgctatatcaccctgcagaggcgtcatcaaagtgccagtagcagttcttcttgctgagcctcctgaatttttttgtgttttctcgaaatgtaacctacaaagacatgcctggggtaagtacc

SEQ ID NO: 581255 - DNA, 309 bp, Homo sapiens
  misc_feature (17)..(17): n is a, c, g, or t
  misc_feature (133)..(133): n is a, c, g, or t
  misc_feature (160)..(160): n is a, c, g, or t
  misc_feature (162)..(162): n is a, c, g, or t
  misc_feature (170)..(170): n is a, c, g, or t
  misc_feature (180)..(180): n is a, c, g, or t
  misc_feature (185)..(185): n is a, c, g, or t
  misc_feature (191)..(191): n is a, c, g, or t
  misc_feature (263)..(263): n is a, c, g, or t
  misc_feature (267)..(267): n is a, c, g, or t
cagtcacatttgtggantggtggccagtggtataccatccctggaaggattttgggacaatatttcagggatttcatggactttttggctccttttttccatttcctttgggggaagggggaattgaccatgnttaagtgcatcctatcaaggggcagcncngtccccanggccattggntcatnaaacantttgaagtcaaaagggtggggcagatcacttcaagcaagcccccatgatggttttcagtcctgtttttttgngggnaggggcccctttgtttaaaaataaactgaatatggatgttta

SEQ ID NO: 581256 - DNA, 447 bp, Homo sapiens
tcgttgcctgggactccgtccctgaatatgaaggttcttagcatttgccatctgtagttacgctcacatgacagattatcttatcaatgtgtctgtttctccttccctttcatgctttcaggactacatcccctctactactacttctccctacaatgggacttcaccttctaaacctgtccaaacactcctactatgacctcttacactacgttctgactcaaactatgaggctacgtcactacatatccttttcctcttcgcataggtgacgggtgggagctcccgcacgaatagacaaacacttgctgtacacaagcagatgatgtcatatataggacgaaaacaaggtaagctaggccctggttccctccatgaaagcttgttcctggtagcaaaaggcaaccaccactttcaaaacatcattcacttcctctatggggttcc

SEQ ID NO: 581257 - DNA, 962 bp, Homo sapiens
  misc_feature (962)..(962): n is a, c, g, or t
gaaagtgaaaagtggccgggtgcagtggctcatacctgtaatcccagcactttgggaggccgagacgggcggattacctgagatcaggagtttaagatcagcctggccaacatggtgaaacaccgtctctactaaaaatacaaaaattagccaggtgtggtggcacacgcctgtaatcccagctactcgggaggctgaggcaggagaactgcttgagcccgggaggcagaggttgcagggagctgagatcgtgccactgtactccagcctggccgacagcacaagactttgtctcaacaaaaaaaaaagaaagaaaagaaacgtgaaaagtggccgggcaccggtggctcgttcctgtagtcttagcactttgggaggccaaggtgggcggatcacctgaagtcaggggttcgggaccagccgtggccaacatggtgataccccatctctactaaaaatacaaaaattagccaggcgtggtggcacccgcctgtggtcccagtacttgggagactgaagcataagaatcacttgagcccgggaggcggaggttgcagtgagccaaatgtgccatgcattcaggcctggttgaccaaaggaagactctgtctcacaaaaattttcattactagttactaaaattacaaagttcgccgggattgggggacacgcctgtagtcccagtactcaggaggcgagaggaaatcggtgaactaggagcaaggttggagtgagcaagatacgcctgcactcaacggagaagaagaacacgttcaaaaagaaagcagtgaagactggcaaagggaattcggccactatgagggctgcacaaaattacaatcaaaaaaacacggggggacacgatcacacttaaggggaacacaggcgcaaccaaaggaacttaaaagggcgagaaacaagggacaagaggcaccgacaaaggcacgtatcggcggcagcgn

SEQ ID NO: 581258 - DNA, 284 bp, Homo sapiens
tattacccaacacaggggggtttttttatccccttttggtccaaaaagtgggtcccagggtcactccttttaatatgctggaattttttgccaattttttggcaatccctttaaattaatcctgctttttttttttttttggtggtttcctcctttccttttttgccccaggttttaggtaattgtaccccgtggttccctaggccacacccaggaacaggggggatttacggcccatctttttaaccggaaaaaccttccccgggggcaccattttttccctg

SEQ ID NO: 581259 - DNA, 295 bp, Homo sapiens
gcctttgcgagcagatcgcctgaggtcaggagttcaggaccagtctggccaacatggtgaaaccccaatctctactaaaaatacaaaagtagccgggcatggtggtgcatgcctgtaatcccagctacttgggaggctgaggcaggataattgtacaaacatacagcctacaacaattctctaatggtgagggatgaaataagtgaccgataatgctggaggaagaggaagtgaatgtggccccagtataggttagaatgaaaaaatccctaccaatgttaatcaaatataaaat

SEQ ID NO: 581260 - DNA, 823 bp, Homo sapiens
  misc_feature (797)..(797): n is a, c, g, or t
ggccccccctcggttaggggtgccgcttcatactgaccccccttgtttctacaaagcgttgtttatagtccgcccccttggcgtgcaccagccaccacacggggtgatattccctcccaccggggggttgcacagcaggggaggattaacgatcaccaaagatttggcggacaccgcgcaatatacctccgatgcgcgtttccttcggcgacaccaccagtggaacccccacacctcgcggcacccgcggtagatataaagacacagtaattctgtgctatacacgcacacctcgagcagtcgcacgctccacccaattgggggggacacacaccactgtcagagagacctctctctcaccccccctgtcattacagcacagtgtggtgacactcaactgaaaggggctgtctttcacagagagtgacatatttctggcgcacgccctcttgccccacactttcggcccttagatacacacgttgtaagcctcctaggccaccctctgtcacaacacacaccctcggaggtgtcgagcgccaccccctcgctcaccccgcgcagaagtggcgcgaccagagtattaacactttgtgttatttgagcagcgagtgtctcctcagtaagtagtggaatatgtatcctctccgcgattataggggtcaacatgagtcgccacgtgccactcagacgtagaccaaacccgacacagctttgctcgctcggtgagacgggtgtatctccctcatagctcccctcgctggtggggttggaagaccttagaatacaaacatgtnttcgcacggtaccaaacaaaacacaa

SEQ ID NO: 581261 - DNA, 698 bp, Homo sapiens
  misc_feature (120)..(120): n is a, c, g, or t
tccccactccctcagccctggggtccccctatcctaagactcggaaaggcccaccctgaggttctattgccttcctggtggtatcagcttccagctgtttcaacccttcccagcccgttngtggcgatgggcccatgccccctctccaggctctctagaggcaggcaggtccttggaatccccagcctgcaagcagaggctggccagctccccagctcagcacacagagacacctggcacctgctgctcatgaagaagtgcacaaggcacaaatgtgtacacttcccatgggaccacagacccagctcagtctgttgaagaccaagcacaaaggccttgaagagtggacattcccaggtccctggcaccttcccttgagccagctccattgctacttattcatgtgactgaagctgaccacaggcagctggcaggtccttttttcaaccagcaggctaggctggccatagacccagctctgcctcaccctgccatgttccagtaatggagcctccagcctgggctctattacattcttctctacagctgccccataacccgtggcttatccctggcactggggccacaccccacgccccctggataggcaacactgtcctgctccagcctgtgctgaaatgaactgtactcctaatttttttttaaaaaaaagtattaaatatctctttctatataaa

SEQ ID NO: 581262 - DNA, 255 bp, Homo sapiens
tctatgggatagctgattcctgaggaaaaaacaacgacaagcgagaccttcagtagtggccaggggtaatcaccggggccaaaactcatcccactataaggcagaagaggaacgagaggaggtgcctcacaggaaaagaggagaagaggaccatgctcgatcctctctgggaataggcctgagattacctctcgtactgggtgatacacatctgctcaaccacgcgctccatcatcttaacgtcggtctcggtga

SEQ ID NO: 581263 - DNA, 718 bp, Homo sapiens
atgaggccccagaaagcacacgtctcgggggcctgcccgcatggggtttcgcgaggccccgttgtggtacgagaaatgaggcccagttgtctgcgcacaaataagcatggctctcctaggacacggtgataccattattggaagtctaagacatgcgagactggtggcccgccaatagcatcccgtgatctgtgttaacgcatagggagggctctgcatagcacccgcgtatagcggtgtcatgtttggagtcgccctttgtgactgattcatctggccctgaccgtggccgtcatcttgactaccttggttgatttgtttggtattggggacattttaaaggctgaggtatttttgaatgtcatcgttatgtcatagacgtagttttcgcaaccctgagattaactgccctaactccctttgtggtgataagcccaactacctggactctggtcctgggatccctttcctgtgtgggtgccccgtgtcctctggcctagggttaagtgtgccagataactactcgtgcaggtattcagaatgttgttcctaattaaagcaccttgttgtctgtcttctttaatccaatcacatcttatataccgccgtcagagatgagtatactagaatcatgcgattgtctggaggtcttttaatttgatgttttcagaagggggtggatttaaatcctgaaataatatttccaccccacgaaata

SEQ ID NO: 581264 - DNA, 171 bp, Homo sapiens
cgctcacaacatgcacagtaaaaaaaaaaaaaaaaaaaaaaaaaaaaaaaaaaaaaaaggggggtttttggggggggggggttctttaagagtggacgggggggtttgaaggttgggaaggggggggggtttaaaaaggtgggggggggtggtgaggatagaaaggaaata

SEQ ID NO: 581265 - DNA, 499 bp, Homo sapiens
  misc_feature (10)..(10): n is a, c, g, or t
  misc_feature (78)..(78): n is a, c, g, or t
  misc_feature (101)..(101): n is a, c, g, or t
  misc_feature (131)..(131): n is a, c, g, or t
  misc_feature (166)..(166): n is a, c, g, or t
  misc_feature (192)..(192): n is a, c, g, or t
  misc_feature (237)..(237): n is a, c, g, or t
  misc_feature (252)..(253): n is a, c, g, or t
  misc_feature (272)..(272): n is a, c, g, or t
  misc_feature (284)..(284): n is a, c, g, or t
  misc_feature (368)..(368): n is a, c, g, or t
  misc_feature (371)..(371): n is a, c, g, or t
  misc_feature (409)..(409): n is a, c, g, or t
  misc_feature (432)..(432): n is a, c, g, or t
  misc_feature (486)..(486): n is a, c, g, or t
cggcttcatnagtctcattttaaaaacagtccgactcaaaccatgtggaaataagtatgcaaaaagtctgcaaaacanaacacacttcaaacatgtctaantcgacacactacctcacaccctggcttctncagtcactccattgtcatcccatggcagccaagtnatccttaactccagtgggagtgagcntcccaaatccagcctcattgcagagtccaactcctatgtcatccnctgtaattggccctnnaaagctttcctttagggtnaagagggctgtntgaatggcatctccaagtcccagacctccattatatctttcctcaaggaaagttttcccattaacatagttctttcccattccngtngctttccaggcaaagtaagccccaaagggatcttactnaaataaatatggccgtccctcantccaaccacaaataagtaaagaaactccaaatggacgaacaccacccgactaantatattcttgcat

SEQ ID NO: 581266 - DNA, 118 bp, Homo sapiens
cctgttttaaattgttttccccaaaactagtcggtgtatatgttgcaatcgagatcgctcgggagaatatgttactgcgataaggagctagggttaggatgacgtgggaagaacaaag

SEQ ID NO: 581267 - DNA, 210 bp, Homo sapiens
  misc_feature (24)..(25): n is a, c, g, or t
  misc_feature (40)..(40): n is a, c, g, or t
  misc_feature (69)..(69): n is a, c, g, or t
  misc_feature (73)..(73): n is a, c, g, or t
  misc_feature (92)..(92): n is a, c, g, or t
  misc_feature (106)..(106): n is a, c, g, or t
  misc_feature (122)..(122): n is a, c, g, or t
  misc_feature (129)..(129): n is a, c, g, or t
  misc_feature (177)..(177): n is a, c, g, or t
  misc_feature (194)..(194): n is a, c, g, or t
  misc_feature (200)..(200): n is a, c, g, or t
ctggcggagtggcgcggcggcagnngcggcggcaggcgcngcgggaggctgaggctgacaagcccgaanggcnggggcggctcaagtaccangcacctgacatcgncgtgcagctgagctcngagctgncagactcgctcaggaccctgaagcccgagggaacatccttcgagaccngttcaagagcttccagnggaggnatatgatccg

SEQ ID NO: 581268 - DNA, 313 bp, Homo sapiens
  misc_feature (152)..(152): n is a, c, g, or t
  misc_feature (226)..(226): n is a, c, g, or t
tcgcagtggaggatcatgaggttcagaagcaggtggtattaagccttgaggatggagatatgcagatatgatgagtaatatcactggtgaggaacatagaaaacaggacagagcaggaaatccagagcatgttggagaaatagtaatcattntgcaagcaaaggttatgtgcagtgaagtcatgggaacaaagggtggggcgcattcaggccaggctaaagagtcntggctttagctcctgtacacagaaaatggtagctgttactcagatgtcatcgagcagaggtgaatgtggccctcctgtgtggggaga

SEQ ID NO: 581269 - DNA, 843 bp, Homo sapiens
ggccgacgaaagctatcttgcctggcgaccggacgtgaccaggagtgagaggcggtgggagggaactgggtgtctgcttgccatgctgtgcacatggtctgtgtacgccacgaggtggaccgcgtggccacctggagagagactgttgccctcaggatcgaccccggaacgtaactgcccttacccctccatgggtccggctcaggttgcagtcgcaccgtgctcgcttctagtgctgtcctgtgactccatcctgacgaaacagtgaagcagtctccatatggatcgtgatactgacatgcacgatgggacagtacgatagtatgacgaatgccttgagtgtgcactttggactccgttctgatggaaacgagtatggacgatacgttcgttagcccctacctctaggattggaccactgcattggagaccatggtgcgagacgcgagagaaggaggtgccgatgctccgtcccagtacctcggttccttagcgaccgtacctgacgagatgttcacaaaagtcatgggttcagccaatatccatgtgttgaacatgacactcaacgaagaagagtacctggtgggtgccctcgctcgcttagtcgtatgaggaacatctcctacctagatcggtcaccatggtgacttcgacggctgaaggcataatggagacccagatttgaacgtgggtgttgagcccggggacccttgcagtgagggaagactgctgccagagaatgctctgacgtgaatttggctggaaaccccacagcgggccaggttgggtgcgaccaagccacagaagcccccccaggggaaggggaacaaacggaggggggaa

SEQ ID NO: 581270 - DNA, 111 bp, Homo sapiens
tgagggagttgcaactgagcccacacacgcctggcatattagccttctctgagcaagcgcagacagccagaaacccggggcagcctttcactttgctacccagcctctggc

SEQ ID NO: 581271 - DNA, 459 bp, Homo sapiens
ccatgcaaaaaataaaaataaaaaataaggtctataaggataaacactagagaactgacaagttatctctgggtgttgtaatttttatttctttcttttagctttacctatatttctgattttctatgataatttgaaatgcaacttgaaaagaaaaggttaactttaattttaaaatgtaaaaaaaaaactatactatgaacatagagaaataacaatgagtaaaatctggaaggaggcctgaaagatgtggacaaattccaaaaagtaaggtcctaagctttaaagaactccccaacttttcagcaaacatgtctctgcagaggaagcactgtgtggcggataaatacaaacgctatttgaatctggattcgaggcctatgctaaggcacttaagaaccataaagctacttgccaacacctttccaaatcagatccaaaagccagagccaggaatcc

SEQ ID NO: 581272 - DNA, 885 bp, Homo sapiens
gtgaggatgtcagcgcctgtgtggccgcgggactcaaggctggcctggctcaagtgagacagcacgtccaggaggcgacctcgtccgcgggtttgcattctggggtggacgagctgggtccccggcctccgacgactaacttgggtgtggagtgtttgcccctgccaggggtgttctggtcctgagcccgtgtgggaggctcccggagctgcagcctgggcccatgcccagcccctgctgcctggctggccatggcatgtgcacccctgtggacgcttggcacaatgtggcttgcactggttggagtgagcttgctccgctgggtgcatacgaaggccttctgcatggctgtgcaagctagctccacgatctaccaacaatccctggaaggacaactccaattccctgcaggtgaaaactgtgccaccttggtcaggtgtacttggatctccgccttcccagcggagttttgacttgaacccggagttggctgagcacgatcaaggagctgaaggctctgctagaccaagaagggaaccgacggcacagcagcctaactcgacatagacagcgtccctacctacaagtggaagcggcaggtgactcagcggaaccctgtggggacagaaaaagcgcaagatgtccctgtagttagaccacctggagcccatggagcctggctggagcatctcacctacttggagtatacgctccttctgcaagatcctgtttcagggactatcacgagttacggggactcatgggtgcactgtggacaacgccggtcctggagcggttcatcctccctcttcaacagcggtctcaacaggggttgcagctcatgatcctccacagaaccaggacccgcagatgggcctggtcatc

SEQ ID NO: 581273 - DNA, 1346 bp, Homo sapiens
  misc_feature (519)..(519): n is a, c, g, or t
gagaacactccttcatggcgccttgtgatccttgtacacaagatgggcgcccggtatgtgttccgcgcgcacctatctaccgtagactgctcttcgcgcctgcggcccgcgtggattccggcgtgaggcggttgcgggctacgagtcagcgcgtgcgactcagtcctgcgacatccatcccctcgacctcggggcccgtgggcgcgcccgctcgctgctcgtggtctgcccgtgatgcgcttatccgtgtttcctaagccggacagtacttgttccttgtcggccggcagcggacatacagctactctgctccagtcgtcgctgtacttgggcggcccaaggtaagaagcgctcacgactccgaagaagtctagcgaacaccggtcgcctctccctagctgcgcggaaatcactcggccttcgcacggcgtacctgactacggctagatggccttggactcgtgagtggagcaacaccatggcagaaccgctgtggaagagaccttggcctcgggaganatccacggcgaacttcattgcgcagccgcgttgaattcgtccgccattgtcgccattgcagcaccaaagtaggaagacctcggtcgcttgattcgcataccgcttgctcaggggatcccggttcgcaagggtccatcctctctccagtcgaatcgaccaagcatggtagggtgaggtgcgtttgctcgcggtttaggacccgggtctggccgggcaccctgtgccccatcacgggacgaccatcccgttgcgtttcaagcccccaggcctgcgcttgcccttcttggaggtgcatggggttgcccagagcagggacacgctagctagcggccccctggggctccccgagaagggttcgcctcccccggatttcccgctaacgctcgtcgggccattggttggcgtctgcttggcaggttccgcgggaatccttgaccgtttctggggaatgaaagcccccctgggggagggatatgggcccgggggcggcaaggcagggccgtcgcggctggtttccctatgggctttgcggcacgagatgaccgccagggtttcccatgtgtgagcgtacacgcggaagggcccttgaaagacccggtggtccccggggccgagacaccggacgtagaaatgcccgcccgggtgacattgtatccccccagaaactcgggtcgtcccacagagggggccttggggacttacggaatttctttcgcagtgagtttctcccttataattcaaggatggcgcgagttttacatcacacgattacatgtcgattctcaagaaatcatataaaacgtggggtgtatacacacattcaagtc

SEQ ID NO: 581274 - DNA, 1166 bp, Homo sapiens
  misc_feature (92)..(92): n is a, c, g, or t
  misc_feature (94)..(95): n is a, c, g, or t
  misc_feature (104)..(104): n is a, c, g, or t
  misc_feature (125)..(125): n is a, c, g, or t
  misc_feature (127)..(127): n is a, c, g, or t
  misc_feature (129)..(129): n is a, c, g, or t
  misc_feature (146)..(147): n is a, c, g, or t
  misc_feature (155)..(155): n is a, c, g, or t
  misc_feature (168)..(168): n is a, c, g, or t
  misc_feature (171)..(171): n is a, c, g, or t
  misc_feature (197)..(197): n is a, c, g, or t
  misc_feature (212)..(212): n is a, c, g, or t
  misc_feature (248)..(248): n is a, c, g, or t
  misc_feature (262)..(262): n is a, c, g, or t
  misc_feature (328)..(328): n is a, c, g, or t
  misc_feature (334)..(334): n is a, c, g, or t
  misc_feature (356)..(356): n is a, c, g, or t
  misc_feature (359)..(359): n is a, c, g, or t
  misc_feature (608)..(608): n is a, c, g, or t
  misc_feature (678)..(678): n is a, c, g, or t
  misc_feature (731)..(731): n is a, c, g, or t
  misc_feature (774)..(775): n is a, c, g, or t
taggctggtacgagctggctttgaatcggcagagggcaaggtgcagatggtgttggaaagcactatggtgtgtgtggacaacagtgagtatntnnggaatggangacttcttacccaccaggctngnangcccagcaggatgctgnncaagatantttgtcattcaanganccgcagcaaccctgagaacaacgtgngccttatcacactgnctaatgactgtgaagtgctgaccacactcaccccanacactggccgtctnctgtaccaagctacatactgtccaacccaagggcaagatcaccttctgcatgggcatccgcgtggnccatcntggtctctgaagcaccgacaanggncaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcanttctccgattttggctggtgaaggtggtgccatgctgggtcttggtgccagtgactttgaatttggagtngatcccagtgctgatcctgagctggccttggccttcgtgtatctatggaagancagcggcagcggcaggaggaggaggcccggcgggcagctgcannttctgctgctgaggccggattgtacgagtggtactgaggactcagatcaatgccctgtctgaagatgaccatcagccagcaagagtttggccgcactgggcttcctgaactaagccgtatgactgaggaagagcaaattgtatgcatgcaaatgtcctgcatggagcagagttggcaaggcggatcagcagaaatgtgcaggtcaagtatgacacattgagccagcagagagtgttacaattgggacccgagtcttaaggctaaaactccgtgtccaagtacttaatgttgccggccagccaggaagaaaaggacaaatacagggagttttgctacgaagatttcgcaggtaaaaactcttgaagttcttatttctaacaccgggtttcta

SEQ ID NO: 581275 - DNA, 1280 bp, Homo sapiens
gttttttttttttccaggttgaaattcttaattctggaggtaggaagggggtcagcatgctcaggtgtgggaagggtccagcccagcttcctccagccccccaggtgcatgtgcccagaccccaattaagtttacccagattactcagctgtgcccttcccttccgtgggatccatcgtgtccttcgtgttcacacccttagacagggccaacctggactcaacacaagggctgctgagtccccagcctgtgggcagtgccacaacggcaggctaaggggaggggtgaagcagcaggaccatagccctgggccgaggaggggcagaggggccacttcgggctccaagggtcaggactgggaaaaccacatcctgggcaggcctggggcccagacccacaaggtctgtgcctgaaaagaggtggaagaaaggaggatggggagacagccaaatcacaacctcaaaaagagagaggtcaagagacccacgagccccatgacacgaatgacagcaagaaccataccgagcatacaataataggagcataaacatgaaccgacgaaatgcacaaacacagaaacaccagagcatgacgatacgggcacgacacgagagagctaccaaggcccctaggggaaacacaaaaaggatggacacagaacaacactgcataacaaaggaggaaaacaccgggggaaagaaggagacacatcaaaaaggagagaaataggaacaaatcataacgagagaagggggcacgggacccaaagggcgcaaaaacaacacaagaacccacaggcggaaaagaggcacagagatgaaagcacccaaagctgtgtagtcgaaaaccccaagaacacagggaccggaccagtatccaaagaggagcacacaaacaatagacgaggcggacaaacaacaccaacaagggcgcacgaggtgaaaaaaccaacaaggagtcaagaggcaaaactaccgcaacaaggacccgcgaaggacgacagcggagcacaagcacaggacaacaaacaagaacaccgacaaaccccaggagatagagaaaaacaaagacaaaaaggaaccaatgcacgagaaagaacggcttatcgcaaaacacaagcgaaaaacaacaagccgaccacaaaaagtagaggacaaaacccaggaaagaaaaaaagcacagaacaaacgggagacaacccagaagagcacaccgcgcggagaacgcacaaaggacaaaaagcaaactgagaagaaacacaagaacagccaccagaaaaa

SEQ ID NO: 581276 - DNA, 1581 bp, Homo sapiens
  misc_feature (9)..(9): n is a, c, g, or t
ggggggacnaacacaatggcatggatgaggccgtgggttttatctggcacgaagggagagagagagagagagagagagagagagagagagagagagagagagagagagagagagagagagagagagagatgagagatatatatatatatatatgagtatgatatgatcatctcatgagcatgagatgagatgtcatctgttttgtgcatcgtgttcgtatcgtgagtgtgcctctcatctgcatcgcggcggcgggacgcgagagtactcgtctctctcatgagcatgatgctctgctgctgcagtagagatatgtgtctatcatgtctcatgtagtgatgctagtgtctcatcgtactcattttgtcctgctcttcttgtcttgttctcttctctcttttatgatcataatatcatcaatatcagcatcagctcatcatcttctacataagcgcatgaatatcatcagatgatagatagaaagtaggaagaggcgacaggatggtaggtagaatggaggacatagcgagtagttgaacgcacgttcgaggaagaaggagagttaagaagcctgggtggagggagaaggaaggggttaggggaggggaggatgaggagatgagtaagatagatagaggatttatatgaaggatgatagagagtgagtcaggagtgcgtcgttgcgtcgatgagagaggatggcgggcgggagggaagggggcggaaggatgggcgtgtgggtggcggttagggcagggaggaaagaggggcggcagcagctcgcgcggcgagccccgtcttcttatgttcgcgtcgcgagagtagtgtcgtcttacttattagtaagtgcgtcgtcgctcatcgttcgtttttagttcgtcgtagagcgtcgtcgatcgaagccggtagacggtgggtgtagattggccgttggtgagtgcggatctcagtcatatgaggcagaagaagaacgcggccgctgacgggcagccggtataagtaccacaacggccattatctgcatcttcctacatcgtcgatcaaacatctatctaatttttttttttatcattcttcttctatctatgaacaaacgtcatcagatacatcaacatgatactaccagtaccaacacgtatttcttactacaatcactcatatttaactatcatcactcaactcatcataaaccgctagcgctctcctcctctgtctcaacacaactctccaacactaccacacatatacttctaatgatacaagtaacacatagatcacatactcttaattcttagactaccacgttctaaaatgtaaatatctcacagtactaagccttaatataaactcaacctacaatagtaaagtaaatcccctctaatcatcgcctacatcaagagaagctatatcctactcacctttcaatacccccccaccagctcctacgaccacaacttcactataagcagcaccacactttctcctccctaccatcatcactacgatacaattccgtttacatcaactaaatcctcacagacatatagaaaataccaataaacacctactattcaaacaaag

SEQ ID NO: 581277 - DNA, 647 bp, Homo sapiens
atccctgacgcaccgccgtgatgcccaggaagacaggcgacctggaagtccaactacttccttaagatcatccaactatttggatgattatccgaaatgtttcatttgtggggagcagacaaattgtggggctccaaggcagaatgcagcagatccgcatgtccctttcgcggggaaaggctgtgggtggctgatggggcaaagaacacccatgcgccagggccatccgaggccactggaaaacaaccccaagctcttgggagaaactggttggctcatattccggggggaattgttgggctttggttggttcccccagggagggaacttccacttggaagattccagggggaccattgtttgcttggcccattaagtgttggccgcttggttggcccgtggcttggttgccattgcccccattgtgaagtcccttgtgccagcccaagaacactggtctcgggcccgagaagacctcctttttccaaggctttaggtatcaccactaaaattctccagggtgcaccatttgaaatcctgagttgatgtgcagctgatcaagactggtgaccaagtgggagccagcgaagccacgctgctgaacattgctcacatctcccccttctcctttgggctggtcatccagc

SEQ ID NO: 581278 - DNA, 1012 bp, Homo sapiens
  misc_feature (94)..(94): n is a, c, g, or t
  misc_feature (108)..(108): n is a, c, g, or t
  misc_feature (174)..(174): n is a, c, g, or t
  misc_feature (180)..(180): n is a, c, g, or t
  misc_feature (202)..(202): n is a, c, g, or t
  misc_feature (205)..(205): n is a, c, g, or t
  misc_feature (454)..(454): n is a, c, g, or t
  misc_feature (524)..(524): n is a, c, g, or t
  misc_feature (577)..(577): n is a, c, g, or t
  misc_feature (620)..(621): n is a, c, g, or t
tgggttgtgcatccagtcgtacattagggacgaggtggtgttggagagccacgaattgtgtgtgactgtgaagtgctgaccacactcaccccanacactggccgtctnctgtaccaagctacatactgtccaacccaagggcaagatcaccttctgcatgggcatccgcgtggnccatcntggtctctgaagcaccgacaanggncaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcanttctccgattttggctggtgaaggtggtgccatgctgggtcttggtgccagtgactttgaatttggagtngatcccagtgctgatcctgagctggccttggccttcgtgtatctatggaagancagcggcagcggcaggaggaggaggcccggcgggcagctgcannttctgctgctgaggccggattgtacgagtggtactgaggactcagatcaatgccctgtctgaagatgaccatcagccagcaagagtttggccgcactgggcttcctgaactaagccgtatgactgaggaagagcaaattgtatgcatgcaaatgtcctgcatggagcagagttggcaaggcggatcagcagaaatgtgcaggtcaagtatgacacattgagccagcagagagtgttacaattgggacccgagtcttaaggctaaaactccgtgtccaagtacttaatgttgccggccagccaggaagaaaaggacaaatacagggagttttgctacgaagatttcgcaggtaaaaactcttgaagttcttatttctaacaccgggtttcta

SEQ ID NO: 581279 - DNA, 260 bp, Homo sapiens
  misc_feature (97)..(97): n is a, c, g, or t
  misc_feature (240)..(241): n is a, c, g, or t
ccctatcatagaagagcttatcacctttcatgatcacgccctcataatcattttccttatctgcttcctagtcctgtatgcccttttcctaacactncacgaacaataactaactaatagctaacgatcttcagacgctcaggcaaattcagaaaccgtctgaacgtatcactggcccgccatcatcctagttccatcatcgccctcgccatcgcctacgcatccgtttacagtaaccanngacgacggtcaacgattcc

SEQ ID NO: 581280 - DNA, 1966 bp, Homo sapiens
caaaatcccactctgcatcaactgaacgcaaatcagccactataattaagctaagcccttactagaccaatgggacttaaacccacaaacacttagttcacagctaagcaccctaatcaagctggcttcaactctacttctcccgccgccgggaacacaccaggcgggacgaagccccggcaggtttgaacgctgcttcttcgaactttgcaattcactatgaaaatcacctcggacgctggtaccaccagaggcctaacccctgtctttagatttacagtccaatgcttcactcagccattttacctcacccccactgatgttcgccgaccgtatgactattctctacaaaacacaaagacattggaacactatacctattattcggcgcatgagctggagtcctaggcacagatctaagcactaccttataacgagccgagcatgggccagaccaggcaacctttctaggtcacgaccacatctacaacgataatcgtacaagcccatgcatttgtaatactcttcttcatagtaatacccatcataatcggaggcttggcacctgactagtaacactaatactcggagcccacgatatggcgtacccagcataaacaaaataaggctaatgacgtataactcactatctcactaatcgtgtcacattgctactaggcagacgaacggaccaggtgtacagtcaacatcctaaaggacagtcaccctgaaccagcaacctacatctacttaaaagggagatcacaaactagggcaaaatatacacaagttaaaaccgacaaacacaacgcaacttgacagatacgacaacatcacgctagtatacacagacacgcccgcacctgttcttctcccactatatttttgcctccctcgagcacactacgagcctgacagaccgagcacactgacgagcaaatgaaaagcacaccgagacgagagaaagaagtagggacaagaacgggggacgaggacgaggacacagaacgacactcaaaccaagcgcgagaactaacgagaggcgcagaagcggcacagagacacaacgcaacaggaagcgcaagaaggtcagacacaggaagaaaaaagagggagacaagcaggcgagagacgaagagaaagaagaagaaagcagagaaaacgcagcagacaaaacaggagaaacaacacaaagacaagccaacaaagagggagaagaacacaaagagaaagagaggagcagaacgacagcgacgaaacagacagaagaagagacgagaagacgacgaaagaaaggacacacagaaagcgaagaacaagacaccagacaacagagcaagaaaaagacgaagacgaagacaaacagaagcagaagcacgcgaagaaacacacacgaaagacaagcacacgaagagagacggacagcgagagacaggcaaagcacccacacaacaggcgagaagacgagagaaaagaccagacagggaagacagcagacgaagaccgcagcatcaaaagaacagaggacagacgaggagagcaacagaggaacaacgaagaagaacagagcagcgagcaagcagaacaagagaccagagaagcagaggagagaacgaaaagagaacgaagcagagaggcagaggagacgacacaccacgaaacagagagaagccaagagaagaagatcgaaccggcgagaaaaagacgagaagaagaaaaaaacaaaaccaaagaaactgcgcgcaaaaaaacagacgaggacggagcaaccgaaagaagagagaaggcaagagaaaaaacaacacagaagaaagaagacatgacgaagaaagacaagaaggaaaaggagaaacagagaagacaaggaagagaagacaacgaggagagaaacgaagcagacgaaggaagagaaaagacggaaaaagaacacaggacaggagaagaaaagaagaaagagaaggaaaat

SEQ ID NO: 581281 - DNA, 270 bp, Homo sapiens
ctgcaggttcggcacgaggagagatagatagagagagatagagatagagagcgatagcgatatagatatcctgtcttacctctttccttctctttatctctttgttcccccccttcatgtttaccgtctcttgccttttccttctccttcttccccccttctccgtttttgttctttccttctccttttctccctgctctttctttccttttctgcttctttttttctttctccttttgtttctctctttctctctctttttttttctct

SEQ ID NO: 581282 - DNA, 993 bp, Homo sapiens
  misc_feature (32)..(32): n is a, c, g, or t
  misc_feature (148)..(148): n is a, c, g, or t
  misc_feature (309)..(309): n is a, c, g, or t
  misc_feature (318)..(318): n is a, c, g, or t
  misc_feature (340)..(340): n is a, c, g, or t
  misc_feature (343)..(343): n is a, c, g, or t
  misc_feature (348)..(348): n is a, c, g, or t
  misc_feature (428)..(428): n is a, c, g, or t
  misc_feature (430)..(430): n is a, c, g, or t
  misc_feature (437)..(437): n is a, c, g, or t
  misc_feature (454)..(454): n is a, c, g, or t
  misc_feature (479)..(480): n is a, c, g, or t
  misc_feature (491)..(492): n is a, c, g, or t
  misc_feature (500)..(500): n is a, c, g, or t
  misc_feature (507)..(508): n is a, c, g, or t
  misc_feature (515)..(515): n is a, c, g, or t
  misc_feature (519)..(519): n is a, c, g, or t
  misc_feature (523)..(523): n is a, c, g, or t
  misc_feature (525)..(525): n is a, c, g, or t
  misc_feature (529)..(529): n is a, c, g, or t
  misc_feature (532)..(532): n is a, c, g, or t
  misc_feature (536)..(536): n is a, c, g, or t
  misc_feature (555)..(555): n is a, c, g, or t
  misc_feature (572)..(572): n is a, c, g, or t
  misc_feature (574)..(574): n is a, c, g, or t
  misc_feature (631)..(631): n is a, c, g, or t
  misc_feature (644)..(644): n is a, c, g, or t
actccagcgcaatttgatgctgatgaactcgngctgccatgaagggccttggaactgatgaagatactctaattgagattttggcatcaagaactaacaaagaaatcagagacattaacagggtctacagagaggaactgaagagagntctggccaaagacataacctcagacacatctggagattttcggaacgctttgctttctcttgctaagggtgaccgatctgaggactttggtgtgaatgaaaacttggctgattcagatgccagggccttgtatgaagcaggagaaaggagaaagggaacanacgtaaacntgttcaatacctatccttaccnccngaagntatccacaacttcgcagagtgtttcagaaatacaccaagtacagtaagcataacatgatacaaagttctgtacctggagntnaaaggtnacatttaaaaatacctnacagctatcgtgaagtgcgccacanncaaaccagctnncttggcanagaagcnncatcaanccangaangntgtnggnaccncccataaggcattgatcangattatggtttcccgtncngaaattgacatgaatgatatcaaagcattctatcagaagatgtatggtatctccctntgccaagccaccntggatgaaaccaaaggagattatgagaaaatcctggtggctctttgtggaggaaactaaacattcccttgatggtctcaagctatgatcagaagactttaacttatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacatcacaagaaaaaaa

SEQ ID NO: 581283 - DNA, 512 bp, Homo sapiens
agagatggaggtttcactatgttgcccaggccaatccttctcactggactcaagcaatcctcctgcattagcctcccaaagtagtgggattacaggtgtgaaccactacacctggcctcttgctaagtcaaggctgttcttatttgaaagataagaacaccctagtgtagagagggatttagctaaagtcacgcagcctttagtgacctaactggaattttatcccaactctgtaagactccaataccgtaatcgccactgtctacttccttgtgtctgagaatgaccaggggaccggcagacagatgcttgctctgggtgtgcctgtacactgtgcttcctgcctggtgcatgcctgagcctgcagggctggtggggctggaggcctgtggggtccctggagactggtggttctttctccacaactgttactgatggtattgaaaggtgagaatgtacctgctggatgtgtgtatcagatgagggaggattttaccacagacgcactggtg

SEQ ID NO: 581284 - DNA, 235 bp, Homo sapiens
aatgcgctacacaagaaaatagtcagtaaataaattaagcaagtaagggtacatcgaaaattacaaaacactgaagacggaaattgaagacacagccaggagcagtagcccacacctgtaatcccagcattctgggaggccaaggcaggaggatcacttaagctcagcagttcaagaccaacctgggcaatacagagaaactgcgactttacaaaaataaaaaaagactccagaa

SEQ ID NO: 581285 - DNA, 553 bp, Homo sapiens
  misc_feature (179)..(179): n is a, c, g, or t
  misc_feature (196)..(196): n is a, c, g, or t
cctagctcgcctgcaccccctctctgatccgagctggatccagagttgcatactgaccaatttctgcatcagtgttatctcgaccagaggctagtaggactggagagggctctacggtatttaatggggcccagaatggtgtgtctcagctaatccaaagggagtttcagaccagtgcnatcagcagagacattgntactgctgcaaatttattggtgcaggtgctgcaacagtaggagtggctggtctggtgctggtattggaacagctttggcagccttatcattggtttatcgcctagaaacccttcgctgcatagcagcagctgttctcattatgctatcctgggatttgccttgttctgtatagctatgggtctctttcgtctgatgaggtgagatcatgattgttgtttatcacatgatcacaaacaaactgctagcacagtgatggcatatcatatagaataacaagaactaatttctctgtatcatgcagcgtgcatcccgattacctcctcagtgtcccggtcaacgagtatgtatttagctcc

SEQ ID NO: 581286 - DNA, 329 bp, Homo sapiens
caaataattttaagtatgcttatcattataagctgagtttgtcattcctatattaaattaacaaagattaggaaatggacgatggtaagaacatggaaaataaagatgggaatagggatttgtacttgatgtagctaagtttggcaaatagaataataaaacaatatttctacctctgtatcacttacagacgacaaacacaaactgcagcaaagggaaaggatatggaaatacaagtgatgtaaagccaaatattagttatgacaacaaataaatagatgtgtttaaatatccccatgaaagggaaacttcaggttggattataattt

SEQ ID NO: 581287 - DNA, 458 bp, Homo sapiens
  misc_feature (179)..(179): n is a, c, g, or t
  misc_feature (196)..(196): n is a, c, g, or t
  misc_feature (340)..(340): n is a, c, g, or t
  misc_feature (344)..(344): n is a, c, g, or t
  misc_feature (384)..(384): n is a, c, g, or t
  misc_feature (458)..(458): n is a, c, g, or t
cctagctcgcctgcaccccctctctgatccgagctggatccagagttgcatactgaccaatttctgcatcagtgttatctcgaccagaggctagtaggactggagagggctctacggtatttaatggggcccagaatggtgtgtctcagctaatccaaagggagtttcagaccagtgcnatcagcagagacattgntactgctgcaaatttattggtgcaggtgctgcaacagtaggagtggctggtctggtgctggtattggaacagctttggcagccttatcattggtatgccaggtaatcatttctatcctaaatagtaagagcatgcttgcagtanttgnaacttactactgaataatactacttgcataagtgcttacntgggcttgcataattaggcttggatgcatacttactttttatacaccatttggatgtatgagcattatgggctn

SEQ ID NO: 581288 - DNA, 207 bp, Homo sapiens
aaaactttggggggtttcccccgaaaaatttcccccccggtttaaaaaaaaaagttggggggggcgttttttaaaccctaaaaggttttcccccccccccggggaatttgggcccccccgggggggtttgggtcccgttgaatttttgggcccttttccccggggggggggggggttttttttttccccccaaacctttttttttta

SEQ ID NO: 581289 - DNA, 715 bp, Homo sapiens
  misc_feature (38)..(38): n is a, c, g, or t
  misc_feature (65)..(65): n is a, c, g, or t
  misc_feature (76)..(76): n is a, c, g, or t
  misc_feature (79)..(79): n is a, c, g, or t
  misc_feature (111)..(111): n is a, c, g, or t
  misc_feature (114)..(114): n is a, c, g, or t
  misc_feature (116)..(117): n is a, c, g, or t
  misc_feature (121)..(121): n is a, c, g, or t
  misc_feature (124)..(124): n is a, c, g, or t
  misc_feature (138)..(138): n is a, c, g, or t
  misc_feature (149)..(150): n is a, c, g, or t
  misc_feature (155)..(156): n is a, c, g, or t
  misc_feature (159)..(159): n is a, c, g, or t
  misc_feature (161)..(161): n is a, c, g, or t
  misc_feature (170)..(173): n is a, c, g, or t
  misc_feature (175)..(175): n is a, c, g, or t
  misc_feature (182)..(183): n is a, c, g, or t
  misc_feature (186)..(186): n is a, c, g, or t
  misc_feature (188)..(188): n is a, c, g, or t
  misc_feature (192)..(193): n is a, c, g, or t
  misc_feature (200)..(201): n is a, c, g, or t
  misc_feature (206)..(206): n is a, c, g, or t
  misc_feature (216)..(216): n is a, c, g, or t
  misc_feature (219)..(219): n is a, c, g, or t
  misc_feature (221)..(222): n is a, c, g, or t
  misc_feature (227)..(227): n is a, c, g, or t
  misc_feature (229)..(229): n is a, c, g, or t
  misc_feature (231)..(231): n is a, c, g, or t
  misc_feature (233)..(233): n is a, c, g, or t
  misc_feature (237)..(237): n is a, c, g, or t
  misc_feature (240)..(240): n is a, c, g, or t
  misc_feature (262)..(262): n is a, c, g, or t
  misc_feature (267)..(267): n is a, c, g, or t
  misc_feature (273)..(273): n is a, c, g, or t
  misc_feature (278)..(278): n is a, c, g, or t
  misc_feature (282)..(282): n is a, c, g, or t
  misc_feature (291)..(291): n is a, c, g, or t
  misc_feature (298)..(298): n is a, c, g, or t
  misc_feature (309)..(309): n is a, c, g, or t
  misc_feature (315)..(316): n is a, c, g, or t
  misc_feature (325)..(326): n is a, c, g, or t
  misc_feature (337)..(337): n is a, c, g, or t
  misc_feature (344)..(344): n is a, c, g, or t
  misc_feature (352)..(352): n is a, c, g, or t
  misc_feature (364)..(364): n is a, c, g, or t
  misc_feature (411)..(411): n is a, c, g, or t
  misc_feature (446)..(446): n is a, c, g, or t
  misc_feature (502)..(502): n is a, c, g, or t
  misc_feature (506)..(506): n is a, c, g, or t
  misc_feature (615)..(615): n is a, c, g, or t
  misc_feature (684)..(684): n is a, c, g, or t
atattagaaccacttttggtaatttgtaaggggctgangactgctgatatcacacatcccatggnaaactccgtanganttcttctaaacatctttgtcattttcttaaanttntnntggnggnagctgatgctggtnctcttttttannaaaannttnantttgtgttnnnntntaatagnngcntntttnntagatgnnttttntagatgaggnggntnntgggntntntnaggnctntgcattctcatatgcagaaacnaggtngggtgnggagntagntgtgtgtgntgggganggggtgagaantacagnnaaatgggtnngtgagagaggnaaaaganatctaganaaactaaatggnataattaagtttggaaactgcctatgatatagcctgttggctctggnatcaaataatacagtatgttaaatctgtaaaatgnggtaacagtgtttcctcaaagagatgttaagatgacatgtaagaagtggttagggnaggnattgcaaaaaaatgtcttatatatcattttaaaatttatttttataaaaactcacaacattattttgcgtccactgtatttatttttacaattacctttatagcaagtnatagtttttgaataaaatttaagcaaatcatcaacagtaccaaaacactagagttgttacacgaaggantgattctacaaaacattaccctaggtgatgg

SEQ ID NO: 581290 - DNA, 1563 bp, Homo sapiens
  misc_feature (479)..(479): n is a, c, g, or t
  misc_feature (1026)..(1026): n is a, c, g, or t
tcccaattggtagtcgggcccactggggtccaaattttaactacaaatttggcttggtctactttgaacacttgtgaatctctttaaaagccctcgagtgtgtttatatttctcagaaacgaggccctcgaggaaagttgtgcagaacgtggtgcgagggagggtgtgcttaaggcgcacagagttcattttcctcccaaattattacactttattgtgggacaggtctctctcacacaaacacaggagaatatattctctctctcaaggctgtgaggacatgtgtgctgtgtgagtataacacacagagacatgtgtggctataacaggacacacaccacacctctctccttatttctctcttattatgtagagtataacaacccccaagagaaacatatgagctgataggtgtttatagacagtgagatgtgcgtgtctattacaccaccgagtgtttctctctctcctcatcacanagatgtgaggagtgacgagtgggcccagagtgtcctcccgggtaaactttaattatctcgtgttgtgttctcccaacacccacatcctccagagcgcgcgagagacgtattaaaaataatcttcaaaagagaagctgtgggaagagagatgatatatactctatcatctggtgtgctggtcacccccaacaaagaagtctctggtgggccccaaatatcttcttctccccgagatcttgtgggcgctctaataatatctcccccatattatgtgcgttacgaggtgagcaaccccgaatgttggtcttcccaaccaagacggtgtgcttatatatgctgctcagaatgtggcgcaatgaggagggatctccccaaagagcgcgtgcgcgccgagaagccccactaaaaacacacacccccaaaagacgacaccactcctccatttatgagcgcggacgcgctgtgttgtccaaaacagaaaagaaggcccctctccgagagacacaaagaaaaacacaccgcctgtgtggggctgtgtgggcgagcnccgcggtgtcacaacaaacataatttttctctcctaatatgatcaccctctccgttgtgattcaccgagagaaaaaccgcctggtggggtggctgttcctctcctgatgagaaaaaggcccaaggcgcgggggggttttcttccccccccccctttcttccgtgggaaacatctcgttgggtgtgggcgcccgtggaatgacaacccaccaacacccaaggggggggagcctcttgcgccggtggagaaaaagaagcgcccatcaaaaaaccacggggggagcagcgccccccacaaggccgggggttgttttaggaaacgcgaccgagctcacccagggtagtggttctacattttccccacagaagagctcttctccccaaaacagtatttggttggctctcccgcgcaggcggcctcttccaccccagaaggggggttccccccccggacttgagggcacacgacaaatgggtcggaccatccctttgagaattttgtacaacaacaacaggagcacgacacacaacacagctg

SEQ ID NO: 581291 - DNA, 117 bp, Homo sapiens
gcatctggtcctgacatctgggacagatccacatgcccttgggaattgttttcagaggaaatggaacgaacatagacattctcacataagcccagttcatcaccatttcctccctta

SEQ ID NO: 581292 - DNA, 161 bp, Homo sapiens
  misc_feature (38)..(38): n is a, c, g, or t
aagaaaacgttcactatcagaggcaagtaacgcacganaggcgagcagaatttcatgttctgctacctcatattcttctggttgccaaacagatttatgcatgtgctgacttctgcaatccgtgtatgctgcgtccgtcgattactgcgttgacgtgaatg

SEQ ID NO: 581293 - DNA, 152 bp, Homo sapiens
  misc_feature (38)..(38): n is a, c, g, or t
aagaaaacgttcactatcagaggcaagtaacgcacganaggcgagcagaatttcatgttctgctacctcatattcttctggttgccaaacagatttagcaggcgactgcgcaaatccgtagcgcctcctcatccgcctgccgccgttgtttt

SEQ ID NO: 581294 - DNA, 191 bp, Homo sapiens
tggtcaacagtaagggtcttgagattatctcctaactggttagccaattctaaaatagccttggtcattgaagtactatctcgtccactaagccgtttaacgatggtaagccgactcttacgctcgacaaacgtagctactgcttgacctttacgttttccagataaaactgtatcagcttcgaggtgacc

SEQ ID NO: 581295 - DNA, 848 bp, Homo sapiens
ctgatttttgtatttctttgtcttagaggccgggtttcaccatgcccggccttcagtctctttttgtaggtttctcctcatttccattacctccaaacattggcatatcccaggactatgtcttttctttgtctatattcattcactgagtgattcagtcccatggctttccaaaaaaaaaaaaacctttttttggaaaccttgattctctaccttgaatcccagaactcaattgtccagttgcctacttgacatctccaggttggtgagataggcatcccaatatgctgccgatgggcatttgtgaaggtaggcctaagctaatgtgggggggtcactaatagccgaagaattgttaaatggattctgggaaaaattatgtctgggcgctgtgtgtgacccatgcctgcaggtctgggccactttgggcaggacgtgtggtgggtgggatctggttggcttagcgggccaagaatgttaccaggcctgggtccaatatgggcaacgctttggtctcaaaaacaaaaaaagagacttctgggaaattagccatggtctttggccctatttatatcccacttctcgtaaaaatttccggcctataattaattcccaggcccttaggagagggacattttggggcgcagcaatacttgaacgcacgggaaaaaacgggccctagggccacgagactcggcagacacagctggtggcgcgcacgcgtctcacctcccgtgagggccagaaaggcggcgggtgtcactcccccgggtgctggaaacggttccagagacacgcgcgggggccaaacatggcggaaccccccagtccgagccacaacacacaca

SEQ ID NO: 581296 - DNA, 178 bp, Homo sapiens
ctactactactaaatgcgcgggggctcgacgaatttggtgagtaacaactctctcagaggccaggcactgtggcgcagacctggaatcctagtactttgggaggctgaggcgggaggatcacttgggcccaggagtttgagaccagcttgggcaatatagtgagactttgtctctaca

SEQ ID NO: 581297 - DNA, 809 bp, Homo sapiens
  misc_feature (37)..(37): n is a, c, g, or t
  misc_feature (44)..(44): n is a, c, g, or t
  misc_feature (60)..(60): n is a, c, g, or t
tttacttttttgtcgcgagcgcgctattgtgttggtnacggggnattcgcgcattatggncggggtgaagatttggaataaaattgattcattttaaaaaaaaaaaaaaaaaaaaaaaaaaaaaaaaacaaaaaaaaaaaaaaaaaaaaaaaaaaaaaacttgcaagaccgcttaggcccagaacaactttagactgggccaggcttttgctggcgcccgaatttggggctcctttgtccttttccccctttggggggccgttttccatttaacgggcgggggttttccaccgtggggcctgggaaacccctggtgttccccaccttattcgctttgcgggccacccccttttcgcccgttggggaaaaaccgaaggggccgggccggttcgcctttcccaggggggtgcgaatccttgttgggggaggggaaattcgcggcggtaatttttttttaaaattccgggtaaatttttgggttactccgctctttttttacccaaagggccccacccggcaaatcccttttaaaatcaaaagattggcccggggtggggttggttgtgtggcccttttggaccaggggcccccttttaagccctggggccccaccgcaatggggcaaaacccgcctttagggggttcccctctttgggacccttcccctccccaaggtttttgggggcggggggcccccaacgcctcaatcggccccttaaagggcgccccccttttagaatgtggctgggcccgtaaggggggggggagggaggggaggccctgggggggggctcttggggcctcccacc

SEQ ID NO: 581298 - DNA, 149 bp, Homo sapiens
gacaagagtcttttaaaaatatcttttaccctggcttgagtgccatgacgtgatcacggctcactgtaaccacaacctttcgggtcaagtgatcctcccacgctcaatgcatccccaccctgacatgctgggactaccttgattggccg

SEQ ID NO: 581299 - DNA, 665 bp, Homo sapiens
  misc_feature (1)..(1): n is a, c, g, or t
  misc_feature (534)..(534): n is a, c, g, or t
ngggagagactctgccttttcaacatggatggctcctcccgctgccgctgccgctccaggagacagcattacagagcatcagttaggtgcagagactgggcagtgcacccgtgtgcaaagacgggagacacgaatcttccctgaaggagtgacagtctagggaggaaggcagactgcagattcttcatgtttacaaaaaaatgtgccaagtgctgtacaatctttgcattctttcccattttccagctgattttttgttctcaaagagctggcaaaatacagagtccttggaagtataataaaataatcagaatctagtcattattatttctcctcaccatttggaaaaaatttgtgtccattatatttccaaaaacttccaacctgtattatcttttgtaaagataaaaaattttttacttgaggtgaataattttcagcaagagtacatctttgtttcctattcaaactacttggccatgtgtttgaattctttgcatttttgctactttcttttagattcatcgattattntctgacaatggaacttggcgacctacttctctcgggaatctcaatacttggaacacggaccctcctagacggaccctttggcataacgaattggaccaactgtaggttcaggactagagagccgctgcctt

SEQ ID NO: 581300 - DNA, 107 bp, Homo sapiens
gagccgaggtgccgatcgaaggttgcctgagcaaggatacaccaaggttcctgtgccaggctacacaaaggtaccagagccgtgtccttcaacggtcactccaggcg

SEQ ID NO: 581301 - DNA, 121 bp, Homo sapiens
attgtgctggagcagaaactacaggtaaccccagcaacaatggaggatgcagcagcaatggaagcctttgacacctgaagcccaagcgggtacagaaggcaagcgacagtgttggtgagct

SEQ ID NO: 581302 - DNA, 543 bp, Homo sapiens
  misc_feature (490)..(490): n is a, c, g, or t
cgcccccccccctccgatcacaaaatattgttttagttcccaatttggggtaggaaaaaagagttggggtaacaacctttttttatacctttttgttcaaaatttgtccccgaaggagggggcgccaaaaacccctccaaggcaagttttgcccccgatgttccatcgaaaaaagaccccaagtgaggggggctgtgggggtaaaaaagatgctcttagctatctttccaattccggtttgcgcttgtcccccctcttcagccattgctaatgcggggtgccccgtaagagcctgaccccaaaaaaaaaggttagagcggcctcccgcacctgactaggcaaaaagaaggttacattttctaagcaatttttctaaaatcaagccctatcttttttataggttaaccagttctcatataaactaccaaaccgaggtctagagtaatgaagttttgacgtggcgctttaccaaatgtgtcccagagttccncggtccctgtggctcatcgcctgtattcacagtcccctggggccgcctaaacc

SEQ ID NO: 581303 - DNA, 205 bp, Homo sapiens
attgaggtggggaactagagaggactctaaggcaggaacatctggaccatctgcagggaaaagctacctccccgggagccacgagctccaaccccacacactatgtctactctggagagccggcatggcagagctggactggctgccacaggagggaagtgccccacgacagggacaaggaggacgatagacacgatggctaagg

SEQ ID NO: 581304 - DNA, 802 bp, Homo sapiens
  misc_feature (696)..(696): n is a, c, g, or t
aaaataaacctattcggtgcattgttggaggtagttttgagtcttcgtgagttctctcaaagaccatatgatgctcgtgaagagtaaaatggatgctgaggttgtgaaatatctgaacgacaataaaacatcttttgagccggactatgacaaaatgaaagactccatgcttgatcacatgcatgaatattccacgacccactccttgggaagatcctgacctcccccaccgaagacacccagaaagccttaatactaatacaacgttgctctgatgattcttttcttccttgcttttttttttaaataaaaatattattaactggacttcctaatctatacttctatcaactggaaacgaaatccctgagccgcagggcaaaactctcggatatcgggctacatctactagacaccacatgaatcctctcacctaatcgggtcatcggtgcaaggctttttataccttcaccatcctactgccgatcctgtcgggttgataagttaacaatcgttgggccaccctctatgattacaccctcgagaacaaaacaggccaatcctgcccccaaaccaaaaaaaagtcgcctcgctggccctcattcgttgagctctcccgccgcttcactttaatgagggtctaattctcgatactcacgtcgtgactccctgcactacggtacctctactcgggtnagccgccttcggctcctcctagggcggtatcgcgtatctccccaaacgcttgcttcacccttgcccgcttgctgctttcagcccgtaacggcctctaccctataac

SEQ ID NO: 581305 - DNA, 749 bp, Homo sapiens
cttccccagtttcttcatctatttaacatgtgacatagcttcaagggccctaaccatggtctaactggttttctttgaacatggtccaagttataaatgttcagtgaacaggccaaaagaaggtttccagctggtggcccctattaatatagtcctgggaaagctgactttccctcttttagaaggcctacaacacaaccaagggtacacacatacgtagtcataaacacaaccataacatacacattaacacaactatggcatggccatttggcaaggcacgaacacacacacacacgcttcacatggcacacataatttccacacacaacacaatatactcacatctactggtggtatgcacccactcacaaatctccatggacaggcacacaggtcacacaaagactttattcacattggattactttcaacgaaagctactctttttccttaaggtaaaacccagttcctttttggaggtctccattctggtatttggggtggttgaactcaagtggttagaacttatattcgctggtggatttctaatctggggggtactggtcccaaaataacccgtaggacacaatgtgctaattaggttattactcaaccacagcaggggtatatgtaagcttcccatgttgggcctatggcatggtcctgttaactccttagccagggaccttgaactggggatataggggcggcttatggccctaaagaggctaacccgtgatagtgcc

SEQ ID NO: 581306 - DNA, 244 bp, Homo sapiens
gattttgtttgagacggagcgcgctctgttgcccaggctggagtgcagtggcacgatcttggctcgctgcaagctccacgcccggctaattttttgtatttttagtagagatggggtttcactgtgtgagccaggatgatctcgatctcctgacctcatgatccgcccgccgcaaatgaatttttgacatttttacttttaagtcttgaaattatttttaagaatagataatacttagtcgacg

SEQ ID NO: 581307 - DNA, 555 bp, Homo sapiens
  misc_feature (56)..(56): n is a, c, g, or t
  misc_feature (117)..(117): n is a, c, g, or t
  misc_feature (211)..(211): n is a, c, g, or t
  misc_feature (213)..(213): n is a, c, g, or t
  misc_feature (286)..(286): n is a, c, g, or t
  misc_feature (377)..(377): n is a, c, g, or t
  misc_feature (406)..(406): n is a, c, g, or t
ttcaccattaaacctattatttcactaacatacttatacaaatttttatccactanccactcttcttaacatctcaacatctcccccttctccttttttctttcatccatcattttntctacaattcatcatctacaacccttaatttctttatatcacatattaaactcttcattctctcttcctttatttttgtcctcaattttccatntncttcttcataattttctacccaactttttcatcattaccccattctatcatcaacttttacaaactattcctntccttttctttttatacttattacaccttcccactttctaaaatttcaattccttcttttcttatccatcttccttttgttcttcttcccnctttcttcttccaccacatcttctcgctntcttcttcatccccatctaatttttaatccaattaatattcttattattcttactattatattttattttttctcttttactaatcaccaaaaatcaaccaacttatccatttttattttcaaaacaattaaataaattcttacttctt

SEQ ID NO: 581308 - DNA, 177 bp, Homo sapiens
acgacaggcgactcctcccaatttgaggccagtacatgtaccatgttcgtcaaggtggagcccaggtgcaagggtctgcattcagctcccactagtcatctcctacactggtgatgacgggttacaaggtgatgctgggaggtcagccatctcactgcgcttttgagggctttgttc

SEQ ID NO: 581309 - DNA, 376 bp, Homo sapiens
ttagcaggccaagagcccatcaccattgacacatttacttatcagaatggtgtcactatgcttggtgttgagtatgcagttgtggcacagaacccttggcccctgcatcttcccaagcttacagtttagtgggagcagatagacaataacatgctttataatactgtttggtcagtgcttggctggaaagcagtagaaatttataggatgaagtaggatttaggctgacctgaaggagaaataggaataagccaggtttgggagtagaggaagggtaagaatgttttagcatgatctggaaagccaacttcaatttcctcacagccattcacattcctcctttctttcctaaagtctaagctatcagttggaaaaa

SEQ ID NO: 581310 - DNA, 420 bp, Homo sapiens
  misc_feature (11)..(11): n is a, c, g, or t
  misc_feature (22)..(22): n is a, c, g, or t
  misc_feature (49)..(49): n is a, c, g, or t
cctttggaggntttccatttanggatcccctgaacctaatattccatantaattgcctgtcagaggtaatttataaattcccccagtccatttagccataaggattttagtgaacagatcctgaggttcctcccaaaaacaccctcaatgcccaagcaaatgattcctgcctattagtccttcttaatgcaccctggcaatttccctgtctttcctactttgatcttctttctcttctcaggtttgcaacattaagaaaggggtagtggcaaaaagaaagaatgtcaacttagaaggctaactttgggggaaatcagtatagccgaggcatcccccaaaagcttcctttgcgttaatgcaaacttccacacaatatttaccaacttctatgaaccagaaaaggctcattcttaaaaaaaa

SEQ ID NO: 581311 - DNA, 138 bp, Homo sapiens
  misc_feature (45)..(45): n is a, c, g, or t
  misc_feature (74)..(74): n is a, c, g, or t
  misc_feature (101)..(101): n is a, c, g, or t
  misc_feature (105)..(105): n is a, c, g, or t
caccgagctctggggtctcgacacacacacagtacctttgaacancactttctccagctcagagtcacctgggnacatgtgtcacggcactcagctctcgnccgnctgtgctgtgggcagggaatccagcggcgtctg

SEQ ID NO: 581312 - DNA, 279 bp, Homo sapiens
ggtgagcccgccaacaatgggatgacaatctacaaggtcttgccggtaggagcaacttgacaagaggagcaagaaaattggagttcaaggcaagcctttggcacattttgcgtgcttgggccttgaggtatggtctgacatacagcctcccatctccagctgagtcccggggtttggggaggggtgtcggggtcccaggacctgagcctggacatgtcctaaccccaaattccccgatttctcccaagtctgtcttggggttgcaataagtctgtttcc

SEQ ID NO: 581313 - DNA, 726 bp, Homo sapiens
  misc_feature (25)..(25): n is a, c, g, or t
  misc_feature (77)..(77): n is a, c, g, or t
  misc_feature (81)..(82): n is a, c, g, or t
  misc_feature (85)..(85): n is a, c, g, or t
  misc_feature (101)..(103): n is a, c, g, or t
  misc_feature (105)..(105): n is a, c, g, or t
  misc_feature (108)..(108): n is a, c, g, or t
  misc_feature (110)..(111): n is a, c, g, or t
  misc_feature (113)..(115): n is a, c, g, or t
  misc_feature (118)..(120): n is a, c, g, or t
  misc_feature (122)..(122): n is a, c, g, or t
  misc_feature (124)..(125): n is a, c, g, or t
  misc_feature (127)..(128): n is a, c, g, or t
  misc_feature (134)..(134): n is a, c, g, or t
  misc_feature (137)..(137): n is a, c, g, or t
  misc_feature (142)..(143): n is a, c, g, or t
  misc_feature (146)..(146): n is a, c, g, or t
  misc_feature (148)..(153): n is a, c, g, or t
  misc_feature (155)..(157): n is a, c, g, or t
  misc_feature (163)..(163): n is a, c, g, or t
  misc_feature (168)..(169): n is a, c, g, or t
  misc_feature (173)..(173): n is a, c, g, or t
  misc_feature (178)..(178): n is a, c, g, or t
  misc_feature (182)..(182): n is a, c, g, or t
  misc_feature (184)..(185): n is a, c, g, or t
  misc_feature (193)..(193): n is a, c, g, or t
  misc_feature (203)..(203): n is a, c, g, or t
  misc_feature (205)..(205): n is a, c, g, or t
  misc_feature (210)..(211): n is a, c, g, or t
  misc_feature (217)..(218): n is a, c, g, or t
  misc_feature (221)..(221): n is a, c, g, or t
  misc_feature (223)..(224): n is a, c, g, or t
  misc_feature (226)..(227): n is a, c, g, or t
  misc_feature (230)..(230): n is a, c, g, or t
  misc_feature (232)..(232): n is a, c, g, or t
  misc_feature (238)..(238): n is a, c, g, or t
  misc_feature (241)..(241): n is a, c, g, or t
  misc_feature (250)..(252): n is a, c, g, or t
  misc_feature (254)..(255): n is a, c, g, or t
  misc_feature (257)..(258): n is a, c, g, or t
  misc_feature (261)..(261): n is a, c, g, or t
  misc_feature (268)..(268): n is a, c, g, or t
  misc_feature (271)..(272): n is a, c, g, or t
  misc_feature (275)..(276): n is a, c, g, or t
  misc_feature (283)..(283): n is a, c, g, or t
  misc_feature (287)..(287): n is a, c, g, or t
  misc_feature (292)..(293): n is a, c, g, or t
  misc_feature (297)..(297): n is a, c, g, or t
  misc_feature (300)..(300): n is a, c, g, or t
  misc_feature (317)..(317): n is a, c, g, or t
  misc_feature (319)..(319): n is a, c, g, or t
  misc_feature (323)..(323): n is a, c, g, or t
  misc_feature (359)..(359): n is a, c, g, or t
  misc_feature (401)..(401): n is a, c, g, or t
  misc_feature (403)..(403): n is a, c, g, or t
  misc_feature (437)..(437): n is a, c, g, or t
  misc_feature (441)..(441): n is a, c, g, or t
  misc_feature (443)..(444): n is a, c, g, or t
  misc_feature (455)..(455): n is a, c, g, or t
  misc_feature (457)..(457): n is a, c, g, or t
  misc_feature (460)..(460): n is a, c, g, or t
  misc_feature (478)..(478): n is a, c, g, or t
  misc_feature (480)..(480): n is a, c, g, or t
  misc_feature (483)..(484): n is a, c, g, or t
  misc_feature (512)..(512): n is a, c, g, or t
  misc_feature (516)..(516): n is a, c, g, or t
  misc_feature (519)..(519): n is a, c, g, or t
  misc_feature (542)..(543): n is a, c, g, or t
  misc_feature (555)..(555): n is a, c, g, or t
  misc_feature (571)..(571): n is a, c, g, or t
  misc_feature (577)..(578): n is a, c, g, or t
  misc_feature (588)..(589): n is a, c, g, or t
  misc_feature (599)..(599): n is a, c, g, or t
  misc_feature (601)..(601): n is a, c, g, or t
  misc_feature (609)..(610): n is a, c, g, or t
  misc_feature (615)..(615): n is a, c, g, or t
  misc_feature (618)..(618): n is a, c, g, or t
  misc_feature (626)..(627): n is a, c, g, or t
  misc_feature (630)..(631): n is a, c, g, or t
  misc_feature (638)..(638): n is a, c, g, or t
  misc_feature (641)..(641): n is a, c, g, or t
  misc_feature (643)..(643): n is a, c, g, or t
  misc_feature (645)..(646): n is a, c, g, or t
  misc_feature (649)..(652): n is a, c, g, or t
  misc_feature (655)..(655): n is a, c, g, or t
  misc_feature (658)..(658): n is a, c, g, or t
  misc_feature (660)..(660): n is a, c, g, or t
  misc_feature (665)..(665): n is a, c, g, or t
  misc_feature (704)..(704): n is a, c, g, or t
agtaaaataaaaacaaggggaaggngactctgacacttggttttcagagcaagtgtggggctggggcagagcccaanatanntgntgtggggaaagggagnnntnagncnncnnnatnnntnannanngtctanaanacagnnatntnnnnnntnnnaaaaanaattnnacgnatgcnaaangnnaaggaagnagcttaaaananatccnncggtcnnctnanntnnagntnaatcantancaataagcnnngnnannganagaaatnganntgnntaatganaaangtaanncacnctngaagaaaaaaagtcctnantagncactcgccaaattattattaaaacttcatcggcaanaaaactaattaatgggaccaaaaataacctaactcaagaaangnaagccgctagtaaaccgtgaaaaatgaggtaaanaagnannagccctaatanancanaaaaccccatttgttacntntgnncgaatttctctcaaagccatctaatctnctancancaggcggtgggaaaagaaacccnnggaactgaaccngaaacaagcaggtggntgtatnnaggcggagtnntgcgataagnangaccaagnngctgnagngagggggnnggnnggggggnggngngnngtnnnnccnggncnttcangaacttctgcctgaccgaatcgcgatgagtgttcttgtntaaaacacgccttccacgagaa

SEQ ID NO: 581314 - DNA, 103 bp, Homo sapiens
gaattttatctgttttaaaaatgaacttctccgctacacagaagtacaaatatggtagtcagttttgtatttaggaatgtattggtagcagggatgtttccat

SEQ ID NO: 581315 - DNA, 346 bp, Homo sapiens
gtaacttgttaagatcagcgggctttcttgttaaagttatttaagttttgaaggctccaccacttcaagtctttaaattttttgagactagaataattttaaataaaatgcccctttgttttttaatgaaataaagattgaagaggttgagtcaggactgagctggtgaaaaaattttgtgggtattttggaaatttaaaacggaaagaacttggtgagctatgaattactctcagtctcctttttacagggttgttgtgaccccttttttccaaaaaattttgtggaatgtttttgtaggactttgttttccccaagcttgaattaaagcaggattcggtttcca

SEQ ID NO: 581316 - DNA, 1058 bp, Homo sapiens
attcctagaggccgaggcgaccgacatgtttttatttgggtttccatttttttatttcattcgtctttttaagccttaaagctgttctacatcttgacatgcacttctcagatgtttggggggaaacatccttcttaaacatgggtccttgtgcttgcctctctgggagaggcaggatcctgagcaggtgaatcataaggcatttatgccatattgttattatgcgggcatctgcacccacctctcgccacccacaagcctttgggccatctatgagttttgtcgtgctggcgtttccccatgtatttggcgtacattactcatagttaagagtgggtttaaccttttgcacttggatttccactgcttctatggcgcggaacagattgacagagattctccctcttagaagactctgcgtcttccaaacttccattcctcgtcacaaatgatagatattacatagttgactacggtgcgcacgactcgttcacaaagaaaacctactagaaacctactccctgaaatcacaacctcacacatacacacaaagactacttatatacatactcttatctataaataaaccaatttacctaacactacataacacctctatccaacgatagcaccaaatcaaacaacgcaccttcgttccttcaccttctacacgcggcccacattcttatgctcacttcaatctgacttatcatatacctcacatccctcatactcatgccgcttaaactatcattgtcaactcgtcactgcgctaccctacgtcccccacaaaaccaacgcttcgcttgttttactcactttctcgcatacatatgtcgcatcagaaaccacttagtttcgatcatatgacttcctcacgtatctacaatctccttcacctcttccataaatcaagactaccatacattatctataacatctttccacgtcttcacattccactacaaaaccacgctcgttattgctccatccgcccctctcttccccctcctttatccttctccctaccactaatcatcacacacatctaccacctc

SEQ ID NO: 581317 - DNA, 430 bp, Homo sapiens
tacacttgcagatatgtcatttgtgtaaaacaaacgaaagttccaaaataactgaataatagcaaataattatggtcttgtttccccaatttcagcagttattttgttttctcggtatcttttgctcaaatacaatgtcaatcaatgcaccagcctgaatggacctcgatgggactgtactgagggggaaaaaagcaatctcaaaagatcacgtatgatgtgattccctttatatgacatccttgagcccacaaaattacagagatggagaacagattagtttcaggagtatggctataaggggtagctttgtgatgatggtatagttctgtatcttgactgaggtagggaaccggttgcacaaagctacaggtgctaaactgcatagaaccacacacacacacgtgcatgtcgatctaacgaaatctga

SEQ ID NO: 581318 - DNA, 101 bp, Homo sapiens
aggcggtacctcagatcggctaacggcgcatgatagaaattcacatttaaaagtttaaagatggaggctgggtgtggtggctcacgcgtgtaatcccagca
